United States Patent 7,745,391 (HUMAN THROMBOSPONDIN POLYPEPTIDE) - sequence listing, part 286

SEQ ID NO: 899243 - protein, 1371 aa, Homo sapiens
PFSFPSRIPDLPRSHHLLRRKILQDSEHTASTRGPMTLDRPGEGATMLKTFTVLLFCIRMSLGMTSIVMDPQPELWIESNYPQAPWENITLWCRSPSRISSKFLLLKDKTQMTWIRPSHKTFQVSFLIGALTESNAGLYRCCYWKETGWSKPSKVLELEAPGQLPKPIFWIQAETPALPGCNVNILCHGWLQDLVFMLFKEGYAEPVDYQVPTGTMAIFSIDNLTPEDEGVYICRTHIQMLPTLWSEPSNPLKLVVAGLYPKPTLTAHPGPIMAPGESLNLRCQGPIYGMTFALMRVEDLEKSFYHKKTIKNEANFFFQSLKIQDTGHYLCFYYDASYRGSLLSDVLKIWVTDTFPKTWLLARPSAVVQMGQNVSLRCRGPVDGVGLALYKKGEDKPLQFLDATSIDDNTSFFLNNVTYSDTGIYSCHYLLTWKTSIRMPSHNTVELMVVDKPPKPSLSAWPSTVFKLGKAITLQCRVSHPVLEFSLEWEERETFQKFSVNGDFIISNVDGKGTGTYSCSYRVETHPNIWSHRSEPLKLMGPAGYLTWNYVLNEAIRLSLIMQLVALLLVVLWIRWKCRRLRIREAWLLGTAQGVTMLFIVTALLCCGLCNGVLIEETEIVMPTPKPELWAETNFPLAPWKNLTLWCRSPSGSTKEFVLLKDGTGWIATRPASEQVRAAFPLGALTQSHTGSYHCHSWEEMAVSEPSEALELVGTDILPKPVISASPTIRGQELQLRCKGWLAGMGFALYKEGEQEPVQQLGAVGREAFFTIQRMEDKDEGNYSCRTHTEKRPFKWSEPSEPLELVIKEMYPKPFFKTWASPVVTPGARVTFNCSTPHQHMSFILYKDGSEIASSDRSWASPGASAAHFLIISVGIGDGGNYSCRYYDFSIWSEPSDPVELVVTEFYPKPTLLAQPGPVVFPGKSVILRCQGTFQGMRFALLQEGAHVPLQFRSVSGNSADFLLHTVGAEDSGNYSCIYYETTMSNRGSYLSMPLMIWVTDTFPKPWLFAEPSSVVPMGQNVTLWCRGPVHGVGYILHKEGEATSMQLWGSTSNDGAFPITNISGTSMGRYSCCYHPDWTSSIKIQPSNTLELLVTGLLPKPSLLAQPGPMVAPGENMTLQCQGELPDSTFVLLKEGAQEPLEQQRPSGYRADFWMPAVRGEDSGIYSCVYYLDSTPFAASNHSDSLEIWVTDKPPKPSLSAWPSTMFKLGKDITLQCRGPLPGVEFVLEHDGEEAPQQFSEDGDFVINNVEGKGIGNYSCSYRLQAYPDIWSEPSDPLELVGAAGPVAQECTVGNIVRSSLIVVVVVALGVVLAIEWKKWPRLRTRGSETDGRDQTIALEECNQEGEPGTPANSPSSTSQRISVELPVPI

SEQ ID NO: 899244 - protein, 607 aa, Homo sapiens
MHLLKSKEASENQYLLYLLSLFLVLNLVLCCILFFVFVFVFCLLEMYPKPFFKTWASPVVTPGARVTFNCSTPHQHMSFILYKDGSEIASSDRSWASPGASAAHFLIISVGIGDGGNYSCRYYDFSIWSEPSDPVELVVTEFYPKPTLLAQPGPVVFPGKSVILRCQGTFQGMRFALLQEGAHVPLQFRSVSGNSADFLLHTVGAEDSGNYSCIYYETTMSNRGSYLSMPLMIWVTDTFPKPWLFAEPSSVVPMGQNVTLWCRGPVHGVGYILHKEGEATSMQLWGSTSNDGAFPITNISGTSMGRYSCCYHPDWTSSIKIQPSNTLELLVTGLLPKPSLLAQPGPMVAPGENMTLQCQGELPDSTFVLLKEGAQEPLEQQRPSGYRADFWMPAVRGEDSGIYSCVYYLDSTPFAASNHSDSLEIWVTDKPPKPSLSAWPSTMFKLGKDITLQCRGPLPGVEFVLEHDGEEAPQQFSEDGDFVINNVEGKGIGNYSCSYRLQAYPDIWSEPSDPLELVGAAGPVAQECTVGNIVRSSLIVVVVVALGVVLAIEWKKWPRLRTRGSETDGRDQTIALEECNQEGEPGTPANSPSSTSQRISVELPVPI

SEQ ID NO: 899245 - protein, 231 aa, Homo sapiens
MLKTFTVLLFCIRMSLGMTSIVMDPQPELWIESNYPQAPWENITLWCRSPSRISSKFLLLKDKTQMTWIRPSHKTFQVSFLIGALTESNAGLYRCCYWKETGWSKPSKVLELEAPGQLPKPIFWIQAETPALPGCNVNILCHGWLQDLVFMLFKEGYAEPVDYQVPTGTMAIFSIDNLTPEDEGVYICRTHIQMLPTLWSEPSNPLKLVVAGGCGYGCWHLAIVVPGIMAG

SEQ ID NO: 899246 - protein, 1336 aa, Homo sapiens
MTLDRPGEGATMLKTFTVLLFCIRMSLGMTSIVMDPQPELWIESNYPQAPWENITLWCRSPSRISSKFLLLKDKTQMTWIRPSHKTFQVSFLIGALTESNAGLYRCCYWKETGWSKPSKVLELEAPGQLPKPIFWIQAETPALPGCNVNILCHGWLQDLVFMLFKEGYAEPVDYQVPTGTMAIFSIDNLTPEDEGVYICRTHIQMLPTLWSEPSNPLKLVVAGLYPKPTLTAHPGPIMAPGESLNLRCQGPIYGMTFALMRVEDLEKSFYHKKTIKNEANFFFQSLKIQDTGHYLCFYYDASYRGSLLSDVLKIWVTDTFPKTWLLARPSAVVQMGQNVSLRCRGPVDGVGLALYKKGEDKPLQFLDATSIDDNTSFFLNNVTYSDTGIYSCHYLLTWKTSIRMPSHNTVELMVVDKPPKPSLSAWPSTVFKLGKAITLQCRVSHPVLEFSLEWEERETFQKFSVNGDFIISNVDGKGTGTYSCSYRVETHPNIWSHRSEPLKLMGPAGYLTWNYVLNEAIRLSLIMQLVALLLVVLWIRWKCRRLRIREAWLLGTAQGVTMLFIVTALLCCGLCNGVLIEETEIVMPTPKPELWAETNFPLAPWKNLTLWCRSPSGSTKEFVLLKDGTGWIATRPASEQVRAAFPLGALTQSHTGSYHCHSWEEMAVSEPSEALELVGTDILPKPVISASPTIRGQELQLRCKGWLAGMGFALYKEGEQEPVQQLGAVGREAFFTIQRMEDKDEGNYSCRTHTEKRPFKWSEPSEPLELVIKEMYPKPFFKTWASPVVTPGARVTFNCSTPHQHMSFILYKDGSEIASSDRSWASPGASAAHFLIISVGIGDGGNYSCRYYDFSIWSEPSDPVELVVTEFYPKPTLLAQPGPVVFPGKSVILRCQGTFQGMRFALLQEGAHVPLQFRSVSGNSADFLLHTVGAEDSGNYSCIYYETTMSNRGSYLSMPLMIWVTDTFPKPWLFAEPSSVVPMGQNVTLWCRGPVHGVGYILHKEGEATSMQLWGSTSNDGAFPITNISGTSMGRYSCCYHPDWTSSIKIQPSNTLELLVTGLLPKPSLLAQPGPMVAPGENMTLQCQGELPDSTFVLLKEGAQEPLEQQRPSGYRADFWMPAVRGEDSGIYSCVYYLDSTPFAASNHSDSLEIWVTDKPPKPSLSAWPSTMFKLGKDITLQCRGPLPGVEFVLEHDGEEAPQQFSEDGDFVINNVEGKGIGNYSCSYRLQAYPDIWSEPSDPLELVGAAGPVAQECTVGNIVRSSLIVVVVVALGVVLAIEWKKWPRLRTRGSETDGRDQTIALEECNQEGEPGTPANSPSSTSQRISVELPVPI

SEQ ID NO: 899247 - protein, 1336 aa, Homo sapiens; identical to SEQ ID NO: 899246

SEQ ID NO: 899248 - protein, 538 aa, Homo sapiens
MLKTFTVLLFCIRMSLGMTSIVMDPQPELWIESNYPQAPWENITLWCRSPSRISSKFLLLKDKTQMTWIRPSHKTFQVSFLIGALTESNAGLYRCCYWKETGWSKPSKVLELEAPGQLPKPIFWIQAETPALPGCNVNILCHGWLQDLVFMLFKEGYAEPVDYQVPTGTMAIFSIDNLTPEDEGVYICRTHIQMLPTLWSEPSNPLKLVVAGLYPKPTLTAHPGPIMAPGESLNLRCQGPIYGMTFALMRVEDLEKSFYHKKTIKNEANFFFQSLKIQDTGHYLCFYYDASYRGSLLSDVLKIWVTDTFPKTWLLARPSAVVQMGQNVSLRCRGPVDGVGLALYKKGEDKPLQFLDATSIDDNTSFFLNNVTYSDTGIYSCHYLLTWKTSIRMPSHNTVELMVVDKPPKPSLSAWPSTVFKLGKAITLQCRVSHPVLEFSLEWEERETFQKFSVNGDFIISNVDGKGTGTYSCSYRVETHPNIWSHRSEPLKLMGPAGYLTWNYVLNEAIRLSLIMQLVALLLVVLWIRWKCRRLRIR

SEQ ID NO: 899249 - protein, 963 aa, Homo sapiens
VVPNARAVIVSKSRARLARSPPLSHHALLSPPFALGLLVPVPAARVELCASEAWVTQAQRGLRALLPIPGCPTFVRLSSALYSRAPSPSRPPRSPRRAPATQVALKSSPSERESNGRGRTKAPSDRAMGDSDDEYDRRRRDKFRRERSDYDRSRERDERRRGDDWNDREWDRGRERRSRGEYRDYDRNRRERFSPPRHELSPPQKRMRRDWDEHSSDPYHSGYEMPYAGGGGGPTYGPPQPWGHPDVHIMQHHVLPIQARLGSIAEIDLGVPPPVMKTFKEFLLSLDDSVDETEAVKRYNDYKLDFRRQQMQDFFLAHKDEEWFRSKYHPDEVGKRRQEARGALQNRLRVFLSLMETGWFDNLLLDIDKADAIVKMLDAAVIKMEGGTENDLRILEQEEEEEQAGKPGEPSKKEEGRAGAGLGDGERKTNDKDEKKEDGKQAENDSSNDDKTKKSEGDGDKEEKKEDSEKEAKKSSKKRNRKHSGDDSFDEGSVSESESESESGQAEEEKEEAEEALKEKEKPKEEEWEKPKDAAGLECKPRPLHKTCSLFMRNIAPNISRAEIISLCKRYPGFMRVALSEPQPERRFFRRGWVTFDRSVNIKEICWNLQNIRLRECELSPGVNRDLTRRVRNINGITQHKQIVRNDIKLAAKLIHTLDDRTQLWASEPGTPPLPTSLPSQNPILKNITDYLIEEVSAEEEELLGSSGGAPPEEPPKEGNPAEINVERDEKLIKVLDKLLLYLRIVHSLDYYNTCEYPNEDEMPNRCGIIHVRGPMPPNRISHGEVLEWQKTFEEKLTPLLSVRESLSEEEAQKMGRKDPEQEVEKFVTSNTQELGKDKWLCPLSGKKFKGPEFVRKHIFNKHAEKIEEVKKEVAFFNNFLTDAKRPALPEIKPAQPPGPAQILPPGLTPGLPYPHQTPQGLMPYGQPRPPILGYGGWCCPPCSPHRRPSIPPCPVWCWSREL

SEQ ID NO: 899250 - protein, 920 aa, Homo sapiens
YARYEAGLKSAEAQAQRGLRALLPIPGCPTFVRLSSALYSRAPSPSRPPRSPRRAPATQVALKSSPSERESNGRGRTKAPSDRAMGDSDDEYDRRRRDKFRRERSDYDRSRERDERRRGDDWNDREWDRGRERRSRGEYRDYDRNRRERFSPPRHELSPPQKRMRRDWDEHSSDPYHSGYEMPYAGGGGGPTYGPPQPWGHPDVHIMQHHVLPIQARLGSIAEIDLGVPPPVMKTFKEFLLSLDDSVDETEAVKRYNDYKLDFRRQQMQDFFLAHKDEEWFRSKYHPDEVGKRRQEARGALQNRLRVFLSLMETGWFDNLLLDIDKADAIVKMLDAAVIKMEGGTENDLRILEQEEEEEQAGKPGEPSKKEEGRAGAGLGDGERKTNDKDEKKEDGKQAENDSSNDDKTKKSEGDGDKEEKKEDSEKEAKKSSKKRNRKHSGDDSFDEGSVSESESESESGQAEEEKEEAEEALKEKEKPKEEEWEKPKDAAGLECKPRPLHKTCSLFMRNIAPNISRAEIISLCKRYPGFMRVALSEPQPERRFFRRGWVTFDRSVNIKEICWNLQNIRLRECELSPGVNRDLTRRVRNINGITQHKQIVRNDIKLAAKLIHTLDDRTQLWASEPGTPPLPTSLPSQNPILKNITDYLIEEVSAEEEELLGSSGGAPPEEPPKEGNPAEINVERDEKLIKVLDKLLLYLRIVHSLDYYNTCEYPNEDEMPNRCGIIHVRGPMPPNRISHGEVLEWQKTFEEKLTPLLSVRESLSEEEAQKMGRKDPEQEVEKFVTSNTQELGKDKWLCPLSGKKFKGPEFVRKHIFNKHAEKIEEVKKEVAFFNNFLTDAKRPALPEIKPAQPPGPAQILPPGLTPGLPYPHQTPQGLMPYGQPRPPILGYGGWCCPPCSPHRRPSIPPCPVWCWSREL

SEQ ID NO: 899251 - protein, 887 aa, Homo sapiens
YARYEAGLKSAEAQAQRGLRALLPIPGCPTFVRLSSALYSRAPSPSRPPRSPRRAPATQVALKSSPSERESNGRGRTKAPSDRAMGDSDDEYDRRRRDKFRRERSDYDRSRERDERRRGDDWNDREWDRGRERRSRGEYRDYDRNRRERFSPPRHELSPPQKRMRRDWDEHSSDPYHSGYEMPYAGGGGGPTYGPPQPWGHPDVHIMQHHVLPIQARLGSIAEIDLGVPPPVMKTFKEFLLSLDDSVDETEAVKRYNDYKLDFRRQQMQDFFLAHKDEEWFRSKYHPDEVGKRRQEARGALQNRLRVFLSLMETGWFDNLLLDIDKADAIVKMLDAAVIKMEGGTENDLRILEQEEEEEQAGKPGEPSKKEEGRAGAGLGDGERKTNDKDEKKEDGKQSSKKRNRKHSGDDSFDEGSVSESESESESGQAEEEKEEAEEALKEKEKPKEEEWEKPKDAAGLECKPRPLHKTCSLFMRNIAPNISRAEIISLCKRYPGFMRVALSEPQPERRFFRRGWVTFDRSVNIKEICWNLQNIRLRECELSPGVNRDLTRRVRNINGITQHKQIVRNDIKLAAKLIHTLDDRTQLWASEPGTPPLPTSLPSQNPILKNITDYLIEEVSAEEEELLGSSGGAPPEEPPKEGNPAEINVERDEKLIKVLDKLLLYLRIVHSLDYYNTCEYPNEDEMPNRCGIIHVRGPMPPNRISHGEVLEWQKTFEEKLTPLLSVRESLSEEEAQKMGRKDPEQEVEKFVTSNTQELGKDKWLCPLSGKKFKGPEFVRKHIFNKHAEKIEEVKKEVAFFNNFLTDAKRPALPEIKPAQPPGPAQILPPGLTPGLPYPHQTPQGLMPYGQPRPPILGYGGWCCPPCSPHRRPSIPPCPVWCWSREL

SEQ ID NO: 899252 - protein, 945 aa, Homo sapiens
YARYEAGLKSAEAQAQRGLRALLPIPGCPTFVRLSSALYSRAPSPSRPPRSPRRAPATQVALKSSPSERESNGRGRTKAPSDRAMGDSDDEYDRRRRDKFRRERSDYDRSRERDERRRGDDWNDRDRVSLLSPGLSALVQSKLAAAATCPEWDRGRERRSRGEYRDYDRNRRERFSPPRHELSPPQKRMRRDWDEHSSDPYHSGYEMPYAGGGGGPTYGPPQPWGHPDVHIMQHHVLPIQARLGSIAEIDLGVPPPVMKTFKEFLLSLDDSVDETEAVKRYNDYKLDFRRQQMQDFFLAHKDEEWFRSKYHPDEVGKRRQEARGALQNRLRVFLSLMETGWFDNLLLDIDKADAIVKMLDAAVIKMEGGTENDLRILEQEEEEEQAGKPGEPSKKEEGRAGAGLGDGERKTNDKDEKKEDGKQAENDSSNDDKTKKSEGDGDKEEKKEDSEKEAKKSSKKRNRKHSGDDSFDEGSVSESESESESGQAEEEKEEAEEALKEKEKPKEEEWEKPKDAAGLECKPRPLHKTCSLFMRNIAPNISRAEIISLCKRYPGFMRVALSEPQPERRFFRRGWVTFDRSVNIKEICWNLQNIRLRECELSPGVNRDLTRRVRNINGITQHKQIVRNDIKLAAKLIHTLDDRTQLWASEPGTPPLPTSLPSQNPILKNITDYLIEEVSAEEEELLGSSGGAPPEEPPKEGNPAEINVERDEKLIKVLDKLLLYLRIVHSLDYYNTCEYPNEDEMPNRCGIIHVRGPMPPNRISHGEVLEWQKTFEEKLTPLLSVRESLSEEEAQKMGRKDPEQEVEKFVTSNTQELGKDKWLCPLSGKKFKGPEFVRKHIFNKHAEKIEEVKKEVAFFNNFLTDAKRPALPEIKPAQPPGPAQILPPGLTPGLPYPHQTPQGLMPYGQPRPPILGYGGWCCPPCSPHRRPSIPPCPVWCWSREL

SEQ ID NO: 899253 - protein, 720 aa, Homo sapiens
PGGGPGPRSLSGPEQARLGSIAEIDLGVPPPVMKTFKEFLLSLDDSVDETEAVKRYNDYKLDFRRQQMQDFFLAHKDEEWFRSKYHPDEVGKRRQEARGALQNRLRVFLSLMETGWFDNLLLDIDKADAIVKMLDAAVIKMEGGTENDLRILEQEEEEEQAGKPGEPSKKEEGRAGAGLGDGERKTNDKDEKKEDGKQAENDSSNDDKTKKSEGDGDKEEKKEDSEKEAKKSSKKRNRKHSGDDSFDEGSVSESESESESGQAEEEKEEAEEALKEKEKPKEEEWEKPKDAAGLECKPRPLHKTCSLFMRNIAPNISRAEIISLCKRYPGFMRVALSEPQPERRFFRRGWVTFDRSVNIKEICWNLQNIRLRECELSPGVNRDLTRRVRNINGITQHKQIVRNDIKLAAKLIHTLDDRTQLWASEPGTPPLPTSLPSQNPILKNITDYLIEEVSAEEEELLGSSGGAPPEEPPKEGNPAEINVERDEKLIKVLDKLLLYLRIVHSLDYYNTCEYPNEDEMPNRCGIIHVRGPMPPNRISHGEVLEWQKTFEEKLTPLLSVRESLSEEEAQKMGRKDPEQEVEKFVTSNTQELGKDKWLCPLSGKKFKGPEFVRKHIFNKHAEKIEEVKKEVAFFNNFLTDAKRPALPEIKPAQPPGPAQILPPGLTPGLPYPHQTPQGLMPYGQPRPPILGYGGWCCPPCSPHRRPSIPPCPVWCWSREL

SEQ ID NO: 899254 - protein, 672 aa, Homo sapiens
FSVPPSILITAASSILTMASVLSFPPPLRSQVFRSKYHPDEVGKRRQEARGALQNRLRVFLSLMETGWFDNLLLDIDKADAIVKMLDAAVIKMEGGTENDLRILEQEEEEEQAGKPGEPSKKEEGRAGAGLGDGERKTNDKDEKKEDGKQAENDSSNDDKTKKSEGDGDKEEKKEDSEKEAKKSSKKRNRKHSGDDSFDEGSVSESESESESGQAEEEKEEAEEALKEKEKPKEEEWEKPKDAAGLECKPRPLHKTCSLFMRNIAPNISRAEIISLCKRYPGFMRVALSEPQPERRFFRRGWVTFDRSVNIKEICWNLQNIRLRECELSPGVNRDLTRRVRNINGITQHKQIVRNDIKLAAKLIHTLDDRTQLWASEPGTPPLPTSLPSQNPILKNITDYLIEEVSAEEEELLGSSGGAPPEEPPKEGNPAEINVERDEKLIKVLDKLLLYLRIVHSLDYYNTCEYPNEDEMPNRCGIIHVRGPMPPNRISHGEVLEWQKTFEEKLTPLLSVRESLSEEEAQKMGRKDPEQEVEKFVTSNTQELGKDKWLCPLSGKKFKGPEFVRKHIFNKHAEKIEEVKKEVAFFNNFLTDAKRPALPEIKPAQPPGPAQILPPGLTPGLPYPHQTPQGLMPYGQPRPPILGYGGWCCPPCSPHRRPSIPPCPVWCWSREL

SEQ ID NO: 899255 - protein, 652 aa, Homo sapiens
RVSSLTAQDEEWFRSKYHPDEVGKRRQEARGALQNRLRVFLSLMETGWFDNLLLDIDKADAIVKMLDAAVIKMEGGTENDLRILEQEEEEEQAGKPGEPSKKEEGRAGAGLGDGERKTNDKDEKKEDGKQAENDSSNDDKTKKSEGDGDKEEKKEDSEKEAKKSSKKRNRKHSGDDSFDEGSVSESESESESGQAEEEKEEAEEALKEKEKPKEEEWEKPKDAAGLECKPRPLHKTCSLFMRNIAPNISRAEIISLCKRYPGFMRVALSEPQPERRFFRRGWVTFDRSVNIKEICWNLQNIRLRECELSPGVNRDLTRRVRNINGITQHKQIVRNDIKLAAKLIHTLDDRTQLWASEPGTPPLPTSLPSQNPILKNITDYLIEEVSAEEEELLGSSGGAPPEEPPKEGNPAEINVERDEKLIKVLDKLLLYLRIVHSLDYYNTCEYPNEDEMPNRCGIIHVRGPMPPNRISHGEVLEWQKTFEEKLTPLLSVRESLSEEEAQKMGRKDPEQEVEKFVTSNTQELGKDKWLCPLSGKKFKGPEFVRKHIFNKHAEKIEEVKKEVAFFNNFLTDAKRPALPEIKPAQPPGPAQILPPGLTPGLPYPHQTPQGLMPYGQPRPPILGYGGWCCPPCSPHRRPSIPPCPVWCWSREL

SEQ ID NO: 899256 - protein, 566 aa, Homo sapiens
MPPRPLAHILGLPDLSKPGLACSGLGDGERKTNDKDEKKEDGKQAENDSSNDDKTKKSEGDGDKEEKKEDSEKEAKKSSKKRNRKHSGDDSFDEGSVSESESESESGQAEEEKEEAEEALKEKEKPKEEEWEKPKDAAGLECKPRPLHKTCSLFMRNIAPNISRAEIISLCKRYPGFMRVALSEPQPERRFFRRGWVTFDRSVNIKEICWNLQNIRLRECELSPGVNRDLTRRVRNINGITQHKQIVRNDIKLAAKLIHTLDDRTQLWASEPGTPPLPTSLPSQNPILKNITDYLIEEVSAEEEELLGSSGGAPPEEPPKEGNPAEINVERDEKLIKVLDKLLLYLRIVHSLDYYNTCEYPNEDEMPNRCGIIHVRGPMPPNRISHGEVLEWQKTFEEKLTPLLSVRESLSEEEAQKMGRKDPEQEVEKFVTSNTQELGKDKWLCPLSGKKFKGPEFVRKHIFNKHAEKIEEVKKEVAFFNNFLTDAKRPALPEIKPAQPPGPAQILPPGLTPGLPYPHQTPQGLMPYGQPRPPILGYGGWCCPPCSPHRRPSIPPCPVWCWSREL

SEQ ID NO: 899257 - protein, 920 aa, Homo sapiens; identical to SEQ ID NO: 899250

SEQ ID NO: 899258 - protein, 503 aa, Homo sapiens
IAGPTLEETRWKPKSSKKRNRKHSGDDSFDEGSVSESESESESGQAEEEKEEAEEALKEKEKPKEEEWEKPKDAAGLECKPRPLHKTCSLFMRNIAPNISRAEIISLCKRYPGFMRVALSEPQPERRFFRRGWVTFDRSVNIKEICWNLQNIRLRECELSPGVNRDLTRRVRNINGITQHKQIVRNDIKLAAKLIHTLDDRTQLWASEPGTPPLPTSLPSQNPILKNITDYLIEEVSAEEEELLGSSGGAPPEEPPKEGNPAEINVERDEKLIKVLDKLLLYLRIVHSLDYYNTCEYPNEDEMPNRCGIIHVRGPMPPNRISHGEVLEWQKTFEEKLTPLLSVRESLSEEEAQKMGRKDPEQEVEKFVTSNTQELGKDKWLCPLSGKKFKGPEFVRKHIFNKHAEKIEEVKKEVAFFNNFLTDAKRPALPEIKPAQPPGPAQILPPGLTPGLPYPHQTPQGLMPYGQPRPPILGYGGWCCPPCSPHRRPSIPPCPVWCWSREL

SEQ ID NO: 899259 - protein, 459 aa, Homo sapiens
MEETRCETFIVTERGDKGKFKLEWEKPKDAAGLECKPRPLHKTCSLFMRNIAPNISRAEIISLCKRYPGFMRVALSEPQPERRFFRRGWVTFDRSVNIKEICWNLQNIRLRECELSPGVNRDLTRRVRNINGITQHKQIVRNDIKLAAKLIHTLDDRTQLWASEPGTPPLPTSLPSQNPILKNITDYLIEEVSAEEEELLGSSGGAPPEEPPKEGNPAEINVERDEKLIKVLDKLLLYLRIVHSLDYYNTCEYPNEDEMPNRCGIIHVRGPMPPNRISHGEVLEWQKTFEEKLTPLLSVRESLSEEEAQKMGRKDPEQEVEKFVTSNTQELGKDKWLCPLSGKKFKGPEFVRKHIFNKHAEKIEEVKKEVAFFNNFLTDAKRPALPEIKPAQPPGPAQILPPGLTPGLPYPHQTPQGLMPYGQPRPPILGYGGWCCPPCSPHRRPSIPPCPVWCWSREL

SEQ ID NO: 899260 - protein, 954 aa, Homo sapiens
YARYEAGLKSAEAQAQRGLRALLPIPGCPTFVRLSSALYSRAPSPSRPPRSPRRAPATQVALKSSPSERESNGRGRTKAPSDRAMGDSDDEYDRRRRDKFRRERSDYDRSRERDERRRGDDWNDREWDRGRERRSRGEYRDYDRNRRERFSPPRHELSPPQKRMRRDWDEHSSDPYHSGYEMPYAGGGGGPTYGPPQPWGHPDVHIMQHHVLPIQARLGSIAEIDLGVPPPVMKTFKEFLLSLDDSVDETEAVKRYNDYKLDFRRQQMQDFFLAHKDEEWFRSKYHPDEVGKRRQEARGALQNRLRVFLSLMETGWFDNLLLDIDKADAIVKMLDAAVIKMEGGTENDLRILEQEEEEEQAGKPGEPSKKEEGRAGAGLGDGERKTNDKDEKKEDGKQAENDSSNDDKTKKSEGDGDKEEKKEDSEKEAKKSSKKRNRKHSGDDSFDEGSVSESESESESGQAEEEKEEAEEALKEKEKPKEEEWEKPKDAAGLECKPRPLHKTCSLFMRNIAPNISRAEIISLCKRYPGFMRVALSEPQPERRLSNSVRWREKCRGTLMANTNSLSLTMLTFSFLCRFFRRGWVTFDRSVNIKEICWNLQNIRLRECELSPGVNRDLTRRVRNINGITQHKQIVRNDIKLAAKLIHTLDDRTQLWASEPGTPPLPTSLPSQNPILKNITDYLIEEVSAEEEELLGSSGGAPPEEPPKEGNPAEINVERDEKLIKVLDKLLLYLRIVHSLDYYNTCEYPNEDEMPNRCGIIHVRGPMPPNRISHGEVLEWQKTFEEKLTPLLSVRESLSEEEAQKMGRKDPEQEVEKFVTSNTQELGKDKWLCPLSGKKFKGPEFVRKHIFNKHAEKIEEVKKEVAFFNNFLTDAKRPALPEIKPAQPPGPAQILPPGLTPGLPYPHQTPQGLMPYGQPRPPILGYGGWCCPPCSPHRRPSIPPCPVWCWSREL

SEQ ID NO: 899261 - protein, 920 aa, Homo sapiens; identical to SEQ ID NO: 899250

SEQ ID NO: 899262 - protein, 917 aa, Homo sapiens
YARYEAGLKSAEAQAQRGLRALLPIPGCPTFVRLSSALYSRAPSPSRPPRSPRRAPATQVALKSSPSERESNGRGRTKAPSDRAMGDSDDEYDRRRRDKFRRERSDYDRSRERDERRRGDDWNDREWDRGRERRSRGEYRDYDRNRRERFSPPRHELSPPQKRMRRDWDEHSSDPYHSGYEMPYAGGGGGPTYGPPQPWGHPDVHIMQHHVLPIQARLGSIAEIDLGVPPPVMKTFKEFLLSLDDSVDETEAVKRYNDYKLDFRRQQMQDFFLAHKDEEWFRSKYHPDEVGKRRQEARGALQNRLRVFLSLMETGWFDNLLLDIDKADAIVKMLDAAVIKMEGGTENDLRILEQEEEEEQAGKPGEPSKKEEGRAGAGLGDGERKTNDKDEKKEDGKQAENDSSNDDKTKKSEGDGDKEEKKEDSEKEAKKSSKKRNRKHSGDDSFDEGSVSESESESESGQAEEEKEEAEEALKEKEKPKEEEWEKPKDAAGLECKPRPLHKTCSLFMRNIAPNISRAEIISLCKRYPGFMRVALSEPQPERRFFRRGWVTFDRSVNIKEICWNLQNIRLRECELSPGVNRDLTRRVRNINGITQHKQIVRNDIKLAAKLIHTLDDRTQLWASEPGTPPLPTSLPSQNPILKNITDYLIEEVSAEEEELLGSSGGAPPEEPPKEGNPAEINVERDEKLIKVLDKLLLYLRIVHSLDYYNTCEYPNEDEMPNRCGIIHVRGPMPPNRISHGEVLEWQKTFEEKLTPLLSVRESLSEEEAQKMGRKDPEQEVEKFVTSNTQELGKDKWLCPLSGKKFKGPEFVRKHIFNKHAEKIEEVKKEVAFFNNFLTDAKRPALPEIKPAQPPGPAQILPPGLTPGLPYPHQTPQGLMPYGQPRPPILGYGGKYRREMKGLGECVALGEENRGWN

SEQ ID NO: 899263 - protein, 900 aa, Homo sapiens
YARYEAGLKSAEAQAQRGLRALLPIPGCPTFVRLSSALYSRAPSPSRPPRSPRRAPATQVALKSSPSERESNGRGRTKAPSDRAMGDSDDEYDRRRRDKFRRERSDYDRSRERDERRRGDDWNDREWDRGRERRSRGEYRDYDRNRRERFSPPRHELSPPQKRMRRDWDEHSSDPYHSGYEMPYAGGGGGPTYGPPQPWGHPDVHIMQHHVLPIQARLGSIAEIDLGVPPPVMKTFKEFLLSLDDSVDETEAVKRYNDYKLDFRRQQMQDFFLAHKDEEWFRSKYHPDEVGKRRQEARGALQNRLRVFLSLMETGWFDNLLLDIDKADAIVKMLDAAVIKMEGGTENDLRILEQEEEEEQAGKPGEPSKKEEGRAGAGLGDGERKTNDKDEKKEDGKQAENDSSNDDKTKKSEGDGDKEEKKEDSEKEAKKSSKKRNRKHSGDDSFDEGSVSESESESESGQAEEEKEEAEEALKEKEKPKEEEWEKPKDAAGLECKPRPLHKTCSLFMRNIAPNISRAEIISLCKRYPGFMRVALSEPQPERRFFRRGWVTFDRSVNIKEICWNLQNIRLRECELSPGVNRDLTRRVRNINGITQHKQIVRNDIKLAAKLIHTLDDRTQLWASEPGTPPLPTSLPSQNPILKNITDYLIEEVSAEEEELLGSSGGAPPEEPPKEGNPAEINVERDEKLIKVLDKLLLYLRIVHSLDYYNTCEYPNEDEMPNRCGIIHVRGPMPPNRISHGEVLEWQKTFEEKLTPLLSVRESLSEEEAQKMGRKDPEQEVEKFVTSNTQELGKDKWLCPLSGKKFKVLSLCAISSTSMQSEEVMPEIKPAQPPGPAQILLPPGLTPGLPYPHQTPQGLMPYGQPRPPILGYGGWCCPPCSPHRRPSIPPCPVWCWSREL

SEQ ID NO: 899264 - protein, 818 aa, Homo sapiens
YARYEAGLKSAEAQAQRGLRALLPIPGCPTFVRLSSALYSRAPSPSRPPRSPRRAPATQVALKSSPSERESNGRGRTKAPSDRAMGDSDDEYDRRRRDKFRRERSDYDRSRERDERRRGDDWNDREWDRGRERRSRGEYRDYDRNRRERFSPPRHELSPPQKRMRRDWDEHSSDPYHSGYEMPYAGGGGGPTYGPPQPWGHPDVHIMQHHVLPIQARLGSIAEIDLGVPPPVMKTFKEFLLSLDDSVDETEAVKRYNDYKLDFRRQQMQDFFLAHKDEEWFRSKYHPDEVGKRRQEARGALQNRLRVFLSLMETGWFDNLLLDIDKADAIVKMLDAAVIKMEGGTENDLRILEQEEEEEQAGKPGEPSKKEEGRAGAGLGDGERKTNDKDEKKEDGKQAENDSSNDDKTKKSEGDGDKEEKKEDSEKEAKKSSKKRNRKHSGDDSFDEGSVSESESESESGQAEEEKEEAEEALKEKEKPKEEEWEKPKDAAGLECKPRPLHKTCSLFMRNIAPNISRAEIISLCKRYPGFMRVALSEPQPERRFFRRGWVTFDRSVNIKEICWNLQNIRLRECELSPGVNRDLTRRVRNINGITQHKQIVRNDIKLAAKLIHTLDDRTQLWASEPGTPPLPTSLPSQNPILKNITDYLIEEVSAEEEELLGSSGGAPPEEPPKEGNPAEINVERDEKLIKVLDKLLLYLRIVHSLDYYNTCEYPNEDEMPNRCGIIHVRGPMPPNRISHGEVLEWQKTFEEKLTPLLSVRESLSEEEAQKMGRKDPEQEVEKFVTSNTQELGKDKWLCPLSGKKFKPPSLAPAVVFP

SEQ ID NO: 899265 - protein, 324 aa, Homo sapiens
KLSGRYEAGWFGVQLIHTLDDRTQLWASEPGTPPLPTSLPSQNPILKNITDYLIEEVSAEEEELLGSSGGAPPEEPPKEGNPAEINVERDEKLIKVLDKLLLYLRIVHSLDYYNTCEYPNEDEMPNRCGIIHVRGPMPPNRISHGEVLEWQKTFEEKLTPLLSVRESLSEEEAQKMGRKDPEQEVEKFVTSNTQELGKDKWLCPLSGKKFKGPEFVRKHIFNKHAEKIEEVKKEVAFFNNFLTDAKRPALPEIKPAQPPGPAQILPPGLTPGLPYPHQTPQGLMPYGQPRPPILGYGGWCCPPCSPHRRPSIPPCPVWCWSREL

SEQ ID NO: 899266 - protein, 452 aa, Homo sapiens
YARYEAGLKSAEAQAQRGLRALLPIPGCPTFVRLSSALYSRAPSPSRPPRSPRRAPATQVALKSSPSERESNGRGRTKAPSDRAMGDSDDEYDRRRRDKFRRERSDYDRSRERDERRRGDDWNDREWDRGRERRSRGEYRDYDRNRRERFSPPRHELSPPQKRMRRDWDEHSSDPYHSGYEMPYAGGGGGPTYGPPQPWGHPDVHIMQHHVLPIQARLGSIAEIDLGVPPPVMKTFKEFLLSLDDSVDETEAVKRYNDYKLDFRRQQMQDFFLAHKDEEWFRSKYHPDEVGKRRQEARGALQNRLRVFLSLMETGWFDNLLLDIDKADAIVKMLDAAVIKMEGGTENDLRILEQEEEEEQAGKPGEPSKKEEGRAGAGLGDGERKTNDKDEKKEDGKQAENDSSNDDKTKKSEGDGDKEEKKEDSEKEAKKDGSWRPKGHCGISGPGCPRRC

SEQ ID NO: 899267 - protein, 157 aa, Homo sapiens
MISDAIWSVVLEVSKQEVEKFVTSNTQELGKDKWLCPLSGKKFKGPEFVRKHIFNKHAEKIEEVKKEVAFFNNFLTDAKRPALPEIKPAQPPGPAQILPPGLTPGLPYPHQTPQGLMPYGQPRPPILGYGGWCCPPCSPHRRPSIPPCPVWCWSREL

SEQ ID NO: 899268 - protein, 370 aa, Homo sapiens
YARYEAGLKSAEAQAQRGLRALLPIPGCPTFVRLSSALYSRAPSPSRPPRSPRRAPATQVALKSSPSERESNGRGRTKAPSDRAMGDSDDEYDRRRRDKFRRERSDYDRSRERDERRRGDDWNDREWDRGRERRSRGEYRDYDRNRRERFSPPRHELSPPQKRMRRDWDEHSSDPYHSGYEMPYAGGGGGPTYGPPQPWGHPDVHIMQHHVLPIQARLGSIAEIDLGVPPPVMKTFKEFLLSLDDSVDETEAVKRYNDYKLDFRRQQMQDFFLAHKDEEWFRSKYHPDEVGKRRQEARGALQNRLRVFLSLMETGWFDNLLLDIDKADAIVKMLDAAVIKMEGGTENDLRILEQEEEEEQAGKPGEPSKK

SEQ ID NO: 899269 - protein, 363 aa, Homo sapiens
YARYEAGLKSAEAQAQRGLRALLPIPGCPTFVRLSSALYSRAPSPSRPPRSPRRAPATQVALKSSPSERESNGRGRTKAPSDRAMGDSDDEYDRRRRDKFRRERSDYDRSRERDERRRGDDWNDREWDRGRERRSRGEYRDYDRNRRERFSPPRHELSPPQKRMRRDWDEHSSDPYHSGYEMPYAGGGGGPTYGPPQPWGHPDVHIMQHHVLPIQARLGSIAEIDLGVPPPVMKTFKEFLLSLDDSVDETEAVKRYNDYKLDFRRQQMQDFFLAHKDEECSVKYHPDAVGHSASATAEPARTATRHKPTEGSTRYHHGELDPATDYTITSRTTSTQSPHDPTHQTMTDRTPAEPPMARPATEQ

SEQ ID NO: 899270 - protein, 287 aa, Homo sapiens
VVPNARAVIVSKSRARLARSPPLSHHALLSPPFALGLLVPVPAARVELCASEAWVTQAQRGLRALLPIPGCPTFVRLSSALYSRAPSPSRPPRSPRRAPATQVALKSSPSERESNGRGRTKVGEGRSLGGPAGAGEEPGSTGAGAEKLGASGGVGAAFSGLGWWGPRRAGLGGREAGELPARDGPFLRSSFCTISYRLSPVPRPPQTVPWVTVMTSTIEGAGAVRPAVPTGGPPYPHAPYGAGRGNYDAFRGQGGYPGKPRNRMVRGDPRAIVEYRDLDAPDDVDFF

SEQ ID NO: 899271 - protein, 302 aa, Homo sapiens
VVPNARAVIVSKSRARLARSPPLSHHALLSPPFALGLLVPVPAARVELCASEAWVTQAQRGLRALLPIPGCPTFVRLSSALYSRAPSPSRPPRSPRRAPATQVALKSSPSERESNGRGRTKVGEGRSLGGPAGAGEEPGSTGAGAEKLGASGGVGAAFSGLGWWGPRRAGLGGREAGELPARDGPFLRYVLLHHSYRLSPVPRPPQTVPWVTVMTSTIEGAGTSSEESAATTTVPAREMKDVEGTIGMTGEPFLTSSCPRFMPFHSTRVAFLSPPCNFYEGESYEMAHWTVFCGSAYLLLAK

SEQ ID NO: 899272 - protein, 79 aa, Homo sapiens
DSRCRLTSCKLCLPSCAPLLPPGLTPGLPYPHQTPQGLMPYGQPRPPILGYGGWCCPPCSPHRRPSIPPCPVWCWSREL

SEQ ID NO: 899273 - protein, 170 aa, Homo sapiens
NCLLHWQAGAGNPSSSGLGARQPLCGCPDPSPLSTQGPEFVRKHIFNKHAEKIEEVKKEVAFFNNFLTDAKRPALPLARPWVHFERHVGKQMAGEPAYPEAGRGCLARREQRAWPTGTRLPEKLEGDKRPTWPWPAEEDIAATRLIVTKHLFCAWQGSRPTEYTIQPLPR

SEQ ID NO: 899274 - protein, 1005 aa, Homo sapiens
VVPNARAVIVSKSRARLARSPPLSHHALLSPPFALGLLVPVPAARVELCASEAWVTQAQRGLRALLPIPGCPTFVRLSSALYSRAPSPSRPPRSPRRAPATQVALKSSPSERESNGRGRTKVGAGEEPGGPRWGGRGTGVHGGGRGETRGEWRCWSRVLRPRMAPSDRAMGDSDDEYDRRRRDKFRRERSDYDRSRERDERRRGDDWNDREWDRGRERRSRGEYRDYDRNRRERFSPPRHELSPPQKRMRRDWDEHSSDPYHSGYEMPYAGGGGGPTYGPPQPWGHPDVHIMQHHVLPIQARLGSIAEIDLGVPPPVMKTFKEFLLSLDDSVDETEAVKRYNDYKLDFRRQQMQDFFLAHKDEEWFRSKYHPDEVGKRRQEARGALQNRLRVFLSLMETGWFDNLLLDIDKADAIVKMLDAAVIKMEGGTENDLRILEQEEEEEQAGKPGEPSKKEEGRAGAGLGDGERKTNDKDEKKEDGKQAENDSSNDDKTKKSEGDGDKEEKKEDSEKEAKKSSKKRNRKHSGDDSFDEGSVSESESESESGQAEEEKEEAEEALKEKEKPKEEEWEKPKDAAGLECKPRPLHKTCSLFMRNIAPNISRAEIISLCKRYPGFMRVALSEPQPERRFFRRGWVTFDRSVNIKEICWNLQNIRLRECELSPGVNRDLTRRVRNINGITQHKQIVRNDIKLAAKLIHTLDDRTQLWASEPGTPPLPTSLPSQNPILKNITDYLIEEVSAEEEELLGSSGGAPPEEPPKEGNPAEINVERDEKLIKVLDKLLLYLRIVHSLDYYNTCEYPNEDEMPNRCGIIHVRGPMPPNRISHGEVLEWQKTFEEKLTPLLSVRESLSEEEAQKMGRKDPEQEVEKFVTSNTQELGKDKWLCPLSGKKFKGPEFVRKHIFNKHAEKIEEVKKEVAFFNNFLTDAKRPALPEIKPAQPPGPAQILPPGLTPGLPYPHQTPQGLMPYGQPRPPILGYGGWCCPPCSPHRRPSIPPCPVWCWSREL

SEQ ID NO: 899275 - protein, 609 aa, Homo sapiens
METGWFDNLLLDIDKADAIVKMLDAAVIKMEGGTENDLRILEQEEEEEQAGKPGEPSKKEEGRAGAGLGDGERKTNDKDEKKEDGKQAENDSSNDDKTKKSEGDGDKEEKKEDSEKEAKKSSKKRNRKHSGDDSFDEGSVSESESESESGQAEEEKEEAEEALKEKEKPKEEEWEKPKDAAGLECKPRPLHKTCSLFMRNIAPNISRAEIISLCKRYPGFMRVALSEPQPERRFFRRGWVTFDRSVNIKEICWNLQNIRLRECELSPGVNRDLTRRVRNINGITQHKQIVRNDIKLAAKLIHTLDDRTQLWASEPGTPPLPTSLPSQNPILKNITDYLIEEVSAEEEELLGSSGGAPPEEPPKEGNPAEINVERDEKLIKVLDKLLLYLRIVHSLDYYNTCEYPNEDEMPNRCGIIHVRGPMPPNRISHGEVLEWQKTFEEKLTPLLSVRESLSEEEAQKMGRKDPEQEVEKFVTSNTQELGKDKWLCPLSGKKFKGPEFVRKHIFNKHAEKIEEVKKEVAFFNNFLTDAKRPALPEIKPAQPPGPAQILPPGLTPGLPYPHQTPQGLMPYGQPRPPILGYGGWCCPPCSPHRRPSIPPCPVWCWSREL

SEQ ID NO: 899276 - protein, 609 aa, Homo sapiens; identical to SEQ ID NO: 899275

SEQ ID NO: 899277 - protein, 648 aa, Homo sapiens
EDPLNIRVFRSKYHPDEVGKRRQEARGALQNRLRVFLSLMETGWFDNLLLDIDKADAIVKMLDAAVIKMEGGTENDLRILEQEEEEEQAGKPGEPSKKEEGRAGAGLGDGERKTNDKDEKKEDGKQAENDSSNDDKTKKSEGDGDKEEKKEDSEKEAKKSSKKRNRKHSGDDSFDEGSVSESESESESGQAEEEKEEAEEALKEKEKPKEEEWEKPKDAAGLECKPRPLHKTCSLFMRNIAPNISRAEIISLCKRYPGFMRVALSEPQPERRFFRRGWVTFDRSVNIKEICWNLQNIRLRECELSPGVNRDLTRRVRNINGITQHKQIVRNDIKLAAKLIHTLDDRTQLWASEPGTPPLPTSLPSQNPILKNITDYLIEEVSAEEEELLGSSGGAPPEEPPKEGNPAEINVERDEKLIKVLDKLLLYLRIVHSLDYYNTCEYPNEDEMPNRCGIIHVRGPMPPNRISHGEVLEWQKTFEEKLTPLLSVRESLSEEEAQKMGRKDPEQEVEKFVTSNTQELGKDKWLCPLSGKKFKGPEFVRKHIFNKHAEKIEEVKKEVAFFNNFLTDAKRPALPEIKPAQPPGPAQILPPGLTPGLPYPHQTPQGLMPYGQPRPPILGYGGWCCPPCSPHRRPSIPPCPVWCWSREL

SEQ ID NO: 899278 - protein, 533 aa, Homo sapiens
METGWFDNLLLDIDKADAIVKMLDAAVIKRKEEKKEDSEKEAKKSSKKRNRKHSGDDSFDEGSVSESESESESGQAEEEKEEAEEALKEKEKPKEEEWEKPKDAAGLECKPRPLHKTCSLFMRNIAPNISRAEIISLCKRYPGFMRVALSEPQPERRFFRRGWVTFDRSVNIKEICWNLQNIRLRECELSPGVNRDLTRRVRNINGITQHKQIVRNDIKLAAKLIHTLDDRTQLWASEPGTPPLPTSLPSQNPILKNITDYLIEEVSAEEEELLGSSGGAPPEEPPKEGNPAEINVERDEKLIKVLDKLLLYLRIVHSLDYYNTCEYPNEDEMPNRCGIIHVRGPMPPNRISHGEVLEWQKTFEEKLTPLLSVRESLSEEEAQKMGRKDPEQEVEKFVTSNTQELGKDKWLCPLSGKKFKGPEFVRKHIFNKHAEKIEEVKKEVAFFNNFLTDAKRPALPEIKPAQPPGPAQILPPGLTPGLPYPHQTPQGLMPYGQPRPPILGYGGWCCPPCSPHRRPSIPPCPVWCWSREL

SEQ ID NO: 899279 - protein, 920 aa, Homo sapiens; identical to SEQ ID NO: 899250

SEQ ID NO: 899280 - protein, 920 aa, Homo sapiens; identical to SEQ ID NO: 899250

SEQ ID NO: 899281 - protein, 1022 aa, Homo sapiens
YARYEAGLKSAEAQAQRGLRALLPIPGCPTFVRLSSALYSRAPSPSRPPRSPRRAPATQVALKSSPSERESNGRGRTKAPSDRAMGDSDDEYDRRRRDKFRRERSDYDRSRERDERRRGDDWNDREWDRGRERRSRGEYRDYDRNRRERFSPPRHELSPPQKRMRRDWDEHSSDPYHSGYEMPYAGGGGGPTYGPPQPWGHPDVHIMQHHVLPIQARLGSIAEIDLGVPPPVMKTFKEFLLSLDDSVDETEAVKRYNDYKLDFRRQQMQDFFLAHKDEEWFRSKYHPDEVGKRRQEARGALQNRLRVFLSLMETGWFDNLLLDIDKADAIVKMLDAAVIKMEGGTENDLRILEQEEEEEQAGKPGEPSKKEEGRAGAGLGDGERKTNDKDEKKEDGKQAENDSSNDDKTKKSEGDGDKEEKKEDSEKEAKKSSKKRNRKHSGDDSFDEGSVSESESESESGQAEEEKEEAEEALKEKEKPKEEEWEKPKDAAGLECKPRPLHKTCSLFMRNIAPNISRAEIISLCKRYPGFMRVALSEPQPERRFFRRGWVTFDRSVNIKEICWNLQNIRVSAGGGTVGKRKGDSVPTGPLCDFVHLIVWLFCTLFDRFVWATLSLGKALGRYMGRNLCGPRPQGARSLINRWCSRGKGLRAAVSLASGVSGVKLLMMSALQLRECELSPGVNRDLTRRVRNINGITQHKQIVRNDIKLAAKLIHTLDDRTQLWASEPGTPPLPTSLPSQNPILKNITDYLIEEVSAEEEELLGSSGGAPPEEPPKEGNPAEINVERDEKLIKVLDKLLLYLRIVHSLDYYNTCEYPNEDEMPNRCGIIHVRGPMPPNRISHGEVLEWQKTFEEKLTPLLSVRESLSEEEAQKMGRKDPEQEVEKFVTSNTQELGKDKWLCPLSGKKFKGPEFVRKHIFNKHAEKIEEVKKEVAFFNNFLTDAKRPALPEIKPAQPPGPAQILPPGLTPGLPYPHQTPQGLMPYGQPRPPILGYGGWCCPPCSPHRRPSIPPCPVWCWSREL

SEQ ID NO: 899282 - protein, 917 aa, Homo sapiens; identical to SEQ ID NO: 899262

SEQ ID NO: 899283 - protein, 911 aa, Homo sapiens
YARYEAGLKSAEAQAQRGLRALLPIPGCPTFVRLSSALYSRAPSPSRPPRSPRRAPATQVALKSSPSERESNGRGRTKAPSDRAMGDSDDEYDRRRRDKFRRERSDYDRSRERDERRRGDDWNDREWDRGRERRSRGEYRDYDRNRRERFSPPRHELSPPQKRMRRDWDEHSSDPYHSGYEMPYAGGGGGPTYGPPQPWGHPDVHIMQHHVLPIQARLGSIAEIDLGVPPPVMKTFKEFLLSLDDSVDETEAVKRYNDYKLDFRRQQMQDFFLAHKDEEWFRSKYHPDEVGKRRQEARGALQNRLRVFLSLMETGWFDNLLLDIDKADAIVKMLDAAVIKMEGGTENDLRILEQEEEEEQAGKPGEPSKKEEGRAGAGLGDGERKTNDKDEKKEDGKQAENDSSNDDKTKKSEGDGDKEEKKEDSEKEAKKSSKKRNRKHSGDDSFDEGSVSESESESESGQAEEEKEEAEEALKEKEKPKEEEWEKPKDAAGLECKPRPLHKTCSLFMRNIAPNISRAEIISLCKRYPGFMRVALSEPQPERRFFRRGWVTFDRSVNIKEICWNLQNIRLRECELSPGVNRDLTRRVRNINGITQHKQIVRNDIKLAAKLIHTLDDRTQLWASEPGTPPLPTSLPSQNPILKNITDYLIEEVSAEEEELLGSSGGAPPEEPPKEGNPAEINVERDEKLIKVLDKLLLYLRIVHSLDYYNTCEYPNEDEMPNRCGIIHVRGPMPPNRISHGEVLEWQKTFEEKLTPLLSVRESLSEEEAQKMGRKDPEQEVEKFVTSNTQELGKDKWLCPLSGKKFKGPEFVRKHIFNKHAEKIEEVKKEVAFFNNFLTDAKRPALPEIKPAQPPGPAQILPPGLTPGLPYPHQTPQGLMPYGQPRPPILGYGAGAVALQSPQEGLGYMST

SEQ ID NO: 899284 - protein, 897 aa, Homo sapiens
YARYEAGLKSAEAQAQRGLRALLPIPGCPTFVRLSSALYSRAPSPSRPPRSPRRAPATQVALKSSPSERESNGRGRTKAPSDRAMGDSDDEYDRRRRDKFRRERSDYDRSRERDERRRGDDWNDREWDRGRERRSRGEYRDYDRNRRERFSPPRHELSPPQKRMRRDWDEHSSDPYHSGYEMPYAGGGGGPTYGPPQPWGHPDVHIMQHHVLPIQARLGSIAEIDLGVPPPVMKTFKEFLLSLDDSVDETEAVKRYNDYKLDFRRQQMQDFFLAHKDEEWFRSKYHPDEVGKRRQEARGALQNRLRVFLSLMETGWFDNLLLDIDKADAIVKMLDAAVIKMEGGTENDLRILEQEEEEEQAGKPGEPSKKEEGRAGAGLGDGERKTNDKDEKKEDGKQAENDSSNDDKTKKSEGDGDKEEKKEDSEKEAKKSSKKRNRKHSGDDSFDEGSVSESESESESGQAEEEKEEAEEALKEKEKPKEEEWEKPKDAAGLECKPRPLHKTCSLFMRNIAPNISRAEIISLCKRYPGFMRVALSEPQPERRFFRRGWVTFDRSVNIKEICWNLQNIRLRECELSPGVNRDLTRRVRNINGITQHKQIVRNDIKLAAKLIHTLDDRTQLWASEPGTPPLPTSLPSQNPILKNITDYLIEEVSAEEEELLGSSGGAPPEEPPKEGNPAEINVERDEKLIKVLDKLLLYLRIVHSLDYYNTCEYPNEDEMPNRCGIIHVRGPMPPNRISHGEVLEWQKTFEEKLTPLLSVRESLSEEEAQKMGRKDPEQEVEKFVTSNTQELGKDKWLCPLSGKKFKVLSLCAISSTSMQSEEVMPEIASPATWARPDTTPPRFDPRTPLPTPDSPGPDALWSAPAPDLGLWRMVRGDPRAIVEYRDLDAPDDVDFF

SEQ ID NO: 899285 - protein, 601 aa, Homo sapiens
YARYEAGLKSAEAQAQRGLRALLPIPGCPTFVRLSSALYSRAPSPSRPPRSPRRAPATQVALKSSPSERESNGRGRTKAPSDRAMGDSDDEYDRRRRDKFRRERSDYDRSRERDERRRGDDWNDREWDRGRERRSRGEYRDYDRNRRERFSPPRHELSPPQKRMRRDWDEHSSDPYHSGYEMPYAGGGGGPTYGPPQPWGHPDVHIMQHHVLPIQARLGSIAEIDLGVPPPVMKTFKEFLLSLDDSVDETEAVKRYNDYKLDFRRQQMQDFFLAHKDEEWFRSKYHPDEVGKRRQEARGALQNRLRVFLSLMETGWFDNLLLDIDKADAIVKMLDAAVIKMEGGTENDLRILEQEEEEEQAGKPGEPSKKEEGRAGAGLGDGERKTNDKDEKKEDGKQAENDSSNDDKTKKSEGDGDKEEKKEDSEKEAKKSSKKRNRKHSGDDSFDEGSVSESESESESGQAEEEKEEAEEALKEKEKPKEEEWEKPKDAAGLECKPRPLHKTCSLFMRNIAPNISRAEIISFGEFFRCGWVTFNRSVNIIEILETFRTFLSGRGRCTSGVYRYLNRCRLNINRTTPVKLFGANQLKLAANLVPLWTPPF

SEQ ID NO: 899286 - protein, 449 aa, Homo sapiens
YARYEAGLKSAEAQAQRGLRALLPIPGCPTFVRLSSALYSRAPSPSRPPRSPRRAPATQVALKSSPSERESNGRGRTKAPSDRAMGDSDDEYDRRRRDKFRRERSDYDRSRERDERRRGDDWNDREWDRGRERRSRGEYRDYDRNRRERFSPPRHELSPPQKRMRRDWDEHSSDPYHSGYEMPYAGGGGGPTYGPPQPWGHPDVHIMQHHVLPIQARLGSIAEIDLGVPPPVMKTFKEFLLSLDDSVDETEAVKRYNDYKLDFRRQQMQDFFLAHKDEEWFRSKYHPDEVGKRRQEARGALQNRLRVFLSLMETGWFDNLLLDIDKADAIVKMLDAAVIKMEGGTENDLRILEQEEEEEQAGKPGEPSKKEEGRAGAGLGDGERKTNDKDEKKEDGKQAENDSSNDDKTKKSEGDGDKEEKKEDSEKEAKKGEVSVAWGQSVGAGVLAR

SEQ ID NO: 899287 - protein, 280 aa, Homo sapiens
YARYEAGLKSAEAQAQRGLRALLPIPGCPTFVRLSSALYSRAPSPSRPPRSPRRAPATQVALKSSPSERESNGRGRTKAPSDRAMGDSDDEYDRRRRDKFRRERSDYDRSRERDERRRGDDWNDREWDRGRERRSRGEYRDYDRNRRERFSPPRHELSPPQKRMRRDWDEHSSDPYHSGYEMPYAGGGGGPTYGPPQPWGHPDVHIMQHHVLPIQARLGSIAEIDLGVPPPVMKTFKEFLLSLDDSVDETEAVKRYNDYKLDFRRQQMQDFFLAHKDEEW

SEQ ID NO: 899288 - protein, 287 aa, Homo sapiens; identical to SEQ ID NO: 899270

SEQ ID NO: 899289 - protein, 168 aa, Homo sapiens
YARYEAGLKSAEAQAQRGLRALLPIPGCPTFVRLSSALYSRAPSPSRPPRSPRRAPATQVALKSSPSERESNGRGRTKAPSDRAMGDSDDEYDRRRRDKFRRERSDYDRSRERDERRRGDDWNDREWDRGRERRSRGEYRDYDRNRRERFSPPRHELSPPQKRMRRDW

SEQ ID NO: 899290 - protein, 104 aa, Homo sapiens
MTSLNARLLSTAAAPSPPCKSPQPTEPLGPKLQAAPHFQDFGRFMGHSPLERPQLLPSYTASAMFMGRQRHGEANGLQAVFGEKEELSSKGISTTGMFIEFVNN

SEQ ID NO: 899291 - protein, 175 aa, Homo sapiens
MGSSPRYIHHLHPTLPAGTYWVDPNLGCSSDTIEVSCNFTHGGQTCLKPITASKVEFAISRVQMNFLHLLSSEVTQHITIHCLNMTVWQEGTGQTPAKQAVRFRAWNGQIFEAGGQFRPEVSMDGCKVQDGRWHQTLFTFRTQDPQQLPIISVDNLPPASSGKQYRLEVGPACFL

SEQ ID NO: 899292 - protein, 741 aa, Homo sapiens
LERMTFEARLKTAVPSALGGRDVDILQRLGLSWTKAGSPAPPGVIPFQSGFIFTQRARLQAPTGTIIPAALGTELALVLSLCSHRVNHAFLFAVRSRKRKLQLGLQFLPGKTVVHLGSRRSVAFDLDMHDGRWHHLALELRGRTVTLVTACGQRRVPVLLPFHRDPALDPGGSFLFGKMNPHAVQFEGALCQFSIYPVTQVAHNYCTHLRKQCGQADTYQSPLGPLFSQDSGRPFTFQSDLALLGLENLTTATPALGSLPAGRGPRGTVAPATPTKPQRTSPTNPHQHMAVGGPAQTPLLPAKLSASNALDPMLPASVGGSTRTPRPAAAQPSQKITATKIPKSLPTKPSAPSTSIVPIKSPHPTQKTAPSSFTKSALPTQKQVPPTSRPVPARVSRPAEKPIQRNPGMPRPPRRLVQWENRAFLGKPEMKGDLGPLGTPGEQGLIGQRGEPGLEGDSGPMGPDGLKGDRGDPGPDGEHGEKGQEGLMGEDGPPGPPGVTGVRGPEGKSGKQGEKGRTGAKGAKGYQGQLGEMGVPGDPGPPGTPGPKGSRGSLGPTGAPGRMGAQGEPGLAGYDGHKGIVGPLGPPGPKGLGCSSDTIEVSCNFTHGGQTCLKPITASKVEFAISRVQMNFLHLLSSEVTQHITIHCLNMTVWQEGTGQTPAKQAVRFRAWNGQIFEAGGQFRPEVSMDGCKVQDGRWHQTLFTFRTQDPQQLPIISVDNLPPASSGKQYRLEVGPACFL

SEQ ID NO: 899293 - protein, 1815 aa, Homo sapiens
LERMTFEARLKTAVPSALGGRDVDILQRLGLSWTKAGSPAPPGVIPFQSGFIFTQRARLQAPTGTIIPAALGTELALVLSLCSHRVNHAFLFAVRSRKRKLQLGLQFLPGKTVVHLGSRRSVAFDLDMHDGRWHHLALELRGRTVTLVTACGQRRVPVLLPFHRDPALDPGGSFLFGKMNPHAVQFEGALCQFSIYPVTQVAHNYCTHLRKQCGQADTYQSPLGPLFSQDSGRPFTFQSDLALLGLENLTTATPALGSLPAGRGPRGTVAPATPTKPQRTSPTNPHQHMAVGGPAQTPLLPAKLSASNALDPMLPASVGGSTRTPRPAAAQPSQKITATKIPKSLPTKPSAPSTSIVPIKSPHPTQKTAPSSFTKSALPTQKQVPPTSRPVPARVSRPAEKPIQRNPGMPRPPPPSTRPLPPTTSSSKKPIPTLARTEAKITSHASKPASARTSTHKPPPFTALSSSPAPTPGSTRSTRPPATMVPPTSGTSTPRTAPAVPTPGSAPTGSKKPIGSEASKKAGPKSSPRKPVPLRPGKAARDVPLSDLTTRPSPRQPQPSQQTTPALVLAPAQFLSSSPRPTSSGYSIFHLAGSTPFPLLMGPPGPKGDCGLPGPPGLPGLPGIPGARGPRGPPGPYGNPGLPGPPGAKGDMGLPGLSGNPGPPGRKGHKGYPGPAGHPGEQGQPGPEGSPGAKGYPGRQGLPGPVGDPGPKGSRGYIGLPGLFGLPGSDGERGLPGVPGKRGKMGMPGFPGVFGERGPPGLDGNPGELGLPGPPGVPGLIGDLGVLGPIGYPGPKGMKGLMGSVGEPGLKGEQGVPGVSGDPGFQGDKGSQGLPGFPGARGKPGPLGKVGDKGSIGFPGPPGPEGFPGDIGPPGDNGPEGMKGKPGARGLPGPRGQLGPEGDEGPMGPPGAPGLEGQPGRKGFPGRPGLDGVKGEPGDPGRPGPVGEQGFMGFIGLVGEPGIVGEKGDRGMMGPPGVPGPKGSMVRRSSWKPGGMGTPGEPGPQGPPGSRGPPGMRGAKGRRGPRGPDGPAGEQGSRGLKGPPGPQGRPGRPGQQGVAGERGHLGSRGFPGIPGPSGPPGTKGLPGEPGPQGPQGPIGPPGEMGPKPPGAVGEPGLPGEAGMKGDLGPLGTPGEQGLIGQRGEPGLEGDSGPMGPDGLKGDRGDPGPDGEHGEKGQEGLMGEDGPPGPPGVTGVRGPEGKSGKQGEKGRTGAKGAKGYQGQLGEMGVPGDPGPPGTPGPKGSRGSLGPTGAPGRMGAQGEPGLAGYDGHKGIVGPLGPPGPKAGEQGEDGKAEGPPGPPGDRGPVGDRGDRGEPGDPGYPGQEGVQGLRGKPGQQGQPGHPGPRGWPGPKGSKGAEGPKGKQGKAGAPGRRGVQGLQGLPGPRGVVGRQGLEGIAGPDGLPGRDGQAGQQGEQGDDGDPGPMGPAGKRGNPGVAGLPGAQGPPGFKGESGLPGQLGPPGKRGTEGRTGLPGNQGEPGSKGQPGDSGEMGFPGMAGLFGPKGPPGDIGFKGIQGPRGPPGLMGKEGIVGPLGILGPSGLPGPKGDKGSRGDWVSGWAGGPPGPRGRPGPPGPPGGPIQLQQDDLGAAFQTWMDTSGALRPESYSYPDRLVLDQGGEIFKTLHYLSNLIQSIKTPLGTKENPARVCRDLMDCEQKMVDGTYWVDPNLGCSSDTIEVSCNFTHGGQTCLKPITASKVEFAISRVQMNFLHLLSSEVTQHITIHCLNMTVWQEGTGQTPAKQAVRFRAWNGQIFEAGGQFRPEVSMDGCKVQDGRWHQTLFTFRTQDPQQLPIISVDNLPPASSGKQYRLEVGPACFL

SEQ ID NO: 899294 - protein, 1058 aa, Homo sapiens
MFVLSHALQGFPGVFGERGPPGLDGNPGELGLPGPPGVPGLIGDLGVLGPIGYPGPKGMKGLMGSVGEPGLKGEQGVPGVSGDPGFQGDKGSQGLPGFPGARGKPGPLGKVGDKGSIGFPGPPGPEGFPGDIGPPGDNGPEGMKGKPGARGLPGPRGQLGPEGDEGPMGPPGAPGLEGQPGRKGFPGRPGLDGVKGEPGDPGRPGPVGEQGFMGFIGLVGEPGIVGEKGDRGMMGPPGVPGPKGSMEGGHPGMPGGMGTPGEPGPQGPPGSRGPPGMRGAKGRRGPRGPDGPAGEQGSRGLKGPPGPQGRPGRPGQQGVAGERGHLGSRGFPGIPGPSGPPGTKGLPGEPGPQGPQGPIGPPGEMGPKPPGAVGEPGLPGEAGMKGDLGPLGTPGEQGLIGQRGEPGLEGDSGPMGPDGLKGDRGDPGPDGEHGEKGQEGLMGEDGPPGPPGVTGVRGPEGKSGKQGEKGRTGAKGAKGYQGQLGEMGVPGDPGPPGTPGPKGSRGSLGPTGAPGRMGAQGEPGLAGYDGHKGIVGPLGPPGPKGGEQGEDGKAEGPPGPPGDRGPVGDRGDRGEPGDPGYPGQEGVQGLRGKPGQQGQPGHPGPRGWPGPKGSKGAEGPKGKQGKAGAPGRRGVQGLQGLPGPRGVVGRQGLEGIAGPDGLPGRDGQAGQQGEQGDDGDPGPMGPAGKRGNPGVAGLPGAQGPPGFKGESGLPGQLGPPGKRGTEGRTGLPGNQGEPGSKGQPGDSGEMGFPGMAGLFGPKGPPGDIGFKGIQGPRGPPGLMGKEGIVGPLGILGPSGLPGPKGDKGSRGDWVSGWAGGPPGPRGRPGPPGPPGGPIQLQQDDLGAAFQTWMDTSGALRPESYSYPDRLVLDQGGEIFTKENPARVCRDLMDCEQKMVDGTYWVDPNLGCSSDTIEVSCNFTHGGQTCLKPITASKVEFAISRVQMNFLHLLSSEVTQHITIHCLNMTVWQEGTGQTPAKQAVRFRAWNGQIFEAGGQFRPEVSMDGCKVQDGRWHQTLFTFRTQDPQQLPIISVDNLPPASSGKQYRLEVGPACFL

SEQ ID NO: 899295 - protein, 1815 aa, Homo sapiens; identical to SEQ ID NO: 899293

SEQ ID NO: 899296 - protein, 744 aa, Homo sapiens
LERMTFEARLKTAVPSALGGRDVDILQRLGLSWTKAGSPAPPGVIPFQSGFIFTQRARLQAPTGTIIPAALGTELALVLSLCSHRVNHAFLFAVRSRKRKLQLGLQFLPGKTVVHLGSRRSVAFDLDMHDGRWHHLALELRGRTVTLVTACGQRRVPVLLPFHRDPALDPGGSFLFGKMNPHAVQFEGALCQFSIYPVTQVAHNYCTHLRKQCGQADTYQSPLGPLFSQDSGRPFTFQSDLALLGLENLTTATPALGSLPAGRGPRGTVAPATPTKPQRTSPTNPHQHMAVGGPAQTPLLPAKLSASNALDPMLPASVGGSTRTPRPAAAQPSQKITATKIPKSLPTKPSAPSTSIVPIKSPHPTQKTAPSSFTKSALPTQKQVPPTSRPVPARVSRPAEKPIQRNPGMPRPPPPSTRPLPPTTSSSKKPIPTLARTEAKITSHASKPASARTSTHKPPPFTALSSSPAPTPGSTRSTRPPATMVPPTSGTSTPRTAPAVPTPGSAPTGSKKPIGSEASKKAGPKSSPRKPVPLRPGKAARDVPLSDLTTRPSPRQPQPSQQTTPALVLAPAQFLSSSPRPTSSGYSIFHLAGSTPFPLLMGPPGPKGDCGLPGPPGLPGLPGIPGARGPRGPPGPYGNPGLPGPPGAKGDMGLPGLSGNPGPPGRKGLPGPVGDPGPKGSRGYIGLPGLFGLPGSDGERGLPGVPGKRGKMGMPVLLPQSSEARGGNSMPSEGALAGRHGSHL

SEQ ID NO: 899297 - protein, 951 aa, Homo sapiens
LERMTFEARLKTAVPSALGGRDVDILQRLGLSWTKAGSPAPPGVIPFQSGFIFTQRARLQAPTGTIIPAALGTELALVLSLCSHRVNHAFLFAVRSRKRKLQLGLQFLPGKTVVHLGSRRSVAFDLDMHDGRWHHLALELRGRTVTLVTACGQRRVPVLLPFHRDPALDPGGSFLFGKMNPHAVQFEGALCQFSIYPVTQVAHNYCTHLRKQCGQADTYQSPLGPLFSQDSGRPFTFQSDLALLGLENLTTATPALGSLPAGRGPRGTVAPATPTKPQRTSPTNPHQHMAVGGPAQTPLLPAKLSASNALDPMLPASVGGSTRTPRPAAAQPSQKITATKIPKSLPTKPSAPSTSIVPIKSPHPTQKTAPSSFTKSALPTQKQVPPTSRPVPARVSRPAEKPIQRNPGMPRPPPPSTRPLPPTTSSSKKPIPTLARTEAKITSHASKPASARTSTHKPPPFTALSSSPAPTPGSTRSTRPPATMVPPTSGTSTPRTAPAVPTPGSAPTGSKKPIGSEASKKAGPKSSPRKPVPLRPGKAARDVPLSDLTTRPSPRQPQPSQQTTPALVLAPAQFLSSSPRPTSSGYSIFHLAGSTPFPLLMGPPGPKGDCGLPGPPGLPGLPGIPGARGPRGPPGPYGNPGLPGPPGAKGDMGLPGLSGNPGPPGRKGHKGYPGPAGHPGEQGQPGPEGSPGAKGYPGRQGLPGPVGDPGPKGSRGYIGLPGLFGLPGSDGERGLPGVPGKRGKMGMPGFPGVFGERGPPGLDGNPGELGLPGPPGVPGLIGDLGVLGPIGYPGPKGMKGLMGSVGEPGLKGEQGVPGVSGDPGFQGDKGSQGLPGFPGARGKPGPLGKVGDKGSIGFPGPPGPEGFPGDIGPPGDNGPEGMKGKPGARGLPGPRGQLGPEGDEGPMGPPGAPGLEGQPGRKGFPGRPGLDGVKGEPGDPGRPGPVGEQVS

SEQ ID NO: 899298 - protein, 951 aa, Homo sapiens; identical to SEQ ID NO: 899297

SEQ ID NO: 899299 - protein, 1815 aa, Homo sapiens; identical to SEQ ID NO: 899293

SEQ ID NO: 899300 - protein, 1104 aa, Homo sapiens
LERMTFEARLKTAVPSALGGRDVDILQRLGLSWTKAGSPAPPGVIPFQSGFIFTQRARLQAPTGTIIPAALGTELALVLSLCSHRVNHAFLFAVRSRKRKLQLGLQFLPGKTVVHLGSRRSVAFDLDMHDGRWHHLALELRGRTVTLVTACGQRRVPVLLPFHRDPALDPGGSFLFGKMNPHAVQFEGALCQFSIYPVTQVAHNYCTHLRKQCGQADTYQSPLGPLFSQDSGRPFTFQSDLALLGLENLTTATPALGSLPAGRGPRGTVAPATPTKPQRTSPTNPHQHMAVGGPAQTPLLPAKLSASNALDPMLPASVGGSTRTPRPAAAQPSQKITATKIPKSLPTKPSAPSTSIVPIKSPHPTQKTAPSSFTKSALPTQKQVPPTSRPVPARVSRPAEKPIQRNPGMPRPPRRLVQWENRAFLGKPEMKGDLGPLGTPGEQGLIGQRGEPGLEGDSGPMGPDGLKGDRGDPGPDGEHGEKGQEGLMGEDGPPGPPGVTGVRGPEGKSGKQGEKGRTGAKGAKGYQGQLGEMGVPGDPGPPGTPGPKGSRGSLGPTGAPGRMGAQGEPGLAGYDGHKGIVGPLGPPGPKAGEQGEDGKAEGPPGPPGDRGPVGDRGDRGEPGDPGYPGQEGVQGLRGKPGQQGQPGHPGPRGWPGPKGSKGAEGPKGKQGKAGAPGRRGVQGLQGLPGPRGVVGRQGLEGIAGPDGLPGRDGQAGQQGEQGDDGDPGPMGPAGKRGNPGVAGLPGAQGPPGFKGESGLPGQLGPPGKRGTEGRTGLPGNQGEPGSKGQPGDSGEMGFPGMAGLFGPKGPPGDIGFKGIQGPRGPPGLMGKEGIVGPLGILGPSGLPGPKGDKGSRGDWVSGWAGGPPGPRGRPGPPGPPGGPIQLQQDDLGAAFQTWMDTSGALRPESYSYPDRLVLDQGGEIFTKENPARVCRDLMDCEQKMVDGTYWVDPNLGCSSDTIEVSCNFTHGGQTCLKPITASKVEFAISRVQMNFLHLLSSEVTQHITIHCLNMTVWQEGTGQTPAKQAVRFRAWNGQIFEAGGQFRPEVSMDGCKVQDGRWHQTLFTFRTQDPQQLPIISVDNLPPASSGKQYRLEVGPACFL

SEQ ID NO: 899301 - protein, 1815 aa, Homo sapiens; identical to SEQ ID NO: 899293

SEQ ID NO: 899302 - protein, 1104 aa, Homo sapiens; identical to SEQ ID NO: 899300

SEQ ID NO: 899303 - protein, 1815 aa, Homo sapiens; identical to SEQ ID NO: 899293

SEQ ID NO: 899304 - protein, 71 aa, Homo sapiens
EHLPDTIELVPLVERVGQSGLGLEVKHQHGTISGSRIASSEVLTSRSLSLQDAIIVPAFSLSLNSVETHCH

SEQ ID NO: 899305 - protein, 106 aa, Homo sapiens
MREERQRPSSLGGESLVTPTPPGLHLLPQHSAISGTLWNHCSGSPRPPPPPPALEPLPTLTGNFLCVSLRVRVGYPDSWVPLASEEQRAERGSLETRGSLGPKASR

SEQ ID NO: 899306 - protein, 668 aa, Homo sapiens
ALWDWMSLKMDNRDVAGKANRWFGVAPPKSGKMNMNILHQEELIAQKKREIEAKMEQKAKQNQVASPQPPHPGEITNAHNSSCISNKFANDGSFLQQFLKLQKAQTSTDAPTSAPSAPPSTPTPSAGKRSLLISRRTGLGLASLPGPVKSYSHAKQLPVAHRPSVFQSPDEDEEEDYEQWLEIKVSPPEGAETRKVIEKLARFVAEGGPELEKVAMEDYKDNPAFAFLHDKNSREFLYYRKKVAEIRKEAQKSQAASQKEIRLLGVVIEPSTDSLLKVSPPEDEEVKNLAEKLARFIADGGPEVETIALQNNRENQAFSFLYEPNSQGYKYYRQKLEEFRKAKASSTGSFTAPDPGLKRKSPPEALSGSLPPATTCPASSTPAPTIIPAPAAPGKPASAATVKRKRKSRWGPEEDKVELPPAELVQRDVDASPSPLSVQDLKGLGYEKGKPVGLVGVTELSDAQKKQLKEQQEMQQMYDMIMQHKRAMQDMQLLWEKAVQQHQHGYDSDEEVDSELGTWEHQLRRMEMDKTREWAEQLTKMGRGKHFIGDFLPPDELEKFMETFKALKEGREPDYSEYKEFKLTVENIGYQMLMKMGWKEGEGLGSEGQGIKNPVNKGTTTVDGAGFGIDRPAELSKEDDEYEAFRKRMMLAYRFRPNPLNNPRRPYY

SEQ ID NO: 899307 - protein, 668 aa, Homo sapiens; identical to SEQ ID NO: 899306

SEQ ID NO: 899308 - protein, 691 aa, Homo sapiens
ALWDWMSLKMDNRDVAGKANRWFGVAPPKSGKMNMNILHQEELIAQKKREIEAKMEQKAKQNQVASPQPPHPGEITNAHNSSCISNKFANDGSFLQQFLKLQKAQTSTDAPTSAPSAPPSTPTPSAGKRSLLISRRTGLGLASLPGPVKSYSHAKQLPVAHRPSVFQSPDEDEEEDYEQWLEIKERAVPIDCGVCELNPSTDSLLKVSPPEGAETRKVIEKLARFVAEGGPELEKVAMEDYKDNPAFAFLHDKNSREFLYYRKKVAEIRKEAQKSQAASQKEIRLLGVVELSPVTDSLLKVSPPEDEEVKNLAEKLARFIADGGPEVETIALQNNRENQAFSFLYEPNSQGYKYYRQKLEEFRKAKASSTGSFTAPDPGLKRKSPPEALSGSLPPATTCPASSTPAPTIIPAPAAPGKPASAATVKRKRKSRWGPEEDKVELPPAELVQRDVDASPSPLSVQDLKGLGYEKGKPVGLVGVTELSDAQKKQLKEQQEMQQMYDMIMQHKRAMQDMQLLWEKAVQQHQHGYDSDEEVDSELGTWEHQLRRMEMDKTREWAEQLTKMGRGKHFIGDFLPPDELEKFMETFKALKEGREPDYSEYKEFKLTVENIGYQMLMKMGWKEGEGLGSEGQGIKNPVNKGTTTVDGAGFGIDRPAELSKEDDEYEAFRKRMMLAYRFRPNPLNNPRRPYY

SEQ ID NO: 899309 - protein, 453 aa, Homo sapiens
MEDYKDNPAFAFLHDKNSREFLYYRKKVAEIRKEAQKSQAASQKEIRLLGVVSEPSTDSLLKVSPPEDEEVKNLAEKLARFIADGGPEVETIALQNNRENQAFSFLYEPNSQGYKYYRQKLEEFRKAKASSTGSFTAPDPGLKRKSPPEALSGSLPPATTCPASSTPAPTIIPAPAAPGKPASAATVKRKRKSRWGPEEDKVELPPAELVQRDVDASPSPLSVQDLKGLGYEKGKPVGLVGVTELSDAQKKQLKEQQEMQQMYDMIMQHKRAMQDMQLLWEKAVQQHQHGYDSDEEVDSELGTWEHQLRRMEMDKTREWAEQLTKMGRGKHFIGDFLPPDELEKFMETFKALKEGREPDYSEYKEFKLTVENIGYQMLMKMGWKEGEGLGSEGQGIKNPVNKGTTTVDGAGFGIDRPAELSKEDDEYEAFRKRMMLAYRFRPNPLNNPRRPYY

SEQ ID NO: 899310 - protein, 631 aa, Homo sapiens
MLQEELIAQKKREIEAKMEQKAKQNQVASPQPPHPGEITNAHNSSCISNKFANDGSFLQQFLKLQKAQTSTDAPTSAPSAPPSTPTPSAGKRSLLISRRTGLGLASLPGPVKSYSHAKQLPVAHRPSVFQSPDEDEEEDYEQWLEIKVSPPEGAETRKVIEKLARFVAEGGPELEKVAMEDYKDNPAFAFLHDKNSREFLYYRKKVAEIRKEAQKSQAASQKEIRLLGVVIEPSTDSLLKVSPPEDEEVKNLAEKLARFIADGGPEVETIALQNNRENQAFSFLYEPNSQGYKYYRQKLEEFRKAKASSTGSFTAPDPGLKRKSPPEALSGSLPPATTCPASSTPAPTIIPAPAAPGKPASAATVKRKRKSRWGPEEDKVELPPAELVQRDVDASPSPLSVQDLKGLGYEKGKPVGLVGVTELSDAQKKQLKEQQEMQQMYDMIMQHKRAMQDMQLLWEKAVQQHQHGYDSDEEVDSELGTWEHQLRRMEMDKTREWAEQLTKMGRGKHFIGDFLPPDELEKFMETFKALKEGREPDYSEYKEFKLTVENIGYQMLMKMGWKEGEGLGSEGQGIKNPVNKGTTTVDGAGFGIDRPAELSKEDDEYEAFRKRMMLAYRFRPNPLNNPRRPYY

SEQ ID NO: 899311 - protein, 489 aa, Homo sapiens
ALWDWMSLKMDNRDVAGKANRWFGVAPPKSGKMNMNILHQEELIAQKKREIEAKMEQKAKQNQVASPQPPHPGEITNAHNSSCISNKFANDGSFLQQFLKLQKAQTSTDAPTSAPSAPPSTPTPSAGKRSLLISRRTGLGLASLPGPVKSYSHAKQLPVAHRPSVFQSPDEDEEEDYEQWLEIKVSPPEGAETRKVIEKLARFVAEGGPELEKVAMEDYKDNPAFAFLHDKNSREFLYYRKKVAEIRKEAQKSQAASQKVSPPEDEEVKNLAEKLARFIADGGPEVETIALQNNRENQAFSFLYEPNSQGYKYYRQKLEEFRKAKASSTGSFTAPDPGLKRKSPPEALSGSLPQWAEQLTKMGRGKHFIGDFLPPDELEKFMETFKALKEGREPDYSEYKEFKLTVENIGYQMLMKMGWKEGEGLGSEGQGIKNPVNKGTTTVDGAGFGIDRPAELSKEDDEYEAFRKRMMLAYRFRPNPLNNPRRPYY

SEQ ID NO: 899312 - protein, 443 aa, Homo sapiens [sequence omitted]

SEQ ID NO: 899313 - protein, 467 aa, Homo sapiens
ALWDWMSLKMDNRDVAGKANRWFGVAPPKSGKMNMNILHQEELIAQKKREIEAKMEQKAKQNQVASPQPPHPGEITNAHNSSCISNKFANDGSFLQQFLKLQKAQTSTDAPTSAPSAPPSTPTPSAGKRSLLISRRTGLGLASLPGPVKSYSHAKQLPVAHRPSVFQSPDEDEEEDYEQWLEIKVSPPEGAETRKVIEKLARFVAEGGPELEKVAMEDYKDNPAFAFLHDKNSREFLYYRKKVAEIRKEAQKSQAASQKVSPPEDEEVKNLAEKLARFIADGGPEVETIALQNNRENQAFSFLYEPNSQGYKYYRQKLEEFRKAKASSTGSFTAPDPGLKRKSPPEALSGSLPPATTCPASSTPAPTIIPAPAAPGKPASAATVKRKRKSRWGPEEDKVELPPAELVQRDVDASPSPLSVQDLKGLGYEKGKPVGLVGPSQKPFQYRLQKKDQFCKGSQAMGRMSSP

SEQ ID NO: 899314 - protein, 325 aa, Homo sapiens
MASTRLGVNRPRRLKRKSPPEALSGSLPPATTCPASSTPAPTIIPAPAAPGKPASAATVKRKRKSRWGPEEDKVELPPAELVQRDVDASPSPLSVQDLKGLGYEKGKPVGLVGVTELSDAQKKQLKEQQEMQQMYDMIMQHKRAMQDMQLLWEKAVQQHQHGYDSDEEVDSELGTWEHQLRRMEMDKTREWAEQLTKMGRGKHFIGDFLPPDELEKFMETFKALKEGREPDYSEYKEFKLTVENIGYQMLMKMGWKEGEGLGSEGQGIKNPVNKGTTTVDGAGFGIDRPAELSKEDDEYEAFRKRMMLAYRFRPNPLNNPRRPYY

SEQ ID NO: 899315 - protein, 324 aa, Homo sapiens
ALWDWMSLKMDNRDVAGKANRWFGVAPPKSGKMNMNILHQEELIAQKKREIEAKMEQKAKQNQVASPQPPHPGEITNAHNSSCISNKFANDGSFLQQFLKLQKAQTSTDAPTSAPSAPPSTPTPSAGKRSLLISRRTGLGLASLPGPVKSYSHAKQLPVAHRPSVFQSPDEDEEEDYEQWLEIKVSPPEGAETRKVIEKLARFVAEGGPELEKVAMEDYKDNPAFAFLHDKNSREFLYYRKKVAEIRKEAQKSQAASQKVSPPEDEEVKNLAEKLARFIADGGPEVETIALQNNRENQAFSFLYEPNSQGSPRRTTSMRRSARG

SEQ ID NO: 899316 - protein, 320 aa, Homo sapiens
TRPLKMDNRDVAGKANRWFGVAPPKSGKMNMNILHQEELIAQKKREIEAKMEQKAKQNQVASPQPPHPGEITNAHNSSCISNKFANDGSFLQQFLKLQKAQTSTDAPTSAPSAPPSTPTPSAGKRSLLISRRTGLGLASLPGPVKSYSHAKQLPVAHRPSVFQSPDEDEEEDYEQWLEIKVSPPEGAETRKVIEKLARFVAEGGPELEKVAMEDYKDNPAFAFLHDKNSREFLYYRKKVAEIRKEAQKSQAASQKVSPPEDEEVKNLAEKLARFIADGGPEVETIALQNNRENQAFSFLYEPNSQGSPRRTTSMRRSARG

SEQ ID NO: 899317 - protein, 299 aa, Homo sapiens
ALWDWMSLKMDNRDVAGKANRWFGVAPPKSGKMNMNILHQEELIAQKKREIEAKMEQKAKQNQVASPQPPHPGEITNAHNSSCISNKFANDGSFLQQFLKLQKAQTSTDAPTSAPSAPPSTPTPSAGKRSLLISRRTGLGLASLPGPVKSYSHAKQLPVAHRPSVFQSPDEDEEEDYEQWLEIKVSPPEGAETRKVIEKLARFVAEGGPELEKVAMENIGYQMLMKMGWKEGEGLGSEGQGIKNPVNKGTTTVDGAGFGIDRPAELSKEDDEYEAFRKRMMLAYRFRPNPLNNPRRPYY

SEQ ID NO: 899318 - protein, 650 aa, Homo sapiens
ALWDWMSLKMDNRDVAGKANRWFGVAPPKSGKMNMNILHQEELIAQKKREIEAKMEQKAKQNQVASPQPPHPGEITNAHNSSCISNKFANDGSFLQQFLKLQKAQTSTDAPTSAPSAPPSTPTPSAGKRSLLISRRTGLGLASLPGPVKSYSHAKQLPVAHRPSVFQSPDEDEEEDYEQWLEIKVSPPEGAETRKVIEKLARFVAEGGPELEKVAMEDYKDNPAFAFLHDKNSREFLYYRKKVAEIRKEAQKSQAASQKVSPPEDEEVKNLAEKLARFIADGGPEVETIALQNNRENQAFSFLYEPNSQGYKYYRQKLEEFRKAKASSTGSFTAPDPGLKRKSPPEALSGSLPPATTCPASSTPAPTIIPAPAAPGKPASAATVKRKRKSRWGPEEDKVELPPAELVQRDVDASPSPLSVQDLKGLGYEKGKPVGLVGVTELSDAQKKQLKEQQEMQQMYDMIMQHKRAMQDMQLLWEKAVQQHQHGYDSDEEVDSELGTWEHQLRRMEMDKTREWAEQLTKMGRGKHFIGDFLPPDELEKFMETFKALKEGREPDYSEYKEFKLTVENIGYQMLMKMGWKEGEGLGSEGQGIKNPVNKGTTTVDGAGFGIDRPAELSKEDDEYEAFRKRMMLAYRFRPNPLNNPRRPYY

SEQ ID NO: 899319 - protein, 646 aa, Homo sapiens
TRPLKMDNRDVAGKANRWFGVAPPKSGKMNMNILHQEELIAQKKREIEAKMEQKAKQNQVASPQPPHPGEITNAHNSSCISNKFANDGSFLQQFLKLQKAQTSTDAPTSAPSAPPSTPTPSAGKRSLLISRRTGLGLASLPGPVKSYSHAKQLPVAHRPSVFQSPDEDEEEDYEQWLEIKVSPPEGAETRKVIEKLARFVAEGGPELEKVAMEDYKDNPAFAFLHDKNSREFLYYRKKVAEIRKEAQKSQAASQKVSPPEDEEVKNLAEKLARFIADGGPEVETIALQNNRENQAFSFLYEPNSQGYKYYRQKLEEFRKAKASSTGSFTAPDPGLKRKSPPEALSGSLPPATTCPASSTPAPTIIPAPAAPGKPASAATVKRKRKSRWGPEEDKVELPPAELVQRDVDASPSPLSVQDLKGLGYEKGKPVGLVGVTELSDAQKKQLKEQQEMQQMYDMIMQHKRAMQDMQLLWEKAVQQHQHGYDSDEEVDSELGTWEHQLRRMEMDKTREWAEQLTKMGRGKHFIGDFLPPDELEKFMETFKALKEGREPDYSEYKEFKLTVENIGYQMLMKMGWKEGEGLGSEGQGIKNPVNKGTTTVDGAGFGIDRPAELSKEDDEYEAFRKRMMLAYRFRPNPLNNPRRPYY

SEQ ID NO: 899320 - protein, 613 aa, Homo sapiens
MLQEELIAQKKREIEAKMEQKAKQNQVASPQPPHPGEITNAHNSSCISNKFANDGSFLQQFLKLQKAQTSTDAPTSAPSAPPSTPTPSAGKRSLLISRRTGLGLASLPGPVKSYSHAKQLPVAHRPSVFQSPDEDEEEDYEQWLEIKVSPPEGAETRKVIEKLARFVAEGGPELEKVAMEDYKDNPAFAFLHDKNSREFLYYRKKVAEIRKEAQKSQAASQKVSPPEDEEVKNLAEKLARFIADGGPEVETIALQNNRENQAFSFLYEPNSQGYKYYRQKLEEFRKAKASSTGSFTAPDPGLKRKSPPEALSGSLPPATTCPASSTPAPTIIPAPAAPGKPASAATVKRKRKSRWGPEEDKVELPPAELVQRDVDASPSPLSVQDLKGLGYEKGKPVGLVGVTELSDAQKKQLKEQQEMQQMYDMIMQHKRAMQDMQLLWEKAVQQHQHGYDSDEEVDSELGTWEHQLRRMEMDKTREWAEQLTKMGRGKHFIGDFLPPDELEKFMETFKALKEGREPDYSEYKEFKLTVENIGYQMLMKMGWKEGEGLGSEGQGIKNPVNKGTTTVDGAGFGIDRPAELSKEDDEYEAFRKRMMLAYRFRPNPLNNPRRPYY

SEQ ID NO: 899321 - protein, 297 aa, Homo sapiens
ALWDWMSLKMDNRDVAGKANRWFGVAPPKSGKMNMNILHQEELIAQKKREIEAKMEQKAKQNQVASPQPPHPGEITNAHNSSCISNKFANDGSFLQQFLKLQKAQTSTDAPTSAPSAPPSTPTPSAGKRSLLISRRTGLGLASLPGPVKSYSHAKQLPVAHRPSVFQSPDEDEEEDYEQWLEIKVSPPEGAETRKVIEKLARFVAEGGPELEKVAMEDYKDNPAFAFLHDKNSREFLYYRKKVAEIRKEAQKSQAASQKAFCMSPIAKGTSTTDRSWRSSGKPRPAPQAASQHLIPA

SEQ ID NO: 899322 - protein, 527 aa, Homo sapiens
ALWDWMSLKMDNRDVAGKANRWFGVAPPKSGKMNMNILHQEELIAQKKREIEAKMEQKAKQNQVASPQPPHPGEITNAHNSSCISNKFANDGSFLQQFLKLQKAQTSTDAPTSAPSAPPSTPTPSAGKRSLLISRRTGLGLASLPGPVKSYSHAKQLPVAHRPSVFQSPDEDEEEDYEQWLEIKVSPPEGAETRKVIEKLARFVAEGGPELEKVAMEDYKDNPAFAFLHDKNSREFLYYRKKVAEIRKEAQKSQAASQKVSPPEDEEVKNLAEKLARFIADGGPEVETIALQNNRENQAFSFLYEPNSQGYKYYRQKLEEFRKAKASSTGSFTAPDPGLKRKSPPEALSGSLPPATTCPASSTPAPTIIPAPAAPGKPASAATVKRKRKSRWGPEEDKVELPPAELVQRDVDASPSPLSVQDLKGLGYEKGKPVGLVGVTELSDAQKKQLKEQQEMQQMYDMIMQHKRAMQDMQLLWEKAVQQHQHGYDSDEEVDSELGTWEQPTWRAPMGRMGLKNQGKLGPQAKL

SEQ ID NO: 899323 - protein, 346 aa, Homo sapiens
DGRIMKISEIGQYGCSPYLYEEIQKCSFTAPDPGLKRKSPPEALSGSLPPATTCPASSTPAPTIIPAPAAPGKPASAATVKRKRKSRWGPEEDKVELPPAELVQRDVDASPSPLSVQDLKGLGYEKGKPVGLVGVTELSDAQKKQLKEQQEMQQMYDMIMQHKRAMQDMQLLWEKAVQQHQHGYDSDEEVDSELGTWEHQLRRMEMDKTREWAEQLTKMGRGKHFIGDFLPPDELEKFMETFKALKEGREPDYSEYKEFKLTVENIGYQMLMKMGWKEGEGLGSEGQGIKNPVNKGTTTVDGAGFGIDRPAELSKEDDEYEAFRKRMMLAYRFRPNPLNNPRRPYY

SEQ ID NO: 899324 - protein, 128 aa, Homo sapiens
MGRGKHFIGDFLPPDELEKFMETFKALKEGREPDYSEYKEFKLTVENIGYQMLMKMGWKEGEGLGSEGQGIKNPVNKGTTTVDGAGFGIDRPAELSKEDDEYEAFRKRMMLAYRFRPNPLNNPRRPYY

SEQ ID NO: 899325 - protein, 149 aa, Homo sapiens
PRPRRRMEMDKTREWAEQLTKMGRGKHFIGDFLPPDELEKFMETFKALKEGREPDYSEYKEFKLTVENIGYQMLMKMGWKEGEGLGSEGQGIKNPVNKGTTTVDGAGFGIDRPAELSKEDDEYEAFRKRMMLAYRFRPNPLNNPRRPYY

SEQ ID NO: 899326 - protein, 264 aa, Homo sapiens
MTVKTEAAKGTLTYSRMRGMVAILIAFMKQRRMGLNDFIQKIANNSYACKHPEVQSILKISQPQEPELMNANPSPPPSPSQQINLGPSSNPHAKPSDFHFLKVIGKGSFGKVLLARHKAEEVFYAVKVLQKKAILKKKEEKHIMSERNVLLKNVKHPFLVGLHFSFQTADKLYFVLDYINGGELFYHLQRERCFLEPRARFYAAEIASALGYLHSLNIVYRETLNQEEIFLLEFNKGTPFALNWDFRDSRQRGKQLPTNRDKQS

SEQ ID NO: 899327 - protein, 431 aa, Homo sapiens
MTVKTEAAKGTLTYSRMRGMVAILIAFMKQRRMGLNDFIQKIANNSYACKHPEVQSILKISQPQEPELMNANPSPPPSPSQQINLGPSSNPHAKPSDFHFLKVIGKGSFGKVLLARHKAEEVFYAVKVLQKKAILKKKEEKHIMSERNVLLKNVKHPFLVGLHFSFQTADKLYFVLDYINGGELFYHLQRERCFLEPRARFYAAEIASALGYLHSLNIVYRDLKPENILLDSQGHIVLTDFGLCKENIEHNSTTSTFCGTPEYLAPEVLHKQPYDRTVDWWCLGAVLYEMLYGLPPFYSRNTAEMYDNILNKPLQLKPNITNSARHLLEGLLQKDRTKRLGAKDDFMEIKSHVFFSLINWDDLINKKITPPFNPNVSGPNDLRHFDPEFTEEPVPNSIGKSPDSVLVTASVKEAAEAFLGFSYAPPTDSFL

SEQ ID NO: 899328 - protein, 420 aa, Homo sapiens [sequence omitted]

SEQ ID NO: 899329 - protein, 361 aa, Homo sapiens
MTVKTEAAKGTLTYSRMRGMVAILIAFMKQRRMGLNDFIQKIANNSYACKHPEVQSILKISQPQEPELMNANPSPPPSPSQQINLGPSSNPHAKPSDFHFLKVIGKGSFGKVLLARHKAEEVFYAVKVLQKKAILKKKEEKHIMSERNVLLKNVKHPFLVGLHFSFQTADKLYFVLDYINGGELFYHLQRERCFLEPRARFYAAEIASALGYLHSLNIVYRDLKPENILLDSQGHIVLTDFGLCKENIEHNSTTSTFCGTPEYLAPEVLHKQPYDRTVDWWCLGAVLYEMLYGLPPFYSRNTAEMYDNILNKPLQLKPNITNSARHLLEGLLQKDRTKRLGAKDDFVSDVFLSSWAGRDVH

SEQ ID NO: 899330 - protein, 503 aa, Homo sapiens
KSTKKAFSEATRPCTRAICLFWDSGQEILPGLSHGGSFKETQCSPVALVCRAPRRPLPMGEMQGALARARLESLLRPRHKKRAEAQKRSESFLLSGLAFMKQRRMGLNDFIQKIANNSYACKHPEVQSILKISQPQEPELMNANPSPPPSPSQQINLGPSSNPHAKPSDFHFLKVIGKGSFGKVLLARHKAEEVFYAVKVLQKKAILKKKEEKHIMSERNVLLKNVKHPFLVGLHFSFQTADKLYFVLDYINGGELFYHLQRERCFLEPRARFYAAEIASALGYLHSLNIVYRDLKPENILLDSQGHIVLTDFGLCKENIEHNSTTSTFCGTPEYLAPEVLHKQPYDRTVDWWCLGAVLYEMLYGLPPFYSRNTAEMYDNILNKPLQLKPNITNSARHLLEGLLQKDRTKRLGAKDDFMEIKSHVFFSLINWDDLINKKITPPFNPNVSGPNDLRHFDPEFTEEPVPNSIGKSPDSVLVTASVKEAAEAFLGFSYAPPTDSFL

SEQ ID NO: 899331 - protein, 363 aa, Homo sapiens [sequence omitted]

SEQ ID NO: 899332 - protein, 431 aa, Homo sapiens; identical to SEQ ID NO: 899327

SEQ ID NO: 899333 - protein, 514 aa, Homo sapiens
MTVKTEAAKGTLTYSRMRGMVAILIAFMKQRRMGLNDFIQKIANNSYACKHPEVQSILKISQPQEPELMNANPSPPPSPSQQINLGPSSNPHAKPSDFHFLKVIGKGSFGKVLLARHKAEEVFYAVKVLQKKAILKKKEEKHIMSERNVLLKNVKHPFLVGLHFSFQTADKLYFVLDYINGGEVSRGDRSQLLVSLHSLLCFSLRKKFSKIFGGENVTRISISFNLSGLELIDYLGPLPAVVLLLCMSKLIKFICNPEVTLFCLLQLFYHLQRERCFLEPRARFYAAEIASALGYLHSLNIVYRDLKPENILLDSQGHIVLTDFGLCKENIEHNSTTSTFCGTPEYLAPEVLHKQPYDRTVDWWCLGAVLYEMLYGLPPFYSRNTAEMYDNILNKPLQLKPNITNSARHLLEGLLQKDRTKRLGAKDDFMEIKSHVFFSLINWDDLINKKITPPFNPNVSGPNDLRHFDPEFTEEPVPNSIGKSPDSVLVTASVKEAAEAFLGFSYAPPTDSFL

SEQ ID NO: 899334 - protein, 328 aa, Homo sapiens
DFFKLKFQVLLARHKAEEVFYAVKVLQKKAILKKKEEKHIMSERNVLLKNVKHPFLVGLHFSFQTADKLYFVLDYINGGELFYHLQRERCFLEPRARFYAAEIASALGYLHSLNIVYRDLKPENILLDSQGHIVLTDFGLCKENIEHNSTTSTFCGTPEYLAPEVLHKQPYDRTVDWWCLGAVLYEMLYGLPPFYSRNTAEMYDNILNKPLQLKPNITNSARHLLEGLLQKDRTKRLGAKDDFMEIKSHVFFSLINWDDLINKKITPPFNPNVSGPNDLRHFDPEFTEEPVPNSIGKSPDSVLVTASVKEAAEAFLGFSYAPPTDSFL

SEQ ID NO: 899335 - protein, 288 aa, Homo sapiens
MSERNVLLKNVKHPFLVGLHFSFQTADKLYFVLDYINGGELFYHLQRERCFLEPRARFYAAEIASALGYLHSLNIVYRDLKPENILLDSQGHIVLTDFGLCKENIEHNSTTSTFCGTPEYLAPEVLHKQPYDRTVDWWCLGAVLYEMLYGLPPFYSRNTAEMYDNILNKPLQLKPNITNSARHLLEGLLQKDRTKRLGAKDDFMEIKSHVFFSLINWDDLINKKITPPFNPNVSGPNDLRHFDPEFTEEPVPNSIGKSPDSVLVTASVKEAAEAFLGFSYAPPTDSFL

SEQ ID NO: 899336 - protein, 142 aa, Homo sapiens
MLYGLPPFYSRNTAEMYDNILNKPLQLKPNITNSARHLLEGLLQKDRTKRLGAKDDFMEIKSHVFFSLINWDDLINKKITPPFNPNVSGPNDLRHFDPEFTEEPVPNSIGKSPDSVLVTASVKEAAEAFLGFSYAPPTDSFL

SEQ ID NO: 899337 - protein, 431 aa, Homo sapiens; identical to SEQ ID NO: 899327

SEQ ID NO: 899338 - protein, 431 aa, Homo sapiens; identical to SEQ ID NO: 899327

SEQ ID NO: 899339 - protein, 317 aa, Homo sapiens
MTVKTEAAKGTLTYSRMRGMVAILIAFMKQRRMGLNDFIQKIANNSYACKHPEVQSILKISQPQEPELMNANPSPPPSPSQQINLGPSSNPHAKPSDFHFLKVIGKGSFGKVLLARHKAEEVFYAVKVLQKKAILKKKEEKHIMSERNVLLKNVKHPFLVGLHFSFQTADKLYFVLDYINGGELFYHLQRERCFLEPRARFYAAEIASALGYLHSLNIVYRELKDQEEYLGRLHRDDMGPLLSFRTSAREKQSEAANKQQPFQPFVWGTAGSNLGSPEGLAFHLKARPFTEPGNLVGTWGGVGPWGKAWCLWAYLDR

SEQ ID NO: 899340 - protein, 130 aa, Homo sapiens
MTVKTEAAKGTLTYSRMRGMVAILIAFMKQRRMGLNDFIQKIANNSYACKHPEVQSILKISQPQEPELMNANPSPPPSPSQQINLGPSSNPHAKPSDFHFLKVIGKGSFGKVISNLKIFWYTSFMSSFVF

SEQ ID NO: 899341 - protein, 77 aa, Homo sapiens
LYRILVITPINEEDTPPFNPNVSGPNDLRHFDPEFTEEPVPNSIGKSPDSVLVTASVKEAAEAFLGFSYAPPTDSFL

SEQ ID NO: 899342 - protein, 340 aa, Homo sapiens
MTVKTEAAKGTLTYSRMRGMVAILIAFMKQRRMGLNDFIQKIANNSYACKHPEVQSILKISQPQEPELMNANPSPPPSPSQQINLGPSSNPHAKPSDFHFLKVIGKGSFGKVLLARHKAEEVFYAVKVLQKKAILKKKEEKHIMSERNVLLKNVKHPFLVGLHFSFQTADKLYFVLDYINGGELFYHLQRERCFLEPRARFYAAEIASALGYLHSLNIVYRDLKPENILLDSQGHIVLTDFGLCKENIEHNSTTSTFCGTPEYLAPEVLHKQPYDRTVDWWCLGAVLYEMLYGLVSGTLGTMEHCLLPTILPSHSPCLAMVSCPYQYAYQKQLRGILVIL

SEQ ID NO: 899343 - protein, 340 aa, Homo sapiens; identical to SEQ ID NO: 899342

SEQ ID NO: 899344 - protein, 421 aa, Homo sapiens
MKPSKRFFISPPSSTAFMKQRRMGLNDFIQKIANNSYACKHPEVQSILKISQPQEPELMNANPSPPPSPSQQINLGPSSNPHAKPSDFHFLKVIGKGSFGKVLLARHKAEEVFYAVKVLQKKAILKKKEEKHIMSERNVLLKNVKHPFLVGLHFSFQTADKLYFVLDYINGGELFYHLQRERCFLEPRARFYAAEIASALGYLHSLNIVYRDLKPENILLDSQGHIVLTDFGLCKENIEHNSTTSTFCGTPEYLAPEVLHKQPYDRTVDWWCLGAVLYEMLYGLPPFYSRNTAEMYDNILNKPLQLKPNITNSARHLLEGLLQKDRTKRLGAKDDFMEIKSHVFFSLINWDDLINKKITPPFNPNVSGPNDLRHFDPEFTEEPVPNSIGKSPDSVLVTASVKEAAEAFLGFSYAPPTDSFL

SEQ ID NO: 899345 - protein, 363 aa, Homo sapiens [sequence omitted]

SEQ ID NO: 899346 - protein, 227 aa, Homo sapiens
MTVKTEAAKGTLTYSRMRGMVAILIAFMKQRRMGLNDFIQKIANNSYACKHPEVQSILKISQPQEPELMNANPSPPPSPSQQINLGPSSNPHAKPSDFHFLKVIGKGSFGKVLLARHKAEEVFYAVKVLQKKAILKKKEEKHIMSERNVLLKNVKHPFLVGLHFSFQTADKLYFVLDYINGGELFYHLQRERCFLEPRARFYAAEIASALGYLHSLNIVYRTLQGEH

SEQ ID NO: 899347 - protein, 256 aa, Homo sapiens [sequence omitted]

SEQ ID NO: 899348 - protein, 299 aa, Homo sapiens
KSTKKAFSEATRPCTRAICLFWDSGQEILPGLSHGGSFKETQCSPVALVCRAPRRPLPMGEMQGALARARLESLLRPRHKKRAEAQKRSESFLLSGLAFMKQRRMGLNDFIQKIANNSYACKHPEVQSILKISQPQEPELMNANPSPPPSPSQQINLGPSSNPHAKPSDFHFLKVIGKGSFGKVLLARHKAEEVFYAVKVLQKKAILKKKEEKHIMSERNVLLKNVKHPFLVGLHFSFQTADKLYFVLDYINGGELFYHLQRERCFLEPRARFYAAEIASALGYLHSLNIVYRTLQGEH

SEQ ID NO: 899349 - protein, 156 aa, Homo sapiens
MCAHMKLPIKSKVIFPFFQPPFYSRNTAEMYDNILNKPLQLKPNITNSARHLLEGLLQKDRTKRLGAKDDFMEIKSHVFFSLINWDDLINKKITPPFNPNVSGPNDLRHFDPEFTEEPVPNSIGKSPDSVLVTASVKEAAEAFLGFSYAPPTDSFL

SEQ ID NO: 899350 - protein, 286 aa, Homo sapiens
MTVKTEAAKGTLTYSRMRGMVAILIAFMKQRRMGLNDFIQKIANNSYACKHPEVQSILKISQPQEPELMNANPSPPPSPSQQINLGPSSNPHAKPSDFHFLKVIGKGSFGKVLLARHKAEEVFYAVKVLQKKAILKKKEEKHIMSERNVLLKNVKHPFLVGLHFSFQTADKLYFVLDYINGGELFYHLQRERCFLEPRARFYAAEIASALGYLHSLNIVYRDLKPENILLDSQGHIVLTDFAGDLGQRNPFWGAGFPLGGSSGFGRLCWVRGAVCSRGALLRRDVA

SEQ ID NO: 899351 - protein, 226 aa, Homo sapiens
MTVKTEAAKGTLTYSRMRGMVAILIAFMKQRRMGLNDFIQKIANNSYACKHPEVQSILKISQPQEPELMNANPSPPPSPSQQINLGPSSNPHAKPSDFHFLKVIGKGSFGKVLLARHKAEEVFYAVKVLQKKAILKKKEEKHIMSERNVLLKNVKHPFLVGLHFSFQTADKLYFVLDYINGGELFYHLQRERCFLEPRARFYAAEIASALGYLHEHTTVHEHTTDA

SEQ ID NO: 899352 - protein, 104 aa, Homo sapiens
MTVKTEAAKGTLTYSRMRGMVAILIGECRNLAGLLLQETQSGNFLKVPDQISVCGAGRYEAVKRFFISPPSSTAFMKQRRMGLNDFIQKIANNSYACKQKFDRI

SEQ ID NO: 899353 - protein, 606 aa, Homo sapiens
MSHTASSCQELVENCAVHVAGMAQEDSRRGQVPSSFYHGANQELDLSTKVYKRESGSPYSVLVDTKMSKPHLHETEEQPYFRETRAVSDVHAVKEDRENSDDTEEEEEEVSYKREQIIVEVNLNNQTLNVSKGEKGVSSQSKETPVLKTSSEEEEEESEEEATDDSNDYGENEKQKKKEKIVEKVSVTQRRTRRAASVAAATTSPTPRTTRGRRKSVEPPKRKKRATKEPKAPVQKAKCEEKETLTCEKCPRVFNTRWYLEKHMNVTHRRMQICDKCGKKFVLESELSLHQQTDCEKNIQCVSCNKSFKKLWSLHEHIKIVHGYAEKKFSCEICEKKFYTMAHVRKHMVAHTKDMPFTCETCGKSFKRSMSLKVHSLQHSGEKPFRCENCDERFQYKYQLRSHMSIHIGHKQFMCQWCGKDFNMKQYFDEHMKTHTGEKPFICEICGKSFTSRPNMKRHRRTHTGEKPYPCDVCGQRFRFSNMLKAHKEKCFRVTSPVNVPPAVQIPLTTSPATPVPSVVNTATTPTPPINMNPVSTLPPRPIPHPFSHLHIHPHPHHPHHLPIPPVPHLPPPPALFKSEPLNHRGQSEDNFLRHLAEKNSSAQHH

SEQ ID NO: 899354 - protein, 606 aa, Homo sapiens; identical to SEQ ID NO: 899353

SEQ ID NO: 899355 - protein, 181 aa, Homo sapiens [sequence omitted]

SEQ ID NO: 899356 - protein, 479 aa, Homo sapiens
MSHTASSCQELVENCAVHVAGMAQEDSRRGQVPSSFYHGANQELDLSTKVYKRESGSPYSVLVDTKMSKPHLHETEEQPYFRETRAVSDVHAVKEDRENSDDTEEEEEEVSYKREQIIVEVNLNNQTLNVSKGEKGVSSQSKETPVLKTSSEEEEEESEEEATDDSNDYGENEKQKKKEKIVEKVSVTQRRTRRAASVAAATTSPTPRTTRGRRKSVEPPKRKKRATKEPKAPVQKAKCEEKETLTCEKCPRVFNTRWYLEKHMNVTHRRMQICDKCGKKFVLESELSLHQQTDCEKNIQCVSCNKSFKKLWSLHEHIKIVHGYAEKKFSCEICEKKFYTMAHVRKHMVAHTKDMPFTCETCGKSFKRSMSLKVHSLQHSGEKPFRCENCDERFQYKYQLRSHMSIHIGHKQFMCQWCGKDFNMKQYFDEHMKTHTGEKPFICEICGKSFTSRHLQLSLRVSLIIEEPGGRRTREGYRR

SEQ ID NO: 899357 - protein, 606 aa, Homo sapiens; identical to SEQ ID NO: 899353

SEQ ID NO: 899358 - protein, 426 aa, Homo sapiens
MSHTASSCQELVENCAVHVAGMAQEDSRRGQVPSSFYHGANQELDLSTKVYKRESGSPYSVLVDTKMSKPHLHETEEQPYFRETRAVSDVHAVKEDRENSDDTEEEEEEVSYKREQIIVECVSCNKSFKKLWSLHEHIKIVHGYAEKKFSCEICEKKFYTMAHVRKHMVAHTKDMPFTCETCGKSFKRSMSLKVHSLQHSGEKPFRCENCDERFQYKYQLRSHMSIHIGHKQFMCQWCGKDFNMKQYFDEHMKTHTGEKPFICEICGKSFTSRPNMKRHRRTHTGEKPYPCDVCGQRFRFSNMLKAHKEKCFRVTSPVNVPPAVQIPLTTSPATPVPSVVNTATTPTPPINMNPVSTLPPRPIPHPFSHLHIHPHPHHPHHLPIPPVPHLPPPPALFKSEPLNHRGQSEDNFLRHLAEKNSSAQHH

SEQ ID NO: 899359 - protein, 338 aa, Homo sapiens
IGVCRGGRDVAGGWSWKVRVVHEGRECEKKVQCVSCNKSFKKLWSLHEHIKIVHGYAEKKFSCEICEKKFYTMAHVRKHMVAHTKDMPFTCETCGKSFKRSMSLKVHSLQHSGEKPFRCENCDERFQYKYQLRSHMSIHIGHKQFMCQWCGKDFNMKQYFDEHMKTHTGEKPFICEICGKSFTSRPNMKRHRRTHTGEKPYPCDVCGQRFRFSNMLKAHKEKCFRVTSPVNVPPAVQIPLTTSPATPVPSVVNTATTPTPPINMNPVSTLPPRPIPHPFSHLHIHPHPHHPHHLPIPPVPHLPPPPALFKSEPLNHRGQSEDNFLRHLAEKNSSAQHH

SEQ ID NO: 899360 - protein, 312 aa, Homo sapiens [sequence omitted]

SEQ ID NO: 899361 - protein, 455 aa, Homo sapiens
EKAVLKPEEAEVSRQTRRLSRQNASAGAGAREAWTCGASSVRRAALHPSPAPVSRGLTRVMPRYCAAICCKNRRGRNNKDRKLSFYPFPLHDKERLEKWLKNMKRDSWVPSKYQFLCSDHFTPDSLDIRWGIRYLKQTAVPTIFSLPEDNQGKDPSKKKSQKKNLEDEKEVCPKAKSEESFVLNETKKNIVNTDVPHQHPELLHSSSLVKPPAPKTGSIQNNMLTLNLVKQHTGKPESTLETSVNQDTGRGGFHTCFENLNSTTITLTTSNSESIHQSLETQEVLEVTTSHLANPNFTSNSMEIKSAQENPFLFSTINQTVEELNTNKESVIAIFVPAENSKPSVNSFISAQKETTEMEDTDIEDSLYKDVDYGTEVLQIEHSYCRQDINKEHLWQKVSKLHSKITLLELKEQQTLGRLKSLEALIRQLKQENWLSEENVKIIENHFTTYEVTMI

SEQ ID NO: 899362 - protein, 353 aa, Homo sapiens
MKRDSWVPSKYQFLCSDHFTPDSLDIRWGIRYLKQTAVPTIFSLPEDNQGKDPSKKKSQKKNLEDEKEVCPKAKSEESFVLNETKKNIVNTDVPHQHPELLHSSSLVKPPAPKTGSIQNNMLTLNLVKQHTGKPESTLETSVNQDTGRGGFHTCFENLNSTTITLTTSNSESIHQSLETQEVLEVTTSHLANPNFTSNSMEIKSAQENPFLFSTINQTVEELNTNKESVIAIFVPAENSKPSVNSFISAQKETTEMEDTDIEDSLYKDVDYGTEVLQIEHSYCRQDINKEHLWQKVSKLHSKITLLELKEQQTLGRLKSLEALIRQLKQENWLSEENVKIIENHFTTYEVTMI

SEQ ID NO: 899363 - protein, 139 aa, Homo sapiens
MPVISAAREAEAGESLEPGRWRLRFPLHDKERLEKWLKNMKRDSWVPSKYQFLCSDHFTPDSLDIRWGIRYLKQTAVPTIFSLPEDNQGKRTFLTHTQSPGSKTLGKHAATEVLPHKPKLRSNPLVFTCRQRTTTFTSP

SEQ ID NO: 899364 - protein, 89 aa, Homo sapiens
EKAVLKPEEAEVSRQTRRLSRQNASAGAGAREAWTCGASSVRRAALHPSPAPVSRGLTRVMPRYCAAICCKNRRGRNNKDRKLSFYPYS

SEQ ID NO: 899365 - protein, 233 aa, Homo sapiens
MLTLNLVKQHTGKPESTLETSVNQDTGRGGFHTCFENLNSTTITLTTSNSESIHQSLETQEVLEVTTSHLANPNFTSNSMEIKSAQENPFLFSTINQTVEELNTNKESVIAIFVPAENSKPSVNSFISAQKETTEMEDTDIEDSLYKDVDYGTEVLQIEHSYCRQDINKEHLWQKVSKLHSKITLLELKEQQTLGRLKSLEALIRQLKQENWLSEENVKIIENHFTTYEVTMI

SEQ ID NO: 899366 - protein, 233 aa, Homo sapiens; identical to SEQ ID NO: 899365

SEQ ID NO: 899367 - protein, 191 aa, Homo sapiens
MASGQGPGPPRQECGEPALPSASEEQVAQDTEEVFRSYVFYRHQQEQEAEGVAAPADPEMVTLPLQPSSTMGQVGRQLAIIGDDINRRYDSEFQTMLQHLQPTAENAYEYFTKIATSLFESGINWGRVVALLGFGYRLALHVYQHGLTGFLGQVTRFVVDFMLHHCIARWIAQRGGWVSIQGLQCPPCCWG

SEQ ID NO: 899368 - protein, 151 aa, Homo sapiens
MGQVGRQLAIIGDDINRRYDSEFQTMLQHLQPTAENAYEYFTKIATSLFESGINWGRVVALLGFGYRLALHVYQHGLTGFLGQVTRFVVDFMLHHCIARWIAQRGGWVADLNLGPWFQFLNVLEDMGEGTCWGQDEEPTDSSEIMNSQEWP

SEQ ID NO: 899369 - protein, 211 aa, Homo sapiens
MASGQGPGPPRQECGEPALPSASEEQVAQDTEEVFRSYVFYRHQQEQEAEGVAAPADPEMVTLPLQPSSTMGQVGRQLAIIGDDINRRYDSEFQTMLQHLQPTAENAYEYFTKIATSLFESGINWGRVVALLGFGYRLALHVYQHGLTGFLGQVTRFVVDFMLHHCIARWIAQRGGWVAALNLGNGPILNVLVVLGVVLLGQFVVRRFFKS

SEQ ID NO: 899370 - protein, 141 aa, Homo sapiens
MGQVGRQLAIIGDDINRRYDSEFQTMLQHLQPTAENAYEYFTKIATSLFESGINWGRVVALLGFGYRLALHVYQHGLTGFLGQVTRFVVDFMLHHCIARWIAQRGGWVAALNLGNGPILNVLVVLGVVLLGQFVVRRFFKS

SEQ ID NO: 899371 - protein, 175 aa, Homo sapiens
ATFFTAISRNRRLKGWLPLPTQRWSPYLCNLAGELQPLGPQGHLQGGSSSHGSLCRSWELGRPRGSCPSLMVAPLLCWAPTPIQDLVSFLAHACPFLLEPSTHVLEHCQGPPRRDAQGHGQLRQNPSAMSQGLVPTAWLLAHLHASCSYSTMGQVGRQLAIIGDDINRRYDSEFQ

SEQ ID NO: 899372 - protein, 211 aa, Homo sapiens; identical to SEQ ID NO: 899369

SEQ ID NO: 899373 - protein, 211 aa, Homo sapiens; identical to SEQ ID NO: 899369

SEQ ID NO: 899374 - protein, 116 aa, Homo sapiens
MGQVGRQLAIIGDDINRRYDSEFQTMLQHLQPTAENAYEYFTKIATRYPSHSLPAPVTPLSCHNHTIPCLHDALLAWGEAFCQCPMSAVNSHVVSAPYFSLSGSQTCILGISSQLF

SEQ ID NO: 899375 - protein, 697 aa, Homo sapiens
MTFISTLHVTDMVYDAISPVDIMGMKTIGGELAVRANFGNRRENYFVPIKSSLTPSPRKQESEFWPAGYLNLTDCCSTGSPGKFFQWASFSEIVIKHISQEESVNRFRSRMFEVVDKTFRIVINVLIKCKVRMNNHNYIDGRYILKFLNNFRFSKFRVFSSLESNINIFYQSTEHNFRELVFRTFYLEMRKPFKFKFAFLKYLFQHCSPFFSLLFALSFSEEEHIFSFLLNTLWFSTEVRQARIYVRRVGIILYIKIIGTEKSKSLLSIGLFLMMEIIYVCAVQYGSHSQRWLLSISRVACDTEELNFKFYLITLNFKSYTWLVGLPNYEENKATEHLSSLMKQQEFGNCKSVLSFFHETFIDIILAYTNTGEILLIELLLTFFFSIYIFKKICFFIINLYCRVTIVLKMLSHLVNNKYAFGFLALFIIEAFRINAPNLKYFCCSLKEWVYDAPKGHFENCRSNRYHHVRSEFPCFSLNLEAYLFRRFPKYSVFSCRTLELPRSILFYAYTQHTARANVGCRFRQNTHTHTHKTLKSTMSIISTANLKDEVLTTFVYIIVSLTLNHYPAFLMQSVHKHQSENTKFVRGQDQLGLYMERQLRAVSLCVGGLAAVDSPSGYQTVASLHLQNQTSILGKNVSLPWTGHKQEIDISSENSAAARLSSCPEILRSTKHNIKTVFYTIIFVFVQQHWVLLSIL

SEQ ID NO: 899376 - protein, 224 aa, Homo sapiens
MESNHKSGDGLSGTQKEAALRALVQRTGYSLVQENGQRKYGGPPPGWDAAPPERGCEIFIGKLPRDLFEDELIPLCEKIGKIYEMRMMMDFNGNNRGYAFVTFSNKVEAKNAIKQLNNYEIRNGRLLGVCASVDNCRLFVGGIPKTKKREEEGKKEKKEEKQEEESRNAATTRNKTRYTQGQKQAKNGHEDRPTQRSARRHGTKGPKRNNGARKEELRRRRRTS

SEQ ID NO: 899377 - protein, 586 aa, Homo sapiens
MESNHKSGDGLSGTQKEAALRALVQRTGYSLVQENGQRKYGGPPPGWDAAPPERGCEIFIGKLPRDLFEDELIPLCEKIGKIYEMRMMMDFNGNNRGYAFVTFSNKVEAKNAIKQLNNYEIRNGRLLGVCASVDNCRLFVGGIPKTKKREEILSEMKKVTEGVVDVIVYPSAADKTKNRGFAFVEYESHRAAAMARRKLLPGRIQLWGHGIAVDWAEPEVEVDEDTMSSVKILYVRNLMLSTSEEMIEKEFNNIKPGAVERVKKIRDYAFVHFSNREDAVEAMKALNGKVLDGSPIEVTLAKPVDKDSYVRYTRGTGGRGTMLQGEYTYSLGQVYDPTTTYLGAPVFYAPQTYAAIPSLHFPATKGHLSNRAIIRAPSVRGAAGVRGLGGRGYLAYTGLGRGYQVKGDKREDKLYDILPGMELTPMNPVTLKPQGIKLAPQILEEICQKNNWGQPVYQLHSAIGQDQRQLFLYKITIPALASQNPAIHPFTPPKLSAFVDEAKTYAAEYTLQTLGIPTDGGDGTMATAAAAATAFPGYAVPNATAPVSAAQLKQAVTLGQDLAAYTTYEVYPTFAVTARGDGYGTF

SEQ ID NO: 899378 - protein, 586 aa, Homo sapiens; identical to SEQ ID NO: 899377

SEQ ID NO: 899379 - protein, 566 aa, Homo sapiens
MESNHKSGDGLSGTQKEAALRALVQRTGYSLVQENGQRKYGGPPPGWDAAPPERGCEIFIGKLPRDLFEDELIPLCEKIGKIYEMRMMMDFNGNNRGYAFVTFSNKVEAKNAIKQLNNYEIRNGRLLGVCASVDNCRLFVGGIPKTKKREEILSEMKKRGFAFVEYESHRAAAMARRKLLPGRIQLWGHGIAVDWAEPEVEVDEDTMSSVKILYVRNLMLSTSEEMIEKEFNNIKPGAVERVKKIRDYAFVHFSNREDAVEAMKALNGKVLDGSPIEVTLAKPVDKDSYVRYTRGTGGRGTMLQGEYTYSLGQVYDPTTTYLGAPVFYAPQTYAAIPSLHFPATKGHLSNRAIIRAPSVRGAAGVRGLGGRGYLAYTGLGRGYQVKGDKREDKLYDILPGMELTPMNPVTLKPQGIKLAPQILEEICQKNNWGQPVYQLHSAIGQDQRQLFLYKITIPALASQNPAIHPFTPPKLSAFVDEAKTYAAEYTLQTLGIPTDGGDGTMATAAAAATAFPGYAVPNATAPVSAAQLKQAVTLGQDLAAYTTYEVYPTFAVTARGDGYGTF

SEQ ID NO: 899380 - protein, 500 aa, Homo sapiens
MMMDFNGNNRGYAFVTFSNKVEAKNAIKQLNNYEIRNGRLLGVCASVDNCRLFVGGIPKTKKREEILSEMKKVTEGVVDVIVYPSAADKTKNRGFAFVEYESHRAAAMARRKLLPGRIQLWGHGIAVDWAEPEVEVDEDTMSSVKILYVRNLMLSTSEEMIEKEFNNIKPGAVERVKKIRDYAFVHFSNREDAVEAMKALNGKVLDGSPIEVTLAKPVDKDSYVRYTRGTGGRGTMLQGEYTYSLGQVYDPTTTYLGAPVFYAPQTYAAIPSLHFPATKGHLSNRAIIRAPSVRGAAGVRGLGGRGYLAYTGLGRGYQVKGDKREDKLYDILPGMELTPMNPVTLKPQGIKLAPQILEEICQKNNWGQPVYQLHSAIGQDQRQLFLYKITIPALASQNPAIHPFTPPKLSAFVDEAKTYAAEYTLQTLGIPTDGGDGTMATAAAAATAFPGYAVPNATAPVSAAQLKQAVTLGQDLAAYTTYEVYPTFAVTARGDGYGTF

SEQ ID NO: 899381 - protein, 109 aa, Homo sapiens
MPTLTDLLSSHPFTPPKLSAFVDEAKTYAAEYTLQTLGIPTDGGDGTMATAAAAATAFPGYAVPNATAPVSAAQLKQAVTLGQDLAAYTTYEVYPTFAVTARGDGYGTF

SEQ ID NO: 899382 - protein, 586 aa, Homo sapiens; identical to SEQ ID NO: 899377

SEQ ID NO: 899383 - protein, 594 aa, Homo sapiens
MEAVCLGTCPEPEASMSTAIPGLKKGNNALQSIILQTLLEKENGQRKYGGPPPGWDAAPPERGCEIFIGKLPRDLFEDELIPLCEKIGKIYEMRMMMDFNGNNRGYAFVTFSNKVEAKNAIKQLNNYEIRNGRLLGVCASVDNCRLFVGGIPKTKKREEILSEMKKVTEGVVDVIVYPSAADKTKNRGFAFVEYESHRAAAMARRKLLPGRIQLWGHGIAVDWAEPEVEVDEDTMSSVKILYVRNLMLSTSEEMIEKEFNNIKPGAVERVKKIRDYAFVHFSNREDAVEAMKALNGKVLDGSPIEVTLAKPVDKDSYVRYTRGTGGRGTMLQGEYTYSLGQVYDPTTTYLGAPVFYAPQTYAAIPSLHFPATKGHLSNRAIIRAPSVRGAAGVRGLGGRGYLAYTGLGRGYQVKGDKREDKLYDILPGMELTPMNPVTLKPQGIKLAPQILEEICQKNNWGQPVYQLHSAIGQDQRQLFLYKITIPALASQNPAIHPFTPPKLSAFVDEAKTYAAEYTLQTLGIPTDGGDGTMATAAAAATAFPGYAVPNATAPVSAAQLKQAVTLGQDLAAYTTYEVYPTFAVTARGDGYGTF

SEQ ID NO: 899384 - protein, 594 aa, Homo sapiens
MESNHKSGDGLSGTQKEAALRALVQRTGYSLVQENGQRKYGGPPPGWDAAPPERGCEIFIGKLPRDLFEDELIPLCEKIGKIYEMRMMMDFNGNNRGYAFVTFSNKVEAKNAIKQLNNYEIRNGRLLGVCASVDNCRLFVGGIPKTKKREEILSEMKKVTEGVVDVIVYPSAADKTKNRGFAFVEYESHRAAAMARRKLLPGRIQLWGHGIAVDWAEPEVEVDEDTMSSVKILYVRNLMLSTSEEMIEKEFNNIKPGAVERVKKIRDYAFVHFSNREDAVEAMKALNGKVLDGSPIEVTLAKPVDKDSYVRYTRGTGGRGTMLQGEYTYSLGQVYDPTTTYLGAPVFYAPQTYAAIPSLHFPATKGHLSNRAIIRAPSVREIYMNVPVGAAGVRGLGGRGYLAYTGLGRGYQVKGDKREDKLYDILPGMELTPMNPVTLKPQGIKLAPQILEEICQKNNWGQPVYQLHSAIGQDQRQLFLYKITIPALASQNPAIHPFTPPKLSAFVDEAKTYAAEYTLQTLGIPTDGGDGTMATAAAAATAFPGYAVPNATAPVSAAQLKQAVTLGQDLAAYTTYEVYPTFAVTARGDGYGTF

SEQ ID NO: 899385 - protein, 109 aa, Homo sapiens; identical to SEQ ID NO: 899381

SEQ ID NO: 899386 - protein, 87 aa, Homo sapiens
DEALEDEDNKKDDGISFSNQTGPAWAGSERDYTYEELLNRVFNIIFFVVFIFYSFIFLYYFILIWVLNILLLILGVKVWEFSSIRRQ

SEQ ID NO: 899387 - protein, 103 aa, Homo sapiens
DEALEDEDNKKDDGISFSNQTGPAWAGSERDYTYEELLNRVFNIMREKNPDMVAGEKRKFVMKPPQVVRVGTKKTSFVNFTDICKLLHRQPKHLLAFLLAELG

SEQ ID NO: 899388 - protein, 106 aa, Homo sapiens
MSVFVYHLVTCQCLCLCVPVSQHLCISVAHAVSLCAMVCQCLCVDGWPMSDPRQERPGWLDPAHLPSGSLALWVRVTEAFCGLKTGCSGSALRVLGPFHPLSPSGW

SEQ ID NO: 899389 - protein, 287 aa, Homo sapiens
MSPHPTALLGLVLCLAQTIHTQEEDLPRPSISAEPGTVIPLGSHVTFVCRGPVGVQTFRLERESRSTYNDTEDVSQASPSESEARFRIDSVSEGNAGPYRCIYYKPPKWSEQSDYLELLVKETSGGPDSPDTEPGSSAGPTQRPSDNSHNEHAPASQGLKAEHLYILIGVSVVFLFCLLLLVLFCLHRQNQIKQGPPRSKDEEQKPQQRPDLAVDVLERTADKATVNGLPEKDRETDTSALAAGSSQEVTYAQLDHWALTQRTARAVSPQSTKPMAESITYAAVARH

SEQ ID NO: 899390 - protein, 209 aa, Homo sapiens
MSPHPTALLGLVLCLAQTIHTQEEDLPRPSISAEPGTVIPLGSHVTFVCRGPVGVQTFRLERESRSTYNDTEDVSQASPSESEARFRIDSVSEGNAGPYRCIYYKPPKWSEQSDYLELLVKETSGGPDSPDTEPGSSAGPTQRPSDNSHNEHAPASQGLKAEHLYILIGVSVVFLFCLLLLVLFCLHRQNQIKQGPPRSKDEEQKPQQR

SEQ ID NO: 899391 - protein, 270 aa, Homo sapiens
MSPHPTALLGLVLCLAQTIHTQEEDLPRPSISAEPGTVIPLGSHVTFVCRGPVGVQTFRLERESRSTYNDTEDVSQASPSESEARFRIDSVSEGNAGPYRCIYYKPPKWSEQSDYLELLVKGPTQRPSDNSHNEHAPASQGLKAEHLYILIGVSVVFLFCLLLLVLFCLHRQNQIKQGPPRSKDEEQKPQQRPDLAVDVLERTADKATVNGLPEKDRETDTSALAAGSSQEVTYAQLDHWALTQRTARAVSPQSTKPMAESITYAAVARH

SEQ ID NO: 899392 - protein, 127 aa, Homo sapiens [sequence omitted]

SEQ ID NO: 899393 - protein, 67 aa, Homo sapiens
VTLRILLVDFKKDRETDTSALAAGSSQEVTYAQLDHWALTQRTARAVSPQSTKPMAESITYAAVARH

SEQ ID NO: 899394 - protein, 153 aa, Homo sapiens [sequence omitted]

SEQ ID NO: 899395 - protein, 122 aa, Homo sapiens
VIPLGSHVTFVCRGPVGVQTFRLERESRSTYNDTEDVSQASPSESEARFRIDSVSEGNAGPYRCIYYKPPKWSEQSDYLELLVKGEDVTWALPQSQLDPRACPQVPGPCPSCCPLWPTLSSS

SEQ ID NO: 899396 - protein, 263 aa, Homo sapiens
MSPHPTALLGLVLCLAQTIHTQEEDLPRPSISAEPGTVIPLGSHVTFVCRGPVGVQTFRLERESRSTYNDTEDVSQASPSESEARFRIDSVSEGNAGPYRCIYYKPPKWSEQSDYLELLVKETSGGPDSPDTEPGSSAGPTQRPSDNSHNEHAPASQGLKAEHLYILIGVSVVFLFCLLLLVLFCLHRQNQIKQGPPRMQRTRSKKATSKNAMTWLVDVLREEQRQRHQFMDFLRRERENGHLWPGCREFRGVTYAMVDPWAY

SEQ ID NO: 899397 - protein, 270 aa, Homo sapiens; identical to SEQ ID NO: 899391

SEQ ID NO: 899398 - protein, 209 aa, Homo sapiens; identical to SEQ ID NO: 899390

SEQ ID NO: 899399 - protein, 153 aa, Homo sapiens [sequence omitted]

SEQ ID NO: 899400 - protein, 119 aa, Homo sapiens
MSPHPTALLGLVLCLAQTIHTQEEDLPRPSISAEPGTVIPLGSHVTFVCRGPVGVQTFRLERESRSTYNDTRDFAVIICPADPKDLPRSQELALRLCYTHTAESQAQFSGLCFTPRINK

SEQ ID NO: 899401 - protein, 116 aa, Homo sapiens
VRPGGGAHVRRGVELAKVSGAGLAEVRKLGQGQGFDQLLEREGAAPARRGVPAWRRGPDGRGGAECSIPPGEKGIRVGQAASAATTYKALSQGIAGPRCLDPGCASPSLCSPWKGR

SEQ ID NO: 899402 - protein, 364 aa, Homo sapiens
MSDEGSRGSRLPLALPPASQGCSSGGGRPAAAGGGSSAGGSGNSRPPRNLQGLLQMAITAGSEEPDPPPEPMSEERRQWLQEAMSAAFRGQREEVEQMKSCLRVLSQPMPPTAGEAEQAADQQEREGALELLADLCENMDNAADFCQLSGMHLLVGRYLEAGAAGLRWRAAQLIGTCSQNVAAIQEQVLGLGALRKLLRLLDRDACDTVRVKALFAISCLVREQEAGLLQFLRLDGFSVLMRAMQQQVQKLKVKSAFLLQNLLVGHPEHKGTLCSMGMVQQLVALVRTEHSPFHEHVLGALCSLVTDFPQGVRECREPELGLEELLRHRCQLLQQHEEYQEELEFCEKLLQTCFSSPADDSMDR

SEQ ID NO: 899403 - protein, 364 aa, Homo sapiens; identical to SEQ ID NO: 899402

SEQ ID NO: 899404 - protein, 410 aa, Homo sapiens
MGGRRAPLKRRLLSRPSRIDPSGRQSCFSGDHLLPLTHSSLLHKRPMSDEGSRGSRLPLALPPASQGCSSGGGRPAAAGGGSSAGGSGNSRPPRNLQGLLQMAITAGSEEPDPPPEPMSEERRQWLQEAMSAAFRGQREEVEQMKSCLRVLSQPMPPTAGEAEQAADQQEREGALELLADLCENMDNAADFCQLSGMHLLVGRYLEAGAAGLRWRAAQLIGTCSQNVAAIQEQVLGLGALRKLLRLLDRDACDTVRVKALFAISCLVREQEAGLLQFLRLDGFSVLMRAMQQQVQKLKVKSAFLLQNLLVGHPEHKGTLCSMGMVQQLVALVRTEHSPFHEHVLGALCSLVTDFPQGVRECREPELGLEELLRHRCQLLQQHEEYQEELEFCEKLLQTCFSSPADDSMDR

SEQ ID NO: 899405 - protein, 309 aa, Homo sapiens [sequence omitted]

SEQ ID NO: 899406 - protein, 364 aa, Homo sapiens; identical to SEQ ID NO: 899402

SEQ ID NO: 899407 - protein, 364 aa, Homo sapiens; identical to SEQ ID NO: 899402

SEQ ID NO: 899408 - protein, 357 aa, Homo sapiens
MSDEGSRGSRLPLALPPASQGCSSGGGRPAAAGGGSSAGGSGNSRPPRNLQGLLQMAITAGSEEPDPPPEPMSEERRQWLQEAMSAAFRGQREEVEQMKSCLRVLSQPMPPTAGEAEQAADQQEREGALELLADLCENMDNAADFCQLSGMHLLVGRYLEAGAAGLRWRAAQLIGTCSQNVAAIQEQVLGLGALRKLLRLLDRDACDTVRVKALFAISCLVREQEAGLLQFLRLDGFSVLMRAMQQQVQKLKVKSAFLLQNLLVGHPEHKGTLCSMGMVQQLVALVRTEHSPFHEHVLGALCKGVRECREPELGLEELLRHRCQLLQQHEEYQEELEFCEKLLQTCFSSPADDSMDR

SEQ ID NO: 899409 - protein, 364 aa, Homo sapiens; identical to SEQ ID NO: 899402

SEQ ID NO: 899410 - protein, 452 aa, Homo sapiens
MACRSCVVGFSSLSSCEVTPVGSPRPGTSGWDSCRAPGPGFSSRSLTGCWSAGTISKVTVNPGLLVPLDVKLDPAVQQLKNQEKEEMKALNDKFASLIGKVQALEQRNQLLETRWSFLQGQDSAIFDLGHLYEEYQGRLQEELRKVSQERGQLEANLLQVLEKVEEFRIRYEDEISKRTDMEFTFVQLKKDLDAECLHRTELETKLKSLESFVELMKTIYEQELKDLAAQVKDVSVTVGMDSRCHIDLSGIVEEVKAQYDAVAARSLEEAEAYSRSQLEEQAARSAEYGSSLQSSRSEIADLNVRIQKLRSQILSVKSHCLKLEENIKTAEEQGELAFQDAKTKLAQLEAALQQAKQDMARQLRKYQELMNVKLALDIEIATYRKLVEGEEGRMDSPSATVVSAVQSRCKTAASRSGLSKAPSRKKKGSKGPVIKITEMSEKYFSQESEVSE

SEQ ID NO: 899411 - protein, 176 aa, Homo sapiens [sequence omitted]

SEQ ID NO: 899412 - protein, 422 aa, Homo sapiens
MACRSCVVGFSSLSSCEVTPVGSPRPGTSGWDSCRAPGPGFSSRSLTGCWSAGTISKVTVNPGLLVPLDVKLDPAVQQLKNQEKEEMKALNDKFASLIGKVQALEQRNQLLETRWSFLQGQDSAIFDLGHLYEEYQGRLQEELRKVSQERGQLEANLLQVLEKVEEFRIRYEDEISKRTDMEFTFVQLKKDLDAECLHRTELETKLKSLESFVELMKTIYEQELKDLAAQVKDVSVTVGMDSRCHIDLSGIVEEVKAQYDAVAARSLEEAEAYSRSQLEEQAARSAEYGSSLQSSRSEIADLNVRIQKLRSQILSVKSHCLKLEENIKTAEEQGELAFQDAKTKLAQLEAALQQAKQDMARQLRKYQELMNVKLALDIEIATYRKLVEGEEGRMDSPSATVVSAVQSRCKTAPSLPYPLCSL

SEQ ID NO: 899413 - protein, 422 aa, Homo sapiens; identical to SEQ ID NO: 899412

SEQ ID NO: 899414 - protein, 176 aa, Homo sapiens [sequence omitted]

SEQ ID NO: 899415 - protein, 422 aa, Homo sapiens; identical to SEQ ID NO: 899412

SEQ ID NO: 899416 - protein, 107 aa, Homo sapiens
MTERETPSQKIIIIIEKKRKDAPALLKSSQQKKGLPSTPCHSNRAFRSSVVLHGRIPGIPGPSPLSSLLYSGNGLSSPTFTCREGHVSLWLVLIEVENSRFLTSELP

SEQ ID NO: 899417 - protein, 137 aa, Homo sapiens
MSAHLQWMVVRNCSSFLIKRNKQTYSTEPNNLKARNSFRYNGLIHRKTVGVEPAADGKGVVVVIKRRSGQRKPATSYVRTTINRNARATLSSIRHMIRKNKYRPDLRMAAIRRASAILRSQKPVMVKRKRTRPTKSS

SEQ ID NO: 899418 - protein, 149 aa, Homo sapiens
MRRATLQQHQTHDPQEQVPPRPCAWQPSAGPSAILRSQKACDGEEEKRDPPHQELLSPRAPRANKGQLAFSPKQNKKGPGRSDNAPHIRPINQQLTISNDGRDVPRDSTYQGTKQHLVQKGSERDNPIIPQKVFPRRISGPLTIQASLS

SEQ ID NO: 899419 - protein, 137 aa, Homo sapiens; identical to SEQ ID NO: 899417

SEQ ID NO: 899420 - protein, 79 aa, Homo sapiens
PAATTTTTKFAAGRRNSFRYNGLIHRKTVGVEAGPADGEEVSWWSLSGDPGQRKPATSYVRTTINKKNASRHASAASDT

SEQ ID NO: 899421 - protein, 79 aa, Homo sapiens; identical to SEQ ID NO: 899420

SEQ ID NO: 899422 - protein, 137 aa, Homo sapiens; identical to SEQ ID NO: 899417

SEQ ID NO: 899423 - protein, 120 aa, Homo sapiens
MRRATLQQHQTHDPQEQVPPRPCAWQPSAGPSAILRSQKACDGEEEKRDPPHQELLSPRAPRANKGQLAFSPKKKKKKKKKNPGPGGGGGKNPGKSGGDHRVFGQRFLGPKKGKGKTGRG

SEQ ID NO: 899424 - protein, 133 aa, Homo sapiens
MGPRTSRIGATRKSSGRVSKTSERFPEYALGPLTEEFRIFPSVERIVGGSSRTSSSRLGGGDRQLLSCPPERKRKCVYGIKGVASPLAFLFPSQVAAAKGAAAMSAHLQWMVVRNCSSFLIKRNKQTYSTEPK

SEQ ID NO: 899425 - protein, 120 aa, Homo sapiens
KQAGTGRNFRDMQFLPLQRTDSPQDCGRGSRPSRRRRGVVVVIKRRSGPAEACHLLCADHHQQEKCVAPRFSSIRHMIRKNKYRPDLAHGSHPQGPAPSCAARKPVMVKRKSGTRPTKSS

SEQ ID NO: 899426 - protein, 137 aa, Homo sapiens; identical to SEQ ID NO: 899417

SEQ ID NO: 899427 - protein, 84 aa, Homo sapiens
VEMKPKNMIRYFRPTFPKRSNSFRYNGLIHRKTVGVEAGPADGEEVSWWSLSGDPGQRKPATSYVRTTINKKNASRHASAASDT

SEQ ID NO: 899428 - protein, 107 aa, Homo sapiens
RIPCSRSWNARLWAWSRPSRRRRGVVVVIKRRSGPAEACHLLCADHHQQEKCVAPRFSSIRHMIRKNKYRPDLAHGSHPQGPAPSCAARKPVMVKRKADPPTIQAPT

SEQ ID NO: 899429 - protein, 144 aa, Homo sapiens
PACAVQREVPQRRCGAPVGVRPCHGTQRDGVVGDDMDVGDALFQQQVFGFEASGHVGRRQGKRKGADPHLASRPHDLRLNAAGGCRPARGSSLRCRGWPLQAVHRARYLAMSRAMSAHLQWMVVRNCSSFLIKRNKQTYSTEPK

SEQ ID NO: 899430 - protein, 137 aa, Homo sapiens; identical to SEQ ID NO: 899417

SEQ ID NO: 899431 - protein, 120 aa, Homo sapiens
MRRATLQQHQTHDPQEQVPPRPCAWQPSAGPSAILRSQKACDGEEEKRDPPHQELLSPRAPRANKGQLAFSPASTGPPFLKRSGELWPCVLSFRPCHQNSACHLVHLEVMSMAGHAGGVG

SEQ ID NO: 899432 - protein, 66 aa, Homo sapiens
GSLIKLILFPPPPLFPSQVAALSVSGQVAAAEGAAAMSAHLQWMVVRNCSSFLIKRNKQTYSTEPK

SEQ ID NO: 899433 - protein, 120 aa, Homo sapiens; identical to SEQ ID NO: 899431

SEQ ID NO: 899434 - protein, 137 aa, Homo sapiens; identical to SEQ ID NO: 899417

SEQ ID NO: 899435 - protein, 137 aa, Homo sapiens; identical to SEQ ID NO: 899417

SEQ ID NO: 899436 - protein, 104 aa, Homo sapiens
MRRATLQQHQTHDPQEQVPPRPCAWQPSAGPSAILRSQKACDGEEEKRDPPHQELLSPRAPRANKGQLAFSPKKKSKSKQFKSGGGAQNQIGPKVSPFTFSVEG

SEQ ID NO: 899437 - protein, 149 aa, Homo sapiens; identical to SEQ ID NO: 899418

SEQ ID NO: 899438 - protein, 104 aa, Homo sapiens
MRRATLQQHQTHDPQEQVPPRPCAWQPSAGPSAILRSQKACDGEEEKRDPPHQELLSPRAPRANKGQLAFSPKTKKKKKKKKKKKKTRRRSNTCGRGAREREVQ

SEQ ID NO: 899439 - protein, 70 aa, Homo sapiens
MRRATLQQHQTHDPQEQVPPRPCAWQPSAGPSAILRSQKACDGEEEKRDPPHQELLSPRAPRAISRVPIP

SEQ ID NO: 899440 - protein, 33 aa, Homo sapiens
MGGGGEKRRKREEGGKRFGDPHFEAKGGREGGH

SEQ ID NO: 899441 - protein, 120 aa, Homo sapiens
MRRATLQQHQTHDPQEQVPPRPCAWQPSAGPSAILRSQKACDGEEENAGDPAPQPKGASLGRPPLGPPKEGKLKGSRLGLFLKNKQNKEKEQKKRHDQEKNHRAAAQKMGGPPINPPGRA

SEQ ID NO: 899442 - protein, 160 aa, Homo sapiens
MRRATLQQHQTHDPQEQVPPRPCAWQPSAGPSAILRSQKACDGEEEKRDPPHQELLSPRAPRANKGQLAFSPKKEKRPGRFEEMRVTQKSTERAHPEAALPEVGEGDRADFQNRPEVQSAAIGALQRLTKRPGGLPKIHPGAPRREPHGQNQGPDRETKR

SEQ ID NO: 899443 - protein, 74 aa, Homo sapiens
MIRKNKYRPDLAHGSHPQGPAQFKPHKLQPVGEGSFILDAPALCPATIKTRATCPFFLECGPCCPQKASFTHTF

SEQ ID NO: 899444 - protein, 109 aa, Homo sapiens
MIRKNKYRPDLAHGELGFGDQAWGDWPVLWGRASHYWLQYGLERDGFLLFSLLPTPSIGLGGGLWSVWAEPCSAPPPPGSHPQGPAPSCAARKPVMVKRKSGTRPTKSS

SEQ ID NO: 899445 - protein, 120 aa, Homo sapiens; identical to SEQ ID NO: 899431

SEQ ID NO: 899446 - protein, 120 aa, Homo sapiens; identical to SEQ ID NO: 899431

SEQ ID NO: 899447 - protein, 120 aa, Homo sapiens; identical to SEQ ID NO: 899431

SEQ ID NO: 899448 - protein, 120 aa, Homo sapiens; identical to SEQ ID NO: 899431

SEQ ID NO: 899449 - protein, 74 aa, Homo sapiens
KTPQQPHPQVHPITARYEAGGGAAAKGAAAMSAHLQWMVVRNCSSFLIKRNKQTYSTEAAIRRAERHPAQPESL

SEQ ID NO: 899450 - protein, 108 aa, Homo sapiens
MQSAALDAVSGVGCSQRRWMQSAALDAVRGVGCSQRRWMQSAAWDAVSGVGCSQSAALDAVSRRRWMQSVGGVGCSQAALDAVSGVGCSQRRWMQSAALDAVSGVGQS

SEQ ID NO: 899451 - protein, 191 aa, Homo sapiens
MRRATLQQHQTHDPQEQVPPRPCAWQPSAGPSAILRSQKACDGEEEKRDPPHQELLSPRAPRANKGQLAFSPKKKKKKKKPRGIKCGGGKKGTEGARGQRRFPGPKFSGPTGGKTGRDPQKGGRNKFRKTPGNLASGAREPPDYTPLITTESGDKDLLQTNPARNRGPSKDAAHRSEHEQPKHQSRTTQTV

SEQ ID NO: 899452 - protein, 183 aa, Homo sapiens
MCGPPSTRKMRRATLQQHQTHDPQEQVPPRPCAWQPSAGPSAILRSQKACDGEEEKRDPPHQELLSPRAPRANKGQLAFSPKKKKKKKKKKKKRGVFGGGGKTGLIKSDQLVPNVFFATRVFLVNRREITGAPQKESAYKFRNRALPVYCFHAQHKDGKSTNDTENGTITCVHTMEHNHTTEQ

SEQ ID NO: 899453 - protein, 93 aa, Homo sapiens
MLPERGGDAPESSRAPRTLENKERGAPQRERQDQHKAADQTGSAKTTQRRGKKKCRHRRTSGSEPTPPGGGPNNRATPTPPEDKTPTDETNTR

SEQ ID NO: 899454 - protein, 128 aa, Homo sapiens
MCGPPSTRKMRRATLQQHQTHDPQEQVPPRPCAWQPSAGPSAILRSQKACDGEEEKRDPPHQELLSPRAPRANKGQLAFSPKKKRKKPKETTKKKGGAPKKNPRGGPKDRATPTVVGTKGGRQKGGAK

SEQ ID NO: 899455 - protein, 105 aa, Homo sapiens
LLLLLLLLNSRPVDSRPSRRRRGVVVVIKRRSGPAEACHLLCADHHQQEKCVAPRFSSIRHMIRKNKYRPDLAHGSHPQGPAPSCAARKPVMVKRKSGTRPTKSS

SEQ ID NO: 899456 - protein, 70 aa, Homo sapiens; identical to SEQ ID NO: 899439

SEQ ID NO: 899457 - protein, 144 aa, Homo sapiens; identical to SEQ ID NO: 899429

SEQ ID NO: 899458 - protein, 120 aa, Homo sapiens; identical to SEQ ID NO: 899441

SEQ ID NO: 899459 - protein, 120 aa, Homo sapiens; identical to SEQ ID NO: 899431

SEQ ID NO: 899460 - protein, 409 aa, Homo sapiens
MCGPPSTRKMRRATLQQHQTHDPQEQVPPRPCAWQPSAGPSAILRSQKACDGEEEKRDPPHQELLSPRAPRANKGQLAFSPKKKKKKKKKKKKKRKKNERKKYHRGEGRLKEEGRRGSATEGETRENKEEGGPHTDEGSSGAGERGGKKRNRGAEQEHEELETGVKDDAHRAEAARHERGGGRKERREGRENTNNGARESGGRQTQTVVRPEGQQREGDDLCGIKTKQGGQARENVKEAKIDRKKDGRRGDTTSKMREAEQRPEVGGSSDRLIFIEAPHAPGARKTPRQERERRRGRRGKHENDRCPGEAPTRRALTRARATAQRRRATRYRDEDEQQGLRDKERETGGEGKYILEAQDDTPEQAHRAPSRTELLSSNLHAVAQCGQGNNDEERSRQPPSRHTTDGVDS

SEQ ID NO: 899461 - protein, 160 aa, Homo sapiens; identical to SEQ ID NO: 899442

SEQ ID NO: 899462 - protein, 34 aa, Homo sapiens
MALALRMAAMRRSRRYLFLRIMCLMLLSVARAFL

SEQ ID NO: 899463 - protein, 68 aa, Homo sapiens
MRRATLQQHQTHDPQEQVPPRPCAWQPSAGPSAILRSQKACDGEEEKRDPPHQELLSPRAPRANKVSW

SEQ ID NO: 899464 - protein, 41 aa, Homo sapiens
MIRKNKYRPDLAHGSHPQGPAPSCAARKPVMVKRKFKARQS

SEQ ID NO: 899465 - protein, 92 aa, Homo sapiens
MRRATLQQHQTHDPQEQVPPRPCAWQPSAGPSAILRSQKACDGEEEKRDPPHQELLSPRAPRANKGQLAFSPKEKNQQNGFPKKIQRKKSSE

SEQ ID NO: 899466 - protein, 116 aa, Homo sapiens
MRRATLQQHQTHDPQEQVPPRPCAWQPSAGPSAILRSQKACDGEEEKRDPPHQELLSPRAPRANKGQLAFSPVKKKIKTRGGARFPIAPIGSPIPFTGRRFPTAGWENPGGPHFNP

SEQ ID NO: 899467 - protein, 34 aa, Homo sapiens; identical to SEQ ID NO: 899462

SEQ ID NO: 899468 - protein, 120 aa, Homo sapiens; identical to SEQ ID NO: 899431

SEQ ID NO: 899469 - protein, 66 aa, Homo sapiens; identical to SEQ ID NO: 899432

SEQ ID NO: 899470 - protein, 55 aa, Homo sapiens
MIRKNKYRPDLAHEHIRRHTILRSQKACDGEEETEPTPPRDKENPATRKIKSATS

SEQ ID NO: 899471 - protein, 137 aa, Homo sapiens; identical to SEQ ID NO: 899417

SEQ ID NO: 899472 - protein, 137 aa, Homo sapiens; identical to SEQ ID NO: 899417

SEQ ID NO: 899473 - protein, 137 aa, Homo sapiens; identical to SEQ ID NO: 899417

SEQ ID NO: 899474 - protein, 137 aa, Homo sapiens; identical to SEQ ID NO: 899417

SEQ ID NO: 899475 - protein, 137 aa, Homo sapiens; identical to SEQ ID NO: 899417

SEQ ID NO: 899476 - protein, 137 aa, Homo sapiens; identical to SEQ ID NO: 899417

SEQ ID NO: 899477 - protein, 382 aa, Homo sapiens
WYRPGVRDEVSGTVPTTVRFVDSLICNSSRSFMDLKALLSSLNDFASLSFAESWDNVGLLVEPSPPHTVNTLFLTNDLTEEVMEEVLQKKADLILSYHPPIFRPMKRITWNTWKERLVIRALENRVGIYSPHTAYDAAPQGVNNWLAKGLGACTSRPIHPSKAPNYPTEGNHRVEFNVNYTQDLDKVMSAVKGIDGVSVTSFSARTGNEEQTRINLNCTQKALMQVVDFLSRNKQLYQKTEILSLEKPLLLHTGMGRLCTLDESVSLATMIDRIKRHLKLSHIRLALGVGRTLESQVKVVALCAGSGSSVLQGVEADLYLTGEMSHHDTLDAASQGINVILCEHSNTERGFLSDLRDMLDSHLENKINIILSETDRDPLQVV

SEQ ID NO: 899478 - protein, 377 aa, Homo sapiens
MLSSCVRPVPTTVRFVDSLICNSSRSFMDLKALLSSLNDFASLSFAESWDNVGLLVEPSPPHTVNTLFLTNDLTEEVMEEVLQKKADLILSYHPPIFRPMKRITWNTWKERLVIRALENRVGIYSPHTAYDAAPQGVNNWLAKGLGACTSRPIHPSKAPNYPTEGNHRVEFNVNYTQDLDKVMSAVKGIDGVSVTSFSARTGNEEQTRINLNCTQKALMQVVDFLSRNKQLYQKTEILSLEKPLLLHTGMGRLCTLDESVSLATMIDRIKRHLKLSHIRLALGVGRTLESQVKVVALCAGSGSSVLQGVEADLYLTGEMSHHDTLDAASQGINVILCEHSNTERGFLSDLRDMLDSHLENKINIILSETDRDPLQVV

SEQ ID NO: 899479 - protein, 377 aa, Homo sapiens; identical to SEQ ID NO: 899478

SEQ ID NO: 899480 - protein, 377 aa, Homo sapiens; identical to SEQ ID NO: 899478

SEQ ID NO: 899481 - protein, 285 aa, Homo sapiens
MLSSCVRPVPTTVRFVDSLICNSSRSFMDLKALLSSLNDFASLSFAESWDNVGLLVEPSPPHTVNTLFLTNDLTEEVMEEVLQKKADLILSYHPPIFRPMKRITWNTWKERLVIRALENRVGIYSPHTAYDAAPQGVNNWLAKGLGACTSRPIHPSKAPNYPTEGNHRVEFNVNYTQDLDKVMSAVKGIDGVSVTSFSARTGNEEQTRINLNCTQKALMQVVDFLSRNKQLYQKTEILSLEKSLKSKSWPCVLVLGAAFCRVLRLTFTSQVRCPIMILWMLLPKE

SEQ ID NO: 899482 - protein, 274 aa, Homo sapiens
MLSSCVRPVPTTVRFVDSLICNSSRSFMDLKALLSSLNDFASLSFAESWDNVGLLVEPSPPHTVNTLFLTNDLTEEVMEEVLQKKADLILSYHPPIFRPMKRITWNTWKERLVIRALENRVGIYSPHTAYDAAPQGVNNWLAKGLGACTSRPIHPSKAPNYPTEGNHRVEFNVNYTQDLDKVMSAVKGIDGVSVTSFSARTGNEEQTRINLNCTQKALMQVVDFLSRNKQLYQKTEILSLEKPLLLHTGMGRLCTLDESVSLATMIDRIYLIFA

SEQ ID NO: 899483 - protein, 350 aa, Homo sapiens
MDLKALLSSLNDFASLSFAESWDNVGLLVEPSPPHTVNTLFLTNDLTEEVMEEVLQKKADLILSYHPPIFRPMKRITWNTWKERLVIRALENRVGIYSPHTAYDAAPQGVNNWLAKGLGACTSRPIHPSKAPNYPTEGNHRVEFNVNYTQDLDKVMSAVKGIDGVSVTSFSARTGNEEQTRINLNCTQKALMQVVDFLSRNKQLYQKTEILSLEKPLLLHTGMGRLCTLDESVSLATMIDRIKRHLKLSHIRLALGVGRTLESQVKVVALCAGSGSSVLQGVEADLYLTGEMSHHDTLDAASQGINVILCEHSNTERGFLSDLRDMLDSHLENKINIILSETDRDPLQVV

SEQ ID NO: 899484 - protein, 377 aa, Homo sapiens; identical to SEQ ID NO: 899478

SEQ ID NO: 899485 - protein, 350 aa, Homo sapiens; identical to SEQ ID NO: 899483

SEQ ID NO: 899486 - protein, 390 aa, Homo sapiens
MLSSCVRPVPTTVRFVDSLICNSSRSFMDLKALLSSLNDFASLSFAESWDNVGLLVEPSPPHTVNTLFLTNDLTEEVMEEVLQKKADLILSYHPPIFRPMKRITWNTWKERLVIRALENRVGIYSPHTAYDAAPQGVNNWLAKGLGACTSRPIHPSKAPNYPTEGNHRVEFNVNYTQDLDKVMSAVKGIDGVSVTSFSARYNLFFSFFVCIYWTGNEEQTRINLNCTQKALMQVVDFLSRNKQLYQKTEILSLEKPLLLHTGMGRLCTLDESVSLATMIDRIKRHLKLSHIRLALGVGRTLESQVKVVALCAGSGSSVLQGVEADLYLTGEMSHHDTLDAASQGINVILCEHSNTERGFLSDLRDMLDSHLENKINIILSETDRDPLQVV

SEQ ID NO: 899487 - protein, 337 aa, Homo sapiens
MLSSCVRPVPTTVRFVDSLICNSSRSFMDLKALLSSLNDFASLSFAESWDNVGLLVEPSPPHTVNTLFLTNDLTEEVMEEVLQKKADLILSYHPPIFRPMKRITWNTWKERLVIRALENRVGIYSPHTAYDAAPQGVNNWLAKGLGACTSRPIHPSKAPNYPTEGNHRVEFNVNYTQDLDKVMSAVKGIDGVSVTSFSARTGNEEQTRINLNCTQKALMQVVDFLSRNKQLYQKTEILSLEKPLLLHTGMGRLCTLDESVSLATMIDRIKRHLKLSHIRLALGVGRTLESQVKVVALCAGSGSSVLQGVEADLYLTDNCRNIRITHSTNQLDANLNL

SEQ ID NO: 899488 - protein, 260 aa, Homo sapiens
MLSSCVRPVPTTVRFVDSLICNSSRSFMDLKALLSSLNDFASLSFAESWDNVGLLVEPSPPHTVNTLFLTNDLTEEVMEEVLQKKADLILSYHPPIFRPMKRITWNTWKERLVIRALENRVGIYSPHTAYDAAPQGVNNWLAKGLGACTSRPIHPSKAPNYPTEGNHRVEFNVNYTQDLDKVMSAVKGIDGVSVTSFSARTGNEEQTRINLNCTQKALMQVVDFLSRNKQLYQKTEILSLEKEGNKNILYLILKYCAHIF

SEQ ID NO: 899489 - protein, 313 aa, Homo sapiens
MDTSTNLDIGAQLIVEECPSTYSLTGMPDIKIEHPLDPNSEEGSAQGVAMGMKFILPNRFDMNVCSRFVKSLNEEDSKNIQDQVNSDLEVASVLFKAECNIHTSPSPGIQVRHVYTPSTTKHFSPIKQSTTLTNKHRGNEVSTTPLLANSLSVHQLAAQGEMLYLATRIEQENVINHTDEEGFTPLMWAAAHGQIAVVEFLLQNGADPQLLGKGRESALSLACSKGYTDIVKMLLDCGVDVNEYDWNGGTPLLYAVHGNHVKCVKMLLESGADPTIETDSGYNSMDLAVALGYRSVQQVIESHLLKLLQNIKE

SEQ ID NO: 899490 - protein, 179 aa, Homo sapiens [sequence omitted]

SEQ ID NO: 899491 - protein, 313 aa, Homo sapiens; identical to SEQ ID NO: 899489

SEQ ID NO: 899492 - protein, 116 aa, Homo sapiens
MDTSTNLDIGAQLIVEECPSTYSLTGMPDIKIEHPLDPNSEEGSAQGVAMGMKFILPNRFDMNVCSRFVKSLNEEDSKNIQDHLELLTSGDPPALASQSAGVTGVSTMPSLDFFFF

SEQ ID NO: 899493 - protein, 116 aa, Homo sapiens; identical to SEQ ID NO: 899492

SEQ ID NO: 899494 - protein, 1554 aa, Homo sapiens [sequence omitted]

SEQ ID NO: 899495 - protein, 107 aa, Homo sapiens
MVSFSMYMSFPGMDSNWWVLKSDFRLPTEEEIRAMVSPEQCCAYYSMIAAEQRLKDAGYGEKSFFAPEEETQLPEKKRNYLRRNATTEKKRNYLRRNATTEKKRNYL

SEQ ID NO: 899496 - protein, 2032 aa, Homo sapiens
MGPGCDLLLRTAATITAAAIMSDTDSDEDSAGGGPFSLAGFLFGNINGAGQLEGESVLDDECKKHLAGLGALGLGSLITELTANEELTGTDGALVNDEGWVRSTEDAVDYSDINEVAEDESRRYQQTMGSLQPLCHSDYDEDDYDADCEDIDCKLMPPPPPPPGPMKKDKDQDSITGVSENGEGIILPSIIAPSSLASEKVDFSSSSDSESEMGPQEATQAESEDGKLTLPLAGIMQHDATKLLPSVTELFPEFRPGKVLRFLRLFGPGKNVPSVWRSARRKRKKKHRELIQEEQIQEVECSVESEVSQKSLWNYDYAPPPPPEQCLSDDEVGKIETCRLRPMRGTNEFNEFSLIYVYIVNNTIADRICANFQMSNHGFNLSGCPFPIVKEKCLVGYAGMRGVDGDMLLNEEGLIDRWNVLRYISIVYILTPGKSSSVSLSSPPDCYTLYSLRTSGIRKFSLLYFFLLLQITMMAPVESKFSQSTGDIDKVTDTKPRVAEWRYGPARLWYDMLGVPEDGSGFDYGFKLRKTEHEPVIKSRMIEEFRKLEENNGTDLLADENFLMVTQLHWEDDIIWDGEDVKHKGTKPQRASLAGWLPSSMTRNAMAYNVQQGFAATLDDDKPWYSIFPIDNEDLVYGRWEDNIIWDAQAMPRLLEPPVLTLDPNDENLILEIPDEKEEATSNSPSKESKKESSLKKSRILLGKTGVIKEEPQQNMSQPEVKDPWNLSNDEYYYPKQQGLRGTFGGNIIQHSIPAVELRQPFFPTHMGPIKLRQFHRPPLKKYSFGALSQPGPHSVQPLLKHIKKKAKMREQERQASGGGEMFFMRTPQDLTGKDGDLILAEYSEENGPLMMQVGMATKIKNYYKRKPGKDPGAPDCKYGETVYCHTSPFLGSLHPGQLLQAFENNLFRAPIYLHKMPETDFLIIRTRQGYYIRELVDIFVVGQQCPLFEVPGPNSKRANTHIRDFLQVFIYRLFWKSKDRPRRIRMEDIKKAFPSHSESSIRKRLKLCADFKRTGMDSNWWVLKSDFRLPTEEEIRAMVSPEQCCAYYSMIAAEQRLKDAGYGEKSFFAPEEENEEDFQMKIDDEVRTAPWNTTRAFIAAMKGKCLLEVTGVADPTGCGEGFSYVKIPNKPTQQKDDKEPQPVKKTVTGTDADLRRLSLKNAKQLLRKFGVPEEEIKKLSRWEVIDVVRTMSTEQARSGEGPMSKFARGSRFSVAEHQERYKEECQRIFDLQNKVLSSTEVLSTDTDSSSAEDSDFEEMGKNIENMLQNKKTSSQLSREREEQERKELQRMLLAAGSAASGNNHRDDDTASVTSLNSSATGRCLKIYRTFRDEEGKEYVRCETVRKPAVIDAYVRIRTTKDEEFIRKFALFDEQHREEMRKERRRIQEQLRRLKRNQEKEKLKGPPEKKPKKMKERPDLKLKCGACGAIGHMRTNKFCPLYYQTNAPPSNPVAMTEEQEEELEKTVIHNDNEELIKVEGTKIVLGKQLIESADEVRRKSLVLKFPKQQLPPKKKRRVGTTVHCDYLNRPHKSIHRRRTDPMVTLSSILESIINDMRDLPNTYPFHTPVNAKVVKDYYKIITRPMDLQTLRENVRKRLYPSREEFREHLELIVKNSATYNGPKHSLTQISQSMLDLCDEKLKEKEDKLARLEKAINPLLDDDDQVAFSFILDNIVTQKMMAVPDSWPFHHPVNKKFVPDYYKVIVNPMDLETIRKNISKHKYQSRESFLDDVNLILANSVKYNGPESQYTKTAQEIVNVCYQTLTEYDEHLTQLEKDICTAKEAALEEAELESLDPMTPGPYTPQPPDLYDTNTSLSMSRDASVFQDESNMSVLDIPSATPEKQVTQEGEDGDGDLADEEEGTVQQPQASVLYEDLLMSEGEDDEEDAGSDEEGDNPFSAIQLSESGSDSDVGSGGIRPKQPRMLQENTRMDMENEESMMSYEGDGGEASHGLEDSNISYGSYEEPDPKSNTQDTSFSSIGGYEVSEEEEDEEEEEQRSGPSVLSQVHLSEDEEDSEDFHSIAGDSDLDSDE

SEQ ID NO: 899497 - protein, 1116 aa, Homo sapiens
MPETDFLIIRTRQGYYIRELVDIFVVGQQCPLFEVPGPNSKRANTHIRDFLQVFIYRLFWKSKDRPRRIRMEDIKKAFPSHSESSIRKRLKLCADFKRTGMDSNWWVLKSDFRLPTEEEIRAMVSPEQCCAYYSMIAAEQRLKDAGYGEKSFFAPEEENEEDFQMKIDDEVRTAPWNTTRAFIAAMKGKCLLEVTGVADPTGCGEGFSYVKIPNKPTQQKDDKEPQPVKKTVTGTDADLRRLSLKNAKQLLRKFGVPEEEIKKLSRWEVIDVVRTMSTEQARSGEGPMSKFARGSRFSVAEHQERYKEECQRIFDLQNKVLSSTEVLSTDTDSSSAEDSDFEEMGKNIENMLQNKKTSSQLSREREEQERKELQRMLLAAGSAASGNNHRDDDTASVTSLNSSATGRCLKIYRTFRDEEGKEYVRCETVRKPAVIDAYVRIRTTKDEEFIRKFALFDEQHREEMRKERRRIQEQLRRLKRNQEKEKLKGPPEKKPKKMKERPDLKLKCGACGAIGHMRTNKFCPLYYQTNAPPSNPVAMTEEQEEELEKTVIHNDNEELIKVEGTKIVLGKQLIESADEVRRKSLVLKFPKQQLPPKKKRRVGTTVHCDYLNRPHKSIHRRRTDPMVTLSSILESIINDMRDLPNTYPFHTPVNAKVVKDYYKIITRPMDLQTLRENVRKRLYPSREEFREHLELIVKNSATYNGPKHSLTQISQSMLDLCDEKLKEKEDKLARLEKAINPLLDDDDQVAFSFILDNIVTQKMMAVPDSWPFHHPVNKKFVPDYYKVIVNPMDLETIRKNISKHKYQSRESFLDDVNLILANSVKYNGPESQYTKTAQEIVNVCYQTLTEYDEHLTQLEKDICTAKEAALEEAELESLDPMTPGPYTPQPPDLYDTNTSLSMSRDASVFQDESNMSVLDIPSATPEKQVTQEGEDGDGDLADEEEGTVQQPQASVLYEDLLMSEGEDDEEDAGSDEEGDNPFSAIQLSESGSDSDVGSGGIRPKQPRMLQENTRMDMENEESMMSYEGDGGEASHGLEDSNISYGSYEEPDPKSNTQDTSFSSIGGYEVSEEEEDEEEEEQRSGPSVLSQVHLSEDEEDSEDFHSIAGDSDLDSDE

SEQ ID NO: 899498 - protein, 1959 aa, Homo sapiens
MGPGCDLLLRTAATITAAAIMSDTDSDEDSAGGGPFSLAGFLFGNINGAGQLEGESVLDDECKKHLAGLGALGLGSLITELTANEELTGTDGALVNDEGWVRSTEDAVDYSDINEVAEDESRRYQQTMGSLQPLCHSDYDEDDYDADCEDIDCKLMPPPPPPPGPMKKDKDQDSITGVSENGEGIILPSIIAPSSLASEKVDFSSSSDSESEMGPQEATQAESEDGKLTLPLAGIMQHDATKLLPSVTELFPEFRPGKVLRFLRLFGPGKNVPSVWRSARRKRKKKHRELIQEEQIQEVECSVESEVSQKSLWNYDYAPPPPPEQCLSDDEVGKIETCRLRPMRGTNEFNEFSLIYVYIVNNTIADRICANFQMSNHGFNLSGCPFPIVKEKCLVGYAGMRGVDGDMLLNEEGLIDRWNVLRYISIVYILTPGKSSSVSLSSPPDCYTLYSLRTSGIRKFSLLYFFLLLQITMMAPVESKFSQSTGDIDKVTDTKPRVAEWRYGPARLWYDMLGVPEDGSGFDYGFKLRKTEHEPVIKSRMIEEFRKLEENNGTDLLADENFLMVTQLHWEDDIIWDGEDVKHKGTKPQRASLAGWLPSSMTRNAMAYNVQQGFAATLDDDKPWYSIFPIDNEDLVYGRWEDNIIWDAQAMPRLLEPPVLTLDPNDENLILEIPDEKEEATSNSPSKESKKESSLKKSRILLGKTGVIKEEPQQNMSQPEVKDPWNLSNDEYYYPKQQGLRGTFGGNIIQHSIPAVELRQPFFPTHMGPIKLRQFHRPPLKKYSFGALSQPGPHSVQPLLKHIKKKAKMREQERQASGGGEMFFMRTPQDLTGKDGDLILAEYSEENGPLMMQVGMATKIKNYYKRKPGKDPGAPDCKYGETVYCHTSPFLGSLHPGQLLQAFENNLFRAPIYLHKMPETDFLIIRTRQGYYIRELVDIFVVGQQCPLFEVPGPNSKRANTHIRDFLQVFIYRLFWKSKDRPRRIRMEDIKKAFPSHSESSIRKRLKLCADFKRTGMDSNWWVLKSDFRLPTEEEIRAMVSPEQCCAYYSMIAAEQRLKDAGYGEKSFFAPEEENEEDFQMKIDDEVRTAPWNTTRAFIAAMKGKCLLEVTGVADPTGCGEGFSYVKIPNKPTQQKDDKEPQPVKKTVTGTDADLRRLSLKNAKQLLRKFGVPEEEIKKLSRWEVIDVVRTMSTEQARSGEGPMSKFARGSRFSVAEHQERYKEECQRIFDLQNKVLSSTEVLSTDTDSSSAEDSDFEEMGKNIENMLQNKKTSSQLSREREEQERKELQRMLLAAGSAASGNNHRDDDTASVTSLNSSATGRCLKIYRTFRDEEGKEYVRCETVRKPAVIDAYVRIRTTKDEEFIRKFALFDEQHREEMRKERRRIQEQLRRLKRNQEKEKLKGPPEKKPKKMKERPDLKLKCGACGAIGHMRTNKFCPLYYQTNAPPSNPVAMTEEQEEELEKTVIHNDNEELIKVEGTKIVLGKQLIESADEVRRKSLVLKFPKQQLPPKKKRRVGTTVHCDYLNRPHKSIHRRRTDPMVTLSSILESIINDMRDLPNTYPFHTPVNAKVVKDYYKIITRPMDLQTLRENVRKRLYPSREEFREHLELIVKNSATYNGPKHSLTQISQSMLDLCDEKLKEKEDKLARLEKAINPLLDDDDQVAFSFILDNIVTQKMMAVPDSWPFHHPVNKKFVPDYYKVIVNPMDLETIRKNISKHKYQSRESFLDDVNLILANSVKYNGPESQYTKTAQEIVNVCYQTLTEYDEHLTQLEKDICTAKEAALEEAELESLDPMTPGPYTPQPPDLYDTNTSLSMSRDASVFQDESNMSVLDIPSATPEKQVTQEGEDGDGDLADEEEGTVQQPQASVLYEDLLMSEGEDDEEDAGSDEEGDNPFSAIQLSESGSDSDVGSGGIRPKQPRMLQENTRMDMENEESMMSYEGDGGEASHGLEDSNIR

SEQ ID NO: 899499 - protein, 2027 aa, Homo sapiens
MGPGCDLLLRTAATITAAAIMSDTDSDEDSAGGGPFSLAGFLFGNINGAGQLEGESVLDDECKKHLAGLGALGLGSLITELTANEELTGTDGALVNDEGWVRSTEDAVDYSDINEVAEDESRRYQQTMGSLQPLCHSDYDEDDYDADCEDIDCKLMPPPPPPPGPMKKDKDQDSITGVSENGEGIILPSIIAPSSLASEKVDFSSSSDSESEMGPQEATQAESEDGKLTLPLAGIMQHDATKLLPSVTELFPEFRPGKVLRFLRLFGPGKNVPSVWRSARRKRKKKHRELIQEEQIQEVECSVESEVSQKSLWNYDYAPPPPPEQCLSDDEVGKIETCRLRPMRGTNEFNEFSLIYVYIVNNTIADRICANFQMSNHGFNLSGCPFPIVKEKCLVGYAGMRGVDGDMLLNEEGLIDRWNVLRYISIVYILTPGKSSSVSLSSPPDCYTLYSLRTSGIRKFSLLYFFLLLQITMMAPVESKFSQSTGDIDKVTDTKPRVAEWRYGPARLWYDMLGVPEDGSGFDYGFKLRKTEHEPVIKSRMIEEFRKLEENNGTDLLADENFLMVTQLHWEDDIIWDGEDVKHKGTKPQRASLAGWLPSSMTRNAMAYNVQQGFAATLDDDKPWYSIFPIDNEDLVYGRWEDNIIWDAQAMPRLLEPPVLTLDPNDENLILEIPDEKEEATSNSPSKESKKESSLKKSRILLGKTGVIKEEPQQNMSQPEVKDPWNLSNDEYYYPKQQGLRGTFGGNIIQHSIPAVELRQPFFPTHMGPIKLRQFHRPPLKKYSFGALSQPGPHSVQPLLKHIKKKAKMREQERQASGGGEMFFMRTPQDLTGKDGDLILAEYSEENGPLMMQVGMATKIKNYYKRKPGKDPGAPDCKYGETVYCHTSPFLGSLHPGQLLQAFENNLFRAPIYLHKMPETDFLIIRTRQGYYIRELVDIFVVGQQCPLFEVPGPNSKRANTHIRDFLQVFIYRLFWKSKDRPRRIRMEDIKKAFPSHSESSIRKRLKLCADFKRTGMDSNWWVLKSDFRLPTEEEIRAMVSPEQCCAYYSMIAAEQRLKDAGYGEKSFFAPEEENEEDFQMKIDDEVRTAPWNTTRAFIAAMKGKCLLEVTGVADPTGCGEGFSYVKIPNKPTQQKDDKEPQPVKKTVTGTDADLRRLSLKNAKQLLRKFGVPEEEIKKLSRWEVIDVVRTMSTEQARSGEGPMSKFARGSRFSVAEHQERYKEECQRIFDLQNKVLSSTEVLSTDTDSSSAEDSDFEEMGKNIENMLQNKKTSSQLSREREEQERKELQRMLLAAGSAASGNNHRDDDTASVTSLNSSATGRCLKIYRTFRDEEGKEYVRCETVRKPAVIDAYVRIRTTKDEEFIRKFALFDEQHREEMRKERRRIQEQLRRLKRNQEKEKLKGPPEKKPKKMKERPDLKLKCGACGAIGHMRTNKFCPLYYQTNAPPSNPVAMTEEQEEELEKTVIHNDNEELIKVEGTKIVLGKQLIESADEVRRKSLVLKFPKQQLPPKKKRRVGTTVHCDYLNRPHKSIHRRRTDPMVTLSSILESIINDMRDLPNTYPFHTPVNAKVVKDYYKIITRPMDLQTLRENVRKRLYPSREEFREHLELIVKNSATYNGPKHSLTQISQSMLDLCDEKLKEKEDKLARLEKAINPLLDDDDQVAFSFILDNIVTQKMMAVPDSWPFHHPVNKKFVPDYYKVIVNPMDLETIRKNISKHKYQSRESFLDDVNLILANSVKYNGPESQYTKTAQEIVNVCYQTLTEYDEHLTQLEKDICTAKEAALEEAELESLDPMTPGPYTPQPPDLYDTNTSLSMSRDASVFQDESNMSVLDIPSATPEKQVTQMRQGRGRLGEEDSDVDIEGYDDEEEDGKPKTPAPEGEDGDGDLADEEEGTVQQPQASVLYEDLLMSEGEDDEEDAGSDEEGDNPFSAIQLSESGSDSDVGSGGIRPKQPRMLQENTRMDMENEESMMSYEGDGGEASHGLEDSNIRWSLPLLPRLECSGVISAHCNLHLPGSSDFPASAS

SEQ ID NO: 899500 - protein, 1094 aa, Homo sapiens
MGPGCDLLLRTAATITAAAIMSDTDSDEDSAGGGPFSLAGFLFGNINGAGQLEGESVLDDECKKHLAGLGALGLGSLITELTANEELTGTDGALVNDEGWVRSTEDAVDYSDINEVAEDESRRYQQTMGSLQPLCHSDYDEDDYDADCEDIDCKLMPPPPPPPGPMKKDKDQDSITGVSENGEGIILPSIIAPSSLASEKVDFSSSSDSESEMGPQEATQAESEDGKLTLPLAGIMQHDATKLLPSVTELFPEFRPGKVLRFLRLFGPGKNVPSVWRSARRKRKKKHRELIQEEQIQEVECSVESEVSQKSLWNYDYAPPPPPEQCLSDDEVGKIETCRLRPMRGTNEFNEFSLIYVYIVNNTIADRICANFQMSNHGFNLSGCPFPIVKEKCLVGYAGMRGVDGDMLLNEEGLIDRWNVLRYISIVYILTPGKSSSVSLSSPPDCYTLYSLRTSGIRKFSLLYFFLLLQITMMAPVESKFSQSTGDIDKVTDTKPRVAEWRYGPARLWYDMLGVPEDGSGFDYGFKLRKTEHEPVIKSRMIEEFRKLEENNGTDLLADENFLMVTQLHWEDDIIWDGEDVKHKGTKPQRASLAGWLPSSMTRNAMAYNVQQGFAATLDDDKPWYSIFPIDNEDLVYGRWEDNIIWDAQAMPRLLEPPVLTLDPNDENLILEIPDEKEEATSNSPSKESKKESSLKKSRILLGKTGVIKEEPQQNMSQPEVKDPWNLSNDEYYYPKQQGLRGTFGGNIIQHSIPAVELRQPFFPTHMGPIKLRQFHRPPLKKYSFGALSQPGPHSVQPLLKHIKKKAKMREQERQASGGGEMFFMRTPQDLTGKDGDLILAEYSEENGPLMMQVGMATKIKNYYKRKPGKDPGAPDCKYGETVYCHTSPFLGSLHPGQLLQAFENNLFRAPIYLHKMPETDFLIIRTRQGYYIRELVDIFVVGQQCPLFEVPGPNSKRANTHIRDFLQVFIYRLFWKSKDRPRRIRMEDIKKAFPSHSESSIRKRLKLCADFKRTGMDSNWWVLKSDFRLPTEEEIRAMVSPEQCCAYYSMIAAEQRLKDAGYGEKSFFAPEEENEEDFQMKIDDEVRLYTSLY

SEQ ID NO: 899501 - protein, 337 aa, Homo sapiens
MGPGCDLLLRTAATITAAAIMSDTDSDEDSAGGGPFSLAGFLFGNINGAGQLEGESVLDDECKKHLAGLGALGLGSLITELTANEELTGTDGALVNDEGWVRSTEDAVDYSDINEVAEDESRRYQQTMGSLQPLCHSDYDEDDYDADCEDIDCKLMPPPPPPPGPMKKDKDQDSITGVSENGEGIILPSIIAPSSLASEKVDFSSSSDSESEMGPQEATQAESEDGKLTLPLAGIMQHDATKLLPSVTELFPEFRPGKVLRFLRLFGPGKNVPSVWRSARRKRKKKHRELIQEEQIQEVECSVESEVSQKSLWNYDYAPPPPPEQCLSDDEVGKIET

SEQ ID NO: 899502 - protein, 1872 aa, Homo sapiens
MGPGCDLLLRTAATITAAAIMSDTDSDEDSAGGGPFSLAGFLFGNINGAGQLEGESVLDDECKKHLAGLGALGLGSLITELTANEELTGTDGALVNDEGWVRSTEDAVDYSDINEVAEDESRRYQQTMGSLQPLCHSDYDEDDYDADCEDIDCKLMPPPPPPPGPMKKDKDQDSITGEKVDFSSSSDSESEMGPQEATQAESEDGKLTLPLAGIMQHDATKLLPSVTELFPEFRPGKVLRFLRLFGPGKNVPSVWRSARRKRKKKHRELIQEEQIQEVECSVESEVSQKSLWNYDYAPPPPPEQCLSDDEITMMAPVESKFSQSTGDIDKVTDTKPRVAEWRYGPARLWYDMLGVPEDGSGFDYGFKLRKTEHEPVIKSRMIEEFRKLEENNGTDLLADENFLMVTQLHWEDDIIWDGEDVKHKGTKPQRASLAGWLPSSMTRNAMAYNVQQGFAATLDDDKPWYSIFPIDNEDLVYGRWEDNIIWDAQAMPRLLEPPVLTLDPNDENLILEIPDEKEEATSNSPSKESKKESSLKKSRILLGKTGVIKEEPQQNMSQPEVKDPWNLSNDEYYYPKQQGLRGTFGGNIIQHSIPAVELRQPFFPTHMGPIKLRQFHRPPLKKYSFGALSQPGPHSVQPLLKHIKKKAKMREQERQASGGGEMFFMRTPQDLTGKDGDLILAEYSEENGPLMMQVGMATKIKNYYKRKPGKDPGAPDCKYGETVYCHTSPFLGSLHPGQLLQAFENNLFRAPIYLHKMPETDFLIIRTRQGYYIRELVDIFVVGQQCPLFEVPGPNSKRANTHIRDFLQVFIYRLFWKSKDRPRRIRMEDIKKAFPSHSESSIRKRLKLCADFKRTGMDSNWWVLKSDFRLPTEEEIRAMVSPEQCCAYYSMIAAEQRLKDAGYGEKSFFAPEEENEEDFQMKIDDEVRTAPWNTTRAFIAAMKGKCLLEVTGVADPTGCGEGFSYVKIPNKPTQQKDDKEPQPVKKTVTGTDADLRRLSLKNAKQLLRKFGVPEEEIKKLSRWEVIDVVRTMSTEQARSGEGPMSKFARGSRFSVAEHQERYKEECQRIFDLQNKVLSSTEVLSTDTDSSSAEDSDFEEMGKNIENMLQNKKTSSQLSREREEQERKELQRMLLAAGSAASGNNHRDDDTASVTSLNSSATGRCLKIYRTFRDEEGKEYVRCETVRKPAVIDAYVRIRTTKDEEFIRKFALFDEQHREEMRKERRRIQEQLRRLKRNQEKEKLKGPPEKKPKKMKERPDLKLKCGACGAIGHMRTNKFCPLYYQTNAPPSNPVAMTEEQEEELEKTVIHNDNEELIKVEGTKIVLGKQLIESADEVRRKSLVLKFPKQQLPPKKKRRVGTTVHCDYLNRPHKSIHRRRTDPMVTLSSILESIINDMRDLPNTYPFHTPVNAKVVKDYYKIITRPMDLQTLRENVRKRLYPSREEFREHLELIVKNSATYNGPKHSLTQISQSMLDLCDEKLKEKEDKLARLEKAINPLLDDDDQVAFSFILDNIVTQKMMAVPDSWPFHHPVNKKFVPDYYKVIVNPMDLETIRKNISKHKYQSRESFLDDVNLILANSVKYNGPESQYTKTAQEIVNVCYQTLTEYDEHLTQLEKDICTAKEAALEEAELESLDPMTPGPYTPQPPDLYDTNTSLSMSRDASVFQDESNMSVLDIPSATPEKQVTQEGEDGDGDLADEEEGTVQQPQASVLYEDLLMSEGEDDEEDAGSDEEGDNPFSAIQLSESGSDSDVGSGGIRPKQPRMLQENTRMDMENEESMMSYEGDGGEASHGLEDSNISYGSYEEPDPKSNTQDTSFSSIGGYEVSEEEEDEEEEEQRSGPSVLSQVHLSEDEEDSEDFHSIAGDSDLDSDE

SEQ ID NO: 899503 - protein, 1382 aa, Homo sapiens
MPRLLEPPVLTLDPNDENLILEIPDEKEEATSNSPSKESKKESSLKKSRILLGKTGVIKEEPQQNMSQPEVKDPWNLSNDEYYYPKQQGLRGTFGGNIIQHSIPAVELRQPFFPTHMGPIKLRQFHRPPLKKYSFGALSQPGPHSVQPLLKHIKKKAKMREQERQASGGGEMFFMRTPQDLTGKDGDLILAEYSEENGPLMMQVGMATKIKNYYKRKPGKDPGAPDCKYGETVYCHTSPFLGSLHPGQLLQAFENNLFRAPIYLHKMPETDFLIIRTRQGYYIRELVDIFVVGQQCPLFEVPGPNSKRANTHIRDFLQVFIYRLFWKSKDRPRRIRMEDIKKAFPSHSESSIRKRLKLCADFKRTGMDSNWWVLKSDFRLPTEEEIRAMVSPEQCCAYYSMIAAEQRLKDAGYGEKSFFAPEEENEEDFQMKIDDEVRTAPWNTTRAFIAAMKGKCLLEVTGVADPTGCGEGFSYVKIPNKPTQQKDDKEPQPVKKTVTGTDADLRRLSLKNAKQLLRKFGVPEEEIKKLSRWEVIDVVRTMSTEQARSGEGPMSKFARGSRFSVAEHQERYKEECQRIFDLQNKVLSSTEVLSTDTDSSSAEDSDFEEMGKNIENMLQNKKTSSQLSREREEQERKELQRMLLAAGSAASGNNHRDDDTASVTSLNSSATGRCLKIYRTFRDEEGKEYVRCETVRKPAVIDAYVRIRTTKDEEFIRKFALFDEQHREEMRKERRRIQEQLRRLKRNQEKEKLKGPPEKKPKKMKERPDLKLKCGACGAIGHMRTNKFCPLYYQTNAPPSNPVAMTEEQEEELEKTVIHNDNEELIKVEGTKIVLGKQLIESADEVRRKSLVLKFPKQQLPPKKKRRVGTTVHCDYLNRPHKSIHRRRTDPMVTLSSILESIINDMRDLPNTYPFHTPVNAKVVKDYYKIITRPMDLQTLRENVRKRLYPSREEFREHLELIVKNSATYNGPKHSLTQISQSMLDLCDEKLKEKEDKLARLEKAINPLLDDDDQVAFSFILDNIVTQKMMAVPDSWPFHHPVNKKFVPDYYKVIVNPMDLETIRKNISKHKYQSRESFLDDVNLILANSVKYNGPESQYTKTAQEIVNVCYQTLTEYDEHLTQLEKDICTAKEAALEEAELESLDPMTPGPYTPQPPDLYDTNTSLSMSRDASVFQDESNMSVLDIPSATPEKQVTQEGEDGDGDLADEEEGTVQQPQASVLYEDLLMSEGEDDEEDAGSDEEGDNPFSAIQLSESGSDSDVGSGGIRPKQPRMLQENTRMDMENEESMMSYEGDGGEASHGLEDSNISYGSYEEPDPKSNTQDTSFSSIGGYEVSEEEEDEEEEEQRSGPSVLSQVHLSEDEEDSEDFHSIAGDSDLDSDE

SEQ ID NO: 899504 - protein, 2066 aa, Homo sapiens
MGPGCDLLLRTAATITAAAIMSDTDSDEDSAGGGPFSLAGFLFGNINGAGQLEGESVLDDECKKHLAGLGALGLGSLITELTANEELTGTDGALVNDEGWVRSTEDAVDYSDINEVAEDESRRYQQTMGSLQPLCHSDYDEDDYDADCEDIDCKLMPPPPPPPGPMKKDKDQDSITGVSENGEGIILPSIIAPSSLASEKVDFSSSSDSESEMGPQEATQAESEDGKLTLPLAGIMQHDATKLLPSVTELFPEFRPGKVLRFLRLFGPGKNVPSVWRSARRKRKKKHRELIQEEQIQEVECSVESEVSQKSLWNYDYAPPPPPEQCLSDDEVGKIETCRLRPMRGTNEFNEFSLIYVYIVNNTIADRICANFQMSNHGFNLSGCPFPIVKEKCLVGYAGMRGVDGDMLLNEEGLIDRWNVLRYISIVYILTPGKSSSVSLSSPPDCYTLYSLRTSGIRKFSLLYFFLLLQITMMAPVESKFSQSTGDIDKVTDTKPRVAEWRYGPARLWYDMLGVPEDGSGFDYGFKLRKTEHEPVIKSRMIEEFRKLEENNGTDLLADENFLMVTQLHWEDDIIWDGEDVKHKGTKPQRASLAGWLPSSMTRNAMAYNVQQGFAATLDDDKPWYSIFPIDNEDLVYGRWEDNIIWDAQAMPRLLEPPVLTLDPNDENLILEIPDEKEEATSNSPSKESKKESSLKKSRILLGKTGVIKEEPQQNMSQPEVKDPWNLSNDEYYYPKQQGLRGTFGGNIIQHSIPAVELRQPFFPTHMGPIKLRQFHRPPLKKYSFGALSQPGPHSVQPLLKHIKKKAKMREQERQASGGGEMFFMRTPQDLTGKDGDLILAEYSEENGPLMMQVGMATKIKNYYKRKPGKDPGAPDCKYGETVYCHTSPFLGSLHPGQLLQAFENNLFRAPIYLHKMPETDFLIIRTRQGYYIRELVDIFVVGQQCPLFEVPGPNSKRANTHIRDFLQVFIYRLFWKSKDRPRRIRMEDIKKAFPSHSESSIRKRLKLCADFKRTGMDSNWWVLKSDFRLPTEEEIRAMVSPEQCCAYYSMIAAEQRLKDAGYGEKSFFAPEEENEEDFQMKIDDEVRTAPWNTTRAFIAAMKGKCLLEVTGVADPTGCGEGFSYVKIPNKPTQQKDDKEPQPVKKTVTGTDADLRRLSLKNAKQLLRKFGVPEEEIKKLSRWEVIDVVRTMSTEQARSGEGPMSKFARGSRFSVAEHQERYKEECQRIFDLQNKVLSSTEVLSTDTDSSSAEDSDFEEMGKNIENMLQNKKTSSQLSREREEQERKELQRMLLAAGSAASGNNHRDDDTASVTSLNSSATGRCLKIYRTFRDEEGKEYVRCETVRKPAVIDAYVRIRTTKDEEFIRKFALFDEQHREEMRKERRRIQEQLRRLKRNQEKEKLKGPPEKKPKKMKERPDLKLKCGACGAIGHMRTNKFCPLYYQTNAPPSNPVAMTEEQEEELEKTVIHNDNEELIKVEGTKIVLGKQLIESADEVRRKSLVLKFPKQQLPPKKKRRVGTTVHCDYLNRPHKSIHRRRTDPMVTLSSILESIINDMRDLPNTYPFHTPVNAKVVKDYYKIITRPMDLQTLRENVRKRLYPSREEFREHLELIVKNSATYNGPKHSLTQISQSMLDLCDEKLKEKEDKLARLEKAINPLLDDDDQVAFSFILDNIVTQKMMAVPDSWPFHHPVNKKFVPDYYKVIVNPMDLETIRKNISKHKYQSRESFLDDVNLILANSVKYNGPESQYTKTAQEIVNVCYQTLTEYDEHLTQLEKDICTAKEAALEEAELESLDPMTPGPYTPQPPDLYDTNTSLSMSRDASVFQDESNMSVLDIPSATPEKQVTQMRQGRGRLGEEDSDVDIEGYDDEEEDGKPKTPAPEGEDGDGDLADEEEGTVQQPQASVLYEDLLMSEGEDDEEDAGSDEEGDNPFSAIQLSESGSDSDVGSGGIRPKQPRMLQENTRMDMENEESMMSYEGDGGEASHGLEDSNISYGSYEEPDPKSNTQDTSFSSIGGYEVSEEEEDEEEEEQRSGPSVLSQVHLSEDEEDSEDFHSIAGDSDLDSDE

SEQ ID NO: 899505 - protein, 1644 aa, Homo sapiens
MGPGCDLLLRTAATITAAAIMSDTDSDEDSAGGGPFSLAGFLFGNINGAGQLEGESVLDDECKKHLAGLGALGLGSLITELTANEELTGTDGALVNDEGWVRSTEDAVDYSDINEVAEDESRRYQQTMGSLQPLCHSDYDEDDYDADCEDIDCKLMPPPPPPPGPMKKDKDQDSITGVSENGEGIILPSIIAPSSLASEKVDFSSSSDSESEMGPQEATQAESEDGKLTLPLAGIMQHDATKLLPSVTELFPEFRPGKVLRFLRLFGPGKNVPSVWRSARRKRKKKHRELIQEEQIQEVECSVESEVSQKSLWNYDYAPPPPPEQCLSDDEVGKIETCRLRPMRGTNEFNEFSLIYVYIVNNTIADRICANFQMSNHGFNLSGCPFPIVKEKCLVGYAGMRGVDGDMLLNEEGLIDRWNVLRYISIVYILTPGKSSSVSLSSPPDCYTLYSLRTSGIRKFSLLYFFLLLQITMMAPVESKFSQSTGDIDKVTDTKPRVAEWRYGPARLWYDMLGVPEDGSGFDYGFKLRKTEHEPVIKSRMIEEFRKLEENNGTDLLADENFLMVTQLHWEDDIIWDGEDVKHKGTKPQRASLAGWLPSSMTRNAMAYNVQQGFAATLDDDKPWYSIFPIDNEDLVYGRWEDNIIWDAQAMPRLLEPPVLTLDPNDENLILEIPDEKEEATSNSPSKESKKESSLKKSRILLGKTGVIKEEPQQNMSQPEVKDPWNLSNDEYYYPKQQGLRGTFGGNIIQHSIPAVELRQPFFPTHMGPIKLRQFHRPPLKKYSFGALSQPGPHSVQPLLKHIKKKAKMREQERQASGGGEMFFMRTPQDLTGKDGDLILAEYSEENGPLMMQVGMATKIKNYYKRKPGKDPGAPDCKYGETVYCHTSPFLGSLHPGQLLQAFENNLFRAPIYLHKMPETDFLIIRTRQGYYIRELVDIFVVGQQCPLFEVPGPNSKRANTHIRDFLQVFIYRLFWKSKDRPRRIRMEDIKKAFPSHSESSIRKRLKLCADFKRTGMDSNWWVLKSDFRLPTEEEIRAMVSPEQCCAYYSMIAAEQRLKDAGYGEKSFFAPEEENEEDFQMKIDDEVRTAPWNTTRAFIAAMKGKCLLEVTGVADPTGCGEGFSYVKIPNKPTQQKDDKEPQPVKKTVTGTDADLRRLSLKNAKQLLRKFGVPEEEIKKLSRWEVIDVVRTMSTEQARSGEGPMSKFARGSRFSVAEHQERYKEECQRIFDLQNKVLSSTEVLSTDTDSSSAEDSDFEEMGKNIENMLQNKKTSSQLSREREEQERKELQRMLLAAGSAASGNNHRDDDTASVTSLNSSATGRCLKIYRTFRDEEGKEYVRCETVRKPAVIDAYVRIRTTKDEEFIRKFALFDEQHREEMRKERRRIQEQLRRLKRNQEKEKLKGPPEKKPKKMKERPDLKLKCGACGAIGHMRTNKFCPLYYQTNAPPSNPVAMTEEQEEELEKTVIHNDNEELIKVEGTKIVLGKQLIESADEVRRKSLVLKFPKQQLPPKKKRRVGTTVHCDYLNRPHKSIHRRRTDPMVTLSSILESIINDMRDLPNTYPFHTPVNAKVVKDYYKIITRPMDLQTLRENVRKRLYPSREEFREHLELIVKNSATYNGIGIRIKHTRSIEKGHSHHHLPRE

SEQ ID NO: 899506 - protein, 910 aa, Homo sapiens
MGPGCDLLLRTAATITAAAIMSDTDSDEDSAGGGPFSLAGFLFGNINGAGQLEGESVLDDECKKHLAGLGALGLGSLITELTANEELTGTDGALVNDEGWVRSTEDAVDYSDINEVAEDESRRYQQTMGSLQPLCHSDYDEDDYDADCEDIDCKLMPPPPPPPGPMKKDKDQDSITGVSENGEGIILPSIIAPSSLASEKVDFSSSSDSESEMGPQEATQAESEDGKLTLPLAGIMQHDATKLLPSVTELFPEFRPGKVLRFLRLFGPGKNVPSVWRSARRKRKKKHRELIQEEQIQEVECSVESEVSQKSLWNYDYAPPPPPEQCLSDDEVGKIETCRLRPMRGTNEFNEFSLIYVYIVNNTIADRICANFQMSNHGFNLSGCPFPIVKEKCLVGYAGMRGVDGDMLLNEEGLIDRWNVLRYISIVYILTPGKSSSVSLSSPPDCYTLYSLRTSGIRKFSLLYFFLLLQITMMAPVESKFSQSTGDIDKVTDTKPRVAEWRYGPARLWYDMLGVPEDGSGFDYGFKLRKTEHEPVIKSRMIEEFRKLEENNGTDLLADENFLMVTQLHWEDDIIWDGEDVKHKGTKPQRASLAGWLPSSMTRNAMAYNVQQGFAATLDDDKPWYSIFPIDNEDLVYGRWEDNIIWDAQAMPRLLEPPVLTLDPNDENLILEIPDEKEEATSNSPSKESKKESSLKKSRILLGKTGVIKEEPQQNMSQPEVKDPWNLSNDEYYYPKQQGLRGTFGGNIIQHSIPAVELRQPFFPTHMGPIKLRQFHRPPLKKYSFGALSQPGPHSVQPLLKHIKKKAKMREQERQASGGGEMFFMRTPQDLTGKDGDLILAEYSEENGPLMMQVGMATKIKNYYKRKPGYSGEYKSVRNNELINVDFPNPDSPTTISVNSKPLFTDFLYT

SEQ ID NO: 899507 - protein, 119 aa, Homo sapiens
RVFTDHQPVLFPSRNRHKDQTHKVDRKGAQSSPPSSRIAFFDFPDLDKCISPLNSYNNYCLCNSFSQLPLGIIQCPTPLLKVTASRTTVQLRQLLNQSKTLRDRPGTVAHACNPSSLGS

SEQ ID NO: 899508 - protein, 690 aa, Homo sapiens
TRGSADSGYQLSGSLTWAGARHRRMAASRKPPRVRVNHQDFQLRNLRIIEPNEVTHSGDTGVETDGRMPPKVTSELLRQLRQAMRNSEYVTEPIQAYIIPSGDAHQSEYIAPCDCRRAFVSGFDGSAGTAIITEEHAAMWTDGRYFLQAAKQMDSNWTLMKMGLKDTPTQEDWLVSVLPEGSRVGVDPLIIPTDYWKKMAKVLRSAGHHLIPVKENLVDKIWTDRPERPCKPLLTLGLDYTGISWKDKVADLRLKMAERNVMWFVVTALDEIAWLFNLRGSDVEHNPVFFSYAIIGLETIMLFIDGDRIDAPSVKEHLLLDLGLEAEYRIQVHPYKSILSELKALCADLSPREKVWVSDKASYAVSETIPKDHRCCMPYTPICIAKAVKNSAESEGMRRAHIKDAVALCELFNWLEKEVPKGGVTEISAADKAEEFRRQQADFVDLSFPTISSTGPNGAIIHYAPVPETNRTLSLDEVYLIDSGAQYKDGTTDVTRTMHFGTPTAYEKECFTYVLKGHIAVSAAVFPTGTKGHLLDSFARSALWDSGLDYLHGTGHGVGSFLNVHEGPCGISYKTFSDEPLEAGMIVTDEPGYYEDGAFGIRIENVVLVVPVKTKYNFNNRGSLTFEPLTLVPIQTKMIDVDSLTDKECDWLNNYHLTCRDVIGKELQKQGRQEALEWLIRETQPISKQH

SEQ ID NO: 899509 - protein, 173 aa, Homo sapiens
LSRLLRAGPSAGDQLVCAPLTWAGARHRRMAASRKPPRVRVNHQDFQLRNLRIIEPNEVTHSGDTGVETDGRMPPKVTSELLRQLRQAMRNSEYVTEPIQAYIIPSGDAHQSEYIAPCDCRRAFVSGFDGSAGTAIITEEHAAMWTDGRYFLQAAKQMDSNWTLMKMGGYRHG

SEQ ID NO: 899510 - protein, 695 aa, Homo sapiens
LSRLLRAGPSAGDQLVCAPLTWAGARHRRMAASRKPPRVRVNHQDFQLRNLRIIEPNEVTHSGDTGVETDGRMPPKVTSELLRQLRQAMRNSEYVTEPIQAYIIPSGDAHQSEYIAPCDCRRAFVSGFDGSAGTAIITEEHAAMWTDGRYFLQAAKQMDSNWTLMKMGLKDTPTQEDWLVSVLPEGSRVGVDPLIIPTDYWKKMAKVLRSAGHHLIPVKENLVDKIWTDRPERPCKPLLTLGLDYTGISWKDKVADLRLKMAERNVMWFVVTALDEIAWLFNLRGSDVEHNPVFFSYAIIGLETIMLFIDGDRIDAPSVKEHLLLDLGLEAEYRIQVHPYKSILSELKALCADLSPREKVWVSDKASYAVSETIPKDHRCCMPYTPICIAKAVKNSAESEGMRRAHIKDAVALCELFNWLEKEVPKGGVTEISAADKAEEFRRQQADFVDLSFPTISSTGPNGAIIHYAPVPETNRTLSLDEVYLIDSGAQYKDGTTDVTRTMHFGTPTAYEKECFTYVLKGHIAVSAAVFPTGTKGHLLDSFARSALWDSGLDYLHGTGHGVGSFLNVHEGPCGISYKTFSDEPLEAGMIVTDEPGYYEDGAFGIRIENVVLVVPVKTKYNFNNRGSLTFEPLTLVPIQTKMIDVDSLTDKECDWLNNYHLTCRDVIGKELQKQGRQEALEWLIRETQPISKQH

SEQ ID NO: 899511 - protein, 674 aa, Homo sapiens
PRTPAANAPSPTQSHREYRVNHQDFQLRNLRIIEPNEVTHSGDTGVETDGRMPPKVTSELLRQLRQAMRNSEYVTEPIQAYIIPSGDAHQSEYIAPCDCRRAFVSGFDGSAGTAIITEEHAAMWTDGRYFLQAAKQMDSNWTLMKMGLKDTPTQEDWLVSVLPEGSRVGVDPLIIPTDYWKKMAKVLRSAGHHLIPVKENLVDKIWTDRPERPCKPLLTLGLDYTGISWKDKVADLRLKMAERNVMWFVVTALDEIAWLFNLRGSDVEHNPVFFSYAIIGLETIMLFIDGDRIDAPSVKEHLLLDLGLEAEYRIQVHPYKSILSELKALCADLSPREKVWVSDKASYAVSETIPKDHRCCMPYTPICIAKAVKNSAESEGMRRAHIKDAVALCELFNWLEKEVPKGGVTEISAADKAEEFRRQQADFVDLSFPTISSTGPNGAIIHYAPVPETNRTLSLDEVYLIDSGAQYKDGTTDVTRTMHFGTPTAYEKECFTYVLKGHIAVSAAVFPTGTKGHLLDSFARSALWDSGLDYLHGTGHGVGSFLNVHEGPCGISYKTFSDEPLEAGMIVTDEPGYYEDGAFGIRIENVVLVVPVKTKYNFNNRGSLTFEPLTLVPIQTKMIDVDSLTDKECDWLNNYHLTCRDVIGKELQKQGRQEALEWLIRETQPISKQH

SEQ ID NO: 899512 - protein, 695 aa, Homo sapiens; identical to SEQ ID NO: 899510

SEQ ID NO: 899513 - protein, 623 aa, Homo sapiens
MPPKVTSELLRQLRQAMRNSEYVTEPIQAYIIPSGDAHQSEYIAPCDCRRAFVSGFDGSAGTAIITEEHAAMWTDGRYFLQAAKQMDSNWTLMKMGLKDTPTQEDWLVSVLPEGSRVGVDPLIIPTDYWKKMAKVLRSAGHHLIPVKENLVDKIWTDRPERPCKPLLTLGLDYTGISWKDKVADLRLKMAERNVMWFVVTALDEIAWLFNLRGSDVEHNPVFFSYAIIGLETIMLFIDGDRIDAPSVKEHLLLDLGLEAEYRIQVHPYKSILSELKALCADLSPREKVWVSDKASYAVSETIPKDHRCCMPYTPICIAKAVKNSAESEGMRRAHIKDAVALCELFNWLEKEVPKGGVTEISAADKAEEFRRQQADFVDLSFPTISSTGPNGAIIHYAPVPETNRTLSLDEVYLIDSGAQYKDGTTDVTRTMHFGTPTAYEKECFTYVLKGHIAVSAAVFPTGTKGHLLDSFARSALWDSGLDYLHGTGHGVGSFLNVHEGPCGISYKTFSDEPLEAGMIVTDEPGYYEDGAFGIRIENVVLVVPVKTKYNFNNRGSLTFEPLTLVPIQTKMIDVDSLTDKECDWLNNYHLTCRDVIGKELQKQGRQEALEWLIRETQPISKQH

SEQ ID NO: 899514 - protein, 314 aa, Homo sapiens
MPYTPICIAKAVKNSAESEGMRRAHIKDAVALCELFNWLEKEVPKGGVTEISAADKAEEFRRQQADFVDLSFPTISSTGPNGAIIHYAPVPETNRTLSLDEVYLIDSGAQYKDGTTDVTRTMHFGTPTAYEKECFTYVLKGHIAVSAAVFPTGTKGHLLDSFARSALWDSGLDYLHGTGHGVGSFLNVHEGPCGISYKTFSDEPLEAGMIVTDEPGYYEDGAFGIRIENVVLVVPVKTKYNFNNRGSLTFEPLTLVPIQTKMIDVDSLTDKECDWLNNYHLTCRDVIGKELQKQGRQEALEWLIRETQPISKQH

SEQ ID NO: 899515 - protein, 552 aa, Homo sapiens
MWTDGRYFLQAAKQMDSNWTLMKMGLKDTPTQEDWLVSVLPEGSRVGVDPLIIPTDYWKKMAKVLRSAGHHLIPVKENLVDKIWTDRPERPCKPLLTLGLDYTGISWKDKVADLRLKMAERNVMWFVVTALDEIAWLFNLRGSDVEHNPVFFSYAIIGLETIMLFIDGDRIDAPSVKEHLLLDLGLEAEYRIQVHPYKSILSELKALCADLSPREKVWVSDKASYAVSETIPKDHRCCMPYTPICIAKAVKNSAESEGMRRAHIKDAVALCELFNWLEKEVPKGGVTEISAADKAEEFRRQQADFVDLSFPTISSTGPNGAIIHYAPVPETNRTLSLDEVYLIDSGAQYKDGTTDVTRTMHFGTPTAYEKECFTYVLKGHIAVSAAVFPTGTKGHLLDSFARSALWDSGLDYLHGTGHGVGSFLNVHEGPCGISYKTFSDEPLEAGMIVTDEPGYYEDGAFGIRIENVVLVVPVKTKYNFNNRGSLTFEPLTLVPIQTKMIDVDSLTDKECDWLNNYHLTCRDVIGKELQKQGRQEALEWLIRETQPISKQH

SEQ ID NO: 899516 - protein, 552 aa, Homo sapiens; identical to SEQ ID NO: 899515

SEQ ID NO: 899517 - protein, 663 aa, Homo sapiens
LSRLLRAGPSAGDQLVCAPLTWAGARHRRMAASRKPPRVRVNHQDFQLRNLRIIEPNEVTHSGDTGVETDGRMPPKVTSELLRQLRQAMRNSEYVTEPIQAYIIPSGDAHQSEYIAPCDCRRAFVSGFDGSAGTAIITEEHAAMWTDGRYFLQAAKQMDSNWTLMKMGLKDTPTQEDWLVSVLPEGSRVGVDPLIIPTDYWKKMAKVLRSAGHHLIPVKENLVDKIWTDRPERPCKPLLTLGLDYTGLFNLRGSDVEHNPVFFSYAIIGLETIMLFIDGDRIDAPSVKEHLLLDLGLEAEYRIQVHPYKSILSELKALCADLSPREKVWVSDKASYAVSETIPKDHRCCMPYTPICIAKAVKNSAESEGMRRAHIKDAVALCELFNWLEKEVPKGGVTEISAADKAEEFRRQQADFVDLSFPTISSTGPNGAIIHYAPVPETNRTLSLDEVYLIDSGAQYKDGTTDVTRTMHFGTPTAYEKECFTYVLKGHIAVSAAVFPTGTKGHLLDSFARSALWDSGLDYLHGTGHGVGSFLNVHEGPCGISYKTFSDEPLEAGMIVTDEPGYYEDGAFGIRIENVVLVVPVKTKYNFNNRGSLTFEPLTLVPIQTKMIDVDSLTDKECDWLNNYHLTCRDVIGKELQKQGRQEALEWLIRETQPISKQH

SEQ ID NO: 899518 - protein, 614 aa, Homo sapiens
LSRLLRAGPSAGDQLVCAPLTWAGARHRRMAASRKPPRVRVNHQDFQLRNLRIIEPNEVTHSGDTGVETDGRMPPKVTSELLRQLRQAMRNSEYVTEPIQAYIIPSGDAHQSEYIAPCDCRRAFVSGFDGSAGTAIITEEHAAMWTDGRYFLQAAKQMDSNWTLMKMGLKDTPTQEDWLVSVLPEGSRVGVDPLIIPTDYWKKMAKVLRSAGHHLIPVKENLVDKIWTDRPERPCKPLLTLGLDYTGISWKDKVADLRLKMAERNVMWFVVTALDEIAWLFNLRGSDVEHNPVFFSYAIIGLETIMLFIDGDRIDAPSVKEHLLLDLGLEAEYRIQVHPYKSILSELKALCADLSPREKVWVSDKASYAVSETIPKDHRCCMPYTPICIAKAVKNSAESEGMRRAHIKDAVALCELFNWLEKEVPKGGVTEISAADKAEEFRRQQADFVDLSFPTISSTGPNGAIIHYAPVPETNRTLSLDEVYLIDSGAQYKDGTTDVTRTMHFGTPTAYEKECFTYVLKGHIAVSAAVFPTGTKGHLLDSFARSALWDSGLDYLHGTGHGVGSFLNVHEGPCGISYKTFSDEPLEAGMIVTDEPGTMKMGFWIHHPASYLAV

SEQ ID NO: 899519 - protein, 566 aa, Homo sapiens
LSRLLRAGPSAGDQLVCAPLTWAGARHRRMAASRKPPRVRVNHQDFQLRNLRIIEPNEVTHSGDTGVETDGRMPPKVTSELLRQLRQAMRNSEYVTEPIQAYIIPSGDAHQSEYIAPCDCRRAFVSGFDGSAGTAIITEEHAAMWTDGRYFLQAAKQMDSNWTLMKMGLKDTPTQEDWLVSVLPEGSRVGVDPLIIPTDYWKKMAKVLRSAGHHLIPVKENLVDKIWTDRPERPCKPLLTLGLDYTGISWKDKVADLRLKMAERNVMWFVVTALDEIAWLFNLRGSDVEHNPVFFSYAIIGLETIMLFIDGDRIDAPSVKEHLLLDLGLEAEYRIQVHPYKSILSELKALCADLSPREKVWVSDKASYAVSETIPKDHRCCMPYTPICIAKAVKNSAESEGMRRAHIKDAVALCELFNWLEKEVPKGGVTEISAADKAEEFRRQQADFVDLSFPTISSTGPNGAIIHYAPVPETNRTLSLDEVYLIDSGAQYKDGTTDVTRTMHFGTPTAYEKECFTYVLKGHIAVSAAVFPTGTKDTFLTPFARSAFIGNSRGPKDLTFGHGGKP

SEQ ID NO: 899520 - protein, 647 aa, Homo sapiens
LSRLLRAGPSAGDQLVCAPLTWAGARHRRMAASRKPPRVRVNHQDFQLRNLRIIEPNEVTHSGDTGVETDGRMPPKVTSELLRQLRQAMRNSEYVTEPIQAYIIPSGDAHQSEYIAPCDCRRAFVSGFDGSAGTAIITEEHAAMWTDGRYFLQAAKQMDSNWTLMKMGLKDTPTQEDWLVSVLPEGSRVGVDPLIIPTGISWKDKVADLRLKMAERNVMWFVVTALDEIAWLFNLRGSDVEHNPVFFSYAIIGLETIMLFIDGDRIDAPSVKEHLLLDLGLEAEYRIQVHPYKSILSELKALCADLSPREKVWVSDKASYAVSETIPKDHRCCMPYTPICIAKAVKNSAESEGMRRAHIKDAVALCELFNWLEKEVPKGGVTEISAADKAEEFRRQQADFVDLSFPTISSTGPNGAIIHYAPVPETNRTLSLDEVYLIDSGAQYKDGTTDVTRTMHFGTPTAYEKECFTYVLKGHIAVSAAVFPTGTKGHLLDSFARSALWDSGLDYLHGTGHGVGSFLNVHEGPCGISYKTFSDEPLEAGMIVTDEPGYYEDGAFGIRIENVVLVVPVKTKYNFNNRGSLTFEPLTLVPIQTKMIDVDSLTDKECDWLNNYHLTCRDVIGKELQKQGRQEALEWLIRETQPISKQH

SEQ ID NO: 899521 - protein, 435 aa, Homo sapiens
MAERNVMWFVVTALDEIAWLFNLRGSDVEHNPVFFSYAIIGLETIMLFIDGDRIDAPSVKEHLLLDLGLEAEYRIQVHPYKSILSELKALCADLSPREKVWVSDKASYAVSETIPKDHRCCMPYTPICIAKAVKNSAESEGMRRAHIKDAVALCELFNWLEKEVPKGGVTEISAADKAEEFRRQQADFVDLSFPTISSTGPNGAIIHYAPVPETNRTLSLDEVYLIDSGAQYKDGTTDVTRTMHFGTPTAYEKECFTYVLKGHIAVSAAVFPTGTKGHLLDSFARSALWDSGLDYLHGTGHGVGSFLNVHEGPCGISYKTFSDEPLEAGMIVTDEPGYYEDGAFGIRIENVVLVVPVKTKYNFNNRGSLTFEPLTLVPIQTKMIDVDSLTDKECDWLNNYHLTCRDVIGKELQKQGRQEALEWLIRETQPISKQH

SEQ ID NO: 899522 - protein, 473 aa, Homo sapiens
TRGSADSGYQLSGSLTWAGARHRRMAASRKPPRVRVNHQDFQLRNLRIIEPNEVTHSGDTGVETDVEHNPVFFSYAIIGLETIMLFIDGDRIDAPSVKEHLLLDLGLEAEYRIQVHPYKSILSELKALCADLSPREKVWVSDKASYAVSETIPKDHRCCMPYTPICIAKAVKNSAESEGMRRAHIKDAVALCELFNWLEKEVPKGGVTEISAADKAEEFRRQQADFVDLSFPTISSTGPNGAIIHYAPVPETNRTLSLDEVYLIDSGAQYKDGTTDVTRTMHFGTPTAYEKECFTYVLKGHIAVSAAVFPTGTKGHLLDSFARSALWDSGLDYLHGTGHGVGSFLNVHEGPCGISYKTFSDEPLEAGMIVTDEPGYYEDGAFGIRIENVVLVVPVKTKYNFNNRGSLTFEPLTLVPIQTKMIDVDSLTDKECDWLNNYHLTCRDVIGKELQKQGRQEALEWLIRETQPISKQH

SEQ ID NO: 899523 - protein, 160 aa, Homo sapiens
MHFGTPTAYEKECFTYVLKGHIAVSAAVFPTGTKGHLLDSFARSALWDSGLDYLHGTGHGVGSFLNVHEGPCGISYKTFSDEPLEAGMIVTDEPGYYEDGAFGIRIENVVLVVPVKTKCDWLNNYHLTCRDVIGKELQKQGRQEALEWLIRETQPISKQH

SEQ ID NO: 899524 - protein, 146 aa, Homo sapiens [sequence omitted]

SEQ ID NO: 899525 - protein, 199 aa, Homo sapiens
TRGSADSGYQLSGSLTWAGARHRRMAASRKPPRVRVNHQDFQLRNLRIIEPNEVTHSGDTGVETDGRMPPKVTSELLRQLRQAMRNSEYVTEPIQAYIIPSGDAHQSEYIAPCDCRRAFVSGFDGSAGTAIITEEHAAMWTDGRYFLQAAKQMDSNWTLMKMGPDRDSSQASSDSPGPGLEDGGFALEKGMPKGLWGGA

SEQ ID NO: 899526 - protein, 666 aa, Homo sapiens
MAASRKPPRVRVNHQDFQLRNLRIIEPNEVTHSGDTGVETDGRMPPKVTSELLRQLRQAMRNSEYVTEPIQAYIIPSGDAHQSEYIAPCDCRRAFVSGFDGSAGTAIITEEHAAMWTDGRYFLQAAKQMDSNWTLMKMGLKDTPTQEDWLVSVLPEGSRVGVDPLIIPTDYWKKMAKVLRSAGHHLIPVKENLVDKIWTDRPERPCKPLLTLGLDYTGISWKDKVADLRLKMAERNVMWFVVTALDEIAWLFNLRGSDVEHNPVFFSYAIIGLETIMLFIDGDRIDAPSVKEHLLLDLGLEAEYRIQVHPYKSILSELKALCADLSPREKVWVSDKASYAVSETIPKDHRCCMPYTPICIAKAVKNSAESEGMRRAHIKDAVALCELFNWLEKEVPKGGVTEISAADKAEEFRRQQADFVDLSFPTISSTGPNGAIIHYAPVPETNRTLSLDEVYLIDSGAQYKDGTTDVTRTMHFGTPTAYEKECFTYVLKGHIAVSAAVFPTGTKGHLLDSFARSALWDSGLDYLHGTGHGVGSFLNVHEGPCGISYKTFSDEPLEAGMIVTDEPGYYEDGAFGIRIENVVLVVPVKTKYNFNNRGSLTFEPLTLVPIQTKMIDVDSLTDKECDWLNNYHLTCRDVIGKELQKQGRQEALEWLIRETQPISKQH

SEQ ID NO: 899527 - protein, 666 aa, Homo sapiens
VCNFLFFLSLRVNHQDFQLRNLRIIEPNEVTHSGDTGVETDGRMPPKVTSELLRQLRQAMRNSEYVTEPIQAYIIPSGDAHQSEYIAPCDCRRAFVSGFDGSAGTAIITEEHAAMWTDGRYFLQAAKQMDSNWTLMKMGLKDTPTQEDWLVSVLPEGSRVGVDPLIIPTDYWKKMAKVLRSAGHHLIPVKENLVDKIWTDRPERPCKPLLTLGLDYTGISWKDKVADLRLKMAERNVMWFVVTALDEIAWLFNLRGSDVEHNPVFFSYAIIGLETIMLFIDGDRIDAPSVKEHLLLDLGLEAEYRIQVHPYKSILSELKALCADLSPREKVWVSDKASYAVSETIPKDHRCCMPYTPICIAKAVKNSAESEGMRRAHIKDAVALCELFNWLEKEVPKGGVTEISAADKAEEFRRQQADFVDLSFPTISSTGPNGAIIHYAPVPETNRTLSLDEVYLIDSGAQYKDGTTDVTRTMHFGTPTAYEKECFTYVLKGHIAVSAAVFPTGTKGHLLDSFARSALWDSGLDYLHGTGHGVGSFLNVHEGPCGISYKTFSDEPLEAGMIVTDEPGYYEDGAFGIRIENVVLVVPVKTKYNFNNRGSLTFEPLTLVPIQTKMIDVDSLTDKECDWLNNYHLTCRDVIGKELQKQGRQEALEWLIRETQPISKQH

SEQ ID NO: 899528 - protein, 678 aa, Homo sapiens
LSRLLRAGPSAGDQLVCAPLTWAGARHRRMAASRKPPRVRVNHQDFQLRNLRIIEPNEVTHSGDTGVETDGRMPPKVTSELLRQLRQAMRNSEYVTEPIQAYIIPSGDAHQSEYIAPCDCRRAFVSGFDGSAGTAIITEEHAAMWTDGRYFLQAAKQMDSNWTLMKMGLKDTPTQEDWLVSVLPEGSRVGVDPLIIPTDYWKKMAKVLRSAGHHLIPVKENLVDKIWTDRPERPCKPLLTLGLDYTGISWKDKVADLRLKMAERNVMWFVVTALDEIAWLFNLRGSDVEHNPVFFSYAIIGLETIMLFIDGDRIDAPSVKEHLLLDLGLEAEYRIQVHPYKSILSELKALCADLSPREKVWVSDKASYAVSETIPKDHRCCMPYTPICIAKAVKNSAESEGMRRAHVPKGGVTEISAADKAEEFRRQQADFVDLSFPTISSTGPNGAIIHYAPVPETNRTLSLDEVYLIDSGAQYKDGTTDVTRTMHFGTPTAYEKECFTYVLKGHIAVSAAVFPTGTKGHLLDSFARSALWDSGLDYLHGTGHGVGSFLNVHEGPCGISYKTFSDEPLEAGMIVTDEPGYYEDGAFGIRIENVVLVVPVKTKYNFNNRGSLTFEPLTLVPIQTKMIDVDSLTDKECDWLNNYHLTCRDVIGKELQKQGRQEALEWLIRETQPISKQH

SEQ ID NO: 899529 - protein, 625 aa, Homo sapiens
LSRLLRAGPSAGDQLVCAPLTWAGARHRRMAASRKPPRVRVNHQDFQLRNLRIIEPNEVTHSGDTGVETDGRMPPKVTSELLRQLRQAMRNSEYVTEPIQAYIIPSGDAHQSEYIAPCDCRRAFVSGFDGSAGTAIITEEHAAMWTDGRYFLQAAKQMDSNWTLMKMGLKDTPTQEDWLVSVLPEGSRVGVDPLIIPTDYWKKMAKVLRSAGHHLIPVKENLVDKIWTDRPERPCKPLLTLGLDYTGISWKDKVADLRLKMAERNVMWFVVTALDEIAWLFNLRGSDVEHNPVFFSYAIIGLETIMLFIDGDRIDAPSVKEHLLLDLGLEAEYRIQVHPYKSILSELKALCADLSPREKVWVSDKASYAVSETIPKDHRCCMPYTPICIAKAVKNSAESEGMRRAHIKDAVALCELFNWLEKEVPKGGVTEISAADKAEEFRRQQADFVDLSFPTISSTGPNGAIIHYAPVPETNRTLSLDEVYLIDSGAQYKDGTTDVTRTMHFGTPTAYEKECFTYVLKGHIAVSAAVFPTGTKGHLLDSFARSALWDSGLDYLHGTGHGVGSFLNVHEGPCGIKRRNPSPNSINKYLPGFVFVKCSGGRKKRGRSLTSFPFPFLLPYLPFLL

SEQ ID NO: 899530 - protein, 552 aa, Homo sapiens; identical to SEQ ID NO: 899515

SEQ ID NO: 899531 - protein, 492 aa, Homo sapiens
MAKVLRSAGHHLIPVKENLVDKIWTDRPERPCKPLLTLGLDYTGISWKDKVADLRLKMAERNVMWFVVTALDEIAWLFNLRGSDVEHNPVFFSYAIIGLETIMLFIDGDRIDAPSVKEHLLLDLGLEAEYRIQVHPYKSILSELKALCADLSPREKVWVSDKASYAVSETIPKDHRCCMPYTPICIAKAVKNSAESEGMRRAHIKDAVALCELFNWLEKEVPKGGVTEISAADKAEEFRRQQADFVDLSFPTISSTGPNGAIIHYAPVPETNRTLSLDEVYLIDSGAQYKDGTTDVTRTMHFGTPTAYEKECFTYVLKGHIAVSAAVFPTGTKGHLLDSFARSALWDSGLDYLHGTGHGVGSFLNVHEGPCGISYKTFSDEPLEAGMIVTDEPGYYEDGAFGIRIENVVLVVPVKTKYNFNNRGSLTFEPLTLVPIQTKMIDVDSLTDKECDWLNNYHLTCRDVIGKELQKQGRQEALEWLIRETQPISKQH

SEQ ID NO: 899532 - protein, 549 aa, Homo sapiens
MRCVKIGTEEQMDSNCTLMKMGLKDTPTQEDWLVSVLPEGSRVGVDPLIIPTDYWKKMAKVLRSAGHHLIPVKENLVDKIWTDRPERPCKPLLTLGLDYTGISWKDKVADLRLKMAERNVMWFVVTALDEIAWLFNLRGSDVEHNPVFFSYAIIGLETIMLFIDGDRIDAPSVKEHLLLDLGLEAEYRIQVHPYKSILSELKALCADLSPREKVWVSDKASYAVSETIPKDHRCCMPYTPICIAKAVKNSAESEGMRRAHIKDAVALCELFNWLEKEVPKGGVTEISAADKAEEFRRQQADFVDLSFPTISSTGPNGAIIHYAPVPETNRTLSLDEVYLIDSGAQYKDGTTDVTRTMHFGTPTAYEKECFTYVLKGHIAVSAAVFPTGTKGHLLDSFARSALWDSGLDYLHGTGHGVGSFLNVHEGPCGISYKTFSDEPLEAGMIVTDEPGYYEDGAFGIRIENVVLVVPVKTKYNFNNRGSLTFEPLTLVPIQTKMIDVDSLTDKECDWLNNYHLTCRDVIGKELQKQGRQEALEWLIRETQPISKQH

SEQ ID NO: 899533 - protein, 549 aa, Homo sapiens
LSRLLRAGPSAGDQLVCAPLTWAGARHRRMAASRKPPRVRVNHQDFQLRNLRIIEPNEVTHSGDTGVETDGRMPPKVTSELLRQLRQAMRNSEYVTEPIQAYIIPSGDAHQSEYIAPCDCRRAFVSGFDGSAGTAIITEEHAAMWTDGRYFLQAAKQMDSNWTLMKMGLKDTPTQEDWLVSVLPEGSRVGVDPLIIPTDYWKKMAKVLRSAGHHLIPVKENLVDKIWTDRPERPCKPLLTLGLDYTGISWKDKVADLRLKMAERNVMWFVVTALDEIAWLFNLRGSDVEHNPVFFSYAIIGLETIMLFIDGDRIDAPSVKEHLLLDLGLEAEYRIQVHPYKSILSELKALCADLSPREKVWVSDKASYAVSETIPKDHRCCMPYTPICIAKAVKNSAESEGMRRAHIKDAVALCELFNWLEKEVPKGGVTEISAADKAEEFRRQQADFVDLSFPTISSTGPNGAIIHYAPVPETNRTLSLDEVYLIDSGAQYKDGTTDVTRTMHFGTPTAYEKECFTYVLKGHIAVSAAVFPTGTKDLVKGRCPDFFGQ

SEQ ID NO: 899534 - protein, 390 aa, Homo sapiens
MLFIDGDRIDAPSVKEHLLLDLGLEAEYRIQVHPYKSILSELKALCADLSPREKVWVSDKASYAVSETIPKDHRCCMPYTPICIAKAVKNSAESEGMRRAHIKDAVALCELFNWLEKEVPKGGVTEISAADKAEEFRRQQADFVDLSFPTISSTGPNGAIIHYAPVPETNRTLSLDEVYLIDSGAQYKDGTTDVTRTMHFGTPTAYEKECFTYVLKGHIAVSAAVFPTGTKGHLLDSFARSALWDSGLDYLHGTGHGVGSFLNVHEGPCGISYKTFSDEPLEAGMIVTDEPGYYEDGAFGIRIENVVLVVPVKTKYNFNNRGSLTFEPLTLVPIQTKMIDVDSLTDKECDWLNNYHLTCRDVIGKELQKQGRQEALEWLIRETQPISKQH

SEQ ID NO: 899535 - protein, 520 aa, Homo sapiens
LSRLLRAGPSAGDQLVCAPLTWAGARHRRMAASRKPPRVRVNHQDFQLRNLRIIEPNEVTHSGDTGVETDGRMPPKVTSELLRQLRQAMRNSEYVTEPIQAYIIPSGDAHQSEYIAPCDCRRAFVSGFDGSAGTAIITEEHAAMWTDGRYFLQAAKQMDSNWTLMKMGLKDTPTQEDWLVSVLPEGSRVGVDPLIIPTDYWKKMAKVLRSAGHHLIPVKENLVDKIWTDRPERPCKPLLTLGLDYTGISWKDKVADLRLKMAERNVMWFVVTALDEIAWLFNLRGSDVEHNPVFFSYAIIGLETIMLFIDGDRIDAPSVKEHLLLDLGLEAEYRIQVHPYKSILSELKALCADLSPREKVWVSDKASYAVSETIPKDHRCCMPYTPICIAKAVKNSAESEGMRRAHVPKGGVTEISAADKAEEFRRQQADFVDLSFPTISSTGPNGAIIHYAPVPETNRTLSLDEVYLIDSGAQYKDGTTDVTRTMHFGTPTAYEKECFTYVLKGHIAVSAAVFPTGTKG

SEQ ID NO: 899536 - protein, 268 aa, Homo sapiens
LSRLLRAGPSAGDQLVCAPLTWAGARHRRMAASRKPPRVRVNHQDFQLRNLRIIEPNEVTHSGDTGVETDGRMPPKVTSELLRQLRQAMRNSEYVTEPIQAYIIPSGDAHQSEYIAPCDCRRAFVSGFDGSAGTAIITEEHAAMWTDGRYFLQAAKQMDSNWTLMKMGLKDTPTQEDWLVSVLPEGSRVGVDPLIIPTDYWKKMAKVLRSAGHHLIPVKENLVDKIWTVFYDFLIVENKPRIKLLHQKEGPSKVEHLVKGRCPDFFGQ

SEQ ID NO: 899537 - protein, 198 aa, Homo sapiens
AAVERSVATVTRAGRCPTMSVRVARVAWVRGLGASYRRGASSFPVPPPGAQGVAELLRDATGAEEEAPWAATERRMPGQCSVLLFPGQGSQVVGMGRGLLNYPRVRELYAAARRVLGYDLLELSLHGPQETLDRTVHCQPAIFVASLAAVEKLHHLQPSVIENCVAAAGFSVGEFAALVFAGAMEFAEGSTVSPEEFL

SEQ ID NO: 899538 - protein, 408 aa, Homo sapiens
AAVERSVATVTRAGRCPTMSVRVARVAWVRGLGASYRRGASSFPVPPPGAQGVAELLRDATGAEEEAPWAATERRMPGQCSVLLFPGQGSQVVGMGRGLLNYPRVRELYAAARRVLGYDLLELSLHGPQETLDRTVHCQPAIFVASLAAVEKLHHLQPSVIENCVAAAGFSVGEFAALVFAGAMEFAEGLYAVKIRAEAMQEASEAVPSGMLSVLGQPQSKFNFACLEAREHCKSLGIENPVCEVSNYLFPDCRVISGHQEALRFLQKNSSKFHFRRTRMLPVSGAFHTRLMEPAVEPLTQALKAVDIKKPLVSVYSNVHAHRYRHPGHIHKLLAQQLVSPVKWEQTMHAIYERKKGRGFPQTFEVGPGRQLGAILKSCNMQAWKSYSAVDVLQTLEHVDLDPQEPPR

SEQ ID NO: 899539 - protein, 408 aa, Homo sapiens; identical to SEQ ID NO: 899538

SEQ ID NO: 899540 - protein, 419 aa, Homo sapiens
AAVERSVATVTRAGRCPTMSVRVARVAWVRGLGASYRRGASSFPVPPPGAQGVAELLRDATGAEEEAPWAATERRMPGQCSVLLFPGQGSQVVGMGRGLLNYPRVRELYAAARRVLGYDLLELSLHGPQETLDRTVHCQPAIFVASLAAVEKLHHLQPSVRPEAPDRRGKVIENCVAAAGFSVGEFAALVFAGAMEFAEGLYAVKIRAEAMQEASEAVPSGMLSVLGQPQSKFNFACLEAREHCKSLGIENPVCEVSNYLFPDCRVISGHQEALRFLQKNSSKFHFRRTRMLPVSGAFHTRLMEPAVEPLTQALKAVDIKKPLVSVYSNVHAHRYRHPGHIHKLLAQQLVSPVKWEQTMHAIYERKKGRGFPQTFEVGPGRQLGAILKSCNMQAWKSYSAVDVLQTLEHVDLDPQEPPR

SEQ ID NO: 899541 - protein, 211 aa, Homo sapiens
AAVERSVATVTRAGRCPTMSVRVARVAWVRGLGASYRRGASSFPVPPPGAQGVAELLRDATGAEEEAPWAATERRMPGQCSVLLFPGQGSQVVGMGRGLLNYPRVRELYAAARRVLGYDLLELSLHGPQETLDRTVHCQPAIFVASLAAVEKLHHLQPSVHPPRPPKVLGLQVIENCVAAAGFSVGEFAALVFAGAMEFAEGSTVSPEEFL

SEQ ID NO: 899542 - protein, 408 aa, Homo sapiens; identical to SEQ ID NO: 899538

SEQ ID NO: 899543 - protein, 198 aa, Homo sapiens; identical to SEQ ID NO: 899537

SEQ ID NO: 899544 - protein, 165 aa, Homo sapiens
AAVERSVATVTRAGRCPTMSVRVARVAWVRGLGASYRRGASSFPVPPPGAQGVAELLRDATGAEEEAPWAATERRMPGQCSVLLFPGQGSQVVGMGRGLLNYPRVRELYAAARRVLGYDLLELSLHGPQETLDRTVHCQPAIFVASLAAVEKLHHLQPSVRPEAP

SEQ ID NO: 899545 - protein, 85 aa, Homo sapiens
RHSGFICLQADYVSSSLSSLSLDPPPELFSRPFRLRTGLRHNGAIFGLAGVGHHAPATPLPFRGTIKGAARRLHLFASRSWKCSY

SEQ ID NO: 899546 - protein, 109 aa, Homo sapiens
MQVFRVQMSVDIIGTPFSRVRIRRPATHGLPLPIVMVLFLNLFCEKAPRYFKLELQEKHQVGLFLNGSHPSADYCCLPTTFHLVTPLKLSTSTIFFFYHKAFFQMESCF

SEQ ID NO: 899547 - protein, 85 aa, Homo sapiens; identical to SEQ ID NO: 899545

SEQ ID NO: 899548 - protein, 85 aa, Homo sapiens; identical to SEQ ID NO: 899545

SEQ ID NO: 899549 - protein, 85 aa, Homo sapiens; identical to SEQ ID NO: 899545

SEQ ID NO: 899550 - protein, 157 aa, Homo sapiens
MIGEIAAAVSFISKFLRLAEAARLIPVLAAQPGWFLEIVLSGTTVLFLKPCPLFPSPHMHNNGCNPGHFKKLIVFIFAPQRSLGRRNPQWELTILSVVSLFFFSSIEHYKHHWFPEKPCKGSGYRCIRINHKMDPLIGQAAQRIGLSSQELFRLLPK

SEQ ID NO: 899551 - protein, 85 aa, Homo sapiens; identical to SEQ ID NO: 899545

SEQ ID NO: 899552 - protein, 85 aa, Homo sapiens; identical to SEQ ID NO: 899545

SEQ ID NO: 899553 - protein, 85 aa, Homo sapiens; identical to SEQ ID NO: 899545

SEQ ID NO: 899554 - protein, 85 aa, Homo sapiens; identical to SEQ ID NO: 899545

SEQ ID NO: 899555 - protein, 85 aa, Homo sapiens; identical to SEQ ID NO: 899545

SEQ ID NO: 899556 - protein, 72 aa, Homo sapiens
EAGAAVRGPSADLGTKEPWGWEHYKHHWFPEKPCKGSGYRCIRINHKMDPLIGQAAQRIGLSSQELFRLLPK

SEQ ID NO: 899557 - protein, 105 aa, Homo sapiens
MIGEIAAAVSFISKFLRTKGLTSERQLQTFSQSLQELLAASDYVKIRWEDDCPQDRKRALTEEPNGQYLDLDFSTQEPGEMNVCCSSHPVNGIWLWAAQLTRERI

SEQ ID NO: 899558 - protein, 423 aa, Homo sapiens
MGFWGSASHRDPLAPKVPVTGWAPSCLSWNTLLGWFWSWRSCQSADLTSHLSRISLAGVEPSLVQAALGQLVRLSCSDDTAPESQAAWQKDGQPISSDRHRLQFDGSLIIHPLQAEDAGTYSCGSTRPGRDSQKIQLRIIGGDMAVLSEAELSRFPQPRDPAQDFGQAGAAGPLGAIPSSHPQPANRLRLDQNQPRVVDASPGQRIRMTCRAEGFPPPAIEWQRDGQPVSSPRHQLQPDGSLVISRVAVEDGGFYTCVAFNGQDRDQRWVQLRVLGELTISGLPPTVTVPEGDTARLLCVVAGESVNIRWSRNGLPVQADGHRVHQSPDGTLLIYNLRARDEGSYTCSAYQGSQAVSRSTEVKVVSPAPTAQPRDPGRDCVDQPELANCDLILQAQLCGNEYYSSFCCASCSRFQPHAQPIWQ

SEQ ID NO: 899559 - protein, 251 aa, Homo sapiens
RRPRPPLLLRRHPGRPASPELARAWPRGPSAHGAGGAVGMGPMWRMRGGATRRGSCCGGDGAADGRGPGRSGRARGGGSPSGGGGGVGWRGRADGARQQLEERFADLAASHLEAIRARDEWDRQNARLRQENARLRLENRRLKRENRSLFRQALRLPGEGGNGTPAEARRVPEEASTNRRARDSGREDEPGSPRALRARLEKLEAMYRRALLQLHLEQRGPRPSGDKEEQPLQEPDSGLRSRDSEPSGPWL

SEQ ID NO: 899560 - protein, 251 aa, Homo sapiens; identical to SEQ ID NO: 899559

SEQ ID NO: 899561 - protein, 184 aa, Homo sapiens
ARESGVGLGCDYAASSYSAEERGGWDWGVVQAIHGFRETEKSRWSEASRAILQRVQAAAFGPGQTLLSSVHVLDLEARGYIKPHVDSIKFCGATIAGLSLLSPSVMRLVHTQEPGEWLELLLEPGSLYILRGSARYDFSHEILRDEESFFGERRIPRGRRISVICRSLPEGMGPGESGQPPPAC

SEQ ID NO: 899562 - protein, 92 aa, Homo sapiens
MAGTGLLALRTLPGPSWVRGSGPSVLSRLQDAAVVRPGFLSTAEEETLSRELEPELRRRRYEYDHWDAKTTLPGRTIGDRCGWSMKRKSSSR

SEQ ID NO: 899563 - protein, 221 aa, Homo sapiens
MAGTGLLALRTLPGPSWVRGSGPSVLSRLQDAAVVRPGFLSTAEEETLSRELEPELRRRRYEYDHWDAAIHGFRETEKSRWSEASRAILQRVQAAAFGPGQTLLSSVHVLDLEARGYIKPHVDSIKFCGATIAGLSLLSPSVMRLVHTQEPGEWLELLLEPGSLYILRGSARYDFSHEILRDEESFFGERRIPRGRRISVICRSLPEGMGPGESGQPPPAC

SEQ ID NO: 899564 - protein, 221 aa, Homo sapiens; identical to SEQ ID NO: 899563

SEQ ID NO: 899565 - protein, 184 aa, Homo sapiens; identical to SEQ ID NO: 899561

SEQ ID NO: 899566 - protein, 221 aa, Homo sapiens; identical to SEQ ID NO: 899563

SEQ ID NO: 899567 - protein, 180 aa, Homo sapiens
WGIERSPSTKVYTCPNKPEIVLQAALSKCMLRVPGSKGSTGGFNRGHCFRRRKHMFHGVSWGVLTAVALHSLLYLLGSNARQPSSSASSRRAEREQLFLQSWKFDTIRFELLEIQHMLNLKYKGEKINQLLKHKNEYQGPDQISHSSFLATLSAPHAPEYPPKKIIGFKTISAPHPKNNC

SEQ ID NO: 899568 - protein, 152 aa, Homo sapiens
MAHRFPALTQEQKKELSEIAQSIVANGKGILAADESVGTMGNRLQRIKVENTEENRRQFREILFSVDSSINQSIGGVILFHETLYQKDSQGKLFRNILKEKGIVVGIKLDQGGAPLAGEQTKKPPFKGLMASQSAVLSTRKMVLTLGSGVLC

SEQ ID NO: 899569 - protein, 346 aa, Homo sapiens
MAHRFPALTQEQKKELSEIAQSIVANGKGILAADESVGTMGNRLQRIKVENTEENRRQFREILFSVDSSINQSIGGVILFHETLYQKDSQGKLFRNILKGTNKETTIQGLDGLSERCAQYKKDGVDFGKWRAVLRIADQCPSSLAIQENANALARYASICQQNGLVPIVEPEVIPDGDHDLEHCQYVTEKVLAAVYKALNDHHVYLEGTLLKPNMVTAGHACTKKYTPEQVAMATVTALHRTVPAAVPGICFLSGGMSEEDATLNLNAINLCPLPKPWKLSFSYGRALQASALAAWGGKAANKEATQEAFMKRAMANCQAAKGQYVHTGSSGAASTQSLFTACYTY

SEQ ID NO: 899570 - protein, 152 aa, Homo sapiens; identical to SEQ ID NO: 899568

SEQ ID NO: 899571 - protein, 152 aa, Homo sapiens; identical to SEQ ID NO: 899568

SEQ ID NO: 899572 - protein, 134 aa, Homo sapiens
MAHRFPALTQEQKKELSEIAQSIVANGKGILAADESVGTMGNRLQRIKVGSINQSIGGVILFHETLYQKDSQGKLFRNILKEKGIVVGIKLDQGGAPLAGEQTKKPPFKGLMASQSAVLSTRKMVLTLGSGVLC

SEQ ID NO: 899573 - protein, 152 aa, Homo sapiens; identical to SEQ ID NO: 899568

SEQ ID NO: 899574 - protein, 152 aa, Homo sapiens; identical to SEQ ID NO: 899568

SEQ ID NO: 899575 - protein, 185 aa, Homo sapiens
MNGLVPIVEPEVIPDGDHDLEHCQYVTEKVLAAVYKALNDHHVYLEGTLLKPNMVTAGHACTKKYTPEQVAMATVTALHRTVPAAVPGICFLSGGMSEEDATLNLNAINLCPLPKPWKLSFSYGRALQASALAAWGGKAANKEATQEAFMKRAMANCQAAKGQYVHTGSSGAASTQSLFTACYTY

SEQ ID NO: 899576 - protein, 152 aa, Homo sapiens; identical to SEQ ID NO: 899568

SEQ ID NO: 899577 - protein, 152 aa, Homo sapiens; identical to SEQ ID NO: 899568

SEQ ID NO: 899578 - protein, 205 aa, Homo sapiens
MRPGDWFRSFCQATNKNSFILPPCSVNVPRSSGSMTSFEFHLVGPLVLQVLAAVYKALNDHHVYLEGTLLKPNMVTAGHACTKKYTPEQVAMATVTALHRTVPAAVPGICFLSGGMSEEDATLNLNAINLCPLPKPWKLSFSYGRALQASALAAWGGKAANKEATQEAFMKRAMANCQAAKGQYVHTGSSGAASTQSLFTACYTY

SEQ ID NO: 899579 - protein, 152 aa, Homo sapiens; identical to SEQ ID NO: 899568

SEQ ID NO: 899580 - protein, 104 aa, Homo sapiens
MASLLPGICFLSGGMSEEDATLNLNAINLCPLPKPWKLSFSYGRALQASALAAWGGKAANKEATQEAFMKRAMANCQAAKGQYVHTGSSGAASTQSLFTACYTY

SEQ ID NO: 899581 - protein, 270 aa, Homo sapiens
GGEGGGAGTGRRPRELPHPQLLISRRTLLSQTTCHHGPPISSPHPGAEEGAGKAVQKHPQGKGDRGGNQVRPRRCSSCRRTNKETTIQGLDGLSERCAQYKKDGVDFGKWRAVLRIADQCPSSLAIQENANALARYASICQQNGLVPIVEPEVIPDGDHDLEHCQYVTEKVLAAVYKALNDHHVYLEGTLLKPNMVTAGHACTKKYTPEQVAMATVTALHRTVPAAVPGICFLSGGMSEEDATLNLNAINLCPSRSSQPAIPTRVQCPPA

SEQ ID NO: 899582 - protein, 51 aa, Homo sapiens
AALGPPTIGTMGNRLQRIKVENTEENRRQFREILFSVDSSINQSIGGVILF

SEQ ID NO: 899583 - protein, 152 aa, Homo sapiens; identical to SEQ ID NO: 899568

SEQ ID NO: 899584 - protein, 134 aa, Homo sapiens; identical to SEQ ID NO: 899572

SEQ ID NO: 899585 - protein, 346 aa, Homo sapiens; identical to SEQ ID NO: 899569

SEQ ID NO: 899586 - protein, 344 aa, Homo sapiens
MAHRFPALTQEQKKELSEIAQSIVANGKGILAADESVGTMGNRLQRIKVENTEENRRQFREILFSVDSSINQSIGGVILFHETLYQKDSQGKLFRNILKEKGIVVGIKLDQGGAPLAGKKDGVDFGKWRAVLRIADQCPSSLAIQENANALARYASICQQNGLVPIVEPEVIPDGDHDLEHCQYVTEKVLAAVYKALNDHHVYLEGTLLKPNMVTAGHACTKKYTPEQVAMATVTALHRTVPAAVPGICFLSGGMSEEDATLNLNAINLCPLPKPWKLSFSYGRALQASALAAWGGKAANKEATQEAFMKRAMANCQAAKGQYVHTGSSGAASTQSLFTACYTY

SEQ ID NO: 899587 - protein, 152 aa, Homo sapiens; identical to SEQ ID NO: 899568

SEQ ID NO: 899588 - protein, 165 aa, Homo sapiens
AHTAHTRAHNTQTHSTRTHMHTQEQKKELSEIAQSIVANGKGILAADESVGTMGNRLQRIKVENTEENRRQFREILFSVDSSINQSIGGVILFHETLYQKDSQGKLFRNILKEKGIVVGIKLDQGGAPLAGEQTKKPPFKGLMASQSAVLSTRKMVLTLGSGVLC

SEQ ID NO: 899589 - protein, 255 aa, Homo sapiens
MAHRFPALTQEQKKELSEIAQSIVANGKGILAADESVGTMGNRLQRIKVGSINQSIGGVILFHETLYQKDSNGLVPIVEPEVIPDGDHDLEHCQYVTEKVLAAVYKALNDHHVYLEGTLLKPNMVTAGHACTKKYTPEQVAMATVTALHRTVPAAVPGICFLSGGMSEEDATLNLNAINLCPLPKPWKLSFSYGRALQASALAAWGGKAANKEATQEAFMKRAMANCQAAKGQYVHTGSSGAASTQSLFTACYTY

SEQ ID NO: 899590 - protein, 152 aa, Homo sapiens; identical to SEQ ID NO: 899568

SEQ ID NO: 899591 - protein, 152 aa, Homo sapiens; identical to SEQ ID NO: 899568

SEQ ID NO: 899592 - protein, 152 aa, Homo sapiens; identical to SEQ ID NO: 899568

SEQ ID NO: 899593 - protein, 152 aa, Homo sapiens; identical to SEQ ID NO: 899568

SEQ ID NO: 899594 - protein, 152 aa, Homo sapiens; identical to SEQ ID NO: 899568

SEQ ID NO: 899595 - protein, 161 aa, Homo sapiens
MVPKLFTSQICLLLLLGLLAVEGSLHVKPPQFTWAQWFETQHINMTSQQCTNAMQVINNYQRRCKNQNTFLLTTFANVVNVCGNPNMTCPSNKTRKNCHHSGSQVPLIHCNLTTPSPQNISNCRYAQTPANMFYIVACDNRDQRRDPPQYPVVPVHLDRII

SEQ ID NO: 899596 - protein, 105 aa, Homo sapiens
MTRCCSLRNRYLPSYTIGYLRACKLCTPDYDLILVRIGETLCDHSGSQVPLIHCNLTTPSPQNISNCRYAQTPANMFYIVACDNRDQRRDPPQYPVVPVHLDRII

SEQ ID NO: 899597 - protein, 2813 aa, Homo sapiens
MIPARFAGVLLALALILPGTLCAEGTRGRSSTARCSLFGSDFVNTFDGSMYSFAGYCSYLLAGGCQKRSFSIIGDFQNGKRVSLSVYLGEFFDIHLFVNGTVTQGDQRVSMPYASKGLYLETEAGYYKLSGEAYGFVARIDGSGNFQVLLSDRYFNKTCGLCGNFNIFAEDDFMTQEGTLTSDPYDFANSWALSSGEQWCERASPPSSSCNISSGEMQKGLWEQCQLLKSTSVFARCHPLVDPEPFVALCEKTLCECAGGLECACPALLEYARTCAQEGMVLYGWTDHSACSPVCPAGMEYRQCVSPCARTCQSLHIKEMCQERCVDGCSCPEGQLLDEGLCVESTECPCVHSGKRYPPGTSLSRDCNTCICRNSQWICSNEECPGECLVTGQSHFKSFDNRYFTFSGICQYLLARDCQDHSFSIVIETVQCADDRDAVCTRSVTVRLPGLHNSLVKLKHGAGVAMDGQDVQLPLLKGDLRIQHTVTASVRLSYGEDLQMDWDGRGRLLVKLSPVYAGKTCGLCGNYNGNQGDDFLTPSGLAEPRVEDFGNAWKLHGDCQDLQKQHSDPCALNPRMTRFSEEACAVLTSPTFEACHRAVSPLPYLRNCRYDVCSCSDGRECLCGALASYAAACAGRGVRVAWREPGRCELNCPKGQVYLQCGTPCNLTCRSLSYPDEECNEACLEGCFCPPGLYMDERGDCVPKAQCPCYYDGEIFQPEDIFSDHHTMCYCEDGFMHCTMSGVPGSLLPDAVLSSPLSHRSKRSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPGGLVVPPTDAPVSPTTLYVEDISEPPLHDFYCSRLLDLVFLLDGSSRLSEAEFEVLKAFVVDMMERLRISQKWVRVAVVEYHDGSHAYIGLKDRKRPSELRRIASQVKYAGSQVASTSEVLKYTLFQIFSKIDRPEASRIALLLMASQEPQRMSRNFVRYVQGLKKKKVIVIPVGIGPHANLKQIRLIEKQAPENKAFVLSSVDELEQQRDEIVSYLCDLAPEAPPPTLPPDMAQVTVGPGLLGVSTLGPKRNSMVLDVAFVLEGSDKIGEADFNRSKEFMEEVIQRMDVGQDSIHVTVLQYSYMVTVEYPFSEAQSKGDILQRVREIRYQGGNRTNTGLALRYLSDHSFLVSQGDREQAPNLVYMVTGNPASDEIKRLPGDIQVVPIGVGPNANVQELERIGWPNAPILIQDFETLPREAPDLVLQRCCSGEGLQIPTLSPAPDCSQPLDVILLLDGSSSFPASYFDEMKSFAKAFISKANIGPRLTQVSVLQYGSITTIDVPWNVVPEKAHLLSLVDVMQREGGPSQIGDALGFAVRYLTSEMHGARPGASKAVVILVTDVSVDSVDAAADAARSNRVTVFPIGIGDRYDAAQLRILAGPAGDSNVVKLQRIEDLPTMVTLGNSFLHKLCSGFVRICMDEDGNEKRPGDVWTLPDQCHTVTCQPDGQTLLKSHRVNCDRGLRPSCPNSQSPVKVEETCGCRWTCPCVCTGSSTRHIVTFDGQNFKLTGSCSYVLFQNKEQDLEVILHNGACSPGARQGCMKSIEVKHSALSVELHSDMEVTVNGRLVSVPYVGGNMEVNVYGAIMHEVRFNHLGHIFTFTPQNNEFQLQLSPKTFASKTYGLCGICDENGANDFMLRDGTVTTDWKTLVQEWTVQRPGQTCQPILEEQCLVPDSSHCQVLLLPLFAECHKVLAPATFYAICQQDSCHQEQVCEVIASYAHLCRTNGVCVDWRTPDFCAMSCPPSLVYNHCEHGCPRHCDGNVSSCGDHPSEGCFCPPDKVMLEGSCVPEEACTQCIGEDGVQHQFLEAWVPDHQPCQICTCLSGRKVNCTTQPCPTAKAPTCGLCEVARLRQNADQCCPEYECVCDPVSCDLPPVPHCERGLQPTLTNPGECRPNFTCACRKEECKRVSPPSCPPHRLPTLRKTQCCDEYECACNCVNSTVSCPLGYLASTATNDCGCTTTTCLPDKVCVHRSTIYPVGQFWEEGCDVCTCTDMEDAVMGLRVAQCSQKPCEDSCRSGFTYVLHEGECCGRCLPSACEVVTGSPRGDSQSSWKSVGSQWASPENPCLINECVRVKEEVFIQQRNVSCPQLEVPVCPSGFQLSCKTSACCPSCRCERMEACMLNGTVIGPGKTVMIDVCTTCRCMVQVGVISGFKLECRKTTCNPCPLGYKEENNTGECCGRCLPTACTIQLRGGQIMTLKRDETLQDGCDTHFCKVNERGEYFWEKRVTGCPPFDEHKCLAEGGKIMKIPGTCCDTCEEPECNDITARLQYVKVGSCKSEVEVDIHYCQGKCASKAMYSIDINDVQDQCSCCSPTRTEPMQVALHCTNGSVVYHEVLNAMECKCSPRKCSK

SEQ ID NO: 899598 - protein, 2850 aa, Homo sapiens
MGAQDEEEGIQDLDGLLVFDKIVEVTLLNLPWYNEETEGQRGEMTAPKSPRAKIRGTLCAEGTRGRSSTARCSLFGSDFVNTFDGSMYSFAGYCSYLLAGGCQKRSFSIIGDFQNGKRVSLSVYLGEFFDIHLFVNGTVTQGDQRVSMPYASKGLYLETEAGYYKLSGEAYGFVARIDGSGNFQVLLSDRYFNKTCGLCGNFNIFAEDDFMTQEGTLTSDPYDFANSWALSSGEQWCERASPPSSSCNISSGEMQKGLWEQCQLLKSTSVFARCHPLVDPEPFVALCEKTLCECAGGLECACPALLEYARTCAQEGMVLYGWTDHSACSPVCPAGMEYRQCVSPCARTCQSLHIKEMCQERCVDGCSCPEGQLLDEGLCVESTECPCVHSGKRYPPGTSLSRDCNTCICRNSQWICSNEECPGECLVTGQSHFKSFDNRYFTFSGICQYLLARDCQDHSFSIVIETVQCADDRDAVCTRSVTVRLPGLHNSLVKLKHGAGVAMDGQDVQLPLLKGDLRIQHTVTASVRLSYGEDLQMDWDGRGRLLVKLSPVYAGKTCGLCGNYNGNQGDDFLTPSGLAEPRVEDFGNAWKLHGDCQDLQKQHSDPCALNPRMTRFSEEACAVLTSPTFEACHRAVSPLPYLRNCRYDVCSCSDGRECLCGALASYAAACAGRGVRVAWREPGRCELNCPKGQVYLQCGTPCNLTCRSLSYPDEECNEACLEGCFCPPGLYMDERGDCVPKAQCPCYYDGEIFQPEDIFSDHHTMCYCEDGFMHCTMSGVPGSLLPDAVLSSPLSHRSKRSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPGGLVVPPTDAPVSPTTLYVEDISEPPLHDFYCSRLLDLVFLLDGSSRLSEAEFEVLKAFVVDMMERLRISQKWVRVAVVEYHDGSHAYIGLKDRKRPSELRRIASQVKYAGSQVASTSEVLKYTLFQIFSKIDRPEASRIALLLMASQEPQRMSRNFVRYVQGLKKKKVIVIPVGIGPHANLKQIRLIEKQAPENKAFVLSSVDELEQQRDEIVSYLCDLAPEAPPPTLPPDMAQVTVGPGLLGVSTLGPKRNSMVLDVAFVLEGSDKIGEADFNRSKEFMEEVIQRMDVGQDSIHVTVLQYSYMVTVEYPFSEAQSKGDILQRVREIRYQGGNRTNTGLALRYLSDHSFLVSQGDREQAPNLVYMVTGNPASDEIKRLPGDIQVVPIGVGPNANVQELERIGWPNAPILIQDFETLPREAPDLVLQRCCSGEGLQIPTLSPAPDCSQPLDVILLLDGSSSFPASYFDEMKSFAKAFISKANIGPRLTQVSVLQYGSITTIDVPWNVVPEKAHLLSLVDVMQREGGPSQIGDALGFAVRYLTSEMHGARPGASKAVVILVTDVSVDSVDAAADAARSNRVTVFPIGIGDRYDAAQLRILAGPAGDSNVVKLQRIEDLPTMVTLGNSFLHKLCSGFVRICMDEDGNEKRPGDVWTLPDQCHTVTCQPDGQTLLKSHRVNCDRGLRPSCPNSQSPVKVEETCGCRWTCPCVCTGSSTRHIVTFDGQNFKLTGSCSYVLFQNKEQDLEVILHNGACSPGARQGCMKSIEVKHSALSVELHSDMEVTVNGRLVSVPYVGGNMEVNVYGAIMHEVRFNHLGHIFTFTPQNNEFQLQLSPKTFASKTYGLCGICDENGANDFMLRDGTVTTDWKTLVQEWTVQRPGQTCQPILEEQCLVPDSSHCQVLLLPLFAECHKVLAPATFYAICQQDSCHQEQVCEVIASYAHLCRTNGVCVDWRTPDFCAMSCPPSLVYNHCEHGCPRHCDGNVSSCGDHPSEGCFCPPDKVMLEGSCVPEEACTQCIGEDGVQHQFLEAWVPDHQPCQICTCLSGRKVNCTTQPCPTAKAPTCGLCEVARLRQNADQCCPEYECVCDPVSCDLPPVPHCERGLQPTLTNPGECRPNFTCACRKEECKRVSPPSCPPHRLPTLRKTQCCDEYECACNCVNSTVSCPLGYLASTATNDCGCTTTTCLPDKVCVHRSTIYPVGQFWEEGCDVCTCTDMEDAVMGLRVAQCSQKPCEDSCRSGFTYVLHEGECCGRCLPSACEVVTGSPRGDSQSSWKSVGSQWASPENPCLINECVRVKEEVFIQQRNVSCPQLEVPVCPSGFQLSCKTSACCPSCRCERMEACMLNGTVIGPGKTVMIDVCTTCRCMVQVGVISGFKLECRKTTCNPCPLGYKEENNTGECCGRCLPTACTIQLRGGQIMTLKRDETLQDGCDTHFCKVNERGEYFWEKRVTGCPPFDEHKCLAEGGKIMKIPGTCCDTCEEPECNDITARLQYVKVGSCKSEVEVDIHYCQGKCASKAMYSIDINDVQDQCSCCSPTRTEPMQVALHCTNGSVVYHEVLNAMECKCSPRKCSK

SEQ ID NO: 899599 - protein, 2758 aa, Homo sapiens
MIPARFAGVLLALALILPGTLCAEGTRGRSSTARCSLFGSDFVNTFDGSMYSFAGYCSYLLAGGCQKRSFSIIGDFQNGKRVSLSVYLGEFFDIHLFVNGTVTQGDQRVSMPYASKGLYLETEAGYYKLSGEAYGFVARIDGSGNFQVLLSDRYFNKTCGLCGNFNIFAEDDFMTQEGTLTSDPYDFANSWALSSGEQWCERASPPSSSCNISSGEMQKGLWEQCQLLKSTSVFARCHPLVDPEPFVALCEKTLCECAGGLECACPALLEYARTCAQEGMVLYGWTDHSACSPVCPAGMEYRQCVSPCARTCQSLHIKEMCQERCVDGCSCPEGQLLDEGLCVESTECPCVHSGKRYPPGTSLSRDCNTCICRNSQWICSNEECPGECLVTGQSHFKSFDNRYFTFSGICQYLLARDCQDHSFSIVIETVQCADDRDAVCTRSVTVRLPGLHNSLVKLKHGAGVAMDGQDVQLPLLKGDLRIQHTVTASVRLSYGEDLQMDWDGRGRLLVKLSPVYAGKTCGLCGNYNGNQGDDFLTPSGLAEPRVEDFGNAWKLHGDCQDLQKQHSDPCALNPRMTRFSEEACAVLTSPTFEACHRAVSPLPYLRNCRYDVCSCSDGRECLCGALASYAAACAGRGVRVAWREPGRCELNCPKGQVYLQCGTPCNLTCRSLSYPDEECNEACLEGCFCPPGLYMDERGDCVPKAQCPCYYDGEIFQPEDIFSDHHTMCYCEDGFMHCTMSGVPGSLLPDAVLSSPLSHRSKRSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPGGLVVPPTDAPVSPTTLYVEDISEPPLHDFYCSRLLDLVFLLDGSSRLSEAEFEVLKAFVVDMMERLRISQKWVRVAVVEYHDGSHAYIGLKDRKRPSELRRIASQVKYAGSQVASTSEVLKYTLFQIFSKIDRPEASRIALLLMASQEPQRMSRNFVRYVQGLKKKKVIVIPVGIGPHANLKQIRLIEKQAPENKAFVLSSVDELEQQRDEIVSYLCDLAPEAPPPTLPPDMAQVTVGPGLLGVSTLGPKRNSMVLDVAFVLEGSDKIGEADFNRSKEFMEEVIQRMDVGQDSIHVTVLQYSYMVTVEYPFSEAQSKGDILQRVREIRYQGGNRTNTGLALRYLSDHSFLVSQGDREQAPNLVYMVTGNPASDEIKRLPGDIQVVPIGVGPNANVQELERIGWPNAPILIQDFETLPREAPDLVLQRCCSGEGLQIPTLSPAPDCSQPLDVILLLDGSSSFPASYFDEMKSFAKAFISKANIGPRLTQVSVLQYGSITTIDVPWNVVPEKAHLLSLVDVMQREGGPSQIGDALGFAVRYLTSEMHGARPGASKAVVILVTDVSVDSVDAAADAARSNRVTVFPIGIGDRYDAAQLRILAGPAGDSNVVKLQRIEDLPTMVTLGNSFLHKLCSGFVRICMDEDGNEKRPGDVWTLPDQCHTVTCQPDGQNFKLTGSCSYVLFQNKEQDLEVILHNGACSPGARQGCMKSIEVKHSALSVELHSDMEVTVNGRLVSVPYVGGNMEVNVYGAIMHEVRFNHLGHIFTFTPQNNEFQLQLSPKTFASKTYGLCGICDENGANDFMLRDGTVTTDWKTLVQEWTVQRPGQTCQPILEEQCLVPDSSHCQVLLLPLFAECHKVLAPATFYAICQQDSCHQEQVCEVIASYAHLCRTNGVCVDWRTPDFCAMSCPPSLVYNHCEHGCPRHCDGNVSSCGDHPSEGCFCPPDKVMLEGSCVPEEACTQCIGEDGVQHQFLEAWVPDHQPCQICTCLSGRKVNCTTQPCPTAKAPTCGLCEVARLRQNADQCCPEYECVCDPVSCDLPPVPHCERGLQPTLTNPGECRPNFTCACRKEECKRVSPPSCPPHRLPTLRKTQCCDEYECACNCVNSTVSCPLGYLASTATNDCGCTTTTCLPDKVCVHRSTIYPVGQFWEEGCDVCTCTDMEDAVMGLRVAQCSQKPCEDSCRSGFTYVLHEGECCGRCLPSACEVVTGSPRGDSQSSWKSVGSQWASPENPCLINECVRVKEEVFIQQRNVSCPQLEVPVCPSGFQLSCKTSACCPSCRCERMEACMLNGTVIGPGKTVMIDVCTTCRCMVQVGVISGFKLECRKTTCNPCPLGYKEENNTGECCGRCLPTACTIQLRGGQIMTLKRDETLQDGCDTHFCKVNERGEYFWEKRVTGCPPFDEHKCLAEGGKIMKIPGTCCDTCEEPECNDITARLQYVKVGSCKSEVEVDIHYCQGKCASKAMYSIDINDVQDQCSCCSPTRTEPMQVALHCTNGSVVYHEVLNAMECKCSPRKCSK

SEQ ID NO: 899600 - protein, 2961 aa, Homo sapiens
MIPARFAGVLLALALILPGTLCAEGTRGRSSTARCSLFGSDFVNTFDGSMYSFAGYCSYLLAGGCQKRSFSIIGDFQNGKRVSLSVYLGEFFDIHLFVNGTVTQGDQRVSMPYASKGLYLETEAGYYKLSGEAYGFVARIDGSGNFQVLLSDRYFNKTCGLCGNFNIFAEDDFMTQEGTLTSDPYDFANSWALSSGEQWCERASPPSSSCNISSGEMQKGLWEQCQLLKSTSVFARCHPLVDPEPFVALCEKTLCECAGGLECACPALLEYARTCAQEGMVLYGWTDHSACSPVCPAGMEYRQCVSPCARTCQSLHIKEMCQERCVDGCSCPEGQLLDEGLCVESTECPCVHSGKRYPPGTSLSRDCNTCICRNSQWICSNEECPGECLVTGQSHFKSFDNRYFTFSGICQYLLARDCQDHSFSIVIETVQCADDRDAVCTRSVTVRLPGLHNSLVKLKHGAGVAMDGQDVQLPLLKGDLRIQHTVTASVRLSYGEDLQMDWDGRGRLLVKLSPVYAGKTCGLCGNYNGNQGDDFLTPSGLAEPRVEDFGNAWKLHGDCQDLQKQHSDPCALNPRMTRFSEEACAVLTSPTFEACHRAVSPLPYLRNCRYDVCSCSDGRECLCGALASYAAACAGRGVRVAWREPGRCELNCPKGQVYLQCGTPCNLTCRSLSYPDEECNEACLEGCFCPPGLYMDERGDCVPKAQCPCYYDGEIFQPEDIFSDHHTMCYCEDGFMHCTMSGVPGSLLPDAVLSSPLSHRSKRSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACQVTCQHPEPLACPVQCVEGCHAHCPPGKILDELLQTCVDPEDCPVCEVAGRRFASGKKVTLNPSDPEHCQIWSVTSLSTGVHILEVGTQERKVRWNPGPSGNMNVVGAIVKVAGCGCHNGEGRCSLLSPWLLTGLASGKLAFGEVEGVLRVSSEPSEVLLISREHLLKSRSIQHHSLTLIKPSGSLNLERKFAGEGLWSQLLESDPAATICTNKNEHCLGHCDVVNLTCEACQEPGGLVVPPTDAPVSPTTLYVEDISEPPLHDFYCSRLLDLVFLLDGSSRLSEAEFEVLKAFVVDMMERLRISQKWVRVAVVEYHDGSHAYIGLKDRKRPSELRRIASQVKYAGSQVASTSEVLKYTLFQIFSKIDRPEASRIALLLMASQEPQRMSRNFVRYVQGLKKKKVIVIPVGIGPHANLKQIRLIEKQAPENKAFVLSSVDELEQQRDEIVSYLCDLAPEAPPPTLPPDMAQVTVGPGLLGVSTLGPKRNSMVLDVAFVLEGSDKIGEADFNRSKEFMEEVIQRMDVGQDSIHVTVLQYSYMVTVEYPFSEAQSKGDILQRVREIRYQGGNRTNTGLALRYLSDHSFLVSQGDREQAPNLVYMVTGNPASDEIKRLPGDIQVVPIGVGPNANVQELERIGWPNAPILIQDFETLPREAPDLVLQRCCSGEGLQIPTLSPAPDCSQPLDVILLLDGSSSFPASYFDEMKSFAKAFISKANIGPRLTQVSVLQYGSITTIDVPWNVVPEKAHLLSLVDVMQREGGPSQIGDALGFAVRYLTSEMHGARPGASKAVVILVTDVSVDSVDAAADAARSNRVTVFPIGIGDRYDAAQLRILAGPAGDSNVVKLQRIEDLPTMVTLGNSFLHKLCSGFVRICMDEDGNEKRPGDVWTLPDQCHTVTCQPDGQTLLKSHRVNCDRGLRPSCPNSQSPVKVEETCGCRWTCPCVCTGSSTRHIVTFDGQNFKLTGSCSYVLFQNKEQDLEVILHNGACSPGARQGCMKSIEVKHSALSVELHSDMEVTVNGRLVSVPYVGGNMEVNVYGAIMHEVRFNHLGHIFTFTPQNNEFQLQLSPKTFASKTYGLCGICDENGANDFMLRDGTVTTDWKTLVQEWTVQRPGQTCQPILEEQCLVPDSSHCQVLLLPLFAECHKVLAPATFYAICQQDSCHQEQVCEVIASYAHLCRTNGVCVDWRTPDFCAMSCPPSLVYNHCEHGCPRHCDGNVSSCGDHPSEGCFCPPDKVMLEGSCVPEEACTQCIGEDGVQHQFLEAWVPDHQPCQICTCLSGRKVNCTTQPCPTAKAPTCGLCEVARLRQNADQCCPEYECVCDPVSCDLPPVPHCERGLQPTLTNPGECRPNFTCACRKEECKRVSPPSCPPHRLPTLRKTQCCDEYECACNCVNSTVSCPLGYLASTATNDCGCTTTTCLPDKVCVHRSTIYPVGQFWEEGCDVCTCTDMEDAVMGLRVAQCSQKPCEDSCRSGFTYVLHEGECCGRCLPSACEVVTGSPRGDSQSSWKSVGSQWASPENPCLINECVRVKEEVFIQQRNVSCPQLEVPVCPSGFQLSCKTSACCPSCRCERMEACMLNGTVIGPGKTVMIDVCTTCRCMVQVGVISGFKLECRKTTCNPCPLGYKEENNTGECCGRCLPTACTIQLRGGQIMTLKRDETLQDGCDTHFCKVNERGEYFWEKRVTGCPPFDEHKCLAEGGKIMKIPGTCCDTCEEPECNDITARLQYVKVGSCKSEVEVDIHYCQGKCASKAMYSIDINDVQDQCSCCSPTRTEPMQVALHCTNGSVVYHEVLNAMECKCSPRKCSK

SEQ ID NO: 899601 - protein, 1789 aa, Homo sapiens
SLFETIELHFSFYLDPLILKLTIRTFAPRLRARVPEHLAIGLGHLRLPLQVDPEPYLDVCIYDTCSCESIGDCACFCDTIAAYAHVCAQHGKVVTWRTATLCPQSCEERNLRENGYECEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPGGLVVPPTDAPVSPTTLYVEDISEPPLHDFYCSRLLDLVFLLDGSSRLSEAEFEVLKAFVVDMMERLRISQKWVRVAVVEYHDGSHAYIGLKDRKRPSELRRIASQVKYAGSQVASTSEVLKYTLFQIFSKIDRPEASRIALLLMASQEPQRMSRNFVRYVQGLKKKKVIVIPVGIGPHANLKQIRLIEKQAPENKAFVLSSVDELEQQRDEIVSYLCDLAPEAPPPTLPPDMAQVTVGPGLLGVSTLGPKRNSMVLDVAFVLEGSDKIGEADFNRSKEFMEEVIQRMDVGQDSIHVTVLQYSYMVTVEYPFSEAQSKGDILQRVREIRYQGGNRTNTGLALRYLSDHSFLVSQGDREQAPNLVYMVTGNPASDEIKRLPGDIQVVPIGVGPNANVQELERIGWPNAPILIQDFETLPREAPDLVLQRCCSGEGLQIPTLSPAPDCSQPLDVILLLDGSSSFPASYFDEMKSFAKAFISKANIGPRLTQVSVLQYGSITTIDVPWNVVPEKAHLLSLVDVMQREGGPSQIGDALGFAVRYLTSEMHGARPGASKAVVILVTDVSVDSVDAAADAARSNRVTVFPIGIGDRYDAAQLRILAGPAGDSNVVKLQRIEDLPTMVTLGNSFLHKLCSGFVRICMDEDGNEKRPGDVWTLPDQCHTVTCQPDGQTLLKSHRVNCDRGLRPSCPNSQSPVKVEETCGCRWTCPCVCTGSSTRHIVTFDGQNFKLTGSCSYVLFQNKEQDLEVILHNGACSPGARQGCMKSIEVKHSALSVELHSDMEVTVNGRLVSVPYVGGNMEVNVYGAIMHEVRFNHLGHIFTFTPQNNEFQLQLSPKTFASKTYGLCGICDENGANDFMLRDGTVTTDWKTLVQEWTVQRPGQTCQPILEEQCLVPDSSHCQVLLLPLFAECHKVLAPATFYAICQQDSCHQEQVCEVIASYAHLCRTNGVCVDWRTPDFCAMSCPPSLVYNHCEHGCPRHCDGNVSSCGDHPSEGCFCPPDKVMLEGSCVPEEACTQCIGEDGVQHQFLEAWVPDHQPCQICTCLSGRKVNCTTQPCPTAKAPTCGLCEVARLRQNADQCCPEYECVCDPVSCDLPPVPHCERGLQPTLTNPGECRPNFTCACRKEECKRVSPPSCPPHRLPTLRKTQCCDEYECACNCVNSTVSCPLGYLASTATNDCGCTTTTCLPDKVCVHRSTIYPVGQFWEEGCDVCTCTDMEDAVMGLRVAQCSQKPCEDSCRSGFTYVLHEGECCGRCLPSACEVVTGSPRGDSQSSWKSVGSQWASPENPCLINECVRVKEEVFIQQRNVSCPQLEVPVCPSGFQLSCKTSACCPSCRCERMEACMLNGTVIGPGKTVMIDVCTTCRCMVQVGVISGFKLECRKTTCNPCPLGYKEENNTGECCGRCLPTACTIQLRGGQIMTLKRDETLQDGCDTHFCKVNERGEYFWEKRVTGCPPFDEHKCLAEGGKIMKIPGTCCDTCEEPECNDITARLQYVKVGSCKSEVEVDIHYCQGKCASKAMYSIDINDVQDQCSCCSPTRTEPMQVALHCTNGSVVYHEVLNAMECKCSPRKCSK

SEQ ID NO: 899602 - protein, 568 aa, Homo sapiens
DSQGERASVGLALPDAVLSPDEVRASPQRSLSLLCAVLDSTEEVNCTTQPCPTAKAPTCGLCEVARLRQNADQCCPEYECVCDPVSCDLPPVPHCERGLQPTLTNPGECRPNFTCACRKEECKRVSPPSCPPHRLPTLRKTQCCDEYECACNCVNSTVSCPLGYLASTATNDCGCTTTTCLPDKVCVHRSTIYPVGQFWEEGCDVCTCTDMEDAVMGLRVAQCSQKPCEDSCRSGFTYVLHEGECCGRCLPSACEVVTGSPRGDSQSSWKSVGSQWASPENPCLINECVRVKEEVFIQQRNVSCPQLEVPVCPSGFQLSCKTSACCPSCRCERMEACMLNGTVIGPGKTVMIDVCTTCRCMVQVGVISGFKLECRKTTCNPCPLGYKEENNTGECCGRCLPTACTIQLRGGQIMTLKRDETLQDGCDTHFCKVNERGEYFWEKRVTGCPPFDEHKCLAEGGKIMKIPGTCCDTCEEPECNDITARLQYVKVGSCKSEVEVDIHYCQGKCASKAMYSIDINDVQDQCSCCSPTRTEPMQVALHCTNGSVVYHEVLNAMECKCSPRKCSK

SEQ ID NO: 899603 - protein, 403 aa, Homo sapiens
PPFDEHKCLAEGGKIMKVPGTCCDTCEEPECNDILPGCDVCTCTDMEDAVMGLRVAQCSQKPCEDSCRSGFTYVLHEGECCGRCLPSACEVVTGSPRGDSQSSWKSVGSQWASPENPCLINECVRVKEEVFIQQRNVSCPQLEVPVCPSGFQLSCKTSACCPSCRCERMEACMLNGTVIGPGKTVMIDVCTTCRCMVQVGVISGFKLECRKTTCNPCPLGYKEENNTGECCGRCLPTACTIQLRGGQIMTLKRDETLQDGCDTHFCKVNERGEYFWEKRVTGCPPFDEHKCLAEGGKIMKIPGTCCDTCEEPECNDITARLQYVKVGSCKSEVEVDIHYCQGKCASKAMYSIDINDVQDQCSCCSPTRTEPMQVALHCTNGSVVYHEVLNAMECKCSPRKCSK

SEQ ID NO: 899604 - protein, 2687 aa, Homo sapiens
MIPARFAGVLLALALILPGTLCAEGTRGRSSTARCSLFGSDFVNTFDGSMYSFAGYCSYLLAGGCQKRSFSIIGDFQNGKRVSLSVYLGEFFDIHLFVNGTVTQGDQRVSMPYASKGLYLETEAGYYKLSGEAYGFVARIDGSGNFQVLLSDRYFNKTCGLCGNFNIFAEDDFMTQEGTLTSDPYDFANSWALSSGEQWCERASPPSSSCNISSGEMQKGLWEQCQLLKSTSVFARCHPLVDPEPFVALCEKTLCECAGGLECACPALLEYARTCAQEGMVLYGWTDHSACSPVCPAGMEYRQCVSPCARTCQSLHIKEMCQERCVDGCSCPEGQLLDEGLCVESTECPCVHSGKRYPPGTSLSRDCNTCICRNSQWICSNEECPGECLVTGQSHFKSFDNRYFTFSGICQYLLARDCQDHSFSIVIETVQCADDRDAVCTRSVTVRLPGLHNSLVKLKHGAGVAMDGQDVQLPLLKGDLRIQHTVTASVRLSYGEDLQMDWDGRGRLLVKLSPVYAGKTCGLCGNYNGNQGDDFLTPSGLAEPRVEDFGNAWKLHGDCQDLQKQHSDPCALNPRMTRFSEEACAVLTSPTFEACHRAVSPLPYLRNCRYDVCSCSDGRECLCGALASYAAACAGRGVRVAWREPGRCELNCPKGQVYLQCGTPCNLTCRSLSYPDEECNEACLEGCFCPPGLYMDERGDCVPKAQCPCYYDGEIFQPEDIFSDHHTMCYCEDGFMHCTMSGVPGSLLPDAVLSSPLSHRSKRSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPGGLVVPPTDAPVSPTTLYVEDISEPPLHDFYCSRLLDLVFLLDGSSRLSEAEFEVLKAFVVDMMERLRISQKWVRVAVVEYHDGSHAYIGLKDRKRPSELRRIASQVKYAGSQVASTSEVLKYTLFQIFSKIDRPEASRIALLLMASQEPQRMSRNFVRYVQGLKKKKVIVIPVGIGPHANLKQIRLIEKQAPENKAFVLSSVDELEQQRDEIVSYLCDLAPEAPPPTLPPDMAQVTVGPGLLGVSTLGPKRNSMVLDVAFVLEGSDKIGEADFNRSKEFMEEVIQRMDVGQDSIHVTVLQYSYMVTVEYPFSEAQSKGDILQRVREIRYQGGNRTNTGLALRYLSDHSFLVSQGDREQAPNLVYMVTGNPASDEIKRLPGDIQVVPIGVGPNANVQELERIGWPNAPILIQDFETLPREAPDLVLQRCCSGEGLQIPTLSPAPDCSQPLDVILLLDGSSSFPASYFDEMKSFAKAFISKANIGPRLTQVSVLQYGSITTIDVPWNVVPEKAHLLSLVDVMQREGGPSQIGDALGFAVRYLTSEMHGARPGASKAVVILVTDVSVDSVDAAADAARSNRVTVFPIGIGDRYDAAQLRILAGPAGDSNVVKLQRIEDLPTMVTLGNSFLHKLCSGFVRICMDEDGNEKRPGDVWTLPDQCHTVTCQPDGQTLLKSHRVNCDRGLRPSCPNSQSPVKVEETCGCRWTCPCVCTGSSTRHIVTFDGQNFKLTGSCSYVLFQNKEQDLEVILHNGACSPGARQGCMKSIEVKHSALSVELHSDMEVTVNGRLVSVPYVGGNMEVNVYGAIMHEVRFNHLGHIFTFTPQNNEFQLQLSPKTFASKTYGLCGICDENGANDFMLRDGTVTTDWKTLVQEWTVQRPGQTCQPILEEQCLVPDSSHCQVLLLPLFAECHKVLAPATFYAICQQDSCHQEQVCEVIASYAHLCRTNGVCVDWRTPDFCAMSCPPSLVYNHCEHGCPRHCDGNVSSCGDHPSEGCFCPPDKVMLEGSCVPEEACTQCIGEDGVQHQFLEAWVPDHQPCQICTCLSGRKVNCTTQPCPTAKAPTCGLCEVARLRQNADQCCPEYECVCDPVSCDLPPVPHCERGLQPTLTNPGECRPNFTCACRKEECKRVSPPSCPPHRLPTLRKTQCCDEYECACNCVNSTVSCPLGYLASTATNDCGCTTTTCLPDKVCVHRSTIYPVGQFWEEGCDVCTCTDMEDAVMGLRVAQCSQKPCEDSCRSGFTYVLHEGECCGRCLPSACEVVTGSPRGDSQSSWKSVGSQWASPENPCLINECVRVKEEVFIQQRNVSCPQLEVPVCPSGFQLSCKTSACCPSCRCERMEACMLNGTVIGPGKTVMIDVCRQRVTMMGKTYHLRRTVAEGISRCHLLLHMLWRPAGLALDNCRRPWGEPSSRGTTGQSYHQFSSEIPSENNPKVNGQLRAYALDGQL

SEQ ID NO: 899605 - protein, 2449 aa, Homo sapiens
MIPARFAGVLLALALILPGTLCAEGTRGRSSTARCSLFGSDFVNTFDGSMYSFAGYCSYLLAGGCQKRSFSIIGDFQNGKRVSLSVYLGEFFDIHLFVNGTVTQGDQRVSMPYASKGLYLETEAGYYKLSGEAYGFVARIDGSGNFQVLLSDRYFNKTCGLCGNFNIFAEDDFMTQEGTLTSDPYDFANSWALSSGEQWCERASPPSSSCNISSGEMQKGLWEQCQLLKSTSVFARCHPLVDPEPFVALCEKTLCECAGGLECACPALLEYARTCAQEGMVLYGWTDHSACSPVCPAGMEYRQCVSPCARTCQSLHIKEMCQERCVDGCSCPEGQLLDEGLCVESTECPCVHSGKRYPPGTSLSRDCNTCICRNSQWICSNEECPGECLVTGQSHFKSFDNRYFTFSGICQYLLARDCQDHSFSIVIETVQCADDRDAVCTRSVTVRLPGLHNSLVKLKHGAGVAMDGQDVQLPLLKGDLRIQHTVTASVRLSYGEDLQMDWDGRGRLLVKLSPVYAGKTCGLCGNYNGNQGDDFLTPSGLAEPRVEDFGNAWKLHGDCQDLQKQHSDPCALNPRMTRFSEEACAVLTSPTFEACHRAVSPLPYLRNCRYDVCSCSDGRECLCGALASYAAACAGRGVRVAWREPGRCELNCPKGQVYLQCGTPCNLTCRSLSYPDEECNEACLEGCFCPPGLYMDERGDCVPKAQCPCYYDGEIFQPEDIFSDHHTMCYCEDGFMHCTMSGVPGSLLPDAVLSSPLSHRSKRSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPGGLVVPPTDAPVSPTTLYVEDISEPPLHDFYCSRLLDLVFLLDGSSRLSEAEFEVLKAFVVDMMERLRISQKWVRVAVVEYHDGSHAYIGLKDRKRPSELRRIASQVKYAGSQVASTSEVLKYTLFQIFSKIDRPEASRIALLLMASQEPQRMSRNFVRYVQGLKKKKVIVIPVGIGPHANLKQIRLIEKQAPENKAFVLSSVDELEQQRDEIVSYLCDLAPEAPPPTLPPDMAQVTVGPGLLGVSTLGPKRNSMVLDVAFVLEGSDKIGEADFNRSKEFMEEVIQRMDVGQDSIHVTVLQYSYMVTVEYPFSEAQSKGDILQRVREIRYQGGNRTNTGLALRYLSDHSFLVSQGDREQAPNLVYMVTGNPASDEIKRLPGDIQVVPIGVGPNANVQELERIGWPNAPILIQDFETLPREAPDLVLQRCCSGEGLQIPTLSPAPDCSQPLDVILLLDGSSSFPASYFDEMKSFAKAFISKANIGPRLTQVSVLQYGSITTIDVPWNVVPEKAHLLSLVDVMQREGGPSQIGDALGFAVRYLTSEMHGARPGASKAVVILVTDVSVDSVDAAADAARSNRVTVFPIGIGDRYDAAQLRILAGPAGDSNVVKLQRIEDLPTMVTLGNSFLHKLCSGFVRICMDEDGNEKRPGDVWTLPDQCHTVTCQPDGQTLLKSHRVNCDRGLRPSCPNSQSPVKVEETCGCRWTCPCVCTGSSTRHIVTFDGQNFKLTGSCSYVLFQNKEQDLEVILHNGACSPGARQGCMKSIEVKHSALSVELHSDMEVTVNGRLVSVPYVGGNMEVNVYGAIMHEVRFNHLGHIFTFTPQNNEFQLQLSPKTFASKTYGLCGICDENGANDFMLRDGTVTTDWKTLVQEWTVQRPGQTCQPILEEQCLVPDSSHCQVLLLPLFAECHKVLAPATFYAICQQDSCHQEQVCEVIASYAHLCRTNGVCVDWRTPDFCAMSCPPSLVYNHCEHGCPRHCDGNVSSCGDHPSEGCFCPPDKVMLEGSCVPEEACTQCIGEDGVQHQFLEAWVPDHQPCQICTCLSGRKVNCTTQPCPTAKAPTCGLCEVARLRQNADQCCPEYECVCDPVSCDLPPVPHLPFLSLPKHSRHGVTPTFRKAGTQIENIEEDFRDGLKLMLLLEVISGEAEPGPGRDTVYVVLPDTLASALPMSAAGFGLLKQVGDDMYEFILGSVGLSFGSAASHPGALD

SEQ ID NO: 899606 - protein, 1097 aa, Homo sapiens
MIPARFAGVLLALALILPGTLCAEGTRGRSSTARCSLFGSDFVNTFDGSMYSFAGYCSYLLAGGCQKRSFSIIGDFQNGKRVSLSVYLGEFFDIHLFVNGTVTQGDQRVSMPYASKGLYLETEAGYYKLSGEAYGFVARIDGSGNFQVLLSDRYFNKTCGLCGNFNIFAEDDFMTQEGTLTSDPYDFANSWALSSGEQWCERASPPSSSCNISSGEMQKGLWEQCQLLKSTSVFARCHPLVDPEPFVALCEKTLCECAGGLECACPALLEYARTCAQEGMVLYGWTDHSACSPVCPAGMEYRQCVSPCARTCQSLHIKEMCQERCVDGCSCPEGQLLDEGLCVESTECPCVHSGKRYPPGTSLSRDCNTCICRNSQWICSNEECPGECLVTGQSHFKSFDNRYFTFSGICQYLLARDCQDHSFSIVIETVQCADDRDAVCTRSVTVRLPGLHNSLVKLKHGAGVAMDGQDVQLPLLKGDLRIQHTVTASVRLSYGEDLQMDWDGRGRLLVKLSPVYAGKTCGLCGNYNGNQGDDFLTPSGLAEPRVEDFGNAWKLHGDCQDLQKQHSDPCALNPRMTRFSEEACAVLTSPTFEACHRAVSPLPYLRNCRYDVCSCSDGRECLCGALASYAAACAGRGVRVAWREPGRCELNCPKGQVYLQCGTPCNLTCRSLSYPDEECNEACLEGCFCPPGLYMDERGDCVPKAQCPCYYDGEIFQPEDIFSDHHTMCYCEDGFMHCTMSGVPGSLLPDAVLSSPLSHRSKRSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVRTLRVVGSRRSQGLAWWYGHRV

SEQ ID NO: 899607 - protein, 111 aa, Homo sapiens
HSYKGWQVLEPQSLLSNIPAEALLLLLSLLELNCPKGQVYLQCGTPCNLTCRSLSYPDEECNEACLEGCFCPPGLYMDERGDCVPKAQCPCYYDGEIFQPEDIFSDHHTMW

SEQ ID NO: 899608 - protein, 86 aa, Homo sapiens
CGMAGEMMHRWDLPWVDPFDVPFQAQCALLVWSIGSVCPLAPGPARACTSKKCVRSDAWMAAAALVMNFPLYLQIRDLASTLGFGK

SEQ ID NO: 899609 - protein, 2916 aa, Homo sapiens
QLTAIVVGKGGWLVDVTAWALSPPAVGTPQPLGYITARQSGAVADLIEPLQQLRAWPRVGGTIVQQLSFPGTLEIAAALICRGSTIVQQLSFPGTLEIAAALFMIPARFAGVLLALALILPGTLCAEGTRGRSSTARCSLFGSDFVNTFDGSMYSFAGYCSYLLAGGCQKRSFSIIGDFQNGKRVSLSVYLGEFFDIHLFVNGTVTQGDQRVSMPYASKGLYLETEAGYYKLSGEAYGFVARIDGSGNFQVLLSDRYFNKTCGLCGNFNIFAEDDFMTQEGTLTSDPYDFANSWALSSGEQWCERASPPSSSCNISSGEMQKGLWEQCQLLKSTSVFARCHPLVDPEPFVALCEKTLCECAGGLECACPALLEYARTCAQEGMVLYGWTDHSACSPVCPAGMEYRQCVSPCARTCQSLHIKEMCQERCVDGCSCPEGQLLDEGLCVESTECPCVHSGKRYPPGTSLSRDCNTCICRNSQWICSNEECPGECLVTGQSHFKSFDNRYFTFSGICQYLLARDCQDHSFSIVIETVQCADDRDAVCTRSVTVRLPGLHNSLVKLKHGAGVAMDGQDVQLPLLKGDLRIQHTVTASVRLSYGEDLQMDWDGRGRLLVKLSPVYAGKTCGLCGNYNGNQGDDFLTPSGLAEPRVEDFGNAWKLHGDCQDLQKQHSDPCALNPRMTRFSEEACAVLTSPTFEACHRAVSPLPYLRNCRYDVCSCSDGRECLCGALASYAAACAGRGVRVAWREPGRCELNCPKGQVYLQCGTPCNLTCRSLSYPDEECNEACLEGCFCPPGLYMDERGDCVPKAQCPCYYDGEIFQPEDIFSDHHTMCYCEDGFMHCTMSGVPGSLLPDAVLSSPLSHRSKRSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPGGLVVPPTDAPVSPTTLYVEDISEPPLHDFYCSRLLDLVFLLDGSSRLSEAEFEVLKAFVVDMMERLRISQKWVRVAVVEYHDGSHAYIGLKDRKRPSELRRIASQVKYAGSQVASTSEVLKYTLFQIFSKIDRPEASRIALLLMASQEPQRMSRNFVRYVQGLKKKKVIVIPVGIGPHANLKQIRLIEKQAPENKAFVLSSVDELEQQRDEIVSYLCDLAPEAPPPTLPPDMAQVTVGPGLLGVSTLGPKRNSMVLDVAFVLEGSDKIGEADFNRSKEFMEEVIQRMDVGQDSIHVTVLQYSYMVTVEYPFSEAQSKGDILQRVREIRYQGGNRTNTGLALRYLSDHSFLVSQGDREQAPNLVYMVTGNPASDEIKRLPGDIQVVPIGVGPNANVQELERIGWPNAPILIQDFETLPREAPDLVLQRCCSGEGLQIPTLSPAPDCSQPLDVILLLDGSSSFPASYFDEMKSFAKAFISKANIGPRLTQVSVLQYGSITTIDVPWNVVPEKAHLLSLVDVMQREGGPSQIGDALGFAVRYLTSEMHGARPGASKAVVILVTDVSVDSVDAAADAARSNRVTVFPIGIGDRYDAAQLRILAGPAGDSNVVKLQRIEDLPTMVTLGNSFLHKLCSGFVRICMDEDGNEKRPGDVWTLPDQCHTVTCQPDGQTLLKSHRVNCDRGLRPSCPNSQSPVKVEETCGCRWTCPCVCTGSSTRHIVTFDGQNFKLTGSCSYVLFQNKEQDLEVILHNGACSPGARQGCMKSIEVKHSALSVELHSDMEVTVNGRLVSVPYVGGNMEVNVYGAIMHEVRFNHLGHIFTFTPQNNEFQLQLSPKTFASKTYGLCGICDENGANDFMLRDGTVTTDWKTLVQEWTVQRPGQTCQPILEEQCLVPDSSHCQVLLLPLFAECHKVLAPATFYAICQQDSCHQEQVCEVIASYAHLCRTNGVCVDWRTPDFCAMSCPPSLVYNHCEHGCPRHCDGNVSSCGDHPSEGCFCPPDKVMLEGSCVPEEACTQCIGEDGVQHQFLEAWVPDHQPCQICTCLSGRKVNCTTQPCPTAKAPTCGLCEVARLRQNADQCCPEYECVCDPVSCDLPPVPHCERGLQPTLTNPGECRPNFTCACRKEECKRVSPPSCPPHRLPTLRKTQCCDEYECACNCVNSTVSCPLGYLASTATNDCGCTTTTCLPDKVCVHRSTIYPVGQFWEEGCDVCTCTDMEDAVMGLRVAQCSQKPCEDSCRSGFTYVLHEGECCGRCLPSACEVVTGSPRGDSQSSWKSVGSQWASPENPCLINECVRVKEEVFIQQRNVSCPQLEVPVCPSGFQLSCKTSACCPSCRCERMEACMLNGTVIGPGKTVMIDVCTTCRCMVQVGVISGFKLECRKTTCNPCPLGYKEENNTGECCGRCLPTACTIQLRGGQIMTLKRDETLQDGCDTHFCKVNERGEYFWEKRVTGCPPFDEHKCLAEGGKIMKIPGTCCDTCEEPECNDITARLQYVKVGSCKSEVEVDIHYCQGKCASKAMYSIDINDVQDQCSCCSPTRTEPMQVALHCTNGSVVYHEVLNAMECKCSPRKCSK

SEQ ID NO: 899610 - protein, 2813 aa, Homo sapiens; identical to SEQ ID NO: 899597

SEQ ID NO: 899611 - protein, 2592 aa, Homo sapiens
GGLDTTKSVVIGTDTMSTGLTGAANVALCEKTLCECAGGLECACPALLEYARTCAQEGMVLYGWTDHSACSPVCPAGMEYRQCVSPCARTCQSLHIKEMCQERCVDGCSCPEGQLLDEGLCVESTECPCVHSGKRYPPGTSLSRDCNTCICRNSQWICSNEECPGECLVTGQSHFKSFDNRYFTFSGICQYLLARDCQDHSFSIVIETVQCADDRDAVCTRSVTVRLPGLHNSLVKLKHGAGVAMDGQDVQLPLLKGDLRIQHTVTASVRLSYGEDLQMDWDGRGRLLVKLSPVYAGKTCGLCGNYNGNQGDDFLTPSGLAEPRVEDFGNAWKLHGDCQDLQKQHSDPCALNPRMTRFSEEACAVLTSPTFEACHRAVSPLPYLRNCRYDVCSCSDGRECLCGALASYAAACAGRGVRVAWREPGRCELNCPKGQVYLQCGTPCNLTCRSLSYPDEECNEACLEGCFCPPGLYMDERGDCVPKAQCPCYYDGEIFQPEDIFSDHHTMCYCEDGFMHCTMSGVPGSLLPDAVLSSPLSHRSKRSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPGGLVVPPTDAPVSPTTLYVEDISEPPLHDFYCSRLLDLVFLLDGSSRLSEAEFEVLKAFVVDMMERLRISQKWVRVAVVEYHDGSHAYIGLKDRKRPSELRRIASQVKYAGSQVASTSEVLKYTLFQIFSKIDRPEASRIALLLMASQEPQRMSRNFVRYVQGLKKKKVIVIPVGIGPHANLKQIRLIEKQAPENKAFVLSSVDELEQQRDEIVSYLCDLAPEAPPPTLPPDMAQVTVGPGLLGVSTLGPKRNSMVLDVAFVLEGSDKIGEADFNRSKEFMEEVIQRMDVGQDSIHVTVLQYSYMVTVEYPFSEAQSKGDILQRVREIRYQGGNRTNTGLALRYLSDHSFLVSQGDREQAPNLVYMVTGNPASDEIKRLPGDIQVVPIGVGPNANVQELERIGWPNAPILIQDFETLPREAPDLVLQRCCSGEGLQIPTLSPAPDCSQPLDVILLLDGSSSFPASYFDEMKSFAKAFISKANIGPRLTQVSVLQYGSITTIDVPWNVVPEKAHLLSLVDVMQREGGPSQIGDALGFAVRYLTSEMHGARPGASKAVVILVTDVSVDSVDAAADAARSNRVTVFPIGIGDRYDAAQLRILAGPAGDSNVVKLQRIEDLPTMVTLGNSFLHKLCSGFVRICMDEDGNEKRPGDVWTLPDQCHTVTCQPDGQTLLKSHRVNCDRGLRPSCPNSQSPVKVEETCGCRWTCPCVCTGSSTRHIVTFDGQNFKLTGSCSYVLFQNKEQDLEVILHNGACSPGARQGCMKSIEVKHSALSVELHSDMEVTVNGRLVSVPYVGGNMEVNVYGAIMHEVRFNHLGHIFTFTPQNNEFQLQLSPKTFASKTYGLCGICDENGANDFMLRDGTVTTDWKTLVQEWTVQRPGQTCQPILEEQCLVPDSSHCQVLLLPLFAECHKVLAPATFYAICQQDSCHQEQVCEVIASYAHLCRTNGVCVDWRTPDFCAMSCPPSLVYNHCEHGCPRHCDGNVSSCGDHPSEGCFCPPDKVMLEGSCVPEEACTQCIGEDGVQHQFLEAWVPDHQPCQICTCLSGRKVNCTTQPCPTAKAPTCGLCEVARLRQNADQCCPEYECVCDPVSCDLPPVPHCERGLQPTLTNPGECRPNFTCACRKEECKRVSPPSCPPHRLPTLRKTQCCDEYECACNCVNSTVSCPLGYLASTATNDCGCTTTTCLPDKVCVHRSTIYPVGQFWEEGCDVCTCTDMEDAVMGLRVAQCSQKPCEDSCRSGFTYVLHEGECCGRCLPSACEVVTGSPRGDSQSSWKSVGSQWASPENPCLINECVRVKEEVFIQQRNVSCPQLEVPVCPSGFQLSCKTSACCPSCRCERMEACMLNGTVIGPGKTVMIDVCTTCRCMVQVGVISGFKLECRKTTCNPCPLGYKEENNTGECCGRCLPTACTIQLRGGQIMTLKRDETLQDGCDTHFCKVNERGEYFWEKRVTGCPPFDEHKCLAEGGKIMKIPGTCCDTCEEPECNDITARLQYVKVGSCKSEVEVDIHYCQGKCASKAMYSIDINDVQDQCSCCSPTRTEPMQVALHCTNGSVVYHEVLNAMECKCSPRKCSK

SEQ ID NO: 899612 - protein, 2010 aa, Homo sapiens
GRIPPPPRRIPPPPGRIPPPPGRIPPPPPSKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPGGLVVPPTDAPVSPTTLYVEDISEPPLHDFYCSRLLDLVFLLDGSSRLSEAEFEVLKAFVVDMMERLRISQKWVRVAVVEYHDGSHAYIGLKDRKRPSELRRIASQVKYAGSQVASTSEVLKYTLFQIFSKIDRPEASRIALLLMASQEPQRMSRNFVRYVQGLKKKKVIVIPVGIGPHANLKQIRLIEKQAPENKAFVLSSVDELEQQRDEIVSYLCDLAPEAPPPTLPPDMAQVTVGPGLLGVSTLGPKRNSMVLDVAFVLEGSDKIGEADFNRSKEFMEEVIQRMDVGQDSIHVTVLQYSYMVTVEYPFSEAQSKGDILQRVREIRYQGGNRTNTGLALRYLSDHSFLVSQGDREQAPNLVYMVTGNPASDEIKRLPGDIQVVPIGVGPNANVQELERIGWPNAPILIQDFETLPREAPDLVLQRCCSGEGLQIPTLSPAPDCSQPLDVILLLDGSSSFPASYFDEMKSFAKAFISKANIGPRLTQVSVLQYGSITTIDVPWNVVPEKAHLLSLVDVMQREGGPSQIGDALGFAVRYLTSEMHGARPGASKAVVILVTDVSVDSVDAAADAARSNRVTVFPIGIGDRYDAAQLRILAGPAGDSNVVKLQRIEDLPTMVTLGNSFLHKLCSGFVRICMDEDGNEKRPGDVWTLPDQCHTVTCQPDGQTLLKSHRVNCDRGLRPSCPNSQSPVKVEETCGCRWTCPCVCTGSSTRHIVTFDGQNFKLTGSCSYVLFQNKEQDLEVILHNGACSPGARQGCMKSIEVKHSALSVELHSDMEVTVNGRLVSVPYVGGNMEVNVYGAIMHEVRFNHLGHIFTFTPQNNEFQLQLSPKTFASKTYGLCGICDENGANDFMLRDGTVTTDWKTLVQEWTVQRPGQTCQPILEEQCLVPDSSHCQVLLLPLFAECHKVLAPATFYAICQQDSCHQEQVCEVIASYAHLCRTNGVCVDWRTPDFCAMSCPPSLVYNHCEHGCPRHCDGNVSSCGDHPSEGCFCPPDKVMLEGSCVPEEACTQCIGEDGVQHQFLEAWVPDHQPCQICTCLSGRKVNCTTQPCPTAKAPTCGLCEVARLRQNADQCCPEYECVCDPVSCDLPPVPHCERGLQPTLTNPGECRPNFTCACRKEECKRVSPPSCPPHRLPTLRKTQCCDEYECACNCVNSTVSCPLGYLASTATNDCGCTTTTCLPDKVCVHRSTIYPVGQFWEEGCDVCTCTDMEDAVMGLRVAQCSQKPCEDSCRSGFTYVLHEGECCGRCLPSACEVVTGSPRGDSQSSWKSVGSQWASPENPCLINECVRVKEEVFIQQRNVSCPQLEVPVCPSGFQLSCKTSACCPSCRCERMEACMLNGTVIGPGKTVMIDVCTTCRCMVQVGVISGFKLECRKTTCNPCPLGYKEENNTGECCGRCLPTACTIQLRGGQIMTLKRDETLQDGCDTHFCKVNERGEYFWEKRVTGCPPFDEHKCLAEGGKIMKIPGTCCDTCEEPECNDITARLQYVKVGSCKSEVEVDIHYCQGKCASKAMYSIDINDVQDQCSCCSPTRTEPMQVALHCTNGSVVYHEVLNAMECKCSPRKCSK

SEQ ID NO: 899613 - protein, 934 aa, Homo sapiens
MDEDGNEKRPGDVWTLPDQCHTVTCQPDGQTLLKSHRVNCDRGLRPSCPNSQSPVKVEETCGCRWTCPCVCTGSSTRHIVTFDGQNFKLTGSCSYVLFQNKEQDLEVILHNGACSPGARQGCMKSIEVKHSALSVELHSDMEVTVNGRLVSVPYVGGNMEVNVYGAIMHEVRFNHLGHIFTFTPQNNEFQLQLSPKTFASKTYGLCGICDENGANDFMLRDGTVTTDWKTLVQEWTVQRPGQTCQPILEEQCLVPDSSHCQVLLLPLFAECHKVLAPATFYAICQQDSCHQEQVCEVIASYAHLCRTNGVCVDWRTPDFCAMSCPPSLVYNHCEHGCPRHCDGNVSSCGDHPSEGCFCPPDKVMLEGSCVPEEACTQCIGEDGVQHQFLEAWVPDHQPCQICTCLSGRKVNCTTQPCPTAKAPTCGLCEVARLRQNADQCCPEYECVCDPVSCDLPPVPHCERGLQPTLTNPGECRPNFTCACRKEECKRVSPPSCPPHRLPTLRKTQCCDEYECACNCVNSTVSCPLGYLASTATNDCGCTTTTCLPDKVCVHRSTIYPVGQFWEEGCDVCTCTDMEDAVMGLRVAQCSQKPCEDSCRSGFTYVLHEGECCGRCLPSACEVVTGSPRGDSQSSWKSVGSQWASPENPCLINECVRVKEEVFIQQRNVSCPQLEVPVCPSGFQLSCKTSACCPSCRCERMEACMLNGTVIGPGKTVMIDVCTTCRCMVQVGVISGFKLECRKTTCNPCPLGYKEENNTGECCGRCLPTACTIQLRGGQIMTLKRDETLQDGCDTHFCKVNERGEYFWEKRVTGCPPFDEHKCLAEGGKIMKIPGTCCDTCEEPECNDITARLQYVKVGSCKSEVEVDIHYCQGKCASKAMYSIDINDVQDQCSCCSPTRTEPMQVALHCTNGSVVYHEVLNAMECKCSPRKCSK

SEQ ID NO: 899614 - protein, 548 aa, Homo sapiens
IGGELESSSSISEHFSGFATPIILRPLYKQQENRTQSQIPYPTLDFSLVSSGREKPMIFKQGSPSEYAAFLEIEVSELHKHFSVPTVPSQQSNNTACRKEECKRVSPPSCPPHRLPTLRKTQCCDEYECACNCVNSTVSCPLGYLASTATNDCGCTTTTCLPDKVCVHRSTIYPVGQFWEEGCDVCTCTDMEDAVMGLRVAQCSQKPCEDSCRSGFTYVLHEGECCGRCLPSACEVVTGSPRGDSQSSWKSVGSQWASPENPCLINECVRVKEEVFIQQRNVSCPQLEVPVCPSGFQLSCKTSACCPSCRCERMEACMLNGTVIGPGKTVMIDVCTTCRCMVQVGVISGFKLECRKTTCNPCPLGYKEENNTGECCGRCLPTACTIQLRGGQIMTLKRDETLQDGCDTHFCKVNERGEYFWEKRVTGCPPFDEHKCLAEGGKIMKIPGTCCDTCEEPECNDITARLQYVKVGSCKSEVEVDIHYCQGKCASKAMYSIDINDVQDQCSCCSPTRTEPMQVALHCTNGSVVYHEVLNAMECKCSPRKCSK

SEQ ID NO: 899615 - protein, 2603 aa, Homo sapiens
MIPARFAGVLLALALILPGTLCAEGTRGRSSTARCSLFGSDFVNTFDGSMYSFAGYCSYLLAGGCQKRSFSIIGDFQNGKRVSLSVYLGEFFDIHLFVNGTVTQGDQRVSMPYASKGLYLETEAGYYKLSGEAYGFVARIDGSGNFQVLLSDRYFNKTCGLCGNFNIFAEDDFMTQEGTLTSDPYDFANSWALSSGEQWCERASPPSSSCNISSGEMQKGLWEQCQLLKSTSVFARCHPLVDPEPFVALCEKTLCECAGGLECACPALLEYARTCAQEGMVLYGWTDHSACSPVCPAGMEYRQCVSPCARTCQSLHIKEMCQERCVDGCSCPEGQLLDEGLCVESTECPCVHSGKRYPPGTSLSRDCNTCICRNSQWICSNEECPGECLVTGQSHFKSFDNRYFTFSGICQYLLARDCQDHSFSIVIETVQCADDRDAVCTRSVTVRLPGLHNSLVKLKHGAGVAMDGQDVQLPLLKGDLRIQHTVTASVRLSYGEDLQMDWDGRGRLLVKLSPVYAGKTCGLCGNYNGNQGDDFLTPSGLAEPRVEDFGNAWKLHGDCQDLQKQHSDPCALNPRMTRFSEEACAVLTSPTFEACHRAVSPLPYLRNCRYDVCSCSDGRECLCGALASYAAACAGRGVRVAWREPGRCELNCPKGQVYLQCGTPCNLTCRSLSYPDEECNEACLEGCFCPPGLYMDERGDCVPKAQCPCYYDGEIFQPEDIFSDHHTMCYCEDGFMHCTMSGVPGSLLPDAVLSSPLSHRSKRSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPGGLVVPPTDAPVSPTTLYVEDISEPPLHDFYCSRLLDLVFLLDGSSRLSEAEFEVLKAFVVDMMERLRISQKWVRVAVVEYHDGSHAYIGLKDRKRPSELRRIASQVKYAGSQVASTSEVLKYTLFQIFSKIDRPEASRIALLLMASQEPQRMSRNFVRYVQGLKKKKVIVIPVGIGPHANLKQIRLIEKQAPENKAFVLSSVDELEQQRDEIVSYLCDLAPEAPPPTLPPDMAQVTVGPGLLGVSTLGPKRNSMVLDVAFVLEGSDKIGEADFNRSKEFMEEVIQRMDVGQDSIHVTVLQYSYMVTVEYPFSEAQSKGDILQRVREIRYQGGNRTNTGLALRYLSDHSFLVSQGDREQAPNLVYMVTGNPASDEIKRLPGDIQVVPIGVGPNANVQELERIGWPNAPILIQDFETLPREAPDLVLQRCCSGEGLQIPTLSPAPDCSQPLDVILLLDGSSSFPASYFDEMKSFAKAFISKANIGPRLTQVSVLQYGSITTIDVPWNVVPEKAHLLSLVDVMQREGGPSQIGDALGFAVRYLTSEMHGARPGASKAVVILVTDVSVDSVDAAADAARSNRVTVFPIGIGDRYDAAQLRILAGPAGDSNVVKLQRIEDLPTMVTLGNSFLHKLCSGFVRICMDEDGNEKRPGDVWTLPDQCHTVTCQPDGQTLLKSHRVNCDRGLRPSCPNSQSPVKVEETCGCRWTCPCVCTGSSTRHIVTFDGQNFKLTGSCSYVLFQNKEQDLEVILHNGACSPGARQGCMKSIEVKHSALSVELHSDMEVTVNGRLVSVPYVGGNMEVNVYGAIMHEVRFNHLGHIFTFTPQNNEFQLQLSPKTFASKTYGLCGICDENGANDFMLRDGTVTTDWKTLVQEWTVQRPGQTCQPILEEQCLVPDSSHCQVLLLPLFAECHKVLAPATFYAICQQDSCHQEQVCEVIASYAHLCRTNGVCVDWRTPDFCAMSCPPSLVYNHCEHGCPRHCDGNVSSCGDHPSEGCFCPPDKVMLEGSCVPEEACTQCIGEDGVQHQFLEAWVPDHQPCQICTCLSGRKVNCTTQPCPTAKAPTCGLCEVARLRQNADQCCPEYECVCDPVSCDLPPVPHCERGLQPTLTNPGECRPNFTCACRKEECKRVSPPSCPPHRLPTLRKTQCCDEYECACNCVNSTVSCPLGYLASTATNDCGCTTTTCLPDKVCVHRSTIYPVGQFWEEGCDVCTCTDMEDAVMGLRVAQCSQKPCEDSCRSGFTYVLHEGECCGRCLPSACEVVTGSPRGDSQSSWKSVGSQWASPENPCLINECVRVKEEVFIQQRNVSCPQLEVPVCPSGFQLSCKTSACCPSCRCGAHVRPACLLDLSLCPVNTCDYPTFSW

SEQ ID NO: 899616 - protein, 2290 aa, Homo sapiens
MIPARFAGVLLALALILPGTLCAEGTRGRSSTARCSLFGSDFVNTFDGSMYSFAGYCSYLLAGGCQKRSFSIIGDFQNGKRVSLSVYLGEFFDIHLFVNGTVTQGDQRVSMPYASKGLYLETEAGYYKLSGEAYGFVARIDGSGNFQVLLSDRYFNKTCGLCGNFNIFAEDDFMTQEGTLTSDPYDFANSWALSSGEQWCERASPPSSSCNISSGEMQKGLWEQCQLLKSTSVFARCHPLVDPEPFVALCEKTLCECAGGLECACPALLEYARTCAQEGMVLYGWTDHSACSPVCPAGMEYRQCVSPCARTCQSLHIKEMCQERCVDGCSCPEGQLLDEGLCVESTECPCVHSGKRYPPGTSLSRDCNTCICRNSQWICSNEECPGECLVTGQSHFKSFDNRYFTFSGICQYLLARDCQDHSFSIVIETVQCADDRDAVCTRSVTVRLPGLHNSLVKLKHGAGVAMDGQDVQLPLLKGDLRIQHTVTASVRLSYGEDLQMDWDGRGRLLVKLSPVYAGKTCGLCGNYNGNQGDDFLTPSGLAEPRVEDFGNAWKLHGDCQDLQKQHSDPCALNPRMTRFSEEACAVLTSPTFEACHRAVSPLPYLRNCRYDVCSCSDGRECLCGALASYAAACAGRGVRVAWREPGRCELNCPKGQVYLQCGTPCNLTCRSLSYPDEECNEACLEGCFCPPGLYMDERGDCVPKAQCPCYYDGEIFQPEDIFSDHHTMCYCEDGFMHCTMSGVPGSLLPDAVLSSPLSHRSKRSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPGGLVVPPTDAPVSPTTLYVEDISEPPLHDFYCSRLLDLVFLLDGSSRLSEAEFEVLKAFVVDMMERLRISQKWVRVAVVEYHDGSHAYIGLKDRKRPSELRRIASQVKYAGSQVASTSEVLKYTLFQIFSKIDRPEASRIALLLMASQEPQRMSRNFVRYVQGLKKKKVIVIPVGIGPHANLKQIRLIEKQAPENKAFVLSSVDELEQQRDEIVSYLCDLAPEAPPPTLPPDMAQVTVGPGLLGVSTLGPKRNSMVLDVAFVLEGSDKIGEADFNRSKEFMEEVIQRMDVGQDSIHVTVLQYSYMVTVEYPFSEAQSKGDILQRVREIRYQGGNRTNTGLALRYLSDHSFLVSQGDREQAPNLVYMVTGNPASDEIKRLPGDIQVVPIGVGPNANVQELERIGWPNAPILIQDFETLPREAPDLVLQRCCSGEGLQIPTLSPAPDCSQPLDVILLLDGSSSFPASYFDEMKSFAKAFISKANIGPRLTQVSVLQYGSITTIDVPWNVVPEKAHLLSLVDVMQREGGPSQIGDALGFAVRYLTSEMHGARPGASKAVVILVTDVSVDSVDAAADAARSNRVTVFPIGIGDRYDAAQLRILAGPAGDSNVVKLQRIEDLPTMVTLGNSFLHKLCSGFVRICMDEDGNEKRPGDVWTLPDQCHTVTCQPDGQTLLKSHRVNCDRGLRPSCPNSQSPVKVEETCGCRWTCPCVCTGSSTRHIVTFDGQNFKLTGSCSYVLFQNKEQDLEVILHNGACSPGARQGCMKSIEVKHSALSVELHSDMEVTVNGRLVSVPYVGGNMEVNVYGAIMHEVRFNHLGHIFTFTPQNNEFQLQLSPKTFASKTYGLCGICDENGANDFMLRDGTVTTDWKTLVQEWTVQRPGQTCQPILEEQCLVPDSSHCQVLLLPLFAECHKVLAPATFYAICQQDSCHQEQVCEVIASYAHLCRTNGVCVDWRTPDFCAMSCPPSLVYNHCEHGCPRHCDGNVSSCGDHPSEGCFCPPDKVMLEGSCVPEEACTQCIGEDGVQHQVGAWAFHFPWGCFPLGSKGRYVHQ

SEQ ID NO: 899617 - protein, 92 aa, Homo sapiens
LYPCWQAPASQAVYCVVGTSPLRVDIHYCQGKCASKAMYSIDINDVQDQCSCCSPTRTEPMQVALHCTNGSVVYHEVLNAMECKCSPRKCSK

SEQ ID NO: 899618 - protein, 76 aa, Homo sapiens
PSSSWISCFVFLQVNVKRPMKDETHFEVVESGRYIILLLGKALSVVWDRHLSISVVLKQTYQVSGFLASSCWGLGL

SEQ ID NO: 899619 - protein, 969 aa, Homo sapiens
SKSIHHTRAPLAAPPSDDGDPGGRQEDMASDAVQSEPRSWSLLEQLGLAGADLAAPGVQQQLELERERLRREIRKELKLKEGAENLRRATTDLGRSLGPVELLLRGSSRRLDLLHQQLQELHAHVVLPDPAATHDGPQSPGAGGPTCSATNLSRVAGLEKQLAIELKVKQGAENMIQTYSNGSTKDRKLLLTAQQMLQDSKTKIDIIRMQLRRALQAGQLENQAAPDDTQGSPDLGAVELRIEELRHHFRVEHAVAEGAKNVLRLLSAAKAPDRKAVSEAQEKLTESNQKLGLLREALERRLGELPADHPKGRLLREELAAASSAAFSTRLAGPFPATHYSTLCKPAPLTGTLEVRVVGCRDLPETIPWNPTPSMGGPGTPDSRPPFLSRPARGLYSRSGSLSGRSSLKAEAENTSEVSTVLKLDNTVVGQTSWKPCGPNAWDQSFTLELERARELELAVFWRDQRGLCALKFLKLEDFLDNERHEVQLDMEPQGCLVAEVTFRNPVIERIPRLRRQKKIFSKQQGKAFQRARQMNIDVATWVRLLRRLIPNATGTGTFSPGASPGSEARTTGDISVEKLNLGTDSDSSPQKSSRDPPSSPSSLSSPIQESTAPELPSETQETPGPALCSPLRKSPLTLEDFKFLAVLGRGHFGKVLLSEFRPSGELFAIKALKKGDIVARDEVESLMCEKRILAAVTSAGHPFLVNLFGCFQTPEHVCFVMEYSAGGDLMLHIHSDVFSEPRAIFYSACVVLGLQFLHEHKIVYRDLKLDNLLLDTEGYVKIADFGLCKEGMGYGDRTSTFCGTPEFLAPEVLTDTSYTRAVDWWGLGVLLYEMLVGESPFPGDDEEEVFDSIVNDEVRYPRFLSAEAIGIMRRLLRRNPERRLGSSERDAEDVKKQPFFRTLGWEALLARRLPPPFVPTLSGRTDVSNFDEEFTGEAPTLSPPRDARPLTAAEQAAFLDFDFVAGGC

SEQ ID NO: 899620 - protein, 954 aa, Homo sapiens
PQPGPRMAEANNPSEQELESEPRSWSLLEQLGLAGADLAAPGVQQQLELERERLRREIRKELKLKEGAENLRRATTDLGRSLGPVELLLRGSSRRLDLLHQQLQELHAHVVLPDPAATHDGPQSPGAGGPTCSATNLSRVAGLEKQLAIELKVKQGAENMIQTYSNGSTKDRKLLLTAQQMLQDSKTKIDIIRMQLRRALQAGQLENQAAPDDTQGSPDLGAVELRIEELRHHFRVEHAVAEGAKNVLRLLSAAKAPDRKAVSEAQEKLTESNQKLGLLREALERRLGELPADHPKGRLLREELAAASSAAFSTRLAGPFPATHYSTLCKPAPLTGTLEVRVVGCRDLPETIPWNPTPSMGGPGTPDSRPPFLSRPARGLYSRSGSLSGRSSLKAEAENTSEVSTVLKLDNTVVGQTSWKPCGPNAWDQSFTLELERARELELAVFWRDQRGLCALKFLKLEDFLDNERHEVQLDMEPQGCLVAEVTFRNPVIERIPRLRRQKKIFSKQQGKAFQRARQMNIDVATWVRLLRRLIPNATGTGTFSPGASPGSEARTTGDISVEKLNLGTDSDSSPQKSSRDPPSSPSSLSSPIQESTAPELPSETQETPGPALCSPLRKSPLTLEDFKFLAVLGRGHFGKVLLSEFRPSGELFAIKALKKGDIVARDEVESLMCEKRILAAVTSAGHPFLVNLFGCFQTPEHVCFVMEYSAGGDLMLHIHSDVFSEPRAIFYSACVVLGLQFLHEHKIVYRDLKLDNLLLDTEGYVKIADFGLCKEGMGYGDRTSTFCGTPEFLAPEVLTDTSYTRAVDWWGLGVLLYEMLVGESPFPGDDEEEVFDSIVNDEVRYPRFLSAEAIGIMRRLLRRNPERRLGSSERDAEDVKKQPFFRTLGWEALLARRLPPPFVPTLSGRTDVSNFDEEFTGEAPTLSPPRDARPLTAAEQAAFLDFDFVAGGC

SEQ ID NO: 899621 - protein, 989 aa, Homo sapiens
MQIRPELVSRVPGGPKASAALGLNAWNRSPRVPARSNGGPLGSVRSSRDPERGKSEPRSWSLLEQLGLAGADLAAPGVQQQLELERERLRREIRKELKLKEGAENLRRATTDLGRSLGPVELLLRGSSRRLDLLHQQLQELHAHVVLPDPAATHDGPQSPGAGGPTCSATNLSRVAGLEKQLAIELKVKQGAENMIQTYSNGSTKDRKLLLTAQQMLQDSKTKIDIIRMQLRRALQAGQLENQAAPDDTQGSPDLGAVELRIEELRHHFRVEHAVAEGAKNVLRLLSAAKAPDRKAVSEAQEKLTESNQKLGLLREALERRLGELPADHPKGRLLREELAAASSAAFSTRLAGPFPATHYSTLCKPAPLTGTLEVRVVGCRDLPETIPWNPTPSMGGPGTPDSRPPFLSRPARGLYSRSGSLSGRSSLKAEAENTSEVSTVLKLDNTVVGQTSWKPCGPNAWDQSFTLELERARELELAVFWRDQRGLCALKFLKLEDFLDNERHEVQLDMEPQGCLVAEVTFRNPVIERIPRLRRQKKIFSKQQGKAFQRARQMNIDVATWVRLLRRLIPNATGTGTFSPGASPGSEARTTGDISVEKLNLGTDSDSSPQKSSRDPPSSPSSLSSPIQESTAPELPSETQETPGPALCSPLRKSPLTLEDFKFLAVLGRGHFGKVLLSEFRPSGELFAIKALKKGDIVARDEVESLMCEKRILAAVTSAGHPFLVNLFGCFQTPEHVCFVMEYSAGGDLMLHIHSDVFSEPRAIFYSACVVLGLQFLHEHKIVYRDLKLDNLLLDTEGYVKIADFGLCKEGMGYGDRTSTFCGTPEFLAPEVLTDTSYTRAVDWWGLGVLLYEMLVGESPFPGDDEEEVFDSIVNDEVRYPRFLSAEAIGIMRRLLRRNPERRLGSSERDAEDVKKQPFFRTLGWEALLARRLPPPFVPTLSGRTDVSNFDEEFTGEAPTLSPPRDARPLTAAEQAAFLDFDFVAGGC

SEQ ID NO: 899622 - protein, 955 aa, Homo sapiens
GCTVRKVFGSEAITLEQELESEPRSWSLLEQLGLAGADLAAPGVQQQLELERERLRREIRKELKLKEGAENLRRATTDLGRSLGPVELLLRGSSRRLDLLHQQLQELHAHVVLPDPAATHDGPQSPGAGGPTCSATNLSRVAGLEKQLAIELKVKQGAENMIQTYSNGSTKDRKLLLTAQQMLQDSKTKIDIIRMQLRRALQAGQLENQAAPDDTQGSPDLGAVELRIEELRHHFRVEHAVAEGAKNVLRLLSAAKAPDRKAVSEAQEKLTESNQKLGLLREALERRLGELPADHPKGRLLREELAAASSAAFSTRLAGPFPATHYSTLCKPAPLTGTLEVRVVGCRDLPETIPWNPTPSMGGPGTPDSRPPFLSRPARGLYSRSGSLSGRSSLKAEAENTSEVSTVLKLDNTVVGQTSWKPCGPNAWDQSFTLELERARELELAVFWRDQRGLCALKFLKLEDFLDNERHEVQLDMEPQGCLVAEVTFRNPVIERIPRLRRQKKIFSKQQGKAFQRARQMNIDVATWVRLLRRLIPNATGTGTFSPGASPGSEARTTGDISVEKLNLGTDSDSSPQKSSRDPPSSPSSLSSPIQESTAPELPSETQETPGPALCSPLRKSPLTLEDFKFLAVLGRGHFGKVLLSEFRPSGELFAIKALKKGDIVARDEVESLMCEKRILAAVTSAGHPFLVNLFGCFQTPEHVCFVMEYSAGGDLMLHIHSDVFSEPRAIFYSACVVLGLQFLHEHKIVYRDLKLDNLLLDTEGYVKIADFGLCKEGMGYGDRTSTFCGTPEFLAPEVLTDTSYTRAVDWWGLGVLLYEMLVGESPFPGDDEEEVFDSIVNDEVRYPRFLSAEAIGIMRRLLRRNPERRLGSSERDAEDVKKQPFFRTLGWEALLARRLPPPFVPTLSGRTDVSNFDEEFTGEAPTLSPPRDARPLTAAEQAAFLDFDFVAGGC

SEQ ID NO: 899623 - protein, 435 aa, Homo sapiens [sequence omitted]

SEQ ID NO: 899624 - protein, 435 aa, Homo sapiens [sequence omitted]

SEQ ID NO: 899625 - protein, 354 aa, Homo sapiens
STLLVPIKINVRAARNQKPSPWQPRTFTSKSAVLGRVILGVLLSEFRPSGELFAIKALKKGDIVARDEVESLMCEKRILAAVTSAGHPFLVNLFGCFQTPEHVCFVMEYSAGGDLMLHIHSDVFSEPRAIFYSACVVLGLQFLHEHKIVYRDLKLDNLLLDTEGYVKIADFGLCKEGMGYGDRTSTFCGTPEFLAPEVLTDTSYTRAVDWWGLGVLLYEMLVGESPFPGDDEEEVFDSIVNDEVRYPRFLSAEAIGIMRRLLRRNPERRLGSSERDAEDVKKQPFFRTLGWEALLARRLPPPFVPTLSGRTDVSNFDEEFTGEAPTLSPPRDARPLTAAEQAAFLDFDFVAGGC

SEQ ID NO: 899626 - protein, 418 aa, Homo sapiens
LQGLGGCCGYEGISDSPYSGLLSPPQSSPIQESTAPELPSETQETPGPALCSPLRKSPLTLEDFKFLAVLGRGHFGKVRWRAGNWETPQVPGWPLKPPLPTVFQVLLSEFRPSGELFAIKALKKGDIVARDEVESLMCEKRILAAVTSAGHPFLVNLFGCFQTPEHVCFVMEYSAGGDLMLHIHSDVFSEPRAIFYSACVVLGLQFLHEHKIVYRDLKLDNLLLDTEGYVKIADFGLCKEGMGYGDRTSTFCGTPEFLAPEVLTDTSYTRAVDWWGLGVLLYEMLVGESPFPGDDEEEVFDSIVNDEVRYPRFLSAEAIGIMRRLLRRNPERRLGSSERDAEDVKKQPFFRTLGWEALLARRLPPPFVPTLSGRTDVSNFDEEFTGEAPTLSPPRDARPLTAAEQAAFLDFDFVAGGC

SEQ ID NO: 899627 - protein, 905 aa, Homo sapiens
PQPGPRMAEANNPSEQELESEPRSWSLLEQLGLAGADLAAPGVQQQLELERERLRREIRKELKLKEGAENLRRATTDLGRSLGPVELLLRGSSRRLDLLHQQLQELHAHVVLPDPAATHDGPQSPGAGGPTCSATNLSRVAGLEKQLAIELKVKQGAENMIQTYSNGSTKDRKLLLTAQQMLQDSKTKIDIIRMQLRRALQAGQLENQAAPDDTQGSPDLGAVELRIEELRHHFRVEHAVAEGAKNVLRLLSAAKAPDRKAVSEAQEKLTESNQKLGLLREALERRLGELPADHPKGRLLREELAAASSAAFSTRLAGPFPATHYSTLCKPAPLTGTLEVRVVGCRDLPETIPWNPTPSMGGPGTPDSRPPFLSRPARGLYSRSGSLSGRSSLKAEAENTSEVSTVLKLDNTVVGQTSWKPCGPNAWDQSFTLELERARELELAVFWRDQRGLCALKFLKLEDFLDNERHEVQLDMEPQGCLVAEVTFRNPVIERIPRLRRQKKIFSKQQGKAFQRARQMNIDVATWVRLLRRLIPNATGTGTFSPGASPGSEARTTGDISVEKLNLGTDSDSSPQKSSRDPPSSPSSLSSPIQESTAPELPSETQETPGPALCSPLRKSPLTLEDFKFLAVLGRGHFGKVLLSEFRPSGELFAIKALKKGDIVARDEVESLMCEKRILAAVTSAGHPFLVNLFGCFQTPEHVCFVMEYSAGGDLMLHIHSDVFSEPRAIFYSACVVLGLQFLHEHKIVYRDLKLDNLLLDTEGYVKIADFGLCKEGMGYGDRTSTFCGTPEFLAPEVLTDTSYTRAVDWWGLGVLLYEMLVGESPFPGDDEEEVFDSIVNDEVRYPRFLSAEAIGIMRRLLRRNPERRLGSSERDAEDVKKQPFFRTLGMGQPILFRALHRHSE

SEQ ID NO: 899628 - protein, 853 aa, Homo sapiens
PQPGPRMAEANNPSEQELESEPRSWSLLEQLGLAGADLAAPGVQQQLELERERLRREIRKELKLKEGAENLRRATTDLGRSLGPVELLLRGSSRRLDLLHQQLQELHAHVVLPDPAATHDGPQSPGAGGPTCSATNLSRVAGLEKQLAIELKVKQGAENMIQTYSNGSTKDRKLLLTAQQMLQDSKTKIDIIRMQLRRALQAGQLENQAAPDDTQGSPDLGAVELRIEELRHHFRVEHAVAEGAKNVLRLLSAAKAPDRKAVSEAQEKLTESNQKLGLLREALERRLGELPADHPKGRLLREELAAASSAAFSTRLAGPFPATHYSTLCKPAPLTGTLEVRVVGCRDLPETIPWNPTPSMGGPGTPDSRPPFLSRPARGLYSRSGSLSGRSSLKAEAENTSEVSTVLKLDNTVVGQTSWKPCGPNAWDQSFTLELERARELELAVFWRDQRGLCALKFLKLEDFLDNERHEVQLDMEPQGCLVAEVTFRNPVIERIPRLRRQKKIFSKQQGKAFQRARQMNIDVATWVRLLRRLIPNATGTGTFSPGASPGSEARTTGDISVEKLNLGTDSDSSPQKSSRDPPSSPSSLSSPIQESTAPELPSETQETPGPALCSPLRKSPLTLEDFKFLAVLGRGHFGKVLLSEFRPSGELFAIKALKKGDIVARDEVESLMCEKRILAAVTSAGHPFLVNLFGCFQTPEHVCFVMEYSAGGDLMLHIHSDVFSEPRAIFYSACVVLGLQFLHEHKIVYRDLKLDNLLLDTEGYVKIADFGLCKEGMGYGDRTSTFCGTPEFLAPEVLTDTSYTLSGRTDVSNFDEEFTGEAPTLSPPRDARPLTAAEQAAFLDFDFVAGGC

SEQ ID NO: 899629 - protein, 195 aa, Homo sapiens
MVDPRRSDRRLWPLQGLGMGYGDRTSTFCGTPEFLAPEVLTDTSYTRAVDWWGLGVLLYEMLVGESPFPGDDEEEVFDSIVNDEVRYPRFLSAEAIGIMRRLLRRNPERRLGSSERDAEDVKKQPFFRTLGWEALLARRLPPPFVPTLSGRTDVSNFDEEFTGEAPTLSPPRDARPLTAAEQAAFLDFDFVAGGC

SEQ ID NO: 899630 - protein, 755 aa, Homo sapiens
PQPGPRMAEANNPSEQELESEPRSWSLLEQLGLAGADLAAPGVQQQLELERERLRREIRKELKLKEGAENLRRATTDLGRSLGPVELLLRGSSRRLDLLHQQLQELHAHVVLPDPAATHDGPQSPGAGGPTCSATNLSRVAGLEKQLAIELKVKQGAENMIQTYSNGSTKDRKLLLTAQQMLQDSKTKIDIIRMQLRRALQAGQLENQAAPDDTQGSPDLGAVELRIEELRHHFRVEHAVAEGAKNVLRLLSAAKAPDRKAVSEAQEKLTESNQKLGLLREALERRLGELPADHPKGRLLREELAAASSAAFSTRLAGPFPATHYSTLCKPAPLTGTLEVRVVGCRDLPETIPWNPTPSMGGPGTPDSRPPFLSRPARGLYSRSGSLSGRSSLKAEAENTSEVSTVLKLDNTVVGQTSWKPCGPNAWDQSFTLELERARELELAVFWRDQRGLCALKFLKLEDFLDNERHEVQLDMEPQGCLVAEVTFRNPVIERIPRLRRQKKIFSKQQGKAFQRARQMNIDVATWVRLLRRLIPNATGTGTFSPGASPGSEARTTGDISVEKLNLGTDSDSSPQKSSRDPPSSPSSLSSPIQESTAPELPSETQETPGPALCSPLRKSPLTLEDFKFLAVLGRGHFGKVLLSEFRPSGELFAIKALKKGDIVARDEVESLMCEKRILAAVTSAGHPFLVNLFGCFQTPEHVCFVMEYSAGGDLMLHIHSDVFSEPRAIFYFPLPPPFCAPRWSRPHTEFKKTF

SEQ ID NO: 899631 - protein, 654 aa, Homo sapiens
PQPGPRMAEANNPSEQELESEPRSWSLLEQLGLAGADLAAPGVQQQLELERERLRREIRKELKLKEGAENLRRATTDLGRSLGPVELLLRGSSRRLDLLHQQLQELHAHVVLPDPAATHDGPQSPGAGGPTCSATNLSRVAGLEKQLAIELKVKQGAENMIQTYSNGSTKDRKLLLTAQQMLQDSKTKIDIIRMQLRRALQAGQLENQAAPDDTQGSPDLGAVELRIEELRHHFRVEHAVAEGAKNVLRLLSAAKAPDRKAVSEAQEKLTESNQKLGLLREALERRLGELPADHPKGRLLREELAAASSAAFSTRLAGPFPATHYSTLCKPAPLTGTLEVRVVGCRDLPETIPWNPTPSMGGPGTPDSRPPFLSRPARGLYSRSGSLSGRSSLKAEAENTSEVSTVLKLDNTVVGQTSWKPCGPNAWDQSFTLELERARELELAVFWRDQRGLCALKFLKLEDFLDNERHEVQLDMEPQGCLVAEVTFRNPVIERIPRLRRQKKIFSKQQGKAFQRARQMNIDVATWVRLLRRLIPNATGTGTFSPGASPGSEARTTGDISVEKLNLGTDSDSSPQKSSRDPPSSPSSLSSPIQESTAPELPSETQETPGPALCRLWAGKPCWPGACHRPLCPRCPAAPTSATSTRSSPGRPPH

SEQ ID NO: 899632 - protein, 151 aa, Homo sapiens
YEAYVDEAVGVLLSDEMLVGESPFPGDDEEEVFDSIVNDEVRYPRFLSAEAIGIMRRLLRRNPERRLGSSERDAEDVKKQPFFRTLGWEALLARRLPPPFVPTLSGRTDVSNFDEEFTGEAPTLSPPRDARPLTAAEQAAFLDFDFVAGGC

SEQ ID NO: 899633 - protein, 428 aa, Homo sapiens
PQPGPRMAEANNPSEQELESEPRSWSLLEQLGLAGADLAAPGVQQQLELERERLRREIRKELKLKEGAENLRRATTDLGRSLGPVELLLRGSSRRLDLLHQQLQELHAHVVLPDPAATHDGPQSPGAGGPTCSATNLSRVAGLEKQLAIELKVKQGAENMIQTYSNGSTKDRKLLLTAQQMLQDSKTKIDIIRMQLRRALQAGQLENQAAPDDTQGSPDLGAVELRIEELRHHFRVEHAVAEGAKNVLRLLSAAKAPDRKAVSEAQEKLTESNQKLGLLREALERRLGELPADHPKGRLLREELAAASSAAFSTRLAGPFPATHYSTLCKPAPLTAPRHARGARALLWPPSLRAGTPGGRQEDMASDAVQSEPRSWSLLEQLGPGGADLGGPGGTATQLEAWSGNRLRREIRKSLKLQEGAANLMEGH

SEQ ID NO: 899634 - protein, 358 aa, Homo sapiens
LARRGGSRAGRSGPRAGEGRAAPAPSPPRPGRTRAPLAAPPSDDGDPGGRQEDMASDAVQSEPRSWSLLEQLGLAGADLAAPGVQQQLELERERLRREIRKELKLKEGAENLRRATTDLGRSLGPVELLLRGSSRRLDLLHQQLQELHAHVVLPDPAATHDGPQSPGAGGPTCSATNLSRVAGLEKQLAIELKVKQGAENMIQTYSNGSTKDRKLLLTAQQMLQDSKTKIDIIRMQLRRALQAGQLENQAAPDDTQGSPDLGAVELRIEELRHHFRVEHAVAEGAKNVLRLLSAAKAPDRKAVSEAREMQIHRMGCGQPERDWDCRHTQGGVKKPGALGLDAGASHKNVTGSRKWATT

SEQ ID NO: 899635 - protein, 954 aa, Homo sapiens
EFPRRDSRSQVDMASDAVQSEPRSWSLLEQLGLAGADLAAPGVQQQLELERERLRREIRKELKLKEGAENLRRATTDLGRSLGPVELLLRGSSRRLDLLHQQLQELHAHVVLPDPAATHDGPQSPGAGGPTCSATNLSRVAGLEKQLAIELKVKQGAENMIQTYSNGSTKDRKLLLTAQQMLQDSKTKIDIIRMQLRRALQAGQLENQAAPDDTQGSPDLGAVELRIEELRHHFRVEHAVAEGAKNVLRLLSAAKAPDRKAVSEAQEKLTESNQKLGLLREALERRLGELPADHPKGRLLREELAAASSAAFSTRLAGPFPATHYSTLCKPAPLTGTLEVRVVGCRDLPETIPWNPTPSMGGPGTPDSRPPFLSRPARGLYSRSGSLSGRSSLKAEAENTSEVSTVLKLDNTVVGQTSWKPCGPNAWDQSFTLELERARELELAVFWRDQRGLCALKFLKLEDFLDNERHEVQLDMEPQGCLVAEVTFRNPVIERIPRLRRQKKIFSKQQGKAFQRARQMNIDVATWVRLLRRLIPNATGTGTFSPGASPGSEARTTGDISVEKLNLGTDSDSSPQKSSRDPPSSPSSLSSPIQESTAPELPSETQETPGPALCSPLRKSPLTLEDFKFLAVLGRGHFGKVLLSEFRPSGELFAIKALKKGDIVARDEVESLMCEKRILAAVTSAGHPFLVNLFGCFQTPEHVCFVMEYSAGGDLMLHIHSDVFSEPRAIFYSACVVLGLQFLHEHKIVYRDLKLDNLLLDTEGYVKIADFGLCKEGMGYGDRTSTFCGTPEFLAPEVLTDTSYTRAVDWWGLGVLLYEMLVGESPFPGDDEEEVFDSIVNDEVRYPRFLSAEAIGIMRRLLRRNPERRLGSSERDAEDVKKQPFFRTLGWEALLARRLPPPFVPTLSGRTDVSNFDEEFTGEAPTLSPPRDARPLTAAEQAAFLDFDFVAGGC

SEQ ID NO: 899636 - protein, 995 aa, Homo sapiens
LARRGGSRAGRSGPRAGEGRAAPAPSPPRPGRTRAPLAAPPSDDGDPGGRQEDMASDAVQSEPRSWSLLEQLGLAGADLAAPGVQQQLELERERLRREIRKELKLKEGAENLRRATTDLGRSLGPVELLLRGSSRRLDLLHQQLQELHAHVVLPDPAATHDGPQSPGAGGPTCSATNLSRVAGLEKQLAIELKVKQGAENMIQTYSNGSTKDRKLLLTAQQMLQDSKTKIDIIRMQLRRALQAGQLENQAAPDDTQGSPDLGAVELRIEELRHHFRVEHAVAEGAKNVLRLLSAAKAPDRKAVSEAQEKLTESNQKLGLLREALERRLGELPADHPKGRLLREELAAASSAAFSTRLAGPFPATHYSTLCKPAPLTGTLEVRVVGCRDLPETIPWNPTPSMGGPGTPDSRPPFLSRPARGLYSRSGSLSGRSSLKAEAENTSEVSTVLKLDNTVVGQTSWKPCGPNAWDQSFTLELERARELELAVFWRDQRGLCALKFLKLEDFLDNERHEVQLDMEPQGCLVAEVTFRNPVIERIPRLRRQKKIFSKQQGKAFQRARQMNIDVATWVRLLRRLIPNATGTGTFSPGASPGSEARTTGDISVEKLNLGTDSDSSPQKSSRDPPSSPSSLSSPIQESTAPELPSETQETPGPALCSPLRKSPLTLEDFKFLAVLGRGHFGKVLLSEFRPSGELFAIKALKKGDIVARDEVESLMCEKRILAAVTSAGHPFLVNLFGCFQTPEHVCFVMEYSAGGDLMLHIHSDVFSEPRAIFYSACVVLGLQFLHEHKIVYRDLKLDNLLLDTEGYVKIADFGLCKEGMGYGDRTSTFCGTPEFLAPEVLTDTSYTRAVDWWGLGVLLYEMLVGESPFPGDDEEEVFDSIVNDEVRYPRFLSAEAIGIMRRLLRRNPERRLGSSERDAEDVKKQPFFRTLGWEALLARRLPPPFVPTLSGRTDVSNFDEEFTGEAPTLSPPRDARPLTAAEQAAFLDFDFVAGGC

SEQ ID NO: 899637 - protein, 756 aa, Homo sapiens
PSLASVLASPVVLPRQCRSPDLGAVELRIEELRHHFRVEHAVAEGAKNVLRLLSAAKAPDRKAVSEAQEKLTESNQKLGLLREALERRLGELPADHPKGRLLREELAAASSAAFSTRLAGPFPATHYSTLCKPAPLTGTLEVRVVGCRDLPETIPWNPTPSMGGPGTPDSRPPFLSRPARGLYSRSGSLSGRSSLKAEAENTSEVSTVLKLDNTVVGQTSWKPCGPNAWDQSFTLELERARELELAVFWRDQRGLCALKFLKLEDFLDNERHEVQLDMEPQGCLVAEVTFRNPVIERIPRLRRQKKIFSKQQGKAFQRARQMNIDVATWVRLLRRLIPNATGTGTFSPGASPGSEARTTGDISVEKLNLGTDSDSSPQKSSRDPPSSPSSLSSPIQESTAPELPSETQETPGPALCSPLRKSPLTLEDFKFLAVLGRGHFGKVLLSEFRPSGELFAIKALKKGDIVARDEVESLMCEKRILAAVTSAGHPFLVNLFGCFQTPEHVCFVMEYSAGGDLMLHIHSDVFSEPRAIFYSACVVLGLQFLHEHKIVYRDLKLDNLLLDTEGYVKIADFGLCKEGMGYGDRTSTFCGTPEFLAPEVLTDTSYTRAVDWWGLGVLLYEMLVGESPFPGDDEEEVFDSIVNDEVRYPRFLSAEAIGIMRRLLRRNPERRLGSSERDAEDVKKQPFFRTLGWEALLARRLPPPFVPTLSGRTDVSNFDEEFTGEAPTLSPPRDARPLTAAEQAAFLDFDFVAGGC

SEQ ID NO: 899638 - protein, 557 aa, Homo sapiens
MDQTLTKHQVLLYPLCKYHCISYYTLVPYDVRTSIIQSFQMRKVWPRRIKKLAQRLVHGWLLKLEDFLDNERHEVQLDMEPQGCLVAEVTFRNPVIERIPRLRRQKKIFSKQQGKAFQRARQMNIDVATWVRLLRRLIPNATGTGTFSPGASPGSEARTTGDISVEKLNLGTDSDSSPQKSSRDPPSSPSSLSSPIQESTAPELPSETQETPGPALCSPLRKSPLTLEDFKFLAVLGRGHFGKVLLSEFRPSGELFAIKALKKGDIVARDEVESLMCEKRILAAVTSAGHPFLVNLFGCFQTPEHVCFVMEYSAGGDLMLHIHSDVFSEPRAIFYSACVVLGLQFLHEHKIVYRDLKLDNLLLDTEGYVKIADFGLCKEGMGYGDRTSTFCGTPEFLAPEVLTDTSYTRAVDWWGLGVLLYEMLVGESPFPGDDEEEVFDSIVNDEVRYPRFLSAEAIGIMRRLLRRNPERRLGSSERDAEDVKKQPFFRTLGWEALLARRLPPPFVPTLSGRTDVSNFDEEFTGEAPTLSPPRDARPLTAAEQAAFLDFDFVAGGC

SEQ ID NO: 899639 - protein, 933 aa, Homo sapiens
PQPGPRMAEANNPSEQELESEPRSWSLLEQLGLAGADLAAPGVQQQLELERERLRREIRKELKLKEGAENLRRATTDLGRSLGPVELLLRGSSRRLDLLHQQLQELHAHVVLPDPAATHDGPQSPGAGGPTCSATNLSRVAGLEKQLAIELKVKQGAENMIQTYSNGSTKDRKLLLTAQQMLQDSKTKIDIIRMQLRRALQAGQLENQAAPDDTQGSPDLGAVELRIEELRHHFRVEHAVAEGAKNVLRLLSAAKAPDRKAVSEAQEKLTESNQKLGLLREALERRLGELPADHPKGRLLREELAAASSAAFSTRLAGPFPATHYSTLCKPAPLTGTLEVRVVGCRDLPETIPWNPTPSMGGPGTPDSRPPFLSRPARGLYSRSGSLSGRSSLKAEAENTSEVSTVLKLDNTVVGQTSWKPCGPNAWDQSFTLELERARELELAVFWRDQRGLCALKFLKLEDFLDNERHEVQLDMEPQGCLVAEVTFRNPVIERIPRLRRQKKIFSKQQGKAFQRARQMNIDVATWVRLLRRLIPNATGTGTFSPGASPGSEARTTGDISVEKLNLGTDSDSSPQKSSRDPPSSPSSLSSPIQESTAPELPSETQETPGPALCSPLRKSPLTLEDFKFLAVLGRGHFGKVLLSEFRPSGELFAIKALKKGDIVARDEVESLMCEKRILAAVTSAGHPFLVNLFGCFQTPEHVCFVMEYSAGGDLMLHIHSDVFSEPRAMDLKLDNLLLDTEGYVKIADFGLCKEGMGYGDRTSTFCGTPEFLAPEVLTDTSYTRAVDWWGLGVLLYEMLVGESPFPGDDEEEVFDSIVNDEVRYPRFLSAEAIGIMRRLLRRNPERRLGSSERDAEDVKKQPFFRTLGWEALLARRLPPPFVPTLSGRTDVSNFDEEFTGEAPTLSPPRDARPLTAAEQAAFLDFDFVAGGC

SEQ ID NO: 899640 - protein, 901 aa, Homo sapiens
PQPGPRMAEANNPSEQELESEPRSWSLLEQLGLAGADLAAPGVQQQLELERERLRREIRKELKLKEGAENLRRATTDLGRSLGPVELLLRGSSRRLDLLHQQLQELHAHVVLPDPAATHDGPQSPGAGGPTCSATNLSRVAGLEKQLAIELKVKQGAENMIQTYSNGSTKDRKLLLTAQQMLQDSKTKIDIIRMQLRRALQAGQLENQAAPDDTQGSPDLGAVELRIEELRHHFRVEHAVAEGAKNVLRLLSAAKAPDRKAVSEAQEKLTESNQKLGLLREALERRLGELPADHPKGRLLREELAAASSAAFSTRLAGPFPATHYSTLCKPAPLTGTLEVRVVGCRDLPETIPWNPTPSMGGPGTPDSRPPFLSRPARGLYSRSGSLSGRSSLKAEAENTSEVSTVLKLDNTVVGQTSWKPCGPNAWDQSFTLELERARELELAVFWRDQRGLCALKFLKLEDFLDNERHEVQLDMEPQGCLVAEVTFRNPVIERIPRLRRQKKIFSKQQGKAFQRARQMNIDVATWVRLLRRLIPNATGTGTFSPGASPGSEARTTGDISVEKLNLGTDSDSSPQKSSRDPPSSPSSLSSPIQESTAPELPSETQETPGPALCSPLRKSPLTLEDFKFLAVLGRGHFGKVLLSEFRPSGELFAIKALKKGDIVARDEVESLMCEKRILAAVTSAGHPFLVNLFGCFQTPEHVCFVMEYSAGGDLMLHIHSDVFSEPRAIFYSACVVLGLQFLHEHKIVYRDLKLDNLLLDTEGYVKIADFGLCKEGMGYGDRTSTFCGTPEFLAPEVLTDTSYTRAVDWWGLGVLLYEMLVGESPFPGDDEEEVFDSIVNDEVRYPRFLSAEAIGIMRRVRTPDVGRAWGGAVGPRRGQILTQCSFLQAASEEPRAEAGI

SEQ ID NO: 899641 - protein, 905 aa, Homo sapiens
PQPGPRMAEANNPSEQELESEPRSWSLLEQLGLAGADLAAPGVQQQLELERERLRREIRKELKLKEGAENLRRATTDLGRSLGPVELLLRGSSRRLDLLHQQLQELHAHVVLPDPAATHDGPQSPGAGGPTCSATNLSRVAGLEKQLAIELKVKQGAENMIQTYSNGSTKDRKLLLTAQQMLQDSKTKIDIIRMQLRRALQAGQLENQAAPDDTQGSPDLGAVELRIEELRHHFRVEHAVAEGAKNVLRLLSAAKAPDRKAVSEAQEKLTESNQKLGLLREALERRLGELPADHPKGRLLREELAAASSAAFSTRLAGPFPATHYSTLCKPAPLTGTLEVRVVGCRDLPETIPWNPTPSMGGPGTPDSRPPFLSRPARGLYSRSGSLSGRSSLKAEAENTSEVSTVLKLDNTVVGQTSWKPCGPNAWDQSFTLELERARELELAVFWRDQRGLCALKFLKLEDFLDNERHEVQLDMEPQGCLVAEVTFRNPVIERIPRLRRQKKIFSKQQGKAFQRARQMNIDVATWVRLLRRLIPNATGTGTFSPGASPGSEARTTGDISVEKLNLGTDSDSSPQKSSRDPPSSPSSLSSPIQESTAPELPSETQETPGPALCSPLRKSPLTLEDFKFLAVLGRGHFGKVLLSEFRPSGELFAIKALKKGDIVARDEVESLMCEKRILAAVTSAGHPFLVNLFGCFQTPEHVCFVMEYSAGGDLMLHIHSDVFSEPRAIFYSACVVLGLQFLHEHKIVYRDLKLDNLLLDTEGYVKIADFGLCKEGMGYGDRTSTFCGTPEFLAPEVLTDTSYTRAVDWWGLGVLLYEMLVGESPFPGDDEEEVFDSIVNDEVRYPRFLSAEAIGIMRRLLRRNPERRLGSSERDAEDVKKQPFFRTRGWEALLARLPQPRGSS

SEQ ID NO: 899642 - protein, 769 aa, Homo sapiens
PQPGPRMAEANNPSEQELESEPRSWSLLEQLGLAGADLAAPGVQQQLELERERLRREIRKELKLKEGAENLRRATTDLGRSLGPVELLLRGSSRRLDLLHQQLQELHAHVVLPDPAATHDGPQSPGAGGPTCSATNLSRVAGLEKQLAIELKVKQGAENMIQTYSNGSTKDRKLLLTAQQMLQDSKTKIDIIRMQLRRALQAGQLENQAAPDDTQGSPDLGAVELRIEELRHHFRVEHAVAEGAKNVLRLLSAAKAPDRKAVSEAQEKLTESNQKLGLLREALERRLGELPADHPKGRLLREELAAASSAAFSTRLAGPFPATHYSTLCKPAPLTGTLEVRVVGCRDLPETIPWNPTPSMGGPGTPDSRPPFLSRPARGLYSRSGSLSGRSSLKAEAENTSEVSTVLKLDNTVVGQTSWKPCGPNAWDQSFTLELERARELELAVFWRDQRGLCALKFLKLEDFLDNERHEVQLDMEPQGCLVAEVTFRNPVIERIPRLRRQKKIFSKQQGKAFQRARQMNIDVATWVRLLRRLIPNATGTGTFSPGASPGSEARTTGDISVEKLNLGTDSDSSPQKSSRDPPSSPSSLSSPIQESTAPELPSETQETPGPALCSPLRKSPLTLEDFKFLAVLGRGHFGKVLLSEFRPSGELFAIKALKKGDIVARDEVESLMCEKRILAAVTSAGHPFLVNLFGCFQTPEHVCFVMEYSAGGDLMLHIHSDVFSEPRAILWAGKPCWPGACHRPLCPRCPAAPTSATSTRSSPGRPPH

SEQ ID NO: 899643 - protein, 177 aa, Homo sapiens
MGYGDRTSTFCGTPEFLAPEVLTDTSYTRAVDWWGLGVLLYEMLVGESPFPGDDEEEVFDSIVNDEVRYPRFLSAEAIGIMRRLLRRNPERRLGSSERDAEDVKKQPFFRTLGWEALLARRLPPPFVPTLSGRTDVSNFDEEFTGEAPTLSPPRDARPLTAAEQAAFLDFDFVAGGC

SEQ ID NO: 899644 - protein, 585 aa, Homo sapiens
PQPGPRMAEANNPSEQELESEPRSWSLLEQLGLAGADLAAPGVQQQLELERERLRREIRKELKLKEGAENLRRATTDLGRSLGPVELLLRGSSRRLDLLHQQLQELHAHVVLPDPAATHDGPQSPGAGGPTCSATNLSRVAGLEKQLAIELKVKQGAENMIQTYSNGSTKDRKLLLTAQQMLQDSKTKIDIIRMQLRRALQAGQLENQAAPDDTQGSPDLGAVELRIEELRHHFRVEHAVAEGAKNVLRLLSAAKAPDRKAVSEAQEKLTESNQKLGLLREALERRLGELPADHPKGRLLREELAAASSAAFSTRLAGPFPATHYSTLCKPAPLTGTLEVRVVGCRDLPETIPWNPTPSMGGPGTPDSRPPFLSRPARGLYSRSGSLSGRSSLKAEAENTSEVSTVLKLDNTVVGQTSWKPCGPNAWDQSFTLELERARELELAVFWRDQRGLCALKFLKLEDFLDNERHEVQLDMEPQGCLVAEVTFRNPVIERIPRLRRQKKIFSKQQGKAFQRARQMNIDVATWVRLLRRLIPNATGTGTFSPGASPGSEARTTGDISVEKLNLGTDSDSSPQKSSRDPPNK

SEQ ID NO: 899645 - protein, 412 aa, Homo sapiens
PQPGPRMAEANNPSEQELESEPRSWSLLEQLGLAGADLAAPGVQQQLELERERLRREIRKELKLKEGAENLRRATTDLGRSLGPVELLLRGSSRRLDLLHQQLQELHAHVVLPDPAATHDGPQSPGAGGPTCSATNLSRVAGLEKQLAIELKVKQGAENMIQTYSNGSTKDRKLLLTAQQMLQDSKTKIDIIRMQLRRALQAGQLENQAAPDDTQGSPDLGAVELRIEELRHHFRVEHAVAEGAKNVLRLLSAAKAPDRKAVSEAQEKLTESNQKLGLLREALERRLGELPADHPKGRLLREELAAASSAAFSTRLAGPFPATHYSTLCKPAPLTGTLEVRVVGCRDLPETIPWNPTPSMGGPGTPDSRPPFLSRPARGLYSRSGSLSGRSSLKAEAENTSEVSTVLKLDNT

SEQ ID NO: 899646 - protein, 939 aa, Homo sapiens
RRSGDGVGGGGGSGSGRGARWGGGGAGEEHEWSKMADHVQSLAQLENLCKQLYETTDTTTRLQAEKALVEFTNSPDCLSKCQLLLERGSSSYSQLLAATCLTKLVSRTNNPLPLEQRIDIRNYVLNYLATRPKLATFVTQALIQLYARITKLGWFDCQKDDYVFRNAITDVTRFLQDSVEYCIIGVTILSQLTNEINQADTTHPLTKHRKIASSFRDSSLFDIFTLSCNLLKQASGKNLNLNDESQHGLLMQLLKLTHNCLNFDFIGTSTDESSDDLCTVQIPTSWRSAFLDSSTLQLSTIGRCEYEKTCALLVQLFDQSAQSYQELLQSASASPMDIAVQEGRLTWLVYIIGAVIGGRVSFASTDEQDAMDGELVCRVLQLMNLTDSRLAQAGNEKLELAMLSFFEQFRKIYIGDQVQKSSKLYRRLSEVLGLNDETMVLSVFIGKIITNLKYWGRCEPITSKTLQLLNDLSIGYSSVRKLVKLSAVQFMLNNHTSEHFSFLGINNQSNLTDMRCRTTFYTALGRLLMVDLGEDEDQYEQFMLPLTAAFEAVAQMFSTNSFNEQEAKRTLVGLVRDLRGIAFAFNAKTSFMMLFEWIYPSYMPILQRAIELWYHDPACTTPVLKLMAELVHNRSQRLQFDVSSPNGILLFRETSKMITMYGNRILTLGEVPKDQVYALKLKGISICFSMLKAALSGSYVNFGVFRLYGDDALDNALQTFIKLLLSIPHSDLLDYPKLSQSYYSLLEVLTQDHMNFIASLEPHVIMYILSSISEGLTALDTMVCTGCCSCLDHIVTYLFKQLSRSTKKRTTPLNQESDRFLHIMQQHPEMIQQMLSTVLNIIIFEDCRNQWSMSRPLLGLILLNEKYFSDLRNSIVNSQPPEKQQAMHLCFENLMEGIERNLLTKNRDRFTQNLSAFRREVNDSMKNSTYGVNSNDMMS

SEQ ID NO: 899647 - protein, 1088 aa, Homo sapiens
MRDPGRKSLAQLENLCKQLYETTDTTTRLQAEKALVEFTNSPDCLSKCQLLLERGSSSYSQLLAATCLTKLVSRTNNPLPLEQRIDIRNYVLNYLATRPKLATFVTQALIQLYARITKLGWFDCQKDDYVFRNAITDVTRFLQDSVEYCIIGVTILSQLTNEINQADTTHPLTKHRKIASSFRDSSLFDIFTLSCNLLKQASGKNLNLNDESQHGLLMQLLKLTHNCLNFDFIGTSTDESSDDLCTVQIPTSWRSAFLDSSTLQLFFDLYHSIPPSFSPLVLSCLVQIASVRRSLFNNAERAKFLSHLVDGVKRILENPQSLSDPNNYHEFCRLLARLKSNYQLGELVKVENYPEVIRLIANFTVTSLQHWEFAPNSVHYLLSLWQRLAASVPYVKATEPHMLETYTPEVTKAYITSRLESVHIILRDGLEDPLEDTGLVQQQLDQLSTIGRCEYEKTCALLVQLFDQSAQSYQELLQSASASPMDIAVQEGRLTWLVYIIGAVIGGRVSFASTDEQDAMDGELVCRVLQLMNLTDSRLAQAGNEKLELAMLSFFEQFRKIYIGDQVQKSSKLYRRLSEVLGLNDETMVLSVFIGKIITNLKYWGRCEPITSKTLQLLNDLSIGYSSVRKLVKLSAVQFMLNNHTSEHFSFLGINNQSNLTDMRCRTTFYTALGRLLMVDLGEDEDQYEQFMLPLTAAFEAVAQMFSTNSFNEQEAKRTLVGLVRDLRGIAFAFNAKTSFMMLFEWIYPSYMPILQRAIELWYHDPACTTPVLKLMAELVHNRSQRLQFDVSSPNGILLFRETSKMITMYGNRILTLGEVPKDQVYALKLKGISICFSMLKAALSGSYVNFGVFRLYGDDALDNALQTFIKLLLSIPHSDLLDYPKLSQSYYSLLEVLTQDHMNFIASLEPHVIMYILSSISEGLTALDTMVCTGCCSCLDHIVTYLFKQLSRSTKKRTTPLNQESDRFLHIMQQHPEMIQQMLSTVLNIIIFEDCRNQWSMSRPLLGLILLNEKYFSDLRNSIVNSQPPEKQQAMHLCFENLMEGIERNLLTKNRDRFTQNLSAFRREVNDSMKNSTYGVNSNDMMS

SEQ ID NO: 899648 - protein, 400 aa, Homo sapiens
PEGVVWVTAAFEAVAQMFSTNSFNEQEAKRTLVGLVRDLRGIAFAFNAKTSFMMLFEWIYPSYMPILQRAIELWYHDPACTTPVLKLMAELVHNRSQRLQFDVSSPNGILLFRETSKMITMYGNRILTLGEVPKDQVYALKLKGISICFSMLKAALSGSYVNFGVFRLYGDDALDNALQTFIKLLLSIPHSDLLDYPKLSQSYYSLLEVLTQDHMNFIASLEPHVIMYILSSISEGLTALDTMVCTGCCSCLDHIVTYLFKQLSRSTKKRTTPLNQESDRFLHIMQQHPEMIQQMLSTVLNIIIFEDCRNQWSMSRPLLGLILLNEKYFSDLRNSIVNSQPPEKQQAMHLCFENLMEGIERNLLTKNRDRFTQNLSAFRREVNDSMKNSTYGVNSNDMMS

SEQ ID NO: 899649 - protein, 1121 aa, Homo sapiens
RRSGDGVGGGGGSGSGRGARWGGGGAGEEHEWSKMADHVQSLAQLENLCKQLYETTDTTTRLQAEKALVEFTNSPDCLSKCQLLLERGSSSYSQLLAATCLTKLVSRTNNPLPLEQRIDIRNYVLNYLATRPKLATFVTQALIQLYARITKLGWFDCQKDDYVFRNAITDVTRFLQDSVEYCIIGVTILSQLTNEINQADTTHPLTKHRKIASSFRDSSLFDIFTLSCNLLKQASGKNLNLNDESQHGLLMQLLKLTHNCLNFDFIGTSTDESSDDLCTVQIPTSWRSAFLDSSTLQLFFDLYHSIPPSFSPLVLSCLVQIASVRRSLFNNAERAKFLSHLVDGVKRILENPQSLSDPNNYHEFCRLLARLKSNYQLGELVKVENYPEVIRLIANFTVTSLQHWEFAPNSVHYLLSLWQRLAASVPYVKATEPHMLETYTPEVTKAYITSRLESVHIILRDGLEDPLEDTGLVQQQLDQLSTIGRCEYEKTCALLVQLFDQSAQSYQELLQSASASPMDIAVQEGRLTWLVYIIGAVIGGRVSFASTDEQDAMDGELVCRVLQLMNLTDSRLAQAGNEKLELAMLSFFEQFRKIYIGDQVQKSSKLYRRLSEVLGLNDETMVLSVFIGKIITNLKYWGRCEPITSKTLQLLNDLSIGYSSVRKLVKLSAVQFMLNNHTSEHFSFLGINNQSNLTDMRCRTTFYTALGRLLMVDLGEDEDQYEQFMLPLTAAFEAVAQMFSTNSFNEQEAKRTLVGLVRDLRGIAFAFNAKTSFMMLFEWIYPSYMPILQRAIELWYHDPACTTPVLKLMAELVHNRSQRLQFDVSSPNGILLFRETSKMITMYGNRILTLGEVPKDQVYALKLKGISICFSMLKAALSGSYVNFGVFRLYGDDALDNALQTFIKLLLSIPHSDLLDYPKLSQSYYSLLEVLTQDHMNFIASLEPHVIMYILSSISEGLTALDTMVCTGCCSCLDHIVTYLFKQLSRSTKKRTTPLNQESDRFLHIMQQHPEMIQQMLSTVLNIIIFEDCRNQWSMSRPLLGLILLNEKYFSDLRNSIVNSQPPEKQQAMHLCFENLMEGIERNLLTKNRDRFTQNLSAFRREVNDSMKNSTYGVNSNDMMS

SEQ ID NO: 899650 - protein, 232 aa, Homo sapiens
DAWVRTRGSIHACRKLLLSIPHSDLLDYPKLSQSYYSLLEVLTQDHMNFIASLEPHVIMYILSSISEGLTALDTMVCTGCCSCLDHIVTYLFKQLSRSTKKRTTPLNQESDRFLHIMQQHPEMIQQMLSTVLNIIIFEDCRNQWSMSRPLLGLILLNEKYFSDLRNSIVNSQPPEKQQAMHLCFENLMEGIERNLLTKNRDRFTQNLSAFRREVNDSMKNSTYGVNSNDMMS

SEQ ID NO: 899651 - protein, 174 aa, Homo sapiens
MYILSSISEGLTALDTMVCTGCCSCLDHIVTYLFKQLSRSTKKRTTPLNQESDRFLHIMQQHPEMIQQMLSTVLNIIIFEDCRNQWSMSRPLLGLILLNEKYFSDLRNSIVNSQPPEKQQAMHLCFENLMEGIERNLLTKNRDRFTQNLSAFRREVNDSMKNSTYGVNSNDMMS

SEQ ID NO: 899652 - protein, 1121 aa, Homo sapiens; identical to SEQ ID NO: 899649

SEQ ID NO: 899653 - protein, 844 aa, Homo sapiens
RRSGDGVGGGGGSGSGRGARWGGGGAGEEHEWSKMADHVQSLAQLENLCKQLYETTDTTTRLQAEKALVEFTNSPDCLSKCQLLLERGSSSYSQLLAATCLTKLVSRTNNPLPLEQRIDIRNYVLNYLATRPKLATFVTQALIQLYARITKLGWFDCQKDDYVFRNAITDVTRFLQDSVEYCIIGVTILSQLTNEINQADTTHPLTKHRKIASSFRDSSLFDIFTLSCNLLKQASGKNLNLNDESQHGLLMQLLKLTHNCLNFDFIGTSTDESSDDLCTVQIPTSWRSAFLDSSTLQLFFDLYHSIPPSFSPLVLSCLVQIASVRRSLFNNAERAKFLSHLVDGVKRILENPQSLSDPNNYHEFCRLLARLKSNYQLGELVKVENYPEVIRLIANFTVTSLQHWEFAPNSVHYLLSLWQRLAASVPYVKATEPHMLETYTPEVTKAYITSRLESVHIILRDGLEDPLEDTGLVQQQLDQLSTIGRCEYEKTCALLVQLFDQSAQSYQELLQSASASPMDIAVQEGRLTWLVYIIGAVIGGRVSFASTDEQDAMDGELVCRVLQLMNLTDSRLAQAGNEKLELAMLSFFEQFRKIYIGDQVQKSSKLYRRLSEVLGLNDETMVLSVFIGKIITNLKYWGRCEPITSKTLQLLNDLSIGYSSVRKLVKLSAVQFMLNNHTSEHFSFLGINNQSNLTDMRCRTTFYTALGRLLMVDLGEDEDQYEQFMLPLTAAFEAVAQMFSTNSFNEQEAKRTLVGLVRDLRGIAFAFNAKTSFMMLFEWIYPSYMPILQRAIELWYHDPACTTPVLKLMAELVHNRSQRLQFDVSSPNGILLFRETSKMITMYG

SEQ ID NO: 899654 - protein, 647 aa, Homo sapiens
RRSGDGVGGGGGSGSGRGARWGGGGAGEEHEWSKMADHVQSLAQLENLCKQLYETTDTTTRLQAEKALVEFTNSPDCLSKCQLLLERGSSSYSQLLAATCLTKLVSRTNNPLPLEQRIDIRNYVLNYLATRPKLATFVTQALIQLYARITKLGWFDCQKDDYVFRNAITDVTRFLQDSVEYCIIGVTILSQLTNEINQADTTHPLTKHRKIASSFRDSSLFDIFTLSCNLLKQASGKNLNLNDESQHGLLMQLLKLTHNCLNFDFIGTSTDESSDDLCTVQIPTSWRSAFLDSSTLQLFFDLYHSIPPSFSPLVLSCLVQIASVRRSLFNNAERAKFLSHLVDGVKRILENPQSLSDPNNYHEFCRLLARLKSNYQLGELVKVENYPEVIRLIANFTVTSLQHWEFAPNSVHYLLSLWQRLAASVPYVKATEPHMLETYTPEVTKAYITSRLESVHIILRDGLEDPLEDTGLVQQQLDQLSTIGRCEYEKTCALLVQLFDQSAQSYQELLQSASASPMDIAVQEGRLTWLVYIIGAVIGGRVSFASTDEQDAMDGELVCRVLQLMNLTDSRLAQAGNEKLELAMLSFFEQFRKIYIGDQVQKSSKLYRRLSEVLGLNDETMVLSVFIGKINQPWSAPEFQGPGYGPV

SEQ ID NO: 899655 - protein, 1121 aa, Homo sapiens; identical to SEQ ID NO: 899649

SEQ ID NO: 899656 - protein, 488 aa, Homo sapiens
MLKSALFYIYTSKTLQLLTDLSTGYSSVRKLVKLSAVQFMLNNHTSEHFSFLGINNQSNLTDMRCRTTFYTALGRLLMVDLGEDEDQYEQFMLPLTAAFEAVAQMFSTNSFNEQEAKRTLVGLVRDLRGIAFAFNAKTSFMMLFEWIYPSYMPILQRAIELWYHDPACTTPVLKLMAELVHNRSQRLQFDVSSPNGILLFRETSKMITMYGNRILTLGEVPKDQVYALKLKGISICFSMLKAALSGSYVNFGVFRLYGDDALDNALQTFIKLLLSIPHSDLLDYPKLSQSYYSLLEVLTQDHMNFIASLEPHVIMYILSSISEGLTALDTMVCTGCCSCLDHIVTYLFKQLSRSTKKRTTPLNQESDRFLHIMQQHPEMIQQMLSTVLNIIIFEDCRNQWSMSRPLLGLILLNEKYFSDLRNSIVNSQPPEKQQAMHLCFENLMEGIERNLLTKNRDRFTQNLSAFRREVNDSMKNSTYGVNSNDMMS

SEQ ID NO: 899657 - protein, 1121 aa, Homo sapiens; identical to SEQ ID NO: 899649

SEQ ID NO: 899658 - protein, 1121 aa, Homo sapiens; identical to SEQ ID NO: 899649

SEQ ID NO: 899659 - protein, 106 aa, Homo sapiens
MLSTVLNIIIFEDCRNQWSMSRPLLGLILLNEKYFSDLRNSIVNSQPPEKQQAMHLCFENLMEGIERNLLTKNRDRFTQNLSAFRREVNDSMKNSTYGVNSNDMMS

SEQ ID NO: 899660 - protein, 699 aa, Homo sapiens
RRSGDGVGGGGGSGSGRGARWGGGGAGEEHEWSKMADHVQSLAQLENLCKQLYETTDTTTRLQAEKALVEFTNSPDCLSKCQLLLERGSSSYSQLLAATCLTKLVSRTNNPLPLEQRIDIRNYVLNYLATRPKLATFVTQALIQLYARITKLGWFDCQKDDYVFRNAITDVTRFLQDSVEYCIIGVTILSQLTNEINQADTTHPLTKHRKIASSFRDSSLFDIFTLSCNLLKQASGKNLNLNDESQHGLLMQLLKLTHNCLNFDFIGTSTDESSDDLCTVQIPTSWRSAFLDSSTLQLFFDLYHSIPPSFSPLVLSCLVQIASVRRSLFNNAERAKFLSHLVDGVKRILENPQSLSDPNNYHEFCRLLARLKSNYQLGELVKVENYPEVIRLIANFTVTSLQHWEFAPNSVHYLLSLWQRLAASVPYVKATEPHMLETYTPEVTKAYITSRLESVHIILRDGLEDPLEDTGLVQQQLDQLSTIGRCEYEKTCALLVQLFDQSAQSYQELLQSASASPMDIAVQEGRLTWLVYIIGAVIGGRVSFASTDEQDAMDGELVCRVLQLMNLTDSRLAQAGNEKLELAMLSFFEQFRKIYIGDQVQKSSKLYRRLSEVLGLNDETMVLSVFIGKIITNLKYWGRCEPITSKTLQLLNDLSIGYSSVRKLVKLSAVQFMLNNHTVSDFSFFSWPSYHPHIHFLDT

SEQ ID NO: 899661 - protein, 245 aa, Homo sapiens
RRSGDGVGGGGGSGSGRGARWGGGGAGEEHEWSKMADHVQSLAQLENLCKQLYETTDTTTRLQAEKALVEFTNSPDCLSKCQLLLERGSSSYSQLLAATCLTKLVSRTNNPLPLEQRIDIRNYVLNYLATRPKLATFVTQALIQLYARITKLGWFDCQKDDYVFRNAITDVTRFLQDSVEYCIIGVTILSQLTNEINQVSATAFLIEADTTHPLTKHRKIASSFRDSSLFDIFTLSCNLLKQVSM

SEQ ID NO: 899662 - protein, 126 aa, Homo sapiens
MPEPAKSAPAPKKGSKKAVTKAQKKDGKKRKRSRKESYSIYVYKVLKQVHPDTGISSKAMGIMNSFVNDIFERIAGEASRLAHYNKRSTITSREIQTAVRLLLPGELAKHAVSEGTKAVTKYTSSK

SEQ ID NO: 899663 - protein, 254 aa, Homo sapiens
MPEPAKSAPAPKKGSKKAVTKAQKKDGKKRKRSRKESCLQEDSQRPGAHLTVKKIFVGGIKEDTEEHHLRDYFEQYGKIEVIEIMIDRGSGKKRGFAFVTFDDHDSVDKIVIQKYHTVNGHNCEVRKALSKQEMASASSSQRGRSGSGNFGGGRGGGFGGNDNFGRGGNFSGRGGFGGSRGGGGYGGSGDGYNGFGNDGSNFGGGGSYNDFGNYNHQSSNFGPMKGGNFGGRSSGPYGGGQSLQNHETKWLLRF

SEQ ID NO: 899664 - protein, 126 aa, Homo sapiens; identical to SEQ ID NO: 899662

SEQ ID NO: 899665 - protein, 72 aa, Homo sapiens
RKGKRDMYSRTGYSYGRLAYFSVLRYTVRHSVTSYTRKGSSPVSPCRDLALARSSRRLLDSKGSFQSHPPNH

SEQ ID NO: 899666 - protein, 126 aa, Homo sapiens; identical to SEQ ID NO: 899662

SEQ ID NO: 899667 - protein, 126 aa, Homo sapiens; identical to SEQ ID NO: 899662

SEQ ID NO: 899668 - protein, 126 aa, Homo sapiens
MSEQGDLNQAIAEEGGTEQETATPENGIVKSESLDEEEKLELQRRLEAQNQERRKSKSGAGKGKLTRSLAVCEESSARPGGESLQDQRMRACKPLFGLAEEWWEQGVDRKHPDTHISKWPCYLFRE

SEQ ID NO: 899669 - protein, 132 aa, Homo sapiens
MSEQGDLNQAIAEEGGTEQETATPENGIVKSESLDEEEKLELQRRLEAQNQERRKSKSGAGKGKLTRSLAVCEESSARPGGESLQDQESIHLQLSSFSSLQEEDKSRKDDSEREKEKDKNKDKTSEKPKIRM

SEQ ID NO: 899670 - protein, 132 aa, Homo sapiens; identical to SEQ ID NO: 899669

SEQ ID NO: 899671 - protein, 75 aa, Homo sapiens
SAKLSSRGGPAGRTPGLGPPVVVKRRRAGRREQEPAAGQPKMVAATPPVIHVDLTAPVAFLRILAEKEVFWNGIC

SEQ ID NO: 899672 - protein, 224 aa, Homo sapiens
MLGSGFKAERLRVNLRLVINRLKLLEKKKTELAQKARKEIADYLAAGKDERARIRVEHIIREDYLVEAMEILELYCDLLLARFGLIQSMKELDSGLAESVSTLIWAAPRLQSEVAELKIVADQLCAKYSKEYGKLCRTNQIGTVNDRLMHKLSVEAPPKILVERYLIEIAKNYNVPYEPDSVVMAEAPPGVETDLIDVGFTDDVNERRPWKRREWWLHSTSWWT

SEQ ID NO: 899673 - protein, 224 aa, Homo sapiens; identical to SEQ ID NO: 899672

SEQ ID NO: 899674 - protein, 224 aa, Homo sapiens; identical to SEQ ID NO: 899672

SEQ ID NO: 899675 - protein, 224 aa, Homo sapiens; identical to SEQ ID NO: 899672

SEQ ID NO: 899676 - protein, 224 aa, Homo sapiens; identical to SEQ ID NO: 899672

SEQ ID NO: 899677 - protein, 224 aa, Homo sapiens; identical to SEQ ID NO: 899672

SEQ ID NO: 899678 - protein, 224 aa, Homo sapiens; identical to SEQ ID NO: 899672

SEQ ID NO: 899679 - protein, 237 aa, Homo sapiens
MVFKLKTKEEQHSMLGSGFKAERLRVNLRLVINRLKLLEKKKTELAQKARKEIADYLAAGKDERARIRVEHIIREDYLVEAMEILELYCDLLLARFGLIQSMKELDSGLAESVSTLIWAAPRLQSEVAELKIVADQLCAKYSKEYGKLCRTNQIGTVNDRLMHKLSVEAPPKILVERYLIEIAKNYNVPYEPDSVVMAEAPPGVETDLIDVGFTDDVNERRPWKRREWWLHSTSWWT

SEQ ID NO: 899680 - protein, 224 aa, Homo sapiens; identical to SEQ ID NO: 899672

SEQ ID NO: 899681 - protein, 148 aa, Homo sapiens
MLGSGFKAERLRVNLRLVINRLKLLEKKKTELAQKARKEIADYLAAGKDERARIRVEHIIREDYLVEAMEILELYCDLLLARFGLIQSMKELDSGLAESVSTLIWAAPRLQSEVAELKIVADQLCAKYSKEYGKLCRTNQIGTVNDRS

SEQ ID NO: 899682 - protein, 147 aa, Homo sapiens
MEESGTKALGAVRPWAQSPRINSCGWPPRAQSEIKGMPPAADSVGVALPPTSAVPPPREVVPGRADSKGNRGRVPRVSAWVPAAAIAQPIPGKEGVAISAPWIPPPALVVLRPRESPFWMVNPEVGVCCVHGRIRLGGTAQHAGLWI

SEQ ID NO: 899683 - protein, 197 aa, Homo sapiens
MLGSGFKAERLRVNLRLVINRLKLLEKKKTELAQKARKEIADYLAAGKDERARIRVEHIIREDYLVEAMEILELYCDLLLARFGLIQSMKELDSGLAESVSTLIWAAPRLQSEVAELKIVADQLCAKYSKEYGKLCRTNQIGTVNDRLMHKLSVEAPPKILVERYLIEIAKNYNAMNVFGEHSMHLHSLSYLQDSTY

SEQ ID NO: 899684 - protein, 136 aa, Homo sapiens
MKELDSGLAESVSTLIWAAPRLQSEVAELKIVADQLCAKYSKEYGKLCRTNQIGTVNDRLMHKLSVEAPPKILVERYLIEIAKNYNVPYEPDSVVMAEAPPGVETDLIDVGFTDDVNERRPWKRREWWLHSTSWWT

SEQ ID NO: 899685 - protein, 70 aa, Homo sapiens
MQVLYCCEIGVGFVSSAELAQKARKEIADYLAAGKDERARIRVEHIIREDYLVEAMEILELYCDLLLARF

SEQ ID NO: 899686 - protein, 224 aa, Homo sapiens; identical to SEQ ID NO: 899672

SEQ ID NO: 899687 - protein, 224 aa, Homo sapiens; identical to SEQ ID NO: 899672

SEQ ID NO: 899688 - protein, 224 aa, Homo sapiens; identical to SEQ ID NO: 899672

SEQ ID NO: 899689 - protein, 224 aa, Homo sapiens; identical to SEQ ID NO: 899672

SEQ ID NO: 899690 - protein, 224 aa, Homo sapiens; identical to SEQ ID NO: 899672

SEQ ID NO: 899691 - protein, 243 aa, Homo sapiens
RVLIRRGVTEDSVQEEQHSMLGSGFKAERLRVNLRLVINRLKLLEKKKTELAQKARKEIADYLAAGKDERARIRVEHIIREDYLVEAMEILELYCDLLLARFGLIQSMKELDSGLAESVSTLIWAAPRLQSEVAELKIVADQLCAKYSKEYGKLCRTNQIGTVNDRLMHKLSVEAPPKILVERYLIEIAKNYNVPYEPDSVVMAEAPPGVETDLIDVGFTDDVNERRPWKRREWWLHSTSWWT

SEQ ID NO: 899692 - protein, 186 aa, Homo sapiens
MLGSGFKAERLRVNLRLVINRLKLLEKKKTELAQKARKEIADYLAAGKDERARIRVEHIIREDYLVEAMEILELYCDLLLARFGLIQSMKELDSGLAESVSTLIWAAPRLQSEVAELKIVADQLCAKYSKEYGKLCRTNQIGTVNDRLMHKLSVEAPPKILVERYLIEIAKNYNVPYEPDSVVMMM

SEQ ID NO: 899693 - protein, 224 aa, Homo sapiens; identical to SEQ ID NO: 899672

SEQ ID NO: 899694 - protein, 185 aa, Homo sapiens
MLGSGFKAERLRVNLRLVINRLKLLEKKKTELAQKARKEIADYLAAGKDERARIRVEHIIREDYLVEAMEILELYCDLLLARFGLIQSMKELDSGLAESVSTLIWAAPRLQSEVAELKIVADQLCAKYSKEYGKLCRTNQIGTVNDRLKASLSCTGFSGSPLWPFALRAVSLVPEGGTVEILFSL

SEQ ID NO: 899695 - protein, 147 aa, Homo sapiens; identical to SEQ ID NO: 899682

SEQ ID NO: 899696 - protein, 498 aa, Homo sapiens
MPLVTRNIEPRHLCRQTLPSVRSELECVTNITLANVIRQLGSLSKYAEDIFGELFTQANTFASRVSSLAERVDRLQVKVTQLDPKEEEVSLQGINTRKAFRSSTIQDQKLFDRNSLPVPVLETYNTCDTPPPLNNLTPYRDDGKEALKFYTDPSYFFDLWKEKMLQDTKDIMKEKRKHRKEKKDNPNRGNVNPRKIKTRKEEWEKMKMGQEFVESKEKLGTSGYPPTLVYQNGSIGCVENVDASSYPPPPQSDSASSPSPSFSEDNLPPPPAEFSYPVDNQRGSGLAGPKRSSVVSPSHPPPAPPLGSPPGPKPGFAPPPAPPPPPPPMIGIPPPPPPVGFGSPGTPPPPSPPSFPPHPDFAAPPPPPPPPAADYPTLPPPPLSQPTGGAPPPPPPPPPPGPPPPPFTGADGQPAIPPPLSDTTKPKSSLPAVSDARSDLLSAIRQGFQLRRVEEQREQEKRDVVGNDVATILSRRIAVEYSDSEDDSSEFDEDDWSD

SEQ ID NO: 899697 - protein, 498 aa, Homo sapiens; identical to SEQ ID NO: 899696

SEQ ID NO: 899698 - protein, 335 aa, Homo sapiens
MLQDTKDIMKEKRKHRKEKKDNPNRGNVNPRKIKTRKEEWEKMKMGQEFVESKEKLGTSGYPPTLVYQNGSIGCVENVDASSYPPPPQSDSASSPSPSFSEDNLPPPPAEFSYPVDNQRGSGLAGPKRSSVVSPSHPPPAPPLGSPPGPKPGFAPPPAPPPPPPPMIGIPPPPPPVGFGSPGTPPPPSPPSFPPHPDFAAPPPPPPPPAADYPTLPPPPLSQPTGGAPPPPPPPPPPGPPPPPFTGADGQPAIPPPLSDTTKPKSSLPAVSDARSDLLSAIRQGFQLRRVEEQREQEKRDVVGNDVATILSRRIAVEYSDSEDDSSEFDEDDWSD

SEQ ID NO: 899699 - protein, 101 aa, Homo sapiens
EFLKTEDRLFSGADGQPAIPPPLSDTTKPKSSLPAVSDARSDLLSAIRQGFQLRRVEEQREQEKRDVVGNDVATILSRRIAVEYSDSEDDSSEFDEDDWSD

SEQ ID NO: 899700 - protein, 102 aa, Homo sapiens
MLLLLFHNNLLFLYPFQYHLPIGGHSLLPSSRWIPRLRTRLPHPSVSLPLGFQLRRVEEQREQEKRDVVGNDVATILSRRIAVEYSDSEDDSSEFDEDDWSD

SEQ ID NO: 899701 - protein, 109 aa, Homo sapiens
MEQWPIRTPKRRSQGASSLPGSPRPRDLPPFLWPWGPASNSVRSNLWLCLGCEMGTFQRSSLGEGAGSASPWRLRAAGPGSSSPPVEARAPSETTLANVNAEPRRCCHG

SEQ ID NO: 899702 - protein, 498 aa, Homo sapiens; identical to SEQ ID NO: 899696

SEQ ID NO: 899703 - protein, 109 aa, Homo sapiens; identical to SEQ ID NO: 899701

SEQ ID NO: 899704 - protein, 109 aa, Homo sapiens; identical to SEQ ID NO: 899701

SEQ ID NO: 899705 - protein, 498 aa, Homo sapiens; identical to SEQ ID NO: 899696

SEQ ID NO: 899706 - protein, 498 aa, Homo sapiens; identical to SEQ ID NO: 899696

SEQ ID NO: 899707 - protein, 498 aa, Homo sapiens; identical to SEQ ID NO: 899696

SEQ ID NO: 899708 - protein, 157 aa, Homo sapiens
YLESRSVTQDGVQWLGLGSLQPPPPEVKQFSCLNLPSSWDYRCLPARLSNFCIFSRDGVSPCCPGWKCVEILSFLPGLIFCITPFSFIQPVLSLMTVHVCQEDSISYRTYAGFLNYEEYFSVSKSSHLHIAQTVLGYVCVYVCVWGLGNTIFSSQFL

SEQ ID NO: 899709 - protein, 630 aa, Homo sapiens
YLESRSVTQDGVQWLGLGSLQPPPPEVKQFSCLNLPSSWDYRCLPARLSNFCIFSRDGVSPCCPGWKCVEILSFLPGLIFCITPFSFIQPVLSLMTVHVCQEDSISYRTYAGFLNYEEYFSVSKSSHLHIAQTVLGYVCVYVCVWGLGNTIFSSQFLGPFTLLLCTSDLVSLLFPGKYAEDIFGELFTQANTFASRVSSLAERVDRLQVKVTQLDPKEEEVSLQGINTRKAFRSSTIQDQKLFDRNSLPVPVLETYNTCDTPPPLNNLTPYRDDGKEALKFYTDPSYFFDLWKEKMLQDTKDIMKEKRKHRKEKKDNPNRGNVNPRKIKTRKEEWEKMKMGQEFVESKEKLGTSGYPPTLVYQNGSIGCVENVDASSYPPPPQSDSASSPSPSFSEDNLPPPPAEFSYPVDNQRGSGLAGPKRSSVVSPSHPPPAPPLGSPPGPKPGFAPPPAPPPPPPPMIGIPPPPPPVGFGSPGTPPPPSPPSFPPHPDFAAPPPPPPPPAADYPTLPPPPLSQPTGGAPPPPPPPPPPGPPPPPFTGADGQPAIPPPLSDTTKPKSSLPAVSDARSDLLSAIRQGFQLRRVEEQREQEKRDVVGNDVATILSRRIAVEYSDSEDDSSEFDEDDWSD

SEQ ID NO: 899710 - protein, 291 aa, Homo sapiens
MGQEFVESKEKLGTSGYPPTLVYQNGSIGCVENVDASSYPPPPQSDSASSPSPSFSEDNLPPPPAEFSYPVDNQRGSGLAGPKRSSVVSPSHPPPAPPLGSPPGPKPGFAPPPAPPPPPPPMIGIPPPPPPVGFGSPGTPPPPSPPSFPPHPDFAAPPPPPPPPAADYPTLPPPPLSQPTGGAPPPPPPPPPPGPPPPPFTGADGQPAIPPPLSDTTKPKSSLPAVSDARSDLLSAIRQGFQLRRVEEQREQEKRDVVGNDVATILSRRIAVEYSDSEDDSSEFDEDDWSD

SEQ ID NO: 899711 - protein, 498 aa, Homo sapiens; identical to SEQ ID NO: 899696

SEQ ID NO: 899712 - protein, 498 aa, Homo sapiens; identical to SEQ ID NO: 899696

SEQ ID NO: 899713 - protein, 498 aa, Homo sapiens; identical to SEQ ID NO: 899696

SEQ ID NO: 899714 - protein, 109 aa, Homo sapiens; identical to SEQ ID NO: 899701

SEQ ID NO: 899715 - protein, 109 aa, Homo sapiens; identical to SEQ ID NO: 899701

SEQ ID NO: 899716 - protein, 498 aa, Homo sapiens; identical to SEQ ID NO: 899696

SEQ ID NO: 899717 - protein, 114 aa, Homo sapiens
MKVAVSPAVGPGPWGSGVGGGGTVRLLLILSGCLVYGTAETDVNVVMLQESQVCEKRASQQFCYTNVLIPKWHDIWTRIQIRVNSSRLVRVTQVENEEKLKELEHCKCRTPKLR

SEQ ID NO: 899718 - protein, 394 aa, Homo sapiens
MLQESQVCEKRASQQFCYTNVLIPKWHDIWTRIQIRVNSSRLVRVTQVENEEKLKELEQFSIWNFFSSFLKEKLNDTYVNVGLYSTKTCLKVEIIEKDTKYSVIVIRRFDPKLFLVFLLGLMLFFCGDLLSRSQIFYYSTGMTVGIVASLLIIIFILSKFMPKKSPIYVILVGGWSFSLYLIQLVFKNLQEIWRCYWQYLLSYVLTVGFMSFAVCYKYGPLENERSINLLTWTLQLMGLCFMYSGIQIPHIALAIIIIALCTKNLEHPIQWLYITCRKVCKGAEKPVPPRLLTEEEYRIQGEVETRKALEELREFCNSPDCSAWKTVSRIQSPKRFADFVEGSSHLTPNEVSVHEQEYGLGSIIAQDEIYEEASSEEEDSYSRCPAITQNNFLT

SEQ ID NO: 899719 - protein, 253 aa, Homo sapiens
MTVGIVASLLIIIFILSKFMPKKSPIYVILVGGWSFSLYLIQLVFKNLQEIWRCYWQYLLSYVLTVGFMSFAVCYKYGPLENERSINLLTWTLQLMGLCFMYSGIQIPHIALAIIIIALCTKNLEHPIQWLYITCRKVCKGAEKPVPPRLLTEEEYRIQGEVETRKALEELREFCNSPDCSAWKTVSRIQSPKRFADFVEGSSHLTPNEVSVHEQEYGLGSIIAQDEIYEEASSEEEDSYSRCPAITQNNFLT

SEQ ID NO: 899720 - protein, 394 aa, Homo sapiens; identical to SEQ ID NO: 899718

SEQ ID NO: 899721 - protein, 440 aa, Homo sapiens [sequence omitted]

SEQ ID NO: 899722 - protein, 367 aa, Homo sapiens
MKVAVSPAVGPGPWGSGVGGGGTVRLLLILSGCLVYGTAETDVNVVMLQESQVCEKRASQQFCYTNVLIPKWHDIWTRIQIRVNSSRLVRVTQVENEEKLKELEQSQIFYYSTGMTVGIVASLLIIIFILSKFMPKKSPIYVILVGGWSFSLYLIQLVFKNLQEIWRCYWQYLLSYVLTVGFMSFAVCYKYGPLENERSINLLTWTLQLMGLCFMYSGIQIPHIALAIIIIALCTKNLEHPIQWLYITCRKVCKGAEKPVPPRLLTEEEYRIQGEVETRKALEELREFCNSPDCSAWKTVSRIQSPKRFADFVEGSSHLTPNEVSVHEQEYGLGSIIAQDEIYEEASSEEEDSYSRCPAITQNNFLT

SEQ ID NO: 899723 - protein, 394 aa, Homo sapiens; identical to SEQ ID NO: 899718

SEQ ID NO: 899724 - protein, 198 aa, Homo sapiens
MARRSVLYFILLNALINKGQACFCDHYAWTQWTSCSKTCNSGTQSRHRQIVVDKYYQENFCEQICSKQETRECNWQRCPINCLLGDFGPWSDCDPCIEKQSKVRSVLRPSQFGGQPCTEPLVAFQPCIPSKLCKIEEADCKNKFRCDSGRCIARKLECTGVCTQKYNPIPSVQLMGWGSSFCTRAQREALVLSTEDMS

SEQ ID NO: 899725 - protein, 68 aa, Homo sapiens
MARRSVLYFILLNALINKGQACFCDHYAWTQWTSCSKTCNSGTQSRHRQIVVDKYYQGCPILPPGRFW

SEQ ID NO: 899726 - protein, 916 aa, Homo sapiens
MARRSVLYFILLNALINKGQACFCDHYAWTQWTSCSKTCNSGTQSRHRQIVVDKYYQENFCEQICSKQETRECNWQRCPINCLLGDFGPWSDCDPCIEKQSKVRSVLRPSQFGGQPCTEPLVAFQPCIPSKLCKIEEADCKNKFRCDSGRCIARKLECNGENDCGDNSDERDCGRTKAVCTRKYNPIPSVQLMGNGFHFLAGEPRGEVLDNSFTGGICKTVKSSRTSNPYRVPANLENVGFEVQTAEDDLKTDFYKDLTSLGHNENQQGSFSSQGGSSFSVPIFYSSKRSENINHNSAFKQAIQASHKKDSSFIRIHKVMKVLNFTTKAKDLHLSDVFLKALNHLPLEYNSALYSRIFDDFGTHYFTSGSLGGVYDLLYQFSSEELKNSGLTEEEAKHCVRIETKKRVLFAKKTKVEHRCTTNKLSEKHEGSFIQGAEKSISLIRGGRSEYGAALAWEKGSSGLEEKTFSEWLESVKENPAVIDFELAPIVDLVRNIPCAVTKRNNLRKALQEYAAKFDPCQCAPCPNNGRPTLSGTECLCVCQSGTYGENCEKQSPDYKSNAVDGQWGCWSSWSTCDATYKRSRTRECNNPAPQRGGKRCEGEKRQEEDCTFSIMENNGQPCINDDEEMKEVDLPEIEADSGCPQPVPPENGFIRNEKQLYLVGEDVEISCLTGFETVGYQYFRCLPDGTWRQGDVECQRTECIKPVVQEVLTITPFQRLYRIGESIELTCPKGFVVAGPSRYTCQGNSWTPPISNSLTCEKDTLTQLSSEEDCSHHSEDLCVFDTDSNDYFTSPACKFLAEKCLNNQQLHFLHIGSCQDGRQLEWGLERTRLSSNSTKKESCGYDTCYDWEKCSASTSKCVCLLPPQCFKGGNQLYCVKMGSSTSEKTLNICEVGTIRCANRKMEILHPGKCLA

SEQ ID NO: 899727 - protein, 803 aa, Homo sapiens
MARRSVLYFILLNALINKGQACFCDHYAWTQWTSCSKTCNSGTQSRHRQIVVDKYYQENFCEQICSKQETRECNWQRCPINCLLGDFGPWSDCDPCIEKQSKVRSVLRPSQFGGQPCTEPLVAFQPCIPSKLCKIEEADCKNKFRCDSGRCIARKLECNGENDCGDNSDERDCGRTKAVCTRKYNPIPSVQLMGNGFHFLAGEPRGEVLDNSFTGGICKTVKSSRTSNPYRVPANLENVGFEVQTAEDDLKTDFYKDLTSLGHNENQQGSFSSQGGSSFSVPIFYSSKRSENINHNSAFKQAIQASHKKDSSFIRIHKVMKVLNFTTKAKDLHLSDVFLKALNHLPLEYNSALYSRIFDDFGTHYFTSGSLGGVYDLLYQFSSEELKNSGLTEEEAKHCVRIETKKRVLFAKKTKVEHRCTTNKLSEKHEGSFIQGAEKSISLIRGGRSEYGAALAWEKGSSGLEEKTFSEWLESVKENPAVIDFELAPIVDLVRNIPCAVTKRNNLRKALQEYAAKFDPCQCAPCPNNGRPTLSGTECLCVCQSGTYGENCEKQSPDYKSNAVDGQWGCWSSWSTCDATYKRSRTRECNNPAPQRGGKRCEGEKRQEEDCTFSIMENNGQPCINDDEEMKEVDLPEIEADSGCPQPVPPENGFIRNEKQLYLVGEDVEISCLTGFETVGYQYFRCLPDGTWRQGDVECQRTECIKPVVQEVLTITPFQRLYRIGESIELTCPKGFVVAGPSRYTCQGNSWTPPISNSLTCEKVYCVKMGSSTSEKTLNICEVGTIRCANRKMEILHPGKCLA

SEQ ID NO: 899728 - protein, 835 aa, Homo sapiens
MARRSVLYFILLNALINKGQACFCDHYAWTQWTSCSKTCNSGTQSRHRQIVVDKYYQENFCEQICSKQETRECNWQRCPINCLLGDFGPWSDCDPCIEKQSKVRSVLRPSQFGGQPCTEPLVAFQPCIPSKLCKIEEADCKNKFRCDSGRCIARKLECNGENDCGDNSDERDCGRTKAVCTRKYNPIPSVQLMGNGFHFLAGEPRGEVLDNSFTGGICKTVKSSRTSNPYRVPANLENVGFEVQTAEDDLKTDFYKDLTSLGHNENQQGSFSSQGGSSFSVPIFYSSKRSENINHNSAFKQAIQASHKKDSSFIRIHKVMKVLNFTTKAKDLHLSDVFLKALNHLPLEYNSALYSRIFDDFGTHYFTSGSLGGVYDLLYQFSSEELKNSGLTEEEAKHCVRIETKKRVLFAKKTKVEHRCTTNKLSEKHEGSFIQGAEKSISLIRGGRSEYGAALAWEKGSSGLEEKTFSEWLESVKENPAVIDFELAPIVDLVRNIPCAVTKRNNLRKALQEYAAKFDPCQCAPCPNNGRPTLSGTECLCVCQSGTYGENCEKQSPDYKSNAVDGQWGCWSSWSTCDATYKRSRTRECNNPAPQRGGKRCEGEKRQEEDCTFSIMENNGQPCINDDEEMKEVDLPEIEADSGCPQPVPPENGFIRNEKQLYLVGEDVEISCLTGFETVGYQYFRCLPDGTWRQGDVECQRTECIKPVVQEVLTITPFQRLYRIGESIELTCPKGFVVAGPSRYTCQGNSWTPPISNSLTCEKDLDTSLSPSEDPLALSTLQTVEYLLLLCWEVWAAESQHCFNLRLIGRADSLHKIIDNFKPVVIEQGCVPLES

SEQ ID NO: 899729 - protein, 934 aa, Homo sapiens
MARRSVLYFILLNALINKGQACFCDHYAWTQWTSCSKTCNSGTQSRHRQIVVDKYYQENFCEQICSKQETRECNWQRCPINCLLGDFGPWSDCDPCIEKQSKVRSVLRPSQFGGQPCTEPLVAFQPCIPSKLCKIEEADCKNKFRCDSGRCIARKLECNGENDCGDNSDERDCGRTKAVCTRKYNPIPSVQLMGNGFHFLAGEPRGEVLDNSFTGGICKTVKSSRTSNPYRVPANLENVGFEVQTAEDDLKTDFYKDLTSLGHNENQQGSFSSQGGSSFSVPIFYSSKRSENINHNSAFKQAIQASHKKDSSFIRIHKVMKVLNFTTKAKDLHLSDVFLKALNHLPLEYNSALYSRIFDDFGTHYFTSGSLGGVYDLLYQFSSEELKNSGLTEEEAKHCVRIETKKRVLFAKKTKVEHRCTTNKLSEKHEGSFIQGAEKSISLIRGGRSEYGAALAWEKGSSGLEEKTFSEWLESVKENPAVIDFELAPIVDLVRNIPCAVTKRNNLRKALQEYAAKFDPCQCAPCPNNGRPTLSGTECLCVCQSGTYGENCEKQSPDYKSNAVDGQWGCWSSWSTCDATYKRSRTRECNNPAPQRGGKRCEGEKRQEEDCTFSIMENNGQPCINDDEEMKEVDLPEIEADSGCPQPVPPENGFIRNEKQLYLVGEDVEISCLTGFETVGYQYFRCLPDGTWRQGDVECQRTECIKPVVQEVLTITPFQRLYRIGESIELTCPKGFVVAGPSRYTCQGNSWTPPISNSLTCEKDTLTKLKGHCQLGQKQSGSECICMSPEEDCSHHSEDLCVFDTDSNDYFTSPACKFLAEKCLNNQQLHFLHIGSCQDGRQLEWGLERTRLSSNSTKKESCGYDTCYDWEKCSASTSKCVCLLPPQCFKGGNQLYCVKMGSSTSEKTLNICEVGTIRCANRKMEILHPGKCLA

SEQ ID NO: 899730 - protein, 102 aa, Homo sapiens
MARRSVLYFILLNALINKGQACFCDHYAWTQWTSCSKTCNSGTQSRHRQIVVDKYYQENFCEQICSKQETRECNWQRCPINCLLGDFGPWSDCDPCIEKQMH

SEQ ID NO: 899731 - protein, 312 aa, Homo sapiens
MARRSVLYFILLNALINKGQACFCDHYAWTQWTSCSKTCNSGTQSRHRQIVVDKYYQENFCEQICSKQETRECNWQRCPINCLLGDFGPWSDCDPCIEKQSKVRSVLRPSQFGGQPCTEPLVAFQPCIPSKLCKIEEADCKNKFRCDSGRCIARKLECNGENDCGDNSDERDCGRTKAVCTRKYNPIPSVQLMGNGFHFLAGEPRGEVLDNSFTGGICKTVKSSRTSNPYRVPANLENVGFEVQTAEDDLKTDFYKDLTSLGHNENQQGSFSSQGGSSFSVPIFYSSKRSENINHNSAFKQAIQASHKKNES

SEQ ID NO: 899732 - protein, 934 aa, Homo sapiens; identical to SEQ ID NO: 899729

SEQ ID NO: 899733 - protein, 243 aa, Homo sapiens
MARRSVLYFILLNALINKGQACFCDHYAWTQWTSCSKTCNSGTQSRHRQIVVDKYYQENFCEQICSKQETRECNWQRCPINCLLGDFGPWSDCDPCIEKQSKVRSVLRPSQFGGQPCTEPLVAFQPCIPSKLCKIEEADCKNKFRCDSGRCIARKLECNGENDCGDNSDERDCGRTKAVCTRKYNPIPSVQLMGNGFHFLAGEPRGEVLDNSFTGGICKTVKSSRTSNPYRVPANLENVGFEV

SEQ ID NO: 899734 - protein, 106 aa, Homo sapiens
MISSVFFPLQVGQAEQMAHIITMAHTCTAKPMHKAKRHRSATLSHSIAVQTNVKPHSRTRLGSSSNNNIGKTLTTDTPAFPLDMSGRIRQATGVPPRHQPASTQHR

SEQ ID NO: 899735 - protein, 703 aa, Homo sapiens
MAPLCSLARWNYFFLYDGSKVKEEGDPTRAGICYFYPSQTLLDQQELLCGQIAGVVRCVSDISDSPPTLVRLRKLKFAIKVDGDYLWVLGCAVELPDVSCKRFLDQLVGFFNFYNGPVSLAYENCSQEELSTEWDTFIEQILKNTSDLHKIFNSLWNLDQTKVEPLLLLKAARILQTCQRSPHILAGCILYKGLIVSTQLPPSLTAKVLLHRTAPQEQRLPTGEDAPQEHGAALPPNVQIIPVFVTKEEAISLHEFPVEQMTRSLASPAGLQDGSAQHHPKGGSTSALKENATGHVESMAWTTPDPTSPDEACPDGRKENGCLSGHDLESIRPAGLHNSARGEVLGLSSSLGKELVFLQEELDLSEIHIPEAQEVEMASGHFAFLHVPVPDGRAPYCKASLSASSSLEPTPPEDTAISSLRPPSAPEMLTQHGAQEQLEDHPGHSSQAPIPRADPLPRRTRRPLLLPRLDPGQRGNKLPTGEQGLDEDVDGVCESHAAPGLECSSGSANCQGAGPSADGISSRLTPAESCMGLVRMNLYTHCVKGLMLSLLAEEPLLGDSAAIEEVYHSSLASLNGLEVHLKETLPRDEAASTSSTYNFTYYDRIQSLLMANLPQVATPHDRRFLQAVSLMHSEFAQLPALYEMTVRNASTAVYACCNPIQETYFQQLAPAARSSGFPNPQDGAFSLSGKAKQKLLKHGVNLL

SEQ ID NO: 899736 - protein, 708 aa, Homo sapiens [sequence omitted]

SEQ ID NO: 899737 - protein, 443 aa, Homo sapiens
MTRSLASPAGLQDGSAQHHPKGGSTSALKENATGHVESMAWTTPDPTSPDEACPDGRKENGCLSGHDLESIRPAGLHNSARGEVLGLSSSLGKELVFLQEELDLSEIHIPEAQEVEMASGHFAFLHVPVPDGRAPYCKASLSASSSLEPTPPEDTAISSLRPPSAPEMLTQHGAQEQLEDHPGHSSQAPIPRADPLPRRTRRPLLLPRLDPGQRGNKLPTGEQGLDEDVDGVCESHAAPGLECSSGSANCQGAGPSADGISSRLTPAESCMGLVRMNLYTHCVKGLMLSLLAEEPLLGDSAAIEEVYHSSLASLNGLEVHLKETLPRDEAASTSSTYNFTYYDRIQSLLMANLPQVATPHDRRFLQAVSLMHSEFAQLPALYEMTVRNASTAVYACCNPIQETYFQQLAPAARSSGFPNPQDGAFSLSGKAKQKLLKHGVNLL

SEQ ID NO: 899738 - protein, 739 aa, Homo sapiens
MAPLCSLARWNYFFLYDGSKVKEEGDPTRAGICYFYPSQTLLDQQELLCGQIAGVVRCVSDISDSPPTLVRLRKLKFAIKVDGDYLWVLGCAVELPDVSCKRFLDQLVGFFNFYNGPVSLAYENCSQEELSTEWDTFIEQILKNTSDLHKIFNSLWNLDQTKALSYTLSSCSVQPFPLFSLPDCEHADGWHDASCPAQVEPLLLLKAARILQTCQRSPHILAGCILYKGLIVSTQLPPSLTAKVLLHRTAPQEQRLPTGEDAPQEHGAALPPNVQIIPVFVTKEEAISLHEFPVEQMTRSLASPAGLQDGSAQHHPKGGSTSALKENATGHVESMAWTTPDPTSPDEACPDGRKENGCLSGHDLESIRPAGLHNSARGEVLGLSSSLGKELVFLQEELDLSEIHIPEAQEVEMASGHFAFLHVPVPDGRAPYCKASLSASSSLEPTPPEDTAISSLRPPSAPEMLTQHGAQEQLEDHPGHSSQAPIPRADPLPRRTRRPLLLPRLDPGQRGNKLPTGEQGLDEDVDGVCESHAAPGLECSSGSANCQGAGPSADGISSRLTPAESCMGLVRMNLYTHCVKGLMLSLLAEEPLLGDSAAIEEVYHSSLASLNGLEVHLKETLPRDEAASTSSTYNFTYYDRIQSLLMANLPQVATPHDRRFLQAVSLMHSEFAQLPALYEMTVRNASTAVYACCNPIQETYFQQLAPAARSSGFPNPQDGAFSLSGKAKQKLLKHGVNLL

SEQ ID NO: 899739 - protein, 604 aa, Homo sapiens
MLYQEDEDLSKCKYDVTCIPESYENCSQEELSTEWDTFIEQILKNTSDLHKIFNSLWNLDQTKVEPLLLLKAARILQTCQRSPHILAGCILYKGLIVSTQLPPSLTAKVLLHRTAPQEQRLPTGEDAPQEHGAALPPNVQIIPVFVTKEEAISLHEFPVEQMTRSLASPAGLQDGSAQHHPKGGSTSALKENATGHVESMAWTTPDPTSPDEACPDGRKENGCLSGHDLESIRPAGLHNSARGEVLGLSSSLGKELVFLQEELDLSEIHIPEAQEVEMASGHFAFLHVPVPDGRAPYCKASLSASSSLEPTPPEDTAISSLRPPSAPEMLTQHGAQEQLEDHPGHSSQAPIPRADPLPRRTRRPLLLPRLDPGQRGNKLPTGEQGLDEDVDGVCESHAAPGLECSSGSANCQGAGPSADGISSRLTPAESCMGLVRMNLYTHCVKGLMLSLLAEEPLLGDSAAIEEVYHSSLASLNGLEVHLKETLPRDEAASTSSTYNFTYYDRIQSLLMANLPQVATPHDRRFLQAVSLMHSEFAQLPALYEMTVRNASTAVYACCNPIQETYFQQLAPAARSSGFPNPQDGAFSLSGKAKQKLLKHGVNLL

SEQ ID NO: 899740 - protein, 419 aa, Homo sapiens
MSDLLSIPGNPAISMTMYTPDPTSPDEACPDGRKENGCLSGHDLESIRPAGLHNSARGEVLGLSSSLGKELVFLQEELDLSEIHIPEAQEVEMASGHFAFLHVPVPDGRAPYCKASLSASSSLEPTPPEDTAISSLRPPSAPEMLTQHGAQEQLEDHPGHSSQAPIPRADPLPRRTRRPLLLPRLDPGQRGNKLPTGEQGLDEDVDGVCESHAAPGLECSSGSANCQGAGPSADGISSRLTPAESCMGLVRMNLYTHCVKGLMLSLLAEEPLLGDSAAIEEVYHSSLASLNGLEVHLKETLPRDEAASTSSTYNFTYYDRIQSLLMANLPQVATPHDRRFLQAVSLMHSEFAQLPALYEMTVRNASTAVYACCNPIQETYFQQLAPAARSSGFPNPQDGAFSLSGKAKQKLLKHGVNLL

SEQ ID NO: 899741 - protein, 708 aa, Homo sapiens [sequence omitted]

SEQ ID NO: 899742 - protein, 68 aa, Homo sapiens
SARHRRAPACQELEGEVGGAARDLRPLCRARRYGAEVAGTQLLPTFLVQSPEPRALGCLATPSQGTDV

SEQ ID NO: 899743 - protein, 225 aa, Homo sapiens [sequence omitted]

SEQ ID NO: 899744 - protein, 225 aa, Homo sapiens [sequence omitted]

SEQ ID NO: 899745 - protein, 708 aa, Homo sapiens [sequence omitted]

SEQ ID NO: 899746 - protein, 726 aa, Homo sapiens
MATSTSTEAKSASWWNYFFLYDGSKVKEEGDPTRAGICYFYPSQTLLDQQELLCGQIAGVVRCVSDISDSPPTLVRLRKLKFAIKVDGDYLWVLGCAVELPDVSCKRFLDQLVGFFNFYNGPVSLAYENCSQEELSTEWDTFIEQILKNTSDLHKIFNSLWNLDQTKVEPLLLLKAARILQTCQRSPHILAGCILYKGLIVSTQLPPSLTAKVLLHRTAPQEQRLPTGEDAPQEHGKWMLWSFKNRVTHQNPNGAALPPNVQIIPVFVTKEEAISLHEFPVEQMTRSLASPAGLQDGSAQHHPKGGSTSALKENATGHVESMAWTTPDPTSPDEACPDGRKENGCLSGHDLESIRPAGLHNSARGEVLGLSSSLGKELVFLQEELDLSEIHIPEAQEVEMASGHFAFLHVPVPDGRAPYCKASLSASSSLEPTPPEDTAISSLRPPSAPEMLTQHGAQEQLEDHPGHSSQAPIPRADPLPRRTRRPLLLPRLDPGQRGNKLPTGEQGLDEDVDGVCESHAAPGLECSSGSANCQGAGPSADGISSRLTPAESCMGLVRMNLYTHCVKGLMLSLLAEEPLLGDSAAIEEVYHSSLASLNGLEVHLKETLPRDEAASTSSTYNFTYYDRIQSLLMANLPQVATPHDRRFLQAVSLMHSEFAQLPALYEMTVRNASTAVYACCNPIQETYFQQLAPAARSSGFPNPQDGAFSLSGKAKQKLLKHGVNLL

SEQ ID NO: 899747 - protein, 714 aa, Homo sapiens
KARYEAGCVLYLHRGKSASWWNYFFLYDGSKVKEEGDPTRAGICYFYPSQTLLDQQELLCGQIAGVVRCVSDISDSPPTLVRLRKLKFAIKVDGDYLWVLGCAVELPDVSCKRFLDQLVGFFNFYNGPVSLAYENCSQEELSTEWDTFIEQILKNTSDLHKIFNSLWNLDQTKVEPLLLLKAARILQTCQRSPHILAGCILYKGLIVSTQLPPSLTAKVLLHRTAPQEQRLPTGEDAPQEHGAALPPNVQIIPVFVTKEEAISLHEFPVEQMTRSLASPAGLQDGSAQHHPKGGSTSALKENATGHVESMAWTTPDPTSPDEACPDGRKENGCLSGHDLESIRPAGLHNSARGEVLGLSSSLGKELVFLQEELDLSEIHIPEAQEVEMASGHFAFLHVPVPDGRAPYCKASLSASSSLEPTPPEDTAISSLRPPSAPEMLTQHGAQEQLEDHPGHSSQAPIPRADPLPRRTRRPLLLPRLDPGQRGNKLPTGEQGLDEDVDGVCESHAAPGLECSSGSANCQGAGPSADGISSRLTPAESCMGLVRMNLYTHCVKGLMLSLLAEEPLLGDSAAIEEVYHSSLASLNGLEVHLKETLPRDEAASTSSTYNFTYYDRIQSLLMANLPQVATPHDRRFLQAVSLMHSEFAQLPALYEMTVRNASTAVYACCNPIQETYFQQLAPAARSSGFPNPQDGAFSLSGKAKQKLLKHGVNLL

SEQ ID NO: 899748 - protein, 708 aa, Homo sapiens [sequence omitted]

SEQ ID NO: 899749 - protein, 360 aa, Homo sapiens
MATSTSTEAKSASWWNYFFLYDGSKVKEEGDPTRAGICYFYPSQTLLDQQELLCGQIAGVVRCVSDISDSPPTLVRLRKLKFAIKVDGDYLWVLGCAVELPDVSCKRFLDQLVGFFNFYNGPVSLAYENCSQEELSTEWDTFIEQILKNTSDLHKIFNSLWNLDQTKVEPLLLLKAARILQTCQRSPHILAGCILYKGLIVSTQLPPSLTAKVLLHRTAPQEQYHSSLASLNGLEVHLKETLPRDEAASTSSTYNFTYYDRIQSLLMANLPQVATPHDRRFLQAVSLMHSEFAQLPALYEMTVRNASTAVYACCNPIQETYFQQLAPAARSSGFPNPQDGAFSLSGKAKQKLLKHGVNLL

SEQ ID NO: 899750 - protein, 174 aa, Homo sapiens
GLSDSIAKILDVLFWGEWGNSIDRHLSLQTISDCVVQKRWRKPDLDTKIHMSSNLAYSYFFAFGNFTFQVHKYDRIQSLLMANLPQVATPHDRRFLQAVSLMHSEFAQLPALYEMTVRNASTAVYACCNPIQETYFQQLAPAARSSGFPNPQDGAFSLSGKAKQKLLKHGVNLL

SEQ ID NO: 899751 - protein, 611 aa, Homo sapiens
NAAQDAAAAAAAPLPLALRPSPALLQRQGGRAAAARLGSPGPQPGLRSHPQASPGGAHAPTARTRGSSAGTAATCSRPRGDDTMRCALALSALLLLLSTPPLLPSSPSPSPSPSPSQNATQTTTDSSNKTAPTPASSVTIMATDTAQQSTVPTSKANEILASVKATTLGVSSDSPGTTTLAQQVSGPVNTTVARGGGSGNPTTTIESPKSTKSADTTTVATSTATAKPNTTSSQNGAEDTTNSGGKSSHSVTTDLTSTKAEHLTTPHPTSPLSPRQPTLTHPVATPTSSGHDHLMKISSSSSTVAIPGYTFTSPGMTTTLPSSVISQRTQQTSSQMPASSTAPSSQETVQPTSPATALRTPTLPETMSSSPTAASTTHRYPKTPSPTVAHESNWAKCEDLETQTQSEKQLVLNLTGNTLCAGGASDEKLISLICRAVKATFNPAQDKCGIRLASVPGSQTVVVKEITIHTKLPAKDVYERLKDKWDELKEAGVSDMKLGDQGPPEEAEDRFSMPLIITIVCMASFLLLVAALYGCCHQRLSQRKDQQRLTEELQTVENGYHDNPTLEVMETSSEMQEKKVVSLNGELGDSWIVPLDNLTKDDLDEEEDTHL

SEQ ID NO: 899752 - protein, 461 aa, Homo sapiens
NAAQDAAAAAAAPLPLALRPSPALLQRQGGRAAAARLGSPGPQPGLRSHPQASPGGAHAPTARTRGSSAGTAATCSRPRGDDTMRCALALSALLLLLSTPPLLPSSPSPSPSPSPSQNATQTTTDSSNKTAPTPASSVTIMATDTAQQSTVPTSKANEILASVKATTLGVSSDSPGTTTLAQQVSGPVNTTVARGGGSGNPTTTIESPKSTKSADTTTVATSTATAKPNTTSSQNGAEDTTNSGGKSSHSVTTDLTSTKAEHLTTPHPTSPLSPRQPTLTHPVATPTSSGHDHLMKISSSSSTVAIPGYTFTSPGMTTTLPSSVISQRTQQTSSQMPASSTAPSSQETVQPTSPATALRTPTLPETMSSSPTAASTTHRYPKTPSPTVAHESNWAKCEDLETQTQSEKQLVLNLTGNTLCAGGHIVDHYKEEKFEDRSPAAECLSEKETEELMAWMRNVSA

SEQ ID NO: 899753 - protein, 611 aa, Homo sapiens; identical to SEQ ID NO: 899751

SEQ ID NO: 899754 - protein, 493 aa, Homo sapiens
NAAQDAAAAAAAPLPLALRPSPALLQRQGGRAAAARLGSPGPQPGLRSHPQASPGGAHAPTARTRGSSAGTAATCSRPRGDDTMRCALALSALLLLLSTPPLLPSSPSPSPSPSPSQNATQTTTDSSNKTAPTPASSVTIMATDTAQQSTVPTSKANEILASVKATTLGVSSDSPGTTTLAQQVSGPVNTTVARGGGSGNPTTTIESPKSTKSADTTTVATSTATAKPNTTSSQNGAEDTTNSGGKSSHSVTTDLTSTKAEHLTTPHPTSPLSPRQPTLTHPVATPTSSGHDHLMKISSSSSTVAIPGYTFTSPGMTTTLPSSVISQRTQQTSSQMPASSTAPSSQETVQPTSPATALRTPTLPETMSSSPTAASTTHRYPKTPSPTVAHESNWAKCEDLETQTQSEKQLVLNLTGNTLCAGGASDEKLISLICRAVKASSTAPSSQETVQPTSPATALQNTYPARDHELQPHSSINYPPDTPKHLLPCRRAG

SEQ ID NO: 899755 - protein, 72 aa, Homo sapiens
IFSHYPRFPNDSVIGYLAKNSTDLQSDASQLYGPFLPGDSAAHEPGNGIENTYPARDHELQPHSSINYPPIP

SEQ ID NO: 899756 - protein, 756 aa, Homo sapiens
MVAPVLETSHVFCCPNRVRGVLNWSSGPRGLLAFGTSCSVVLYDPLKRVVVTNLNGHTARVNCIQWICKQDGSPSTELVSGGSDNQVIHWEIEDNQLLKAVHLQGHEGPVYAVHAVYQRRTSDPALCTLIVSAAADSAVRLWSKKGPEVPILACGNDDCRIHIFAQQNDQFQKVLSLCGHEDWIRGVEWAAFGRDLFLASCSQDCLIRIWKLYIKSTSLETQDDDNIRLKENTFTIENESVKIAFAVTLETVLAGHENWVNAVHWQPVFYKDGVLQQPVRLLSASMDKTMILWAPDEESGVWLEQREWTPEIVISGHFDGVQDLVWDPEGEFIITVGTDQTTRLFAPWKRKDQSQVTWHEIARPQIHGYDLKCLAMINRFQFVSGADEKVLRVFSAPRNFVENFCAITGQSLNHVLCNQDSDLPEGATVPALGLSNKAVFQGDIASQPSDEEELLTSTGFEYQQVAFQPSILTEPPTEDHLLQNTLWPEVQKLYGHGYEIFCVTCNSSKTLLASACKAAKKEHAAIILWNTTSWKQVQNLVFHSLTVTQMAFSPNEKFLLAVSRDRTWSLWKKQDTISPEFEPVFSLFAFTNKITSVHSRIIWSCDWSPDSKYFFTGSRDKKVVVWGECDSTDDCIEHNIGPCSSVLDVGGAVTAVSVCPVLHPSQRYVVAVGLECGKICLYTWKKTDQVPEINDWTHCVETSQSQSHTLAIRKLCWKNCSGKTEQKEAEGAEWLHFASCGEDHTVKIHRVNKCAL

SEQ ID NO: 899757 - protein, 826 aa, Homo sapiens
MVAPVLETSHVFCCPNRVRGVLNWSSGPRGLLAFGTSCSVVLYDPLKRVVVTNLNGHTARVNCIQWICKQDGSPSTELVSGGSDNQVIHWEIEDNQLLKAVHLQGHEGPVYAVHAVYQRRTSDPALCTLIVSAAADSAVRLWSKKGPEVMCLQTLNFGNGFALALCLSFLPNTDVPILACGNDDCRIHIFAQQNDQFQKVLSLCGHEDWIRGVEWAAFGRDLFLASCSQDCLIRIWKLYIKSTSLETQDDDNIRLKENTFTIENESVKIAFAVTLETVLAGHENWVNAVHWQPVFYKDGVLQQPVRLLSASMDKTMILWAPDEESGVWLEQVRVGEVGGNTLGFYDCQFNEDGSMIIAHAFHGALHLWKQNTVNPREWTPEIVISGHFDGVQDLVWDPEGEFIITVGTDQTTRLFAPWKRKDQSQVTWHEIARPQIHGYDLKCLAMINRFQFVSGADEKVLRVFSAPRNFVENFCAITGQSLNHVLCNQDSDLPEGATVPALGLSNKAVFQGDIASQPSDEEELLTSTGFEYQQVAFQPSILTEPPTEDHLLQNTLWPEVQKLYGHGYEIFCVTCNSSKTLLASACKAAKKEHAAIILWNTTSWKQVQNLVFHSLTVTQMAFSPNEKFLLAVSRDRTWSLWKKQDTISPEFEPVFSLFAFTNKITSVHSRIIWSCDWSPDSKYFFTGSRDKKVVVWGECDSTDDCIEHNIGPCSSVLDVGGAVTAVSVCPVLHPSQRYVVAVGLECGKICLYTWKKTDQVPEINDWTHCVETSQSQSHTLAIRKLCWKNCSGKTEQKEAEGAEWLHFASCGEDHTVKIHRVNKCAL

SEQ ID NO: 899758 - protein, 590 aa, Homo sapiens
MVAPVLETSHVFCCPNRVRGVLNWSSGPRGLLAFGTSCSVVLYDPLKRVVVTNLNGHTARVNCIQWICKQDGSPSTELVSGGSDNQVIHWEIEDNQLLKAVHLQGHEGPVYAVHAVYQRRTSDPALCTLIVSAAADSAVRLWSKKGPEVMCLQTLNFGNGFALALCLSFLPNTDVPILACGNDDCRIHIFAQQNDQFQKVLSLCGHEDWIRGVEWAAFGRDLFLASCSQDCLIRIWKLYIKSTSLETQDDDNIRLKENTFTIENESVKIAFAVTLETVLAGHENWVNAVHWQPVFYKDGVLQQPVRLLSASMDKTMILWAPDEESGVWLEQVRVGEVGGNTLGFYDCQFNEDGSMIIAHAFHGALHLWKQNTVNPREWTPEIVISGHFDGVQDLVWDPEGEFIITVGTDQTTRLFAPWKRKDQSQVTWHEIARPQIHGYDLKCLAMINRFQFVSGADEKVLRVFSAPRNFVENFCAITGQSLNHVLCNQDSDLPEGATVPALGLSNKAVFQGDIASQPSDEEELLTSTGFEYQQVAFQPSILTDMGTVMKYFVLLVTVQRLCLPQLVRQLRKSMQLSFFGTLHLGNRCRI

SEQ ID NO: 899759 - protein, 677 aa, Homo sapiens
MCLQTLNFGNGFALALCLSFLPNTDVPILACGNDDCRIHIFAQQNDQFQKVLSLCGHEDWIRGVEWAAFGRDLFLASCSQDCLIRIWKLYIKSTSLETQDDDNIRLKENTFTIENESVKIAFAVTLETVLAGHENWVNAVHWQPVFYKDGVLQQPVRLLSASMDKTMILWAPDEESGVWLEQVRVGEVGGNTLGFYDCQFNEDGSMIIAHAFHGALHLWKQNTVNPREWTPEIVISGHFDGVQDLVWDPEGEFIITVGTDQTTRLFAPWKRKDQSQVTWHEIARPQIHGYDLKCLAMINRFQFVSGADEKVLRVFSAPRNFVENFCAITGQSLNHVLCNQDSDLPEGATVPALGLSNKAVFQGDIASQPSDEEELLTSTGFEYQQVAFQPSILTEPPTEDHLLQNTLWPEVQKLYGHGYEIFCVTCNSSKTLLASACKAAKKEHAAIILWNTTSWKQVQNLVFHSLTVTQMAFSPNEKFLLAVSRDRTWSLWKKQDTISPEFEPVFSLFAFTNKITSVHSRIIWSCDWSPDSKYFFTGSRDKKVVVWGECDSTDDCIEHNIGPCSSVLDVGGAVTAVSVCPVLHPSQRYVVAVGLECGKICLYTWKKTDQVPEINDWTHCVETSQSQSHTLAIRKLCWKNCSGKTEQKEAEGAEWLHFASCGEDHTVKIHRVNKCAL

SEQ ID NO: 899760 - protein, 646 aa, Homo sapiens
RLGRGLGVRIAQQNDQFQKVLSLCGHEDWIRGVEWAAFGRDLFLASCSQDCLIRIWKLYIKSTSLETQDDDNIRLKENTFTIENESVKIAFAVTLETVLAGHENWVNAVHWQPVFYKDGVLQQPVRLLSASMDKTMILWAPDEESGVWLEQVRVGEVGGNTLGFYDCQFNEDGSMIIAHAFHGALHLWKQNTVNPREWTPEIVISGHFDGVQDLVWDPEGEFIITVGTDQTTRLFAPWKRKDQSQVTWHEIARPQIHGYDLKCLAMINRFQFVSGADEKVLRVFSAPRNFVENFCAITGQSLNHVLCNQDSDLPEGATVPALGLSNKAVFQGDIASQPSDEEELLTSTGFEYQQVAFQPSILTEPPTEDHLLQNTLWPEVQKLYGHGYEIFCVTCNSSKTLLASACKAAKKEHAAIILWNTTSWKQVQNLVFHSLTVTQMAFSPNEKFLLAVSRDRTWSLWKKQDTISPEFEPVFSLFAFTNKITSVHSRIIWSCDWSPDSKYFFTGSRDKKVVVWGECDSTDDCIEHNIGPCSSVLDVGGAVTAVSVCPVLHPSQRYVVAVGLECGKICLYTWKKTDQVPEINDWTHCVETSQSQSHTLAIRKLCWKNCSGKTEQKEAEGAEWLHFASCGEDHTVKIHRVNKCAL

SEQ ID NO: 899761 - protein, 826 aa, Homo sapiens; identical to SEQ ID NO: 899757

SEQ ID NO: 899762 - protein, 457 aa, Homo sapiens
GALPLQREWTPEIVISGHFDGVQDLVWDPEGEFIITVGTDQTTRLFAPWKRKDQSQVTWHEIARPQIHGYDLKCLAMINRFQFVSGADEKVLRVFSAPRNFVENFCAITGQSLNHVLCNQDSDLPEGATVPALGLSNKAVFQGDIASQPSDEEELLTSTGFEYQQVAFQPSILTEPPTEDHLLQNTLWPEVQKLYGHGYEIFCVTCNSSKTLLASACKAAKKEHAAIILWNTTSWKQVQNLVFHSLTVTQMAFSPNEKFLLAVSRDRTWSLWKKQDTISPEFEPVFSLFAFTNKITSVHSRIIWSCDWSPDSKYFFTGSRDKKVVVWGECDSTDDCIEHNIGPCSSVLDVGGAVTAVSVCPVLHPSQRYVVAVGLECGKICLYTWKKTDQVPEINDWTHCVETSQSQSHTLAIRKLCWKNCSGKTEQKEAEGAEWLHFASCGEDHTVKIHRVNKCAL

SEQ ID NO: 899763 - protein, 705 aa, Homo sapiens
MVAPVLETSHVFCCPNRVRGVLNWSSGPRGLLAFGTSCSVVLYDPLKRVVVTNLNGHTARVNCIQWICKQDGSPSTELVSGGSDNQVIHWEIEDNQLLKAVHLQGHEGPVYAVHAVYQRRTSDPALCTLIVSAAADSAVRLWSKKGPEVMCLQTLNFGNGFALALCLSFLPNTDVPILACGNDDCRIHIFAQQNDQFQKVLSLCGHEDWIRGVEWAAFGRDLFLASCSQDCLIRIWKLYIKSTSLETQDDDNIRLKENTFTIENESVKIAFAVTLETVLAGHENWVNAVHWQPVFYKDGVLQQPVRLLSASMDKTMILWAPDEESGVWLEQVRVGEVGGNTLGFYDCQFNEDGSMIIAHAFHGALHLWKQNTVNPREWTPEIVISGHFDGVQDLVWDPEGEFIITVGTDQTTRLFAPWKRKDQSQVTWHEIARPQIHGYDLKCLAMINRFQFVSGADEKVLRVFSAPRNFVENFCAITGQSLNHVLCNQDSDLPEGATVPALGLSNKAVFQGDIASQPSDEEELLTSTGFEYQQVAFQPSILTEPPTEDHLLQNTLWPEVQKLYGHGYEIFCVTCNSSKTLLASACKAAKKEHAAIILWNTTSWKQVQNLVFHSLTVTQMAFSPNEKFLLAVSRDRTWSLWKKQDTISPEFVELFGLVIGVLTASISSLGVETKRWLSGVSATPLMTVLSTTLAPAPQSWTWVGL

SEQ ID NO: 899764 - protein, 661 aa, Homo sapiens
MVAPVLETSHVFCCPNRVRGVLNWSSGPRGLLAFGTSCSVVLYDPLKRVVVTNLNGHTARVNCIQWICKQDGSPSTELVSGGSDNQVIHWEIEDNQLLKAVHLQGHEGPVYAVHAVYQRRTSDPALCTLIVSAAADSAVRLWSKKGPEVMCLQTLNFGNGFALALCLSFLPNTDVPILACGNDDCRIHIFAQQNDQFQKVLSLCGHEDWIRGVEWAAFGRDLFLASCSQDCLIRIWKLYIKSTSLETQDDDNIRLKENTFTIENESVKIAFAVTLETVLAGHENWVNAVHWQPVFYKDGVLQQPVRLLSASMDKTMILWAPDEESGVWLEQVRVGEVGGNTLGFYDCQFNEDGSMIIAHAFHGALHLWKQNTVNPREWTPEIVISGHFDGVQDLVWDPEGEFIITVGTDQTTRLFAPWKRKDQSQVTWHEIARPQIHGYDLKCLAMINRFQFVSGADEKVLRVFSAPRNFVENFCAITGQSLNHVLCNQDSDLPEGATVPALGLSNKAVFQGDIASQPSDEEELLTSTGFEYQQVAFQPSILTEPPTEDHLLQNTLWPEVQKLYGHGYEIFCVTCNSSKTLLASACKAAKKEHAAIILWNTTSWKQVQNLVFHSLTVTQMAFSPNEKFLLAVSRDRTWSLWKKQDTISPEFGKTASDWESY

SEQ ID NO: 899765 - protein, 709 aa, Homo sapiens
MVAPVLETSHVFCCPNRVRGVLNWSSGPRGLLAFGTSCSVVLYDPLKRVVVTNLNGHTARVNCIQWICKQDGSPSTELVSGGSDNQVIHWEIEDNQLLKAVHLQGHEGPVYAVHAVYQRRTSDPALCTLIVSAAADSAVRLWSKKGPEVMCLQTLNFGNGFALALCLSFLPNTDVPILACGNDDCRIHIFAQQNDQFQKVLSLCGHEDWIRGVEWAAFGRDLFLASCSQDCLIRIWKLYIKSTSLETQDDDNIRLKENTFTIENESVKIAFAVTLETVLAGHENWVNAVHWQPVFYKDGVLQQPVRLLSASMDKTMILWAPDEESGVWLEQVRVGEVGGNTLGFYDCQFNEDGSMIIAHAFHGALHLWKQNTVNPREWTPEIVISGHFDGVQDLVWDPEGEFIITVGTDQTTRLFAPWKRKDQSQVTWHEIARPQIHGYDLKCLAMINRFQFVSGADEKVLRVFSAPRNFVENFCAITGQSLNHVLCNQDSDLPEGATVPALGLSNKAVFQGDIASQPSDEEELLTSTGFEYQQVAFQPSILTEPPTEDHLLQNTLWPEVQKLYGHGYEIFCVTCNSSKTLLASACKAAKKEHAAIILWNTTSWKQVQNLVFHSLTVTQMAFSPNEKFLLAVSRDRTWSLWKKQDTISPEFEPVFSLFAFTNKITSVHSRIIWSCDWSPDSKYFFTGSRDKKVCLGDATPPGLNDTTCI

SEQ ID NO: 899766 - protein, 654 aa, Homo sapiens
MVAPVLETSHVFCCPNRVRGVLNWSSGPRGLLAFGTSCSVVLYDPLKRVVVTNLNGHTARVNCIQWICKQDGSPSTELVSGGSDNQVIHWEIEDNQLLKAVHLQGHEGPVYAVHAVYQRRTSDPALCTLIVSAAADSAVRLWSKKGPEVMCLQTLNFGNGFALALCLSFLPNTDVPILACGNDDCRIHIFAQQNDQFQKVLSLCGHEDWIRGVEWAAFGRDLFLASCSQDCLIRIWKLYIKSTSLETQDDDNIRLKENTFTIENESVKIAFAVTLETVLAGHENWVNAVHWQPVFYKDGVLQQPVRLLSASMDKTMILWAPDEESGVWLEQVRVGEVGGNTLGFYDCQFNEDGSMIIAHAFHGALHLWKQNTVNPREWTPEIVISGHFDGVQDLVWDPEGEFIITVGTDQTTRLFAPWKRKDQSQVTWHEIARPQIHGYDLKCLAMINRFQFVSGADEKVLRVFSAPRNFVENFCAITGQSLNHVLCNQDSDLPEGATVPALGLSNKAVFQGDIASQPSDEEELLTSTGFEYQQVAFQPSILTVLDVGGAVTAVSVCPVLHPSQRYVVAVGLECGKICLYTWKKTDQVPEINDWTHCVETSQSQSHTLAIRKLCWKNCSGKTEQKEAEGAEWLHFASCGEDHTVKIHRVNKCAL

SEQ ID NO: 899767 - protein, 393 aa, Homo sapiens
MVAPVLETSHVFCCPNRVRGVLNWSSGPRGLLAFGTSCSVVLYDPLKRVVVTNLNGHTARVNCIQWICKQDGSPSTELVSGGSDNQVIHWEIEDNQLLKAVHLQGHEGPVYAVHAVYQRRTSDPALCTLIVSAAADSAVRLWSKKGPEVMCLQTLNFGNGFALALCLSFLPNTDVPILACGNDDCRIHIFAQQNDQFQKVLSLCGHEDWIRGVEWAAFGRDLFLASCSQDCLIRIWKLYIKSTSLETQDDDNIRLKENTFTIENESVKIAFAVTLETVLAGHENWVNAVHWQPVFYKDGVLQQPVRLLSASMDKTMILWAPDEESGVWLEQVRVGEVGGNTLGFYDCQFNEDGSMIIAHAFHGACTFGNRIQLTQESGLQRLSFQDTLMVSKT

SEQ ID NO: 899768 - protein, 393 aa, Homo sapiens; identical to SEQ ID NO: 899767

SEQ ID NO: 899769 - protein, 891 aa, Homo sapiens
MVAPVLETSHVFCCPNRVRGVLNWSSGPRGLLAFGTSCSVVLYDPLKRVVVTNLNGHTARVNCIQWICKQDGSPSTELVSGGSDNQVIHWEIEDNQLLKAVHLQGHEGPVYAVHAVYQRRTSDPALCTLIVSAAADSAVRLWSKKGPEVMCLQTLNFGNGFALALCLSFLPNTDVTWKTGQVERGRAWKPPASLALCSRSCDSMVSCYASILCKALWKEKLHTFWHHNRISFLPSAFRPIPILACGNDDCRIHIFAQQNDQFQKVLSLCGHEDWIRGVEWAAFGRDLFLASCSQDCLIRIWKLYIKSTSLETQDDDNIRLKENTFTIENESVKIAFAVTLETVLAGHENWVNAVHWQPVFYKDGVLQQPVRLLSASMDKTMILWAPDEESGVWLEQVRVGEVGGNTLGFYDCQFNEDGSMIIAHAFHGALHLWKQNTVNPREWTPEIVISGHFDGVQDLVWDPEGEFIITVGTDQTTRLFAPWKRKDQSQVTWHEIARPQIHGYDLKCLAMINRFQFVSGADEKVLRVFSAPRNFVENFCAITGQSLNHVLCNQDSDLPEGATVPALGLSNKAVFQGDIASQPSDEEELLTSTGFEYQQVAFQPSILTEPPTEDHLLQNTLWPEVQKLYGHGYEIFCVTCNSSKTLLASACKAAKKEHAAIILWNTTSWKQVQNLVFHSLTVTQMAFSPNEKFLLAVSRDRTWSLWKKQDTISPEFEPVFSLFAFTNKITSVHSRIIWSCDWSPDSKYFFTGSRDKKVVVWGECDSTDDCIEHNIGPCSSVLDVGGAVTAVSVCPVLHPSQRYVVAVGLECGKICLYTWKKTDQVPEINDWTHCVETSQSQSHTLAIRKLCWKNCSGKTEQKEAEGAEWLHFASCGEDHTVKIHRVNKCAL

SEQ ID NO: 899770 - protein, 705 aa, Homo sapiens; identical to SEQ ID NO: 899763

SEQ ID NO: 899771 - protein, 826 aa, Homo sapiens; identical to SEQ ID NO: 899757

SEQ ID NO: 899772 - protein, 661 aa, Homo sapiens; identical to SEQ ID NO: 899764

SEQ ID NO: 899773 - protein, 712 aa, Homo sapiens
MVAPVLETSHVFCCPNRVRGVLNWSSGPRGLLAFGTSCSVVLYDPLKRVVVTNLNGHTARVNCIQWICKQDGSPSTELVSGGSDNQVIHWEIEDNQLLKAVHLQGHEGPVYAVHAVYQRRTSDPALCTLIVSAAADSAVRLWSKKGPEVMCLQTLNFGNGFALALCLSFLPNTDVPILACGNDDCRIHIFAQQNDQFQKVLSLCGHEDWIRGVEWAAFGRDLFLASCSQDCLIRIWKLYIKSTSLETQDDDNIRLKENTFTIENESVKIAFAVTLETVLAGHENWVNAVHWQPVFYKDGVLQQPVRLLSASMDKTMILWAPDEESGVWLEQVRVGEVGGNTLGFYDCQFNEDGSMIIAHAFHGALHLWKQNTVNPREWTPEIVISGHFDGVQDLVWDPEGEFIITVGTDQTTRLFAPWKRKDQSQVTWHEIARPQIHGYDLKCLAMINRFQFVSGADEKVLRVFSAPRNFVENFCAITGQSLNHVLCNQDSDLPEGATVPALGLSNKAVFQGDIASQPSDEEELLTSTGFEYQQVAFQPSILTEPPTEDHLLQNTLWPEVQKLYGHGYEIFCVTCNSSKTLLASACKAAKKEHAAIILWNTTSWKQVQNLVFHSLTVTQMAFSPNEKFLLAVSRDRTWSLWKKQDTISPEFEPVFSLFAFTNKITSVHSRIIWSCDWSPDSKYFFTGSRDKKIRGCSRIGVWKDLLIYLEKD

SEQ ID NO: 899774 - protein, 712 aa, Homo sapiens; identical to SEQ ID NO: 899773

SEQ ID NO: 899775 - protein, 359 aa, Homo sapiens
GDLEDPLAVYYRTITESVLCNQDSDLPEGATVPALGLSNKAVFQGDIASQPSDEEELLTSTGFEYQQVAFQPSILTEPPTEDHLLQNTLWPEVQKLYGHGYEIFCVTCNSSKTLLASACKAAKKEHAAIILWNTTSWKQVQNLVFHSLTVTQMAFSPNEKFLLAVSRDRTWSLWKKQDTISPEFEPVFSLFAFTNKITSVHSRIIWSCDWSPDSKYFFTGSRDKKVVVWGECDSTDDCIEHNIGPCSSVLDVGGAVTAVSVCPVLHPSQRYVVAVGLECGKICLYTWKKTDQVPEINDWTHCVETSQSQSHTLAIRKLCWKNCSGKTEQKEAEGAEWLHFASCGEDHTVKIHRVNKCAL

SEQ ID NO: 899776 - protein, 207 aa, Homo sapiens
MAFSPNEKFLLAVSRDRTWSLWKKQDTISPEFEPVFSLFAFTNKITSVHSRIIWSCDWSPDSKYFFTGSRDKKVVVWGECDSTDDCIEHNIGPCSSVLDVGGAVTAVSVCPVLHPSQRYVVAVGLECGKICLYTWKKTDQVPEINDWTHCVETSQSQSHTLAIRKLCWKNCSGKTEQKEAEGAEWLHFASCGEDHTVKIHRVNKCAL

SEQ ID NO: 899777 - protein, 257 aa, Homo sapiens
RAYSGFAEMGLPQPGLWLKRLWVLLEVAVHVVVGKVLLILFPDRVKRNILAMGEKTGMTRNPHFSHDNWIPTFFSTQYFWFVLKVRWQRLEDTTELGGLAPNCPVVRLSGQRCNIWEFMQGNRPLVLNFGSCTSPSFMFKFDQFKRLIEDFSSIADFLVIYIEEAHASDGWAFKNNMDIRNHQNLQDRLQAAHLLLARSPQCPVVVDTMQNQSSQLYAALPERLYIIQEGRILYKGKSGPWNYNPEEVRAVLEKLHS

SEQ ID NO: 899778 - protein, 120 aa, Homo sapiens
MFKFDQFKRLIEDFSSIADFLVIYIEEAHASDGWAFKNNMDIRNHQNLQDRLQAAHLLLARSPQCPVVVDTMQNQSSQLYAALPERLYIIQEGRILYKGKSGPWNYNPEEVRAVLEKLHS

SEQ ID NO: 899779 - protein, 133 aa, Homo sapiens
RAYSGFAEMGLPQPGLWLKRLWVLLEVAVHVVVGKVLLILFPDRVKRNILAMGEKTGMTRNPHFSHDNWIPTFFSTQYFWFVLKVRWQRLEDTTELGGLAPNCPVVRLSGQRCNIWEFMQGNRPLVLNFGSCT

SEQ ID NO: 899780 - protein, 120 aa, Homo sapiens; identical to SEQ ID NO: 899778

SEQ ID NO: 899781 - protein, 136 aa, Homo sapiens
MFKFDQFKRLIEDFSSIADFLVIYIEEAHASDGWAFKNNMDIRNHQNLQDRLQAAHLLLARSPQCPVVVDTMQNQSSQLYAALPERLYIIQEGRILYKGKSGPWNYNPEEVRAVLEASQGLALPETQLAFTLDLCP

SEQ ID NO: 899782 - protein, 343 aa, Homo sapiens
AGVLLSPSGGEGRPSPGADWPITGRKMKVLWAALLVTFLAGCQAKVEQAVETEPEPELRQQTEWQSGQRWELALGRFWDYLRWVQTLSEQVQEELLSSQVTQELRALMDETMKELKAYKSELEEQLTPVAEETRARLSKELQAAQARLGADMEDVCGRLVQYRGEVQAMLGQSTEELRVRLASHLRKLRKRLLRDADDLQKRLAVYQAGAREGAERGLSAIRERLGPLVEQGRVRAATVGSLAGQPLQERAQAWGERLRARMEEMGSRTRDRLDEVKEQVAEVRAKLEEQAQQIRLQAEAFQARLKSWFEPLVEDMQRQWAGLVEKVQAAVGTSAAPVPSDNH

SEQ ID NO: 899783 - protein, 153 aa, Homo sapiens
PVRKRLLRDADDLQKPRVIMAGRRGGGGGFPLSHRRRFPGKERVRAATVGSLAGQPLQERAQAWGERLRARMEEMGSRTRDRLDEVKEQVAEVRAKLEEQAQQIRLQAEAFQARLKSWFEPLVEDMQRQWAGLVEKVQAAVGTSAAPVPSDNH

SEQ ID NO: 899784 - protein, 122 aa, Homo sapiens
MDETMKELKAYKSELEEQLTPVAEETRARLSKELQAAQARLGADMEDVCGRLVQYRGEVQAMLGQSTEELRVRLASHLRKLRKRLLRDADDLQRLARTMTVYREVIERELSGMPERLGPLMQ

SEQ ID NO: 899785 - protein, 122 aa, Homo sapiens
MKVLWAALLVTFLAGCQAKVEQAVETEPEPELRQQTEWQSGQRWELALGRFWDYLRWVQTLSEQVQEELLSSQVTQELREGADGRDHEGVEGLQIGTGGTTLDFGPCLDFGPCLDSGPCLDS

SEQ ID NO: 899786 - protein, 191 aa, Homo sapiens
DGERIHSPSGGEGRPSPGADWPITGRKMKVLWAALLVTFLAGCQAKVEQAVETEPEPELRQQTEWQSGQRWELALGRFWDYLRWVQTLSEQVQEELLSSQVTQELREGADGRDHEGVEGLQIGTGGTTDPGGGGDAGTAVQGAAGGAGPAGRGHGGRVRPPGAVPRRGAGHARPEHRGAAGAPRLPPAQAA

SEQ ID NO: 899787 - protein, 201 aa, Homo sapiens
QRSPYVRPHRYRDMDVLPQETRLAWTTHRQEDEGSVGCVAGHIPGRMPGQGGASGGDRAGARAAPADRVAERPALGTGTGSLLGLPWDYLRWVQTLSEQVQEELLSSQVTQELREGADGRDHEGVEGLQIGTGGTTDPGGGVGCSQRGKEAGLDAVDCIQSRVTASNAAGVLRRAQGGQKPPVEQKGKSSVDLDFQYEYRP

SEQ ID NO: 899788 - protein, 101 aa, Homo sapiens
PAAQPRHRSAPECPSGLAMRLFLSLPVLVVVLSIVLEGPAPAQGTPDVSSALDKLKEFGNTLEDKARELISRIKQSELSAKMREWFSETFQKVKEKLKIDS

SEQ ID NO: 899789 - protein, 1123 aa, Homo sapiens
MLRRELALREGKLGWKPRSRRHSLLLPPPQFSETGRRVPTNGGQAETVSLYLLGQLQHLLVPLPILAPAHPELGAFPGTALITHVEEHPSPGDDSPGLSEEGKGQCAHRQGAWSAGPAADSPYVQELEQHPLRASVSPDVNERISISHISHLKNLNLEFSPLRIFFVFLRQCLAQSTTLECSSTIINHCSLQLKQPSCLNLLSSWGHRHPPPCLANSFFFEMESHSVAQAGVQWHHLGSPQPLPPGFKQFSCLSLLVARITGAHHHTRLIFVFLVETRFHHGGQVGLKLLTSGDPPASASQSTGITGVSHHAWPYFKLFCRDGVLLCCPGCSQTLGLKQILLPKLPKVVGLQVGATTPHQPMKMSKQTGCPISPHPQSDPEVGQGWEGGSRTKAGRESYGTGADPATIHRDILEPGKEKDKEPPFLNFFYVFETESHSVTQAGVQWHNLGSLQPPPHGFKRLSCLSLLSSWDHRCTPPCLDNFEFLVETEFHHVGQAGLELLTSSAPPTLASQSSGNTGVSHCNQPVAPIFAPAEPYWMFLVMRQFPHLLKRNPYSRGEDEVGKAGALLCYSCGVWEADIWVDVWGVLGLVGEVGGPLGLQGLEALSWPEGCCNPARVLSMLSFSQPSPYCQADTWLRGHKASQPESLRLGGGHPPHQLPGSLAVKGSWWGRHWTPALGDGCSDGGKQAWCQEGRQRVNKADRVFGGGSQPKGVRPGGREEGTYTQSFAAEGFEFFEMGSLSHQAGVQWHNHSSLQPRTPGLKQSSYLSLLSSWDYSMRHHARLIFEFFVEMRSPYIAQAGLELPGSSDPPSSASQSAGITGMSHHAWLMQVRFLQCHPAKATRSPPKKGRLRTMKLRAQRISRWSGVLQGLVWNKLEVARRVGAPGQLGDPANIKEKLLGLRRLAERGEVRERGDLGTGVNEGGMRSQGYYWETPEGRWPQGQDKAVFLREETTPHIVLCPISASKERKSKNYKGRNEIHKQTARATPWAWWLKIDPGPNPLGLSIDYRHCIEKHCENPYSVLFRSNYRCMQPPVTIPCLFNRSRPSHVHPLRVVSPEKEQGLLTRGARLLRQESCPFPERINPFLNSASEEFCLRLLLLHSEWGKGLRWSEDPTESGRLRA

SEQ ID NO: 899790 - protein, 1232 aa, Homo sapiens
MLRRELALREGKLGWKPRSRRHSLLLPPPQFSETGRRVPTNGGQAETVSLYLLGQLQHLLVPLPILAPAHPELGAFPGTALITHVEEHPSPGDDSPGLSEEGKGQCAHRQGAWSAGPAADSPYVQELEQHPLRASVSPDVNERISISHISHLKNLNLEFSPLRIFFVFLRQCLAQSTTLECSSTIINHCSLQLKQPSCLNLLSSWGHRHPPPCLANSFFFEMESHSVAQAGVQWHHLGSPQPLPPGFKQFSCLSLLVARITGAHHHTRLIFVFLVETRFHHGGQVGLKLLTSGDPPASASQSTGITGVSHHAWPYFKLFCRDGVLLCCPGCSQTLGLKQILLPKLPKVVGLQVGATTPHQPMKMSKQTGCPISPHPQSDPEVGQGWEGGSRTKAGRESYGTGADPATIHRDILEPGKEKDKEPPFLNFFYVFETESHSVTQAGVQWHNLGSLQPPPHGFKRLSCLSLLSSWDHRCTPPCLDNFEFLVETEFHHVGQAGLELLTSSAPPTLASQSSGNTGVSHCNQPVAPIFAPAEPYWMFLVMRQFPHLLKRNPYSRGEDEVGKAGALLCYSCGVWEADIWVDVWGVLGLVGEVGGPLGLQGLEALSWPEGCCNPARVLSMLSFSQPSPYCQADTWLRGHKASQPESLRLGGGHPPHQLPGSLAVKGSWWGRHWTPALGDGCSDGGKQAWCQEGRQRVNKADRVFGGGSQPKGVRPGGREEGTYTQSFAAEGFEFFEMGSLSHQAGVQWHNHSSLQPRTPGLKQSSYLSLLSSWDYSMRHHARLIFEFFVEMRSPYIAQAGLELPGSSDPPSSASQSAGITGMSHHAWLMQVRFLQCHPAKATRSPPKKGRLRTMKLRAQRISRWSGVLQGLVWNKLEVARRVGAPGQLGDPANIKEKLLGLRRLAERGEVRERGDLGTGVNEGGMRSQGYYWETPEGRWPQGQDKAVFLREETTPHIVLCPISASKERKSKNYKGRNEIHKQTARATPWAWWLKIDPGPNPLGLSIDYRHCIEKHCENPYSVLFRSNYRCMQPPVTIPCLFNRSRPSHVHPLRVVSPEKEQGLLTRGARLLRQESCPFPERINPFLNSASEEFCLRLLLLHSEWGKGLRWSEDPTESGRLRGESAERGGALGLREVPGTPPDPNAHGTGAEEKNVGGQREAGGQGKAQEEGDQHQPAPPPPQPDKGPAGRTGPPNQALQQGFRLVLSAWEGHPPTLCKKLKKGDEGIVGGR

SEQ ID NO: 899791 - protein, 1123 aa, Homo sapiens; identical to SEQ ID NO: 899789

SEQ ID NO: 899792 - protein, 343 aa, Homo sapiens; identical to SEQ ID NO: 899782

SEQ ID NO: 899793 - protein, 1123 aa, Homo sapiens; identical to SEQ ID NO: 899789

SEQ ID NO: 899794 - protein, 1213 aa, Homo sapiens
MLRRELALREGKLGWKPRSRRHSLLLPPPQFSETGRRVPTNGGQAETVSLYLLGQLQHLLVPLPILAPAHPELGAFPGTALITHVEEHPSPGDDSPGLSEEGKGQCAHRQGAWSAGPAADSPYVQELEQHPLRASVSPDVNERISISHISHLKNLNLEFSPLRIFFVFLRQCLAQSTTLECSSTIINHCSLQLKQPSCLNLLSSWGHRHPPPCLANSFFFEMESHSVAQAGVQWHHLGSPQPLPPGFKQFSCLSLLVARITGAHHHTRLIFVFLVETRFHHGGQVGLKLLTSGDPPASASQSTGITGVSHHAWPYFKLFCRDGVLLCCPGCSQTLGLKQILLPKLPKVVGLQVGATTPHQPMKMSKQTGCPISPHPQSDPEVGQGWEGGSRTKAGRESYGTGADPATIHRDILEPGKEKDKEPPFLNFFYVFETESHSVTQAGVQWHNLGSLQPPPHGFKRLSCLSLLSSWDHRCTPPCLDNFEFLVETEFHHVGQAGLELLTSSAPPTLASQSSGNTGVSHCNQPVAPIFAPAEPYWMFLVMRQFPHLLKRNPYSRGEDEVGKAGALLCYSCGVWEADIWVDVWGVLGLVGEVGGPLGLQGLEALSWPEGCCNPARVLSMLSFSQPSPYCQADTWLRGHKASQPESLRLGGGHPPHQLPGSLAVKGSWWGRHWTPALGDGCSDGGKQAWCQEGRQRVNKADRVFGGGSQPKGVRPGGREEGTYTQSFAAEGFEFFEMGSLSHQAGVQWHNHSSLQPRTPGLKQSSYLSLLSSWDYSMRHHARLIFEFFVEMRSPYIAQAGLELPGSSDPPSSASQSAGITGMSHHAWLMQVRFLQCHPAKATRSPPKKGRLRTMKLRAQRISRWSGVLQGLVWNKLEVARRVGAPGQLGDPANIKEKLLGLRRLAERGEVRERGDLGTGVNEGGMRSQGYYWETPEGRWPQGQDKAVFLREETTPHIVLCPISASKERKSKNYKGRNEIHKQTARATPWAWWLKIDPGPNPLGLSIDYRHCIEKHCENPYSVLFRSNYRCMQPPVTIPCLFNRSRPSHVHPLRVVSPEKEQGLLTRGARLLRQESCPFPERINPFLNSASEEFCLRLLLLHSEWGKGLRWSEDPTESGRLRGESAERGGALGLREVPGTPPDPNAHGTGAEEKNVGGQREAGGQGKAQEEGDQHQPAPPPPQPDKGPAGRTGPPNQALQQGFLKFPTPQRLC

SEQ ID NO: 899795 - protein, 380 aa, Homo sapiens
REPYNWTSLGAESYSAPAEVKDVLPQEPVRSAVGGTGMSSGASRKSWDPGKPWPPDWPITGRKMKVLWAALLVTFLAGCQAKVEQAVETEPEPELRQQTEWQSGQRWELALGRFWDYLRWVQTLSEQVQEELLSSQVTQELRALMDETMKELKAYKSELEEQLTPVAEETRARLSKELQAAQARLGADMEDVCGRLVQYRGEVQAMLGQSTEELRVRLASHLRKLRKRLLRDADDLQKRLAVYQAGAREGAERGLSAIRERLGPLVEQGRVRAATVGSLAGQPLQERAQAWGERLRARMEEMGSRTRDRLDEVKEQVAEVRAKLEEQAQQIRLQAEAFQARLKSWFEPLVEDMQRQWAGLVEKVQAAVGTSAAPVPSDNH

SEQ ID NO: 899796 - protein, 1231 aa, Homo sapiens
MLRRELALREGKLGWKPRSRRHSLLLPPPQFSETGRRVPTNGGQAETVSLYLLGQLQHLLVPLPILAPAHPELGAFPGTALITHVEEHPSPGDDSPGLSEEGKGQCAHRQGAWSAGPAADSPYVQELEQHPLRASVSPDVNERISISHISHLKNRTLVLTFKNFFFFLRQCLAQSTTLECSSTIINHCSLQLKQPSCLNLLSSWGHRHPPPCLANSFFFEMESHSVAQAGVQWHHLGSPQPLPPGFKQFSCLSLLVARITGAHHHTRLIFVFLVETRFHHGGQVGLKLLTSGDPPASASQSTGITGVSHHAWPYFKLFCRDGVLLCCPELISNSWAQADPPAKASQSSWITGVSHHAPPTYEDVKQTGCPISPHPQSDPEVGQGWEGGSRTKAGRESYGTGADPATIHRDILEPGKEKDKEPPFLNFFYVFETESHSVTQAGVQWHNLGSLQPPPHGFKRLSCLSLLSSWDHRCTPPCLDNFEFLVETEFHHVGQAGLELLTSSAPPTLASQSSGNTGVSHCNQPVAPIFAPAEPYWMFLVMRQFPHLLKRNPYSRGEDEVGKAGALLCYSCGVWEADIWVDVWGVLGLVGEVGGPLGLQGLEALSWPEGCCNPARVLSMLSFSQPSPYCQADTWLRGHKASQPESLRLGGGHPPHQLPGSLAVKGSWWGRHWTPALGDGCSDGGKQAWCQEGRQRVNKADRVFGGGSQPKGVRPGGREEGTYTQSFAAEGFEFFEMGSLSHQAGVQWHNHSSLQPRTPGLKQSSYLSLLSSWDYSMRHHARLIFEFFVEMRSPYIAQAGLELPGSSDPPSSASQSAGITGMSHHAWLMQVRFLQCHPAKATRSPPKKGRLRTMKLRAQRISRWSGVLQGLVWNKLEVARRVGAPGQLGDPANIKEKLLGLRRLAERGEVRERGDLGTGVNEGGMRSQGYYWETPEGRWPQGQDKAVFLREETTPHIVLCPISASKERKSKELKGRNEIHKQTARATPWAWWLKIDPGPNPLELSIDYRHCIEKHCENPYSVLFRSNYRCMQPPVTHPLLFNRSRPSHVHPLRVVSPEKEQGLLTRGARLLRQESCPFPERINPFLNSASEEFCLRLLLLHSEWGKGLRWSEDPTESGRLRGESAERGGALGLREVPGTPPDPNAHGTGAEEKNVGGQREAGGQGKAQEEGDQHQPAPPPPQPDKGPAGRTGPPNQALQQGFRLVLSAWEGHPPTLCKKLKKGDEGIVGGR

SEQ ID NO: 899797 - protein, 1231 aa, Homo sapiens
MLRRELALREGKLGWKPRSRRHSLLLPPPQFSETGRRVPTNGGQAETVSLYLLGQLQHLLVPLPILAPAHPELGAFPGTALITHVEEHPSPGDDSPGLSEEGKGQCAHRQGAWSAGPAADSPYVQELEQHPLRASVSPDVNERISISHISHLKNRTLVLTFKNFFFFLRQCLAQSTTLECSSTIINHCSLQLKQPSCLNLLSSWGHRHPPPCLANSFFFEMESHSVAQAGVQWHHLGSPQPLPPGFKQFSCLSLLVARITGAHHHTRLIFVFLVETRFHHGGQVGLKLLTSGDPPASASQSTGITGVSHHAWPYFKLFCRDGVLLCCPELISNSWAQADPPAKASQSSWITGVSHHAPPTYEDVKQTGCPISPHPQSDPEVGQGWEGGSRTKAGRESYGTGADPATIHRDILEPGKEKDKEPPFLNFFYVFETESHSVTQAGVQWHNLGSLQPPPHGFKRLSCLSLLSSWDHRCTPPCLDNFEFLVETEFHHVGQAGLELLTSSAPPTLASQSSGNTGVSHCNQPVAPIFAPAEPYWMFLVMRQFPHLLKRNPYSRGEDEVGKAGALLCYSCGVWEADIWVDVWGVLGLVGEVGGPLGLQGLEALSWPEGCCNPARVLSMLSFSQPSPYCQADTWLRGHKASQPESLRLGGGHPPHQLPGSLAVKGSWWGRHWTPALGDGCSDGGKQAWCQEGRQRVNKADRVFGGGSQPKGVRPGGREEGTYTQSFAAEGFEFFEMGSLSHQAGVQWHNHSSLQPRTPGLKQSSYLSLLSSWDYSMRHHARLIFEFFVEMRSPYIAQAGLELPGSSDPPSSASQSAGITGMSHHAWLMQVRFLQCHPAKATRSPPKKGRLRTMKLRAQRISRWSGVLQGLVWNKLEVARRVGAPGQLGDPANIKEKLLGLRRLAERGEVRERGDLGTGVNEGGMRSQGYYWETPEGRWPQGQDKAVFLREETTPHIVLCPISASKERKSKELKGRNEIHKQTARATPWAWWLKIDPGPNPLGLSIDYRHCIEKHCENPYSVLFRSNYRCMQPPVTIPCLFNRSRPSHVHPLRVVSPEKEQGLLTRGARLLRQESCPFPERINPFLNSASEEFCLRLLLLHSEWGKGLRWSEDPTESGRLRGESAERGGALGLREVPGTPPDPNAHGTGAEEKNVGGQREAGGQGKAQEEGDQHQPAPPPPQPDKGPAGRTGPPNQALQQGFRLVLSAWEGHPPTLCKKLKKGDEGIVGGR

SEQ ID NO: 899798 - protein, 332 aa, Homo sapiens
AGVLLSPSGGEGRPSPGADWPITGRKMKVLWAALLVTFLAGCQAKVEQAVETEPEPELRQQTEWQSGQRWELALGRFWDYLRWVQTLSEQVQEELLSSQVTQELRALMDETMKELKAYKSELEEQLTPVAEETRARLSKELQAAQARLGADMEDVCGRLVQYRGEVQAMLGQSTEELRVRLASHLRKLRKRLLRDADDLQKRLAVYQAGAREGAERGLSAIRVRAATVGSLAGQPLQERAQAWGERLRARMEEMGSRTRDRLDEVKEQVAEVRAKLEEQAQQIRLQAEAFQARLKSWFEPLVEDMQRQWAGLVEKVQAAVGTSAAPVPSDNH

SEQ ID NO: 899799 - protein, 1232 aa, Homo sapiens
MLRRELALREGKLGWKPRSRRHSLLLPPPQFSETGRRVPTNGGQAETVSLYLLGQLQHLLVPLPILAPAHPELGAFPGTALITHVEAAPSPGDDSPGLSEEGKGQCAHRQGAWSAGPAADSPYVQELEQHPLRASVSPDVNERISISHISHLKNLNLEFSPLRIFFLFLRQCLAQSTTLECSSTIINHCSLQLKQPSCLNLLSSWGHRHPPPCLANSFFFEMESHSVAQAGVQWHHLGSPQPLPPGFKQFSCLSLLVARITGAHHHTRLIFVFLVETRFHHGGQVGLKLLTSGDPPASASQSTGITGVSHHAWPYFKLFCRDGVLLCCPELISNSWAQADPPAKASQSSWITGVSHHAPPTYEDVKQTGCPISPHPQSDPEVGQGWEGGSRTKAGRESYGTGADPATIHRDILEPGKEKDKEPPFLNFFYVFETESHSVTQAGVQWHNLGSLQPPPHGFKRLSCLSLLSSWDHRCTPPCLDNFEFLVETEFHHVGQAGLELLTSSAPPTLASQSSGNTGVSHCNQPVAPIFAPPEPYWMFLVMRQFPHLLKRNPYSRGEDEVGKAGALLCYSCGVWEADIWVDVWGVLGLVGEVGGPLGLTGTGSSELARGMLQSCQGLVYAVLFYNHPPTARLTRGCGGTRPANLESEARRRTPSPPAARVTGGQRQLVGKALDSSLGGRMYDGGKQAWCQEGRQRVNKSRRVFGGGSQPKGVRPGGREEGTYTQSFAAEGFNFLEMGSLSHQAGVQWHNHSSLQPRTPGLKQSSYLSLLSSWDYSMRHHARLIFEFFVEMRSPYIAQAGLELPGSSDPPSSASQSAGITGMSHHAWLMQVRFLQCHPAKATRSPPKKGRLRTMKLRAQRISRWSGVLQGLVWNKLEVARRVGAPGQLGDPANIKEKLLGLRRLAERGEVRERGDLGTRVNEGGMRSQGYYWETPEGRWPQGQDKAVFLREETTPHIVLCPISASKERKSKELKGRNEIHKQTARATPWAWWLKIDPGPNPLGLSIDYRHCIEKHCENPYSVLFRSNYRCMQPPVTIPCLFNRSRPSHVHPLRVVSPEKEQGLLTRGARLLRQESCPFPERINPFLNSASEEFCLRLLLLHSEWGKGLRWSEDPTESGRLRGESAERGGALGLREVPGTPPDPNAHGTGAEEKNVGGQREAGGQGKAQEEGDQHQPAPPPPQPDKGPAGRTGPPNQALQQGFRLVLSAWEGHPPTLCKKLKKGDEGIVGGR

SEQ ID NO: 899800 - protein, 961 aa, Homo sapiens
MTHQELSEEGKGQCAHRQGAWSAGPAADSPYVQELEQHPLRASVSPDVNERISISHISHLKNLNLEFSPLRIFFSFLRQCLAQSTTLECSSTIINHCSLQLKQPSCLNLLSSWGHRHPPPCLANSFFFEMESHSVAQAGVQWHHLGSPQPLPPGFKQFSCLSLLVARITGAHHHTRLIFVFLVETRFHHGGQVGLKLLTSGDPPASASQSTGITGVSHHAWPYFKLFCRDGVLLCCPELISNSWAQADPPAKASQSSWITGVSHHAPPTYEDVKQTGCPISPHPQSDPEVGQGWEGGSRTKAGRESYGTGADPATIHRDILEPGKEKDKEPPFLNFFYVFETESHSVTQAGVQWHNLGSLQPPPHGFKRLSCLSLLSSWDHRCTPPCLDNFEFLVETEFHHVGQAGLELLTSSAPPTLASQSSGNTGVSHCNQPVAPIFAPAEPYWMFLVMRQFPHLLKRNPYSRGEDEVGKAGALLCYSCGVWEADIWVDVWGVLGLVGEVGGPLGLQGLEALSWPEGCCNPARVLSMLSFSQPSPYCQADTWLRGHKASQPESLRLGGGHPPHQLPGSLAVKGSWWGRHWTPALGDGCSDGGKQAWCQEGRQRVNKADRVFGGGSQPKGVRPGGREEGTYTQSFAAEGFEFFEMGSLSHQAGVQWHNHSSLQPRTPGLKQSSYLSLLSSWDYSMRHHARLIFEFFVEMRSPYIAQAGLELPGSSDPPSSASQSAGITGMSHHAWLMQVRFLQCHPAKATRSPPKKGRLRTMKLRAQRISRWSGVLQGLVWNKLEVARRVGAPGQLGDLSNIKEKLLGLRRLAERGEVRERGDLGTRVNEGGMRSQGYYWETPEGRWPQGQDKAVFLREETTPHIVLCPISASKERKSKELKGRNEIHKQTARATPWAWWLKIDPGPNPLGLSIDYRHCIEKHCENPYSVLFRSNYRCMQPPVTHPLLVQSITTLSRAPT

SEQ ID NO: 899801 - protein, 1011 aa, Homo sapiens
MESHSVAQAGVQWHHLGSPQPLPPGFKQFSCLSLLVARITGAHHHTRLIFVFLVETRFHHGGQVGLKLLTSGDPPASASQSTGITGVSHHAWPYFKLFCRDGVLLCCPELISNSWAQADPPAKASQSSWITGVSHHAPPTYEDVKQTGCPISPHPQSDPEVGQGWEGGSRTKAGRESYGTGADPATIHRDILEPGKEKDKEPPFLNFFYVFETESHSVTQAGVQWHNLGSLQPPPHGFKRLSCLSLLSSWDHRCTPPCLDNFEFLVETEFHHVGQAGLELLTSSAPPTLASQSSGNTGVSHCNQPVAPIFAPAEPYWMFLVMRQFPHLLKRNPYSRGEDEVGKAGALLCYSCGVWEADIWVDVWGVLGLVGEVGGPLGLQGLEALSWPEGCCNPARVLSMLSFSQPSPYCQADTWLRGHKASQPESLRLGGGHPPHQLPGSLAVKGSWWGRHWTPALGDGCSDGGKQAWCQEGRQRVNKADRVFGGGSQPKGVRPGGREEGTYTQSFAAEGFEFFEMGSLSHQAGVQWHNHSSLQPRTPGLKQSSYLSLLSSWDYSMRHHARLIFEFFVEMRSPYIAQAGLELPGSSDPPSSASQSAGITGMSHHAWLMQVRFLQCHPAKATRSPPKKGRLRTMKLRAQRISRWSGVLQGLVWNKLEVARRVGAPGQLGDPANIKEKLLGLRRLAERGEVRERGDLGTGVNEGGMRSQGYYWETPEGRWPQGQDKAVFLREETTPHIVLCPISASKERKSKELKGRNEIHKQTARATPWAWWLKIDPGPNPLGLSIDYRHCIEKHCENPYSVLFRSNYRCMQPPVTIPCLFNRSRPSHVHPLRVVSPEKEQGLLTRGARLLRQESCPFPERINPFLNSASEEFCLRLLLLHSEWGKGLRWSEDPTESGRLRGESAERGGALGLREVPGTPPDPNAHGTGAEEKNVGGQREAGGQGKAQEEGDQHQPAPPPPQPDKGPAGRTGPPNQALQQGFRLVLSAWEGHPPTLCKKLKKGDEGIVGGR

SEQ ID NO: 899802 - protein, 193 aa, Homo sapiens
LYGDRPKIAIPREKGWWCFSSTEPPVGGVVWPPVATLEGFLGPWLLQGRVRAATVGSLAGQPLQERAQAWGERLRARMEEMGSRTRDRLDEVKEQVAEGAGPADTPAGRGLPGPPQELVRAPGGRHAAPVGRAGGEGAGCRGHQRRPCAQRQSLNAEACSHATPRHPVPPASAQPAAGDPVPAPAVLLGWALV

SEQ ID NO: 899803 - protein, 115 aa, Homo sapiens
MKVLWAALLVTFLAGCQAKVEQAVETEPEPELRQQTEWQSGQRWELALGRFWDYLRAKLEEQAQQIRLQAEAFQARLKSWFEPLVEDMQRQWAGLVEKVQAAVGTSAAPVPSDNH

SEQ ID NO: 899804 - protein, 132 aa, Homo sapiens
MDETMKELKAYKSELEEQLTPVAEETRARLSKELQAAQARLGADMEDVCGRLVQYRGEVQAMLGQSTEELRVRLASHLRKLRKRLLRDADDLQKRLAVYQAGAREGAERGLSAIREALVALWARPPSAPPCA

SEQ ID NO: 899805 - protein, 120 aa, Homo sapiens
QRSPYVRPHRYRDMDVLPQETRLAWTTHRQEDEGSVGCVAGHIPGRMPGQGGASGGDRAGARAAPADRVAERPALGTGTGSLLGLPWDYLRWVQTLSEQVQEELLSSQVTQELRASRGPD

SEQ ID NO: 899806 - protein, 1232 aa, Homo sapiens; identical to SEQ ID NO: 899790

SEQ ID NO: 899807 - protein, 1232 aa, Homo sapiens; identical to SEQ ID NO: 899790

SEQ ID NO: 899808 - protein, 1164 aa, Homo sapiens
MLRRELALREGKLGWKPRSRRHSLLLPPPQFSETGRRVPTNGGQAETVSLYLLGQLQHLLVPLPILAPAHPELGAFPGTALITHVEEHPSPGDDSPGLSEEGKGQCAHRQGAWSAGPAADSPYVQELEQHPLRASVSPDVNERISISHISHLKNLNLEFSPLRIFFVFLRQCLAQSTTLECSSTIINHCSLQLKQPSCLNLLSSWGHRHPPPCLANSFFFEMESHSVAQAGVQWHHLGSPQPLPPGFKQFSCLSLLVARITGAHHHTRLIFVFLVETRFHHGGQVGLKLLTSGDPPASASQSTGITGVSHHAWPYFKLFCRDGVLLCCPGCSQTLGLKQILLPKLPKVVGLQVGATTPHQPMKMSKQTGCPISPHPQSDPEVGQGWEGGSRTKAGRESYGTGADPATIHRDILEPGKEKDKEPPFLNFFYVFETESHSVTQAGVQWHNLGSLQPPPHGFKRLSCLSLLSSWDHRCTPPCLDNFEFLVETEFHHVGQAGLELLTSSAPPTLASQSSGNTGVSHCNQPVAPIFAPAEPYWMFLVMRQFPHLLKRNPYSRGEDEVGKAGALLCYSCGVWEADIWVDVWGVLGLVGEVGGPLGLQGLEALSWPEGCCNPARVLSMLSFSQPSPYCQADTWLRGHKASQPESLRLGGGHPPHQLPGSLAVKGSWWGRHWTPALGDGCSDGGKQAWCQEGRQRVNKADRVFGGGSQPKGVRPGGREEGTYTQSFAAEGFEFFEMGSLSHQAGVQWHNHSSLQPRTPGLKQSSYLSLLSSWDYSMRHHARLIFEFFVEMRSPYIAQAGLELPGSSDPPSSASQSAGITGMSHHAWLMQVRFLQCHPAKATRSPPKKGRLRTMKLRAQRISRWSGVLQGLVWNKLEVARRVGAPGQLGDPANIKEKLLGLRRLAERGEVRERGDLGTGVNEGGMRSQGYYWETPEGRWPQGQDKAVFLREETTPHIVLCPISASKERKSKNYKGRNEIHKQTARATPWAWWLKIDPGPNPLGLSIDYRHCIEKHCENPYSVLFRSNYRCMQPPVTIPCLFNRSRPSHVHPLRVVSPEKEQGLLTRGARLLRQESCPFPERINPFLNSASEEFCLRLLLLHSEWGKGLRWSEDPTESGRLSRVPLRPRHEALPVAPGPGGGSVDRLGRPSPSPGDPRRLQCLG

SEQ ID NO: 899809 - protein, 1123 aa, Homo sapiens; identical to SEQ ID NO: 899789

SEQ ID NO: 899810 - protein, 343 aa, Homo sapiens; identical to SEQ ID NO: 899782

SEQ ID NO: 899811 - protein, 353 aa, Homo sapiens
REPYNVDKSGSGVLLSPSGGEGRPSPGADWPITGRKMKVLWAALLVTFLAGCQAKVEQAVETEPEPELRQQTEWQSGQRWELALGRFWDYLRWVQTLSEQVQEELLSSQVTQELRALMDETMKELKAYKSELEEQLTPVAEETRARLSKELQAAQARLGADMEDVCGRLVQYRGEVQAMLGQSTEELRVRLASHLRKLRKRLLRDADDLQKRLAVYQAGAREGAERGLSAIRERLGPLVEQGRVRAATVGSLAGQPLQERAQAWGERLRARMEEMGSRTRDRLDEVKEQVAEVRAKLEEQAQQIRLQAEAFQARLKSWFEPLVEDMQRQWAGLVEKVQAAVGTSAAPVPSDNH

SEQ ID NO: 899812 - protein, 1141 aa, Homo sapiens
MTHQELSEEGKGQCAHRQGAWSAGPAADSPYVQELEQHPLRASVSPDVNERISISHISHLKNRTLVLTFKNFFFFLRQCLAQSTTLECSSTIINHCSLQLKQPSCLNLLSSWGHRHPPPCLANSFFFEMESHSVAQAGVQWHHLGSPQPLPPGFKQFSCLSLLVARITGAHHHTRLIFVFLVETRFHHGGQVGLKLLTSGDPPASASQSTGITGVSHHAWPYFKLFCRDGVLLCCPELISNSWAQADPPAKASQSSWITGVSHHAPPTYEDVKQTGCPISPHPQSDPEVGQGWEGGSRTKAGRESYGTGADPATIHRDILEPGKEKDKEPPFLNFFYVFETESHSVTQAGVQWHNLGSLQPPPHGFKRLSCLSLLSSWDHRCTPPCLDNFWIFGRDGVSPCWPGRSRTPDLKCSAHLGLPKFWEYRREPLQPASEPPSLPLAEPYWMFLVMRQFPHLLKRNPYSRGEDEVGKAGALLCYSCGVWEADIWVDVWGVLGLVGEVGGPLGLQGLEALSWPEGCCNPARVLSMLSFSQPSPYCQADTWLRGHKASQPESLRLGGGHPPHQLPGSLAVKGSWWGRHWTPALGDGCSDGGKQAWCQEGRQRVNKADRVFGGGSQPKGVRPGGREEGTYTQSFAAEGFNFLEMGSLSHQAGVQWHNHSSLQPRTPGLKQSSYLSLLSSWDYRHAPPRSAEFLNFFVEMRSPYIAQAGLELPGSSDPPSSASQSAGITGMSHHAWLMQVRFLQCHPAKATRSPPKKGRLRTMKLRAQRISRWSGVLQGLVWNKLEVARRVGAPGQLGDPANIKEKLLGLRRLAERGEVRERGDLGTGVNEGGMRSQGYYWETPEGRWPQGQDKAVFLREETTPHIVLCPISASKERKSKELKGRNEIHKQTARATPWAWWLKIDPGPNPLGLSIDYRHCIEKHCENPYSVLFRSNYRCMQPPVTIPCLFNRSRPSHVHPLRVVSPEKEQGLLTRGARLLRQESCPFPERINPFLNSASEEFCLRLLLLHSEWGKGLRWSEDPTESGRLRGESAERGGALGLREVPGTPPDPNAHGTGAEEKNVGGQREAGGQGKAQEEGDQHQPAPPPPQPDKGPAGRTGPPNQALQQGFRLVLSAWEGHPPTLCKKLKKGDEGIVGGR

SEQ ID NO: 899813 - protein, 960 aa, Homo sapiens
MTHQELSEEGKGQCAHRQGAWSAGPAADSPYVQELEQHPLRASVSPDVNERISISHISHLKNRTLSSHLEEFFFFFETVPCSVTTLECSSTIINHCSLQLKQPSCLNLLSSWGHRHPPPCLANSFFFEMESHSVAQAGVQWHHLGSPQPLPPGFKQFSCLSLLVARITGAHHHTRLIFVFLVETRFHHGGQVGLKLLTSGDPPASASQSTGITGVSHHAWPYFKLFCRDGVLLCCPELISNSWAQADPPAKASQSSWITGVSHHAPPTYEDVKQTGCPISPHPQSDPEVGQGWEGGSRTKAGRESYGTGADPATIHRDILEPGKEKDKEPPFLNFFYVFETESHSVTQAGVQWHNLGSLQPPPHGFKRLSCLSLLSSWDHRCTPPCLDNFEFLVETEFHHVGQAGLELLTSSAPPTLASQSSGNTGVSHCNQPVAPIFAPAEPYWMFLVMRQFPHLLKRNPYSRGEDEVGKAGALLCYSCGVWEADIWVDVWGVLGLVGEVGGPLGLQGLEALSWPEGCCNPARVLSMLSFSQPSPYCQADTWLRGHKASQPESLRLGGGHPPHQLPGSLAVKGSWWGRHWTPALGDGCSDGGKQAWCQEGRQRVNKADRVFGGGSQPKGVRPGGREEGTYTQSFAAEGFEFFEMGSLSHQAGVQWHNHSSLQPRTPGLKQSSYLSLLSSWDYSMRHHARLIFEFFVEMRSPYIAQAGLELPGSSDPPSSASQSAGITGMSHHAWLMQVRFLQCHPAKATRSPPKKGRLRTMKLRAQRISRWSGVLQGLVWNKLEVARRVGAPGQLGDPANIKEKLLGLRRLAERGEVRERGDLGTRVNEGGMRSQGYYWETPEGRWPQGQDKAVFLREETTPHIVLCPISASKERKSKELKGRNEIHKQTARATPWAWWLKIDPGPNPLGLSIDYRHCIEKHCENPYSVLFRSNYRCMQPPVTHPLLVQSITTLSRAPT

SEQ ID NO: 899814 - protein, 209 aa, Homo sapiens
AGVLLSPSGGEGRPSPGADWPITGRKMKVLWAALLVTFLAGCQAKVEQAVETEPEPELRQQTEWQSGQRWELALGRFWDYLRWVQTLSEQVQEELLSSQVTQELRALMDETMKELKAYKSELEEQLTPVAEETRARLSKELQAAQARLGADMEDVCGRLVQYRGEVQAMLGQSTEELRVRLASHLRKLRKRLLRDADDLAAGPATAWTR

SEQ ID NO: 899815 - protein, 1232 aa, Homo sapiens
MLRRELALREGKLGWKPRSRRHSLLLPPPQFSETGRRVPTNGGQAETVSLYLLGQLQHLLVPLPILAPAHPELGAFPGTALITHVEEHPSPGDDSPGLSEEGKGQCAHRQGAWSAGPAADSPYVQELEQHPLRASVSPDVNERISISHISHLKNRTLSLTFKNFFFFLRQCLAQSTTLECSSTIINHCSLQLKQPSCLNLLSSWGHRHPPPCLANSFFFEMESHSVAQAGVQWHHLGSPQPLPPGFKQFSCLSLLVARITGAHHHTRLIFVFLVETRFHHGGQVGLKLLTSGDPPASASQSTGITGVSHHAWPYFKLFCRDGVLLCCPGCSQTLGLKQILLPKLPKVVGLQVGATTPHQPMKMSKQTGCPISPHPQSDPEVGQGWEGGSRTKAGRESYGTGADPATIHRDILEPGKEKDKEPPFLNFFYVFETESHSVTQAGVQWHNLGSLQPPPHGFKRLSCLSLLSSWDHRCTPPCLDNFEFLVETEFHHVGQAGLELLTSSAPPTLASQSSGNTGVSHCNQPVAPIFAPAEPYWMFLVMRQFPHLLKRNPYSRGEDEVGKAGALLCYSCGVWEADIWVDVWGVLGLVGEVGGPLGLQGLEALSWPEGCCNPARVLSMLSFSQPSPYCQADTWLRGHKASQPKSLRLGGGHPPHQLPGSLAVKGSWWGRHWTPALGDGCSDGGKQAWCQEGRQRVNKADRVFGGGSQPKGVRPGGREEGTYTQSFAAEGFEFFEMGSLSHQAGVQWHNHSSLQPRTPGLKQSSYLSLLSSWDYRHAPPRSAEFLNFFVEMRSPYIAQAGLELPGSSDPPSSASQSAGITGMSHHAWLMQVRFLQCHPAKATRSPPKKGRLRTMKLRAQRISRWSGVLQGLVWNKLEVARRVGAPGQLGDPANIKEKLLGLRRLAERGEVRERGDLGTGVNEGGMRSQGYYWETPEGRWPQGQDKAVFLREETTPHIVLCPISASKERKSKELKGRNEIHKQTARATPWAWWLKIDPGPNPLGLSIDYRHCIEKHCENPYSVLFRSNYRCMQPPVTIPCLFNRSRPSHVHPLRVVSPEKEQGLLTRGARLLRQESCPFPERINPFLNSASEEFCLRLLLLHSEWGKGLRWSEDPTESGRLRGESAERGGALGLREVPGTPPDPNAHGTGAEEKNVGGQREAGGQGKAQEEGDQHQPAPPPPQPDKGPAGRTGPPNQALQQGFRLVLSAWEGHPPTLCKKLKKGDEGIVGGR

SEQ ID NO: 899816 - protein, 276 aa, Homo sapiens
MDETMKELKAYKSELEEQLTPVAEETRARLSKELQAAQARLGADMEDVCGRLVQYRGEVQAMLGQSTEELRVRLASHLRKLRKRLLRDADDLQKRLAVYQAGAREGAERGLSAIRERLGPLVEQGLLRAATVGSLAGQPLQERAQAWGERLRARMEEMVGSRTRDRLDEVKEQVAEVRAKLGAGPADTPAGRGLPGPPQELVRAPGGRHAAPVGRAGGEGAGCRGHQRRPCAQRQSLNAEACSHATPRHPVPPASAQPAAGDPVPAPAVLLGWALV

SEQ ID NO: 899817 - protein, 137 aa, Homo sapiens
LKPCTSVRGRVELPLMPQLPHPYVGVMLARPPGRSGSKAAAVSCQVFTADETWSLNTAVPVLITRVSVMPPFPEGSPCSLRVPPSAMAARAASGSSLRPSFPFLESSTLAWPCRTKHNSEIPPQPSAVKLLRIRLFS

SEQ ID NO: 899818 - protein, 646 aa, Homo sapiens
MADNFVFDGSSLPADVHRYMKMIQLGKTVHYLPILFIDQLSNRVKDLMVINRSGGLRRAAHSFPRGGGGGARRLSSERRSPERRAGRRAGGGSRLRGGRAGGAGRGAAMWSGRSSFTSLVVGVFVVYVVHTCWVMYGIVYTRPCSGDANCIQPYLARRPKLQLSVYTTTRSHLGAENNIDLVLNVEDFDVESKFERTVNVSVPKKTRNNGTLYAYIFLHHAGVLPWHDGKQVHLVSPLTTYMVPKPEEINLLTGESDTQQIEAEKKPTSALDEPVSHWRPRLALNVMADNFVFDGSSLPADVHRYMKMIQLGKTVHYLPILFIDQLSNRVKDLMVINRSTTELPLTVSYDKVSLGRLRFWIHMQDAVYSLQQFGFSEKDADEVKGIFVDTNLYFLALTFFVAAFHLLFDFLAFKNDISFWKKKKSMIGMSTKAVLWRCFSTVVIFLFLLDEQTSLLVLVPAGVGAAIELWKVKKALKMTIFWRGLMPEFQFGTYSESERKTEEYDTQAMKYLSYLLYPLCVGGAVYSLLNIKYKSWYSWLINSFVNGVYAFGFLFMLPQLFVNYKLKSVAHLPWKAFTYKAFNTFIDDVFAFIITMPTSHRLACFRDDVVFLVYLYQRWLYPVDKRRVNEFGESYEEKATRAPHTD

SEQ ID NO: 899819 - protein, 538 aa, Homo sapiens
MWSGRSSFTSLVVGVFVVYVVHTCWVMYGIVYTRPCSGDANCIQPYLARRPKLQLSVYTTTRSHLGAENNIDLVLNVEDFDVESKFERTVNVSVPKKTRNNGTLYAYIFLHHAGVLPWHDGKQVHLVSPLTTYMVPKPEEINLLTGESDTQQIEAEKKPTSALDEPVSHWRPRLALNVMADNFVFDGSSLPADVHRYMKMIQLGKTVHYLPILFIDQLSNRVKDLMVINRSTTELPLTVSYDKVSLGRLRFWIHMQDAVYSLQQFGFSEKDADEVKGIFVDTNLYFLALTFFVAAFHLLFDFLAFKNDISFWKKKKSMIGMSTKAVLWRCFSTVVIFLFLLDEQTSLLVLVPAGVGAAIELWKVKKALKMTIFWRGLMPEFQFGTYSESERKTEEYDTQAMKYLSYLLYPLCVGGAVYSLLNIKYKSWYSWLINSFVNGVYAFGFLFMLPQLFVNYKLKSVAHLPWKAFTYKAFNTFIDDVFAFIITMPTSHRLACFRDDVVFLVYLYQRWLYPVDKRRVNEFGESYEEKATRAPHTD

SEQ ID NO: 899820 - protein, 538 aa, Homo sapiens; identical to SEQ ID NO: 899819

SEQ ID NO: 899821 - protein, 538 aa, Homo sapiens; identical to SEQ ID NO: 899819

SEQ ID NO: 899822 - protein, 393 aa, Homo sapiens
MLDVKWNISWRMKQIVRKVEPVSHWRPRLALNVMADNFVFDGSSLPADVHRYMKMIQLGKTVHYLPILFIDQLSNRVKDLMVINRSTTELPLTVSYDKVSLGRLRFWIHMQDAVYSLQQFGFSEKDADEVKGIFVDTNLYFLALTFFVAAFHLLFDFLAFKNDISFWKKKKSMIGMSTKAVLWRCFSTVVIFLFLLDEQTSLLVLVPAGVGAAIELWKVKKALKMTIFWRGLMPEFQFGTYSESERKTEEYDTQAMKYLSYLLYPLCVGGAVYSLLNIKYKSWYSWLINSFVNGVYAFGFLFMLPQLFVNYKLKSVAHLPWKAFTYKAFNTFIDDVFAFIITMPTSHRLACFRDDVVFLVYLYQRWLYPVDKRRVNEFGESYEEKATRAPHTD

SEQ ID NO: 899823 - protein, 554 aa, Homo sapiens
MWSGRSSFTSLVVGVFVVYVVHTCWVMYGIVYTRPCSGDANCIQPYLARRPKLQLSVYTTTRSHLGAENNIDLVLNVEDFDVESKFERTVNVSVPKKTRNNGTLYAYIFLHHAGVLPWHDGKQVHLVSPLTTYMVPKPEEINLLTGESDTQQIEAEKKPTSALDEPVSHWRPRLALNVMADNFVFDGSSLPADVHRYMKMIQLGKTVHYLPILFIDQLSNRVKDLMVINRSTTELPLTVSYDKVSLGRLRFWIHMQDAVYSLQQFGFSEKDADEVKGIFVDTNLYFLALTFFVAAFHLLFDFLAFKNDISFWKKKKSMIGMSTKAGGVCPAPPPSPTILSPVLWRCFSTVVIFLFLLDEQTSLLVLVPAGVGAAIELWKVKKALKMTIFWRGLMPEFQFGTYSESERKTEEYDTQAMKYLSYLLYPLCVGGAVYSLLNIKYKSWYSWLINSFVNGVYAFGFLFMLPQLFVNYKLKSVAHLPWKAFTYKAFNTFIDDVFAFIITMPTSHRLACFRDDVVFLVYLYQRWLYPVDKRRVNEFGESYEEKATRAPHTD

SEQ ID NO: 899824 - protein, 354 aa, Homo sapiens
MWSGRSSFTSLVVGVFVVYVVHTCWVMYGIVYTRPCSGDANCIQPYLARRPKLQLSVYTTTRSHLGAENNIDLVLNVEDFDVESKFERTVNVSVPKKTRNNGTLYAYIFLHHAGVLPWHDGKQVHLVSPLTTYMVPKPEEINLLTGESDTQQIEAEKKPTSALDEPVSHWRPRLALNVMADNFVFDGSSLPADVHRYMKMIQLGKTVHYLPILFIDQLSNRVKDLMVINRSTTELPLTVSYDKVSLGRLRFWIHMQDAVYSLQQFGFSEKDADEVKGIFVDTNLYFLALTFFVAAFHLLFDFLAFKNDISFWKKKKSMIGMSTKAAVESEEGIEDDYFLERPDARISVWHLQRI

SEQ ID NO: 899825 - protein, 538 aa, Homo sapiens; identical to SEQ ID NO: 899819

SEQ ID NO: 899826 - protein, 229 aa, Homo sapiens
TKAVLWRCFSTVVIFLFLLRKANETRKGPPLAFVGWPWGFPRCRVFGAAIELWKVKKALKMTIFWRGLMPEFQFGTYSESERKTEEYDTQAMKYLSYLLYPLCVGGAVYSLLNIKYKSWYSWLINSFVNGVYAFGFLFMLPQLFVNYKLKSVAHLPWKAFTYKAFNTFIDDVFAFIITMPTSHRLACFRDDVVFLVYLYQRWLYPVDKRRVNEFGESYEEKATRAPHTD

SEQ ID NO: 899827 - protein, 138 aa, Homo sapiens
MKYLSYLLYPLCVGGAVYSLLNIKYKSWYSWLINSFVNGVYAFGFLFMLPQLFVNYKLKSVAHLPWKAFTYKAFNTFIDDVFAFIITMPTSHRLACFRDDVVFLVYLYQRWLYPVDKRRVNEFGESYEEKATRAPHTD

SEQ ID NO: 899828 - protein, 166 aa, Homo sapiens
MKYLSYLLYPLCVGGAVYSLLNIKYKSWYSWLINSFVNGVYAFGFLFMLPQLFVNYKVRRCVLPAARPPSPVLPTADLGLSLLFQLKSVAHLPWKAFTYKAFNTFIDDVFAFIITMPTSHRLACFRDDVVFLVYLYQRWLYPVDKRRVNEFGESYEEKATRAPHTD

SEQ ID NO: 899829 - protein, 435 aa, Homo sapiens
MWSGRSSFTSLVVGVFVVYVVHTCWVMYGIVYTRPCSGDANCIQPYLARRPKLQLSVYTTTRSHLGAENNIDLVLNVEDFDVESKFERTVNVSVPKKTRNNGTLYAYIFLHHAGVLPWHDGKQVHLVSPLTTYMVPKPEEINLLTGESDTQQIEAEKKPTSALDEPVSHWRPRLALNVMADNFVFDGSSLPADVHRYMKMIQLGKTVHYLPILFIDQLSNRVKDLMVINRSTTELPLTVSYDKVSLGRLRFWIHMQDAVYSLQQFGFSEKDADEVKGIFVDTNLYFLALTFFVAAFHLLFDFLAFKNDISFWKKKKSMIGMSTKAVLWRCFSTVVIFLFLLDEQTSLLVLVPAGVGAAIELWKVKKALKMTIFWRGLMPEFQFGTYSESERKTEEYDTQAMKYLSYLLYPLCVCKRREDKRRGNAERTNAERFSR

SEQ ID NO: 899830 - protein, 137 aa, Homo sapiens; identical to SEQ ID NO: 899817

SEQ ID NO: 899831 - protein, 214 aa, Homo sapiens
MWSGRSSFTSLVVGVFVVYVVHTCWVMYGIVYTRPCSGDANCIQPYLARRPKLQLSVYTTTRSHLGAENNIDLVLNVEDFDVESKFERTVNVSVPKKTRNNGTLYAYIFLHHAGVLPWHDGKQVHLVSPLTTYMVPKPEEINLLTGESDTQQIEAEKKPTSALDEPVSHWRPRLALNVMADNFVFDGSSLPADVHRYMKMIQLGKTVRDPLDDL

SEQ ID NO: 899832 - protein, 538 aa, Homo sapiens; identical to SEQ ID NO: 899819

SEQ ID NO: 899833 - protein, 538 aa, Homo sapiens; identical to SEQ ID NO: 899819

SEQ ID NO: 899834 - protein, 590 aa, Homo sapiens
MADNFVFDGSSLPADVHRYMKMIQLGKTVHYLPILFIDQLSNRVKDLMVINRSAVCGARRIRSPAAVAVARGGSPVSGGARSGGLGAGRAGLAAERRAGRGRRARGRHVERPQLLHLGAENNIDLVLNVEDFDVESKFERTVNVSVPKKTRNNGTLYAYIFLHHAGVLPWHDGKQVHLVSPLTTYMVPKPEEINLLTGESDTQQIEAEKKPTSALDEPVSHWRPRLALNVMADNFVFDGSSLPADVHRYMKMIQLGKTVHYLPILFIDQLSNRVKDLMVINRSTTELPLTVSYDKVSLGRLRFWIHMQDAVYSLQQFGFSEKDADEVKGIFVDTNLYFLALTFFVAAFHLLFDFLAFKNDISFWKKKKSMIGMSTKAVLWRCFSTVVIFLFLLDEQTSLLVLVPAGVGAAIELWKVKKALKMTIFWRGLMPEFQFGTYSESERKTEEYDTQAMKYLSYLLYPLCVGGAVYSLLNIKYKSWYSWLINSFVNGVYAFGFLFMLPQLFVNYKLKSVAHLPWKAFTYKAFNTFIDDVFAFIITMPTSHRLACFRDDVVFLVYLYQRWLYPVDKRRVNEFGESYEEKATRAPHTD

SEQ ID NO: 899835 - protein, 566 aa, Homo sapiens
MWSGRSSFTSLVVGVFVVYVVHTCWVMYGIVYTRPCSGDANCIQPYLARRPKLQLSVYTTTRSHLGAENNIDLVLNVEDFDVESKFERTVNVSVPKKTRNNGTLYAYIFLHHAGVLPWHDGKQVHLVSPLTTYMVPKPEEINLLTGESDTQQIEAEKKPTSALDEPVSHWRPRLALNVMADNFVFDGSSLPADVHRYMKMIQLGKTVHYLPILFIDQLSNRVKDLMVINRSTTELPLTVSYDKVSLGRLRFWIHMQDAVYSLQQFGFSEKDADEVKGIFVDTNLYFLALTFFVAAFHLLFDFLAFKNDISFWKKKKSMIGMSTKAVLWRCFSTVVIFLFLLDEQTSLLVLVPAGVGAAIELWKVKKALKMTIFWRGLMPEFQFGTYSESERKTEEYDTQAMKYLSYLLYPLCVGGAVYSLLNIKYKSWYSWLINSFVNGVYAFGFLFMLPQLFVNYKVRRCVLPAARPPSPVLPTADLGLSLLFQLKSVAHLPWKAFTYKAFNTFIDDVFAFIITMPTSHRLACFRDDVVFLVYLYQRWLYPVDKRRVNEFGESYEEKATRAPHTD

SEQ ID NO: 899836 - protein, 538 aa, Homo sapiens; identical to SEQ ID NO: 899819

SEQ ID NO: 899837 - protein, 538 aa, Homo sapiens; identical to SEQ ID NO: 899819

SEQ ID NO: 899838 - protein, 169 aa, Homo sapiens [sequence omitted]

SEQ ID NO: 899839 - protein, 477 aa, Homo sapiens
MWSGRSSFTSLVVGVFVVYVVHTCWVMYGIVYTRPCSGDANCIQPYLARRPKLQLSVYTTTRSHLGAENNIDLVLNVEDFDVESKFERTVNVSVPKKTRNNGTLYAYIFLHHAGVLPWHDGKQVHLVSPLTTYMVPKPEEINLLTGESDTQQIEAEKKPTSALDEPVSHWRPRLALNVMADNFVFDGSSLPADVHRYMKMIQLGKTVHYLPILFIDQLSNRVKDLMVINRSTTELPLTVSYDKVSLGRLRFWIHMQDAVYSLQQFGFSEKDADEVKGIFVDTNLYFLALTFFVAAFHLLFDFLAFKNDISFWKKKKSMIGMSTKAVLWRCFSTVVIFLFLLDEQTSLLVLVPAGVGAAIELWKVKKALKMTIFWRGLMPEFQFGTYSESERKTEEYDTQAMKYLSYLLYPLCVGGAVYSLLNIKYKSWYSWLINSFVNGVYVYGIPPDAFQKYSSTSSVAPGWRQSRPAVQSRCGAP

SEQ ID NO: 899840 - protein, 357 aa, Homo sapiens
MWSGRSSFTSLVVGVFVVYVVHTCWVMYGIVYTRPCSGDANCIQPYLARRPKLQLSVYTTTRSHLGAENNIDLVLNVEDFDVESKFERTVNVSVPKKTRNNGTLYAYIFLHHAGVLPWHDGKQVHLVSPLTTYMVPKPEEINLLTGESDTQQIEAEKKPTSALDEPVSHWRPRLALNVMADNFVFDGSSLPADVHRYMKMIQLGKTVHYLPILFIDQLSNRVKDLMVINRSTTELPLTVSYDKVSLGRLRFWIHMQDAVYSLQQFGFSEKDADEVKGIFVDTNLYFLALTFFVAAFHLLFDFLAFKNDISLCCQNPFGHFSDISQVPITSDLELVALTMPPRVNICLGHRAGCCRSP

SEQ ID NO: 899841 - protein, 403 aa, Homo sapiens
MWSGRSSFTSLVVGVFVVYVVHTCWVMYGIVYTRPCSGDANCIQPYLARRPKLQLSVYTTTRSHLGAENNIDLVLNVEDFDVESKFERTVNVSVPKKTRNNGTLYAYIFLHHAGVLPWHDGKQVHLVSPLTTYMVPKPEEINLLTGESDTQQIEAEKKPTSALDEPVSHWRPRLALNVMADNFVFDGSSLPADVHRYMKMIQLGKTVHYLPILFIDQLSNRVKDLMVINRSTTELPLTVSYDKVSLGRLRFWIHMQDAVYSLQQFGFSEKDADEVKGIFVDTNLYFLALTFFVAAFHLLFDFLAFKNDISFWKKKKSMIGMSTKAVLWRCFSTVVIFLFLLDEQTSLLVLVPAGVGAAIELWKVKKALKMTIFWRGLMPEFQFGTYSESERKTEEYDTQVSHL

SEQ ID NO: 899842 - protein, 161 aa, Homo sapiens
MWSGRSSFTSLVVGVFVVYVVHTCWVMYGIVYTRPCSGDANCIQPYLARRPKLQLSVYTTTRSHLGAENNIDLVLNVEDFDVESKFERTVNVSVPKKTRNNGTLYAYIFLHHVLEEEEEHDRHVHQGSALALLQHRGHLSVPAGRADEPAGAGPGGCWSRH

SEQ ID NO: 899843 - protein, 125 aa, Homo sapiens
GRRRLMDPRIAWFQPEQLGPSNSLWMQIWETTQGLRNLYFNHHCHSSGGASGGGGSSSSSSTATGGSGSSTGSPGGAASAPAPAPAGMYRSGERLLGSHALPAEQRDFLPLETTNNNNNHHQPGA

SEQ ID NO: 899844 - protein, 285 aa, Homo sapiens
DIDLVVFGKWENLPLWTLEEALRKHKVADEDSVKVLDKATVPIIKLTDSFTEVKVDISFNVQNGVRAADLIKDFTKKYPVLPYLVLVLKQFLLQRDLNEVFTGGIGSYSLFLMAVSFLQLHPREDACIPNTNYGVLLIEFFELYGRHFNYLKTGIRIKDGGSYVAKDEVQKNMLDGYRPSMLYIEDPLQPGNDVGRSSYGAMQVKQAFDYAYVVLSHAVSPIAKYYPNNETESILGRIIRVTDEVATYRDWISKQWGLKNRPEPSCNVKLFIRSSVVLFCHTVQL

SEQ ID NO: 899845 - protein, 285 aa, Homo sapiens; identical to SEQ ID NO: 899844

SEQ ID NO: 899846 - protein, 443 aa, Homo sapiens
DIDLVVFGKWENLPLWTLEEALRKHKVADEDSVKVLDKATVPIIKLTDSFTEVKVDISFNVQNGVRAADLIKDFTKKYPVLPYLVLVLKQFLLQRDLNEVFTGGIGSYSLFLMAVSFLQLHPREDACIPNTNYGVLLIEFFELYGRHFNYLKTGIRIKDGGSYVAKDEVQKNMLDGYRPSMLYIEDPLQPGNDVGRSSYGAMQVKQAFDYAYVVLSHAVSPIAKYYPNNETESILGRIIRVTDEVATYRDWISKQWGLKNRPEPSCNGNGVTLIVDTQQLDKCNNNLSEENEALGKCRSKTSESLSKHSSNSSSGPVSSSSATQSSSSDVDSDATPCKTPKQLLCRPSTGNRVGSQDVSLESSQAVGKMQSTQTTNTSNSTNKSQHGSARLFRSSSKGFQGTTQTSHGSLMTNKQHQGKSNNQYYHGKKRKHKRDAPLSDLCR

SEQ ID NO: 899847 - protein, 285 aa, Homo sapiens; identical to SEQ ID NO: 899844

SEQ ID NO: 899848 - protein, 285 aa, Homo sapiens; identical to SEQ ID NO: 899844

SEQ ID NO: 899849 - protein, 70 aa, Homo sapiens
VTTSWLGEPLWPFGQPWPRFPNRGPDPQKKRSPMSGLIPVAVKLRVPQTLHAGFSNPVCCVCLFLISYSF

SEQ ID NO: 899850 - protein, 285 aa, Homo sapiens; identical to SEQ ID NO: 899844

SEQ ID NO: 899851 - protein, 285 aa, Homo sapiens; identical to SEQ ID NO: 899844

SEQ ID NO: 899852 - protein, 285 aa, Homo sapiens; identical to SEQ ID NO: 899844

SEQ ID NO: 899853 - protein, 285 aa, Homo sapiens; identical to SEQ ID NO: 899844

SEQ ID NO: 899854 - protein, 453 aa, Homo sapiens
DIDLVVFGKWENLPLWTLEEALRKHKVADEDSVKVLDKATVPIIKLTDSFTEVKVDISFNVQNGVRAADLIKDFTKKYPVLPYLVLVLKQFLLQRDLNEVFTGGIGSYSLFLMAVSFLQLHPREDACIPNTNYGVLLIEFFELYGRHFNYLKTGIRIKDGGSYVAKDEVQKNMLDGYRPSMLYIEDPLQPGNDVGRSSYGAMQVKQAFDYAYVVLSHAVSPIAKYYPNNETESILGRIIRVTDEVATYRDWISKQWGLKNRPEPSCNGNGVTLIVDTQQLDKCNNNLSEENEALGKCRSKTSESLSKHSSNSSSGPVSSSSATQSSSSDVDSDATPCKTPKQLLCRPSTGNRVGSQDVSLESSQAVGKMQSTQTTNTSNSTNKSQHGSARLFRSSSKGFQGTTQTSHGSLMTNKQHQGKSNNQYYHGTEKTVRAALTIYRGLRGARPSCVSSF

SEQ ID NO: 899855 - protein, 164 aa, Homo sapiens
QVEIAGLNTDLQQEYTRQREHLERNLATLKKKVVKEGELHRTDYVRIMQENVSLIKEINELRRELKFTRSQVYDLEAALKLTKKVRPQEVSETEPSRDMLSTAPTARLNEQEETGRIIEMQRLEIQRLRDQIQEQEQVTGFHTLAGVRLPSLSNSEVDLEVKTN

SEQ ID NO: 899856 - protein, 279 aa, Homo sapiens
MAALGRPFSGLPLSGGSDFLQPPQPAFPGRAFPPGADGAELAPRPGPRAVPSSPAGSAARGRVSVHCKKKHKREEEEDDDCPVRKKRITEAELCAGPNDWILCAHQDVEGHGVNPSVSGLSIPGILDVICEEMDQTTGEPQCEVARRKLQEIEDRIIDEDEEVEADRNVNHLPSLVLSDTMKTGLKREFDEVFTKKMIESMSRPSMELVLWKPLPELLSDKPKPSSNTKNYTGESQAKHVAAGTAFPQRTELFSEPRPTGMSLYNSLETATSTEEEMEL

SEQ ID NO: 899857 - protein, 279 aa, Homo sapiens; identical to SEQ ID NO: 899856

SEQ ID NO: 899858 - protein, 279 aa, Homo sapiens; identical to SEQ ID NO: 899856

SEQ ID NO: 899859 - protein, 279 aa, Homo sapiens; identical to SEQ ID NO: 899856

SEQ ID NO: 899860 - protein, 279 aa, Homo sapiens; identical to SEQ ID NO: 899856

SEQ ID NO: 899861 - protein, 279 aa, Homo sapiens; identical to SEQ ID NO: 899856

SEQ ID NO: 899862 - protein, 1829 aa, Homo sapiens
MREFGVGVVGVRCVEMDCRKQAAALRGAARRRVRLAAGPDQMQPGPGRAAPRACGPGASSGPGKLSTYIRLYGRKFSKEDHVLFIKLLYELVSIPKLEISMMQGFARLLINLLKKKELLSRADLELPWRPLYDMVERILYSKTEHLGLNWFPNSVENILKTLVKSCRPYFPADATAEMLEEWRPLMCPFDVTMQKAITYFEIFLPTSLPPELHHKGFKLWFDELIGLWVSVQNLPQWEGQLVNLFARLATDNIGYIDWDPYVPKIFTRILRSLNLPVGSSQVLVPRFLTNAYDIGHAVIWITAMMGGPSKLVQKHLAGLFNSITSFYHPSNNGRWLNKLMKLLQRLPNSVVRRLHRERYKKPSWLTPVPDSHKLTDQDVTDFVQCIIQPVLLAMFSKTGSLEAAQALQNLALMRPELVIPPVLERTYPALETLTEPHQLTATLSCVIGVARSLVSGGRWFPEGPTHMLPLLMRALPGVDPNDFSKCMITFQFIATFSTLVPLVDCSSVLQERNDLTEVERELCSATAEFEDFVLQFMDRCFGLIESSTLEQTREETETEKMTHLESLVELGLSSTFSTILTQCSKEIFMVALQKVFNFSTSHIFETRVAGRMVADMCRAAVKCCPEESLKLFVPHCCSVITQLTMNDDVLNDEELDKELLWNLQLLSEITRVDGRKLLLYREQLVKILQRTLHLTCKQGYTLSCNLLHHLLRSTTLIYPTEYCSVPGGFDKPPSEYFPIKDWGKPGDLWNLGIQWHVPSSEEVSFAFYLLDSFLQPELVKLQHCGDGKLEMSRDDILQSLTIVHNCLIGSGNLLPPLKGEPVTNLVPSMVSLEETKLYTGLEYDLSRENHREVIATVIRKLLNHILDNSEDDTKSLFLIIKIIGDLLQFQGSHKHEFDSRWKSFNLVKKSMENRLHGKKQHIRALLIDRVMLQHELRTLTVEGCEYKKIHQDMIRDLLRLSTSSYSQVRNKAQQTFFAALGAYNFCCRDIIPLVLEFLRPDRQGVTQQQFKGALYCLLGNHSGVCLANLHDWDCIVQTWPAIVSSGLSQAMSLEKPSIVRLFDDLAEKIHRQYETIGLDFTIPKSCVEIAELLQQSKNPSINQILLSPEKIKEGIKRQQEKNADALRNYENLVDTLLDGVEQRNLPWKFEHIGIGLLSLLLRDDRVLPLRAIRFFVENLNHDAIVVRKMAISAVAGILKQLKRTHKKLTINPCEISGCPKPTQIIAGDRPDNHWLHYDSKTIPRTKKEWESSCFVEKTHWGYYTWPKNMVVYAGVEEQPKLGRSREDMTEAEQIIFDHFSDPKFVEQLITFLSLEDRKGKDKFNPRRFCLFKGIFRNFDDAFLPVLKPHLEHLVADSHESTQRCVAEIIAGLIRGSKHWTFEKVEKLWELLCPLLRTALSNITVETYNDWGACIATSCESRDPRKLHWLFELLLESPLSGEGGSFVDACRLYVLQGGLAQQEWRVPELLHRLLKYLEPKLTQVYKNVRERIGSVLTYIFMIDVSLPNTTPTISPHVPEFTARILEKLKPLMDVDEEIQNHVMEENGIGEEDERTQGIKLLKTILKWLMASAGRSFSTAVTEQLQLLPLFFKIAPVENDNSYDELKRDAKLCLSLMSQGLLYPHQVPLVLQVLKQTARSSSWHARYTVLTYLQTMVFYNLFIFLNNEDAVKDIRWLVISLLEDEQLEVREMAATTLSGLLQCNFLTMDSPMQIHFEQLCKTKLPKKRKRDPGSVGDTIPSAELVKRHAGVLGLGACVLSSPYDVPTWMPQLLMNLSAHLNDPQPIEMTVKKTLSNFRRTHHDNWQEHKQQFTDDQLLVLTDLLVSPCYYA

SEQ ID NO: 899863 - protein, 1895 aa, Homo sapiens
MVALCPEGWSLSICPRRSCPRAGDPSGRDRACEVLNAVLPATFLRDFPGLYHPSTSLPREIGEPPEPGGRPEPGPRGFVPQKEIVYNKLLPYAERLDAESDLQLAQIKCNLGRAVQLQELWPGGLFWTRKLSTYIRLYGRKFSKEDHVLFIKLLYELVSIPKLEISMMQGFARLLINLLKKKELLSRADLELPWRPLYDMVERILYSKTEHLGLNWFPNSVENILKTLVKSCRPYFPADATAEMLEEWRPLMCPFDVTMQKAITYFEIFLPTSLPPELHHKGFKLWFDELIGLWVSVQNLPQWEGQLVNLFARLATDNIGYIDWDPYVPKIFTRILRSLNLPVGSSQVLVPRFLTNAYDIGHAVIWITAMMGGPSKLVQKHLAGLFNSITSFYHPSNNGRWLNKLMKLLQRLPNSVVRRLHRERYKKPSWLTPVPDSHKLTDQDVTDFVQCIIQPVLLAMFSKTGSLEAAQALQNLALMRPELVIPPVLERTYPALETLTEPHQLTATLSCVIGVARSLVSGGRWFPEGPTHMLPLLMRALPGVDPNDFSKCMITFQFIATFSTLVPLVDCSSVLQERNDLTEVERELCSATAEFEDFVLQFMDRCFGLIESSTLEQTREETETEKMTHLESLVELGLSSTFSTILTQCSKEIFMVALQKVFNFSTSHIFETRVAGRMVADMCRAAVKCCPEESLKLFVPHCCSVITQLTMNDDVLNDEELDKELLWNLQLLSEITRVDGRKLLLYREQLVKILQRTLHLTCKQGYTLSCNLLHHLLRSTTLIYPTEYCSVPGGFDKPPSEYFPIKDWGKPGDLWNLGIQWHVPSSEEVSFAFYLLDSFLQPELVKLQHCGDGKLEMSRDDILQSLTIVHNCLIGSGNLLPPLKGEPVTNLVPSMVSLEETKLYTGLEYDLSRENHREVIATVIRKLLNHILDNSEDDTKSLFLIIKIIGDLLQFQGSHKHEFDSRWKSFNLVKKSMENRLHGKKQHIRALLIDRVMLQHELRTLTVEGCEYKKIHQDMIRDLLRLSTSSYSQVRNKAQQTFFAALGAYNFCCRDIIPLVLEFLRPDRQGVTQQQFKGALYCLLGNHSGVCLANLHDWDCIVQTWPAIVSSGLSQAMSLEKPSIVRLFDDLAEKIHRQYETIGLDFTIPKSCVEIAELLQQSKNPSINQILLSPEKIKEGIKRQQEKNADALRNYENLVDTLLDGVEQRNLPWKFEHIGIGLLSLLLRDDRVLPLRAIRFFVENLNHDAIVVRKMAISAVAGILKQLKRTHKKLTINPCEISGCPKPTQIIAGDRPDNHWLHYDSKTIPRTKKEWESSCFVEKTHWGYYTWPKNMVVYAGVEEQPKLGRSREDMTEAEQIIFDHFSDPKFVEQLITFLSLEDRKGKDKFNPRRFCLFKGIFRNFDDAFLPVLKPHLEHLVADSHESTQRCVAEIIAGLIRGSKHWTFEKVEKLWELLCPLLRTALSNITVETYNDWGACIATSCESRDPRKLHWLFELLLESPLSGEGGSFVDACRLYVLQGGLAQQEWRVPELLHRLLKYLEPKLTQVYKNVRERIGSVLTYIFMIDVSLPNTTPTISPHVPEFTARILEKLKPLMDVDEEIQNHVMEENGIGEEDERTQGIKLLKTILKWLMASAGRSFSTAVTEQLQLLPLFFKIAPVENDNSYDELKRDAKLCLSLMSQGLLYPHQVPLVLQVLKQTARSSSWHARYTVLTYLQTMVFYNLFIFLNNEDAVKDIRWLVISLLEDEQLEVREMAATTLSGLLQCNFLTMDSPMQIHFEQLCKTKLPKKRKRDPGSVGDTIPSAELVKRHAGVLGLGACVLSSPYDVPTWMPQLLMNLSAHLNDPQPIEMTVKKTLSNFRRTHHDNWQEHKQQFTDDQLLVLTDLLVSPCYYA

SEQ ID NO: 899864 - protein, 1039 aa, Homo sapiens [sequence omitted]

SEQ ID NO: 899865 - protein, 1642 aa, Homo sapiens
MREFGVGVVGVRCVEMDCRKQAAALRGAARRRVRLAAGPDQMQPGPGRAAPRACGPGASSGPGKLSTYIRLYGRKFSKEDHVLFIKLLYELVSIPKLEISMMQGFARLLINLLKKKELLSRADLELPWRPLYDMVERILYSKTEHLGLNWFPNSVENILKTLVKSCRPYFPADATAEMLEEWRPLMCPFDVTMQKAITYFEIFLPTSLPPELHHKGFKLWFDELIGLWVSVQNLPQWEGQLVNLFARLATDNIGYIDWDPYVPKIFTRILRSLNLPVGSSQVLVPRFLTNAYDIGHAVIWITAMMGGPSKLVQKHLAGLFNSITSFYHPSNNGRWLNKLMKLLQRLPNSVVRRLHRERYKKPSWLTPVPDSHKLTDQDVTDFVQCIIQPVLLAMFSKTGSLEAAQALQNLALMRPELVIPPVLERTYPALETLTEPHQLTATLSCVIGVARSLVSGGRWFPEGPTHMLPLLMRALPGVDPNDFSKCMITFQFIATFSTLVPLVDCSSVLQERNDLTEVERELCSATAEFEDFVLQFMDRCFGLIESSTLEQTREETETEKMTHLESLVELGLSSTFSTILTQCSKEIFMVALQKVFNFSTSHIFETRVAGRMVADMCRAAVKCCPEESLKLFVPHCCSVITQLTMNDDVLNDEELDKELLWNLQLLSEITRVDGRKLLLYREQLVKILQRTLHLTCKQGYTLSCNLLHHLLRSTTLIYPTEYCSVPGGFDKPPSEYFPIKDWGKPGDLWNLGIQWHVPSSEEVSFAFYLLDSFLQPELVKLQHCGDGKLEMSRDDILQSLTIVHNCLIGSGNLLPPLKGEPVTNLVPSMVSLEETKLYTGLEYDLSRENHREVIATVIRKLLNHILDNSEDDTKSLFLIIKIIGDLLQFQGSHKHEFDSRWKSFNLVKKSMENRLHGKKQHIRALLIDRVMLQHELRTLTVEGCEYKKIHQDMIRDLLRLSTSSYSQVRNKAQQTFFAALGAYNFCCRDIIPLVLEFLRPDRQGVTQQQFKGALYCLLGNHSGVCLANLHDWDCIVQTWPAIVSSGLSQAMSLEKPSIVRLFDDLAEKIHRQYETIGLDFTIPKSCVEIAELLQQSKNPSINQILLSPEKIKEGIKRQQEKNADALRNYENLVDTLLDGVEQRNLPWKFEHIGIGLLSLLLRDDRVLPLRAIRFFVENLNHDAIVVRKMAISAVAGILKQLKRTHKKLTINPCEISGCPKPTQIIAGDRPDNHWLHYDSKTIPRTKKEWESSCFVEKTHWGYYTWPKNMVVYAGVEEQPKLGRSREDMTEAEQIIFDHFSDPKFVEQLITFLSLEDRKGKDKFNPRRFCLFKGIFRNFDDAFLPVLKPHLEHLVADSHESTQRCVAEIIAGLIRGSKHWTFEKVEKLWELLCPLLRTALSNITVETYNDWGACIATSCESRDPRKLHWLFELLLESPLSGEGGSFVDACRLYVLQGGLAQQEWRVPELLHRLLKYLEPKLTQVYKNVRERIGSVLTYIFMIDVSLPNTTPTISPHVPEFTARILEKLKPLMDVDEEIQNHVMEENGIGEEDERTQGIKLLKTILKWLMASAGRSFSTAVTEQLQLLPLFFKIAPVENDNSYDELKRDAKLCLSLMSQGLLYPHQVPLVLQVLKQLPPDHGIL

SEQ ID NO: 899866 - protein, 1829 aa, Homo sapiens; identical to SEQ ID NO: 899862

SEQ ID NO: 899867 - protein, 281 aa, Homo sapiens
MNGKDLLCIFVFKIVLKWLMASAGRSFSTAVTEQLQLLPLFFKIAPVENDNSYDELKRDAKLCLSLMSQGLLYPHQVPLVLQVLKQTARSSSWHARYTVLTYLQTMVFYNLFIFLNNEDAVKDIRWLVISLLEDEQLEVREMAATTLSGLLQCNFLTMDSPMQIHFEQLCKTKLPKKRKRDPGSVGDTIPSAELVKRHAGVLGLGACVLSSPYDVPTWMPQLLMNLSAHLNDPQPIEMTVKKTLSNFRRTHHDNWQEHKQQFTDDQLLVLTDLLVSPCYYA

SEQ ID NO: 899868 - protein, 215 aa, Homo sapiens
MSQGLLYPHQVPLVLQVLKQTARSSSWHARYTVLTYLQTMVFYNLFIFLNNEDAVKDIRWLVISLLEDEQLEVREMAATTLSGLLQCNFLTMDSPMQIHFEQLCKTKLPKKRKRDPGSVGDTIPSAELVKRHAGVLGLGACVLSSPYDVPTWMPQLLMNLSAHLNDPQPIEMTVKKTLSNFRRTHHDNWQEHKQQFTDDQLLVLTDLLVSPCYYA

SEQ ID NO: 899869 - protein, 1691 aa, Homo sapiens
MREFGVGVVGVRCVEMDCRKQAAALRGAARRRVRLAAGPDQMQPGPGRAAPRACGPGASSGPGKLSTYIRLYGRKFSKEDHVLFIKLLYELVSIPKLEISMMQGFARLLINLLKKKELLSRADLELPWRPLYDMVERILYSKTEHLGLNWFPNSVENILKTLVKSCRPYFPADATAEMLEEWRPLMCPFDVTMQKAITYFEIFLPTSLPPELHHKGFKLWFDELIGLWVSVQNLPQWEGQLVNLFARLATDNIGYIDWDPYVPKIFTRILRSLNLPVGSSQVLVPRFLTNAYDIGHAVIWITAMMGGPSKLVQKHLAGLFNSITSFYHPSNNGRWLNKLMKLLQRLPNSVVRRLHRERYKKPSWLTPVPDSHKLTDQDVTDFVQCIIQPVLLAMFSKTGSLEAAQALQNLALMRPELVIPPVLERTYPALETLTEPHQLTATLSCVIGVARSLVSGGRWFPEGPTHMLPLLMRALPGVDPNDFSKCMITFQFIATFSTLVPLVDCSSVLQERNDLTEVERELCSATAEFEDFVLQFMDRCFGLIESSTLEQTREETETEKMTHLESLVELGLSSTFSTILTQCSKEIFMVALQKVFNFSTSHIFETRVAGRMVADMCRAAVKCCPEESLKLFVPHCCSVITQLTMNDDVLNDEELDKELLWNLQLLSEITRVDGRKLLLYREQLVKILQRTLHLTCKQGYTLSCNLLHHLLRSTTLIYPTEYCSVPGGFDKPPSEYFPIKDWGKPGDLWNLGIQWHVPSSEEVSFAFYLLDSFLQPELVKLQHCGDGKLEMSRDDILQSLTIVHNCLIGSGNLLPPLKGEPVTNLVPSMVSLEETKLYTGLEYDLSRENHREVIATVIRKLLNHILDNSEDDTKSLFLIIKIIGDLLQFQGSHKHEFDSRWKSFNLVKKSMENRLHGKKQHIRALLIDRVMLQHELRTLTVEGCEYKKIHQDMIRDLLRLSTSSYSQVRNKAQQTFFAALGAYNFCCRDIIPLVLEFLRPDRQGVTQQQFKGALYCLLGNHSGVCLANLHDWDCIVQTWPAIVSSGLSQAMSLEKPSIVRLFDDLAEKIHRQYETIGLDFTIPKSCVEIAELLQQSKNPSINQILLSPEKIKEGIKRQQEKNADALRNYENLVDTLLDGVEQRNLPWKFEHIGIGLLSLLLRDDRVLPLRAIRFFVENLNHDAIVVRKMAISAVAGILKQLKRTHKKLTINPCEISGCPKPTQIIAGDRPDNHWLHYDSKTIPRTKKEWESSCFVEKTHWGYYTWPKNMVVYAGVEEQPKLGRSREDMTEAEQIIFDHFSDPKFVEQLITFLSLEDRKGKDKFNPRRFCLFKGIFRNFDDAFLPVLKPHLEHLVADSHESTQRCVAEIIAGLIRGSKHWTFEKVEKLWELLCPLLRTALSNITVETYNDWGACIATSCESRDPRKLHWLFELLLESPLSGEGGSFVDACRLYVLQGGLAQQEWRVPELLHRLLKYLEPKLTQVYKNVRERIGSVLTYIFMIDVSLPNTTPTISPHVPEFTARILEKLKPLMDVDEEIQNHVMEENGIGEEDERTQGIKLLKTILKWLMASAGRSFSTAVTEQLQLLPLFFKIAPVENDNSYDELKRDAKLCLSLMSQGLLYPHQVPLVLQVLKQTARSSSWHARYTVLTYLQTMVFYNLFIFLNNEDAVKDIRWLVISLLEDEQLEVKFKL

SEQ ID NO: 899870 - protein, 1333 aa, Homo sapiens
MREFGVGVVGVRCVEMDCRKQAAALRGAARRRVRLAAGPDQMQPGPGRAAPRACGPGASSGPGKLSTYIRLYGRKFSKEDHVLFIKLLYELVSIPKLEISMMQGFARLLINLLKKKELLSRADLELPWRPLYDMVERILYSKTEHLGLNWFPNSVENILKTLVKSCRPYFPADATAEMLEEWRPLMCPFDVTMQKAITYFEIFLPTSLPPELHHKGFKLWFDELIGLWVSVQNLPQWEGQLVNLFARLATDNIGYIDWDPYVPKIFTRILRSLNLPVGSSQVLVPRFLTNAYDIGHAVIWITAMMGGPSKLVQKHLAGLFNSITSFYHPSNNGRWLNKLMKLLQRLPNSVVRRLHRERYKKPSWLTPVPDSHKLTDQDVTDFVQCIIQPVLLAMFSKTGSLEAAQALQNLALMRPELVIPPVLERTYPALETLTEPHQLTATLSCVIGVARSLVSGGRWFPEGPTHMLPLLMRALPGVDPNDFSKCMITFQFIATFSTLVPLVDCSSVLQERNDLTEVERELCSATAEFEDFVLQFMDRCFGLIESSTLEQTREETETEKMTHLESLVELGLSSTFSTILTQCSKEIFMVALQKVFNFSTSHIFETRVAGRMVADMCRAAVKCCPEESLKLFVPHCCSVITQLTMNDDVLNDEELDKELLWNLQLLSEITRVDGRKLLLYREQLVKILQRTLHLTCKQGYTLSCNLLHHLLRSTTLIYPTEYCSVPGGFDKPPSEYFPIKDWGKPGDLWNLGIQWHVPSSEEVSFAFYLLDSFLQPELVKLQHCGDGKLEMSRDDILQSLTIVHNCLIGSGNLLPPLKGEPVTNLVPSMVSLEETKLYTGLEYDLSRENHREVIATVIRKLLNHILDNSEDDTKSLFLIIKIIGDLLQFQGSHKHEFDSRWKSFNLVKKSMENRLHGKKQHIRALLIDRVMLQHELRTLTVEGCEYKKIHQDMIRDLLRLSTSSYSQVRNKAQQTFFAALGAYNFCCRDIIPLVLEFLRPDRQGVTQQQFKGALYCLLGNHSGVCLANLHDWDCIVQTWPAIVSSGLSQAMSLEKPSIVRLFDDLAEKIHRQYETIGLDFTIPKSCVEIAELLQQSKNPSINQILLSPEKIKEGIKRQQEKNADALRNYENLVDTLLDGVEQRNLPWKFEHIGIGLLSLLLRDDRVLPLRAIRFFVENLNHDAIVVRKMAISAVAGILKQLKRTHKKLTINPCEISGCPKPTQIIAGDRPDNHWLHYDSKTIPRTKKEWESSCFVEKTHWGYYTWPKNMVVYAGVEEQPKLGRSREDMTEVSIPFHHGSNASCFGPLIYLNLTSVLLLLFFLNTICVFLYSTA

SEQ ID NO: 899871 - protein, 163 aa, Homo sapiens
MVAFVQRAGPLALSSLELSRAGDPSGRDRACEVLNAVLPATFLRDFPGLYHPSTSLPRESRRAPGAGRASRAGPAGLRPAEGDRLQQAAALRGAARRRVRLAAGPDQMQPGPGRAAPRAVARGPLLDQETLHVSVPGPAGRAGGKGSVRGVGDGCSLSRGLDP

SEQ ID NO: 899872 - protein, 67 aa, Homo sapiens
QVVAFLLISPHVPEFTARILEKLKPLMDVDEEIQNHVMEENGIGEEDERTQGIKLLKTSEWIKLVEP

SEQ ID NO: 899873 - protein, 2046 aa, Homo sapiens
MVAFVQRAGPLALSSLELSRAGDPSGRDRACEVLNAVLPATFLRDFPGLYHPSTSLPRESRRAPGAGRASRAGPAGLRPAEGDRLQQAAALRGAARRRVRLAAGPDQMQPGPGRAAPRAVARGPLLDQETLHVKCARACGPGRGERLSERCRGWLLFVQRAGPLALSSLELSPSGDPRVVTEPVKYSSRPPCHFPTGLPGSLPSLYVLPRGSWRARGTEREFGVGVVGVRCVEMDAVNKLLPYAERLDAESDLQLAQIKCNLGRAVQLQELWPGGLFWTRKLSTYIRLYGRKFSKEDHVLFIKLLYELVSIPKLEISMMQGFARLLINLLKKKELLSRADLELPWRPLYDMVERILYSKTEHLGLNWFPNSVENILKTLVKSCRPYFPADATAEMLEEWRPLMCPFDVTMQKAITYFEIFLPTSLPPELHHKGFKLWFDELIGLWVSVQNLPQWEGQLVNLFARLATDNIGYIDWDPYVPKIFTRILRSLNLPVGSSQVLVPRFLTNAYDIGHAVIWITAMMGGPSKLVQKHLAGLFNSITSFYHPSNNGRWLNKLMKLLQRLPNSVVRRLHRERYKKPSWLTPVPDSHKLTDQDVTDFVQCIIQPVLLAMFSKTGSLEAAQALQNLALMRPELVIPPVLERTYPALETLTEPHQLTATLSCVIGVARSLVSGGRWFPEGPTHMLPLLMRALPGVDPNDFSKCMITFQFIATFSTLVPLVDCSSVLQERNDLTEVERELCSATAEFEDFVLQFMDRCFGLIESSTLEQTREETETEKMTHLESLVELGLSSTFSTILTQCSKEIFMVALQKVFNFSTSHIFETRVAGRMVADMCRAAVKCCPEESLKLFVPHCCSVITQLTMNDDVLNDEELDKELLWNLQLLSEITRVDGRKLLLYREQLVKILQRTLHLTCKQGYTLSCNLLHHLLRSTTLIYPTEYCSVPGGFDKPPSEYFPIKDWGKPGDLWNLGIQWHVPSSEEVSFAFYLLDSFLQPELVKLQHCGDGKLEMSRDDILQSLTIVHNCLIGSGNLLPPLKGEPVTNLVPSMVSLEETKLYTGLEYDLSRENHREVIATVIRKLLNHILDNSEDDTKSLFLIIKIIGDLLQFQGSHKHEFDSRWKSFNLVKKSMENRLHGKKQHIRALLIDRVMLQHELRTLTVEGCEYKKIHQDMIRDLLRLSTSSYSQVRNKAQQTFFAALGAYNFCCRDIIPLVLEFLRPDRQGVTQQQFKGALYCLLGNHSGVCLANLHDWDCIVQTWPAIVSSGLSQAMSLEKPSIVRLFDDLAEKIHRQYETIGLDFTIPKSCVEIAELLQQSKNPSINQILLSPEKIKEGIKRQQEKNADALRNYENLVDTLLDGVEQRNLPWKFEHIGIGLLSLLLRDDRVLPLRAIRFFVENLNHDAIVVRKMAISAVAGILKQLKRTHKKLTINPCEISGCPKPTQIIAGDRPDNHWLHYDSKTIPRTKKEWESSCFVEKTHWGYYTWPKNMVVYAGVEEQPKLGRSREDMTEAEQIIFDHFSDPKFVEQLITFLSLEDRKGKDKFNPRRFCLFKGIFRNFDDAFLPVLKPHLEHLVADSHESTQRCVAEIIAGLIRGSKHWTFEKVEKLWELLCPLLRTALSNITVETYNDWGACIATSCESRDPRKLHWLFELLLESPLSGEGGSFVDACRLYVLQGGLAQQEWRVPELLHRLLKYLEPKLTQVYKNVRERIGSVLTYIFMIDVSLPNTTPTISPHVPEFTARILEKLKPLMDVDEEIQNHVMEENGIGEEDERTQGIKLLKTILKWLMASAGRSFSTAVTEQLQLLPLFFKIAPVENDNSYDELKRDAKLCLSLMSQGLLYPHQVPLVLQVLKQTARSSSWHARYTVLTYLQTMVFYNLFIFLNNEDAVKDIRWLVISLLEDEQLEVREMAATTLSGLLQCNFLTMDSPMQIHFEQLCKTKLPKKRKRDPGSVGDTIPSAELVKRHAGVLGLGACVLSSPYDVPTWMPQLLMNLSAHLNDPQPIEMTVKKTLSNFRRTHHDNWQEHKQQFTDDQLLVLTDLLVSPCYYA

SEQ ID NO: 899874 - protein, 1459 aa, Homo sapiens
MREFGVGVVGVRCVEMDCRKQAAALRGAARRRVRLAAGPDQMQPGPGRAAPRACGPGASSGPGKLSTYIRLYGRKFSKEDHVLFIKLLYELVSIPKLEISMMQGFARLLINLLKKKELLSRADLELPWRPLYDMVERILYSKTEHLGLNWFPNSVENILKTLVKSCRPYFPADATAEMLEEWRPLMCPFDVTMQKAITYFEIFLPTSLPPELHHKGFKLWFDELIGLWVSVQNLPQWEGQLVNLFARLATDNIGYIDWDPYVPKIFTRILRSLNLPVGSSQVLVPRFLTNAYDIGHAVIWITAMMGGPSKLVQKHLAGLFNSITSFYHPSNNGRWLNKLMKLLQRLPNSVVRRLHRERYKKPSWLTPVPDSHKLTDQDVTDFVQCIIQPVLLAMFSKTGSLEAAQALQNLALMRPELVIPPVLERTYPALETLTEPHQLTATLSCVIGVARSLVSGGRWFPEGPTHMLPLLMRALPGVDPNDFSKCMITFQFIATFSTLVPLVDCSSVLQERNDLTEVERELCSATAEFEDFVLQFMDRCFGLIESSTLEQTREETETEKMTHLESLVELGLSSTFSTILTQCSKEIFMVALQKVFNFSTSHIFETRVAGRMVADMCRAAVKCCPEESLKLFVPHCCSVITQLTMNDDVLNDEELDKELLWNLQLLSEITRVDGRKLLLYREQLVKILQRTLHLTCKQGYTLSCNLLHHLLRSTTLIYPTEYCSVPGGFDKPPSEYFPIKDWGKPGDLWNLGIQWHVPSSEEVSFAFYLLDSFLQPELVKLQHCGDGKLEMSRDDILQSLTIVHNCLIGSGNLLPPLKGEPVTNLVPSMVSLEETKLYTGLEYDLSRENHREVIATVIRKLLNHILDNSEDDTKSLFLIIKIIGDLLQFQGSHKHEFDSRWKSFNLVKKSMENRLHGKKQHIRALLIDRVMLQHELRTLTVEGCEYKKIHQDMIRDLLRLSTSSYSQVRNKAQQTFFAALGAYNFCCRDIIPLVLEFLRPDRQGVTQQQFKGALYCLLGNHSGVCLANLHDWDCIVQTWPAIVSSGLSQAMSLEKPSIVRLFDDLAEKIHRQYETIGLDFTIPKSCVEIAELLQQSKNPSINQILLSPEKIKEGIKRQQEKNADALRNYENLVDTLLDGVEQRNLPWKFEHIGIGLLSLLLRDDRVLPLRAIRFFVENLNHDAIVVRKMAISAVAGILKQLKRTHKKLTINPCEISGCPKPTQIIAGDRPDNHWLHYDSKTIPRTKKEWESSCFVEKTHWGYYTWPKNMVVYAGVEEQPKLGRSREDMTEAEQIIFDHFSDPKFVEQLITFLSLEDRKGKDKFNPRRFCLFKGIFRNFDDAFLPVLKPHLEHLVADSHESTQRCVAEIIAGLIRGSKHWTFEKVEKLWELLCPLLRTALSNITVETYNDWGACIATSCESRDPRKLHWLFELLLESPLSGEGGSFVDAWWPCPARMESA

SEQ ID NO: 899875 - protein, 1777 aa, Homo sapiens
MREFGVGVVGVRCVEMDCRKQAAALRGAARRRVRLAAGPDQMQPGPGRAAPRACGPGASSGPGKLSTYIRLYGRKFSKEDHVLFIKLLYELVSIPKLEISMMQGFARLLINLLKKKELLSRADLELPWRPLYDMVERILYSKTEHLGLNWFPNSVENILKTLVKSCRPYFPADATAEMLEEWRPLMCPFDVTMQKAITYFEIFLPTSLPPELHHKGFKLWFDELIGLWVSVQNLPQWEGQLVNLFARLATDNIGYIDWDPYVPKIFTRILRSLNLPVGSSQVLVPRFLTNAYDIGHAVIWITAMMGGPSKLVQKHLAGLFNSITSFYHPSNNGRWLNKLMKLLQRLPNSVVRRLHRERYKKPSWLTPVPDSHKLTDQDVTDFVQCIIQPVLLAMFSKTGSLEAAQALQNLALMRPELVIPPVLERTYPALETLTEPHQLTATLSCVIGVARSLVSGGRWFPEGPTHMLPLLMRALPGVDPNDFSKCMITFQFIATFSTLVPLVDCSSVLQERNDLTEVERELCSATAEFEDFVLQFMDRCFGLIESSTLEQTREETETEKMTHLESLVELGLSSTFSTILTQCSKEIFMVALQKVFNFSTSHIFETRVAGRMVADMCRAAVKCCPEESLKLFVPHCCSVITQLTMNDDVLNDEELDKELLWNLQLLSEITRVDGRKLLLYREQLVKILQRTLHLTCKQGYTLSCNLLHHLLRSTTLIYPTEYCSVPGGFDKPPSEYFPIKDWGKPGDLWNLGIQWHVPSSEEVSFAFYLLDSFLQPELVKLQHCGDGKLEMSRDDILQSLTIVHNCLIGSGNLLPPLKGEPVTNLVPSMVSLEETKLYTGLEYDLSRENHREVIATVIRKLLNHILDNSEDDTKSLFLIIKIIGDLLQFQGSHKHEFDSRWKSFNLVKKSMENRLHGKKQHIRALLIDRVMLQHELRTLTVEGCEYKKIHQDMIRDLLRLSTSSYSQVRNKAQQTFFAALGAYNFCCRDIIPLVLEFLRPDRQGVTQQQFKGALYCLLGNHSGVCLANLHDWDCIVQTWPAIVSSGLSQAMSLEKPSIVRLFDDLAEKIHRQYETIGLDFTIPKSCVEIAELLQQSKNPSINQILLSPEKIKEGIKRQQEKNADALRNYENLVDTLLDGVEQRNLPWKFEHIGIGLLSLLLRDDRVLPLRAIRFFVENLNHDAIVVRKMAISAVAGILKQLKRTHKKLTINPCEISGCPKPTQIIAGDRPDNHWLHYDSKTIPRTKKEWESSCFVEKTHWGYYTWPKNMVVYAGVEEQPKLGRSREDMTEAEQIIFDHFSDPKFVEQLITFLSLEDRKGKDKFNPRRFCLFKGIFRNFDDAFLPVLKPHLEHLVADSHESTQRCVAEIIAGLIRGSKHWTFEKVEKLWELLCPLLRTALSNITVETYNDWGACIATSCESRDPRKLHWLFELLLESPLSGEGGSFVDACRLYVLQGGLAQQEWRVPELLHRLLKYLEPKLTQVYKNVRERIGSVLTYIFMIDVSLPNTTPTISPHVPEFTARILEKLKPLMDVDEEIQNHVMEENGIGEEDERTQGIKLLKTILKWLMASAGRSFSTAVTEQLQLLPLFFKIAPVENDNSYDELKRDAKLCLSLMSQGLLYPHQVPLVLQVLKQVREMAATTLSGLLQCNFLTMDSPMQIHFEQLCKTKLPKKRKRDPGSVGDTIPSAELVKRHAGVLGLGACVLSSPYDVPTWMPQLLMNLSAHLNDPQPIEMTVKKTLSNFRRTHHDNWQEHKQQFTDDQLLVLTDLLVSPCYYA

SEQ ID NO: 899876 - protein, 1811 aa, Homo sapiens
MREFGVGVVGVRCVEMDCRKQAAALRGAARRRVRLAAGPDQMQPGPGRAAPRACGPGASSGPGKLSTYIRLYGRKFSKEDHVLFIKLLYELVSIPKLEISMMQGFARLLINLLKKKELLSRADLELPWRPLYDMVERILYSKTEHLGLNWFPNSVENILKTLVKSCRPYFPADATAEMLEEWRPLMCPFDVTMQKAITYFEIFLPTSLPPELHHKGFKLWFDELIGLWVSVQNLPQWEGQLVNLFARLATDNIGYIDWDPYVPKIFTRILRSLNLPVGSSQVLVPRFLTNAYDIGHAVIWITAMMGGPSKLVQKHLAGLFNSITSFYHPSNNGRWLNKLMKLLQRLPNSVVRRLHRERYKKPSWLTPVPDSHKLTDQDVTDFVQCIIQPVLLAMFSKTGSLEAAQALQNLALMRPELVIPPVLERTYPALETLTEPHQLTATLSCVIGVARSLVSGGRWFPEGPTHMLPLLMRALPGVDPNDFSKCMITFQFIATFSTLVPLVDCSSVLQERNDLTEVERELCSATAEFEDFVLQFMDRCFGLIESSTLEQTREETETEKMTHLESLVELGLSSTFSTILTQCSKEIFMVALQKVFNFSTSHIFETRVAGRMVADMCRAAVKCCPEESLKLFVPHCCSVITQLTMNDDVLNDEELDKELLWNLQLLSEITRVDGRKLLLYREQLVKILQRTLHLTCKQGYTLSCNLLHHLLRSTTLIYPTEYCSVPGGFDKPPSEYFPIKDWGKPGDLWNLGIQWHVPSSEEVSFAFYLLDSFLQPELVKLQHCGDGKLEMSRDDILQSLTIVHNCLIGSGNLLPPLKGEPVTNLVPSMVSLEETKLYTGLEYDLSRENHREVIATVIRKLLNHILDNSEDDTKSLFLIIKIIGDLLQFQGSHKHEFDSRWKSFNLVKKSMENRLHGKKQHIRALLIDRVMLQHELRTLTVEGCEYKKIHQDMIRDLLRLSTSSYSQVRNKAQQTFFAALGAYNFCCRDIIPLVLEFLRPDRQGVTQQQFKGALYCLLGNHSGVCLANLHDWDCIVQTWPAIVSSGLSQAMSLEKPSIVRLFDDLAEKIHRQYETIGLDFTIPKSCVEIAELLQQSKNPSINQILLSPEKIKEGIKRQQEKNADALRNYENLVDTLLDGVEQRNLPWKFEHIGIGLLSLLLRDDRVLPLRAIRFFVENLNHDAIVVRKMAISAVAGILKQLKRTHKKLTINPCEISGCPKPTQIIAGDRPDNHWLHYDSKTIPRTKKEWESSCFVEKTHWGYYTWPKNMVVYAGVEEQPKLGRSREDMTEAEQIIFDHFSDPKFVEQLITFLSLEDRKGKDKFNPRRFCLFKGIFRNFDDAFLPVLKPHLEHLVADSHESTQRCVAEIIAGLIRGSKHWTFEKVEKLWELLCPLLRTALSNITVETYNDWGACIATSCESRDPRKLHWLFELLLESPLSGEGGSFVDACRLYVLQGGLAQQEWRVPELLHRLLKYLEPKLTQVYKNVRERIGSVLTYIFMIDVSLPNTTPTISPHVPEFTARILEKLKPLMDVDEEIQNHVMEENGIGEEDERTQGIKLLKTILKWLMASAGRSFSTAVTEQLQLLPLFFKIAPVENDNSYDELKRDAKLCLSLMSQGLLYPHQVPLVLQVLKQTARSSSWHARYTVLTYLQTMVFYNLFIFLNNEDAVKDIRWLVISLLEDEQLEVREMAATTLSGLLQCNFLTMDSPMQIHFEQLCKTKLQLVKRHAGVLGLGACVLSSPYDVPTWMPQLLMNLSAHLNDPQPIEMTVKKTLSNFRRTHHDNWQEHKQQFTDDQLLVLTDLLVSPCYYA

SEQ ID NO: 899877 - protein, 200 aa, Homo sapiens
KVYTLNEDRQWDDRGTGHVSSTYVEELKGMSLLVRAESDGSLLLESKINPNTAYQKQVREMAATTLSGLLQCNFLTMDSPMQIHFEQLCKTKLPKKRKRDPGSVGDTIPSAELVKRHAGVLGLGACVLSSPYDVPTWMPQLLMNLSAHLNDPQPIEMTVKKTLSNFRRTHHDNWQEHKQQFTDDQLLVLTDLLVSPCYYA

SEQ ID NO: 899878 - protein, 1712 aa, Homo sapiens
MREFGVGVVGVRCVEMDCRKQAAALRGAARRRVRLAAGPDQMQPGPGRAAPRACGPGASSGPGKLSTYIRLYGRKFSKEDHVLFIKLLYELVSIPKLEISMMQGFARLLINLLKKKELLSRADLELPWRPLYDMVERILYSKTEHLGLNWFPNSVENILKTLVKSCRPYFPADATAEMLEEWRPLMCPFDVTMQKAITYFEIFLPTSLPPELHHKGFKLWFDELIGLWVSVQNLPQWEGQLVNLFARLATDNIGYIDWDPYVPKIFTRILRSLNLPVGSSQVLVPRFLTNAYDIGHAVIWITAMMGGPSKLVQKHLAGLFNSITSFYHPSNNGRWLNKLMKLLQRLPNSVVRRLHRERYKKPSWLTPVPDSHKLTDQDVTDFVQCIIQPVLLAMFSKTGSLEAAQALQNLALMRPELVIPPVLERTYPALETLTEPHQLTATLSCVIGVARSLVSGGRWFPEGPTHMLPLLMRALPGVDPNDFSKCMITFQFIATFSTLVPLVDCSSVLQERNDLTEVERELCSATAEFEDFVLQFMDRCFGLIESSTLEQTREETETEKMTHLESLVELGLSSTFSTILTQCSKEIFMVALQKVFNFSTSHIFETRVAGRMVADMCRAAVKCCPEESLKLFVPHCCSVITQLTMNDDVLNDEELDKELLWNLQLLSEITRVDGRKLLLYREQLVKILQRTLHLTCKQGYTLSCNLLHHLLRSTTLIYPTEYCSVPGGFDKPPSEYFPIKDWGKPGDLWNLGIQWHVPSSEEVSFAFYLLDSFLQPELVKLQHCGDGKLEMSRDDILQSLTIVHNCLIGSGNLLPPLKGEPVTNLVPSMVSLEETKLYTGLEYDLSRENHREVIATVIRKLLNHILDNSEDDTKSLFLIIKIIGDLLQFQGSHKHEFDSRWKSFNLVKKSMENRLHGKKQHIRALLIDRVMLQHELRTLTVEGCEYKKIHQDMIRDLLRLSTSSYSQVRNKAQQTFFAALGAYNFCCRDIIPLVLEFLRPDRQGVTQQQFKGALYCLLGNHSGVCLANLHDWDCIVQTWPAIVSSGLSQAMSLEKPSIVRLFDDLAEKIHRQYETIGLDFTIPKSCVEIAELLQQSKNPSINQILLSPEKIKEGIKRQQEKNADALRNYENLVDTLLDGVEQRNLPWKFEHIGIGLLSLLLRDDRVLPLRAIRFFVENLNHDAIVVRKMAISAVAGILKQLKRTHKKLTINPCEISGCPKPTQIIAGDRPDNHWLHYDSKTIPRTKKEWESSCFVEKTHWGYYTWPKNMVVYAGVEEQPKLGRSREDMTEAEQIIFDHFSDPKFVEQLITFLSLEDRKGKDKFNPRRFCLFKGIFRNFDDAFLPVLKPHLEHLVADSHESTQRCVAEIIAGLIRGSKHWTFEKVEKLWELLCPLLRTALSNITVETYNDWGACIATSCESRDPRKLHWLFELLLESPLSGEGGSFVDACRLYVLQGGLAQQEWRVPELLHRLLKYLEPKLTQVYKNVRERIGSVLTYIFMIDVSLPNTTPTISPHVPEFTARILEKLKPLMDVDEEIQNHVMEENGIGEEDERTQGIKLLKTILKWLMASAGRSFSTAVTEQLQLLPLFFKIAPVENDNSYDELKRDAKLCLSLMSQGLLYPHQVPLVLQVLKQTARSSSWHARYTVLTYLQTMVFYNLFIFLNNEDAVKDIRWLVISLLEDEQLEKIYCRPGTEAYACNPSTLGGQGRRIA

SEQ ID NO: 899879 - protein, 919 aa, Homo sapiens
MREFGVGVVGVRCVEMDCRKQAAALRGAARRRVRLAAGPDQMQPGPGRAAPRACGPGASSGPGKLSTYIRLYGRKFSKEDHVLFIKLLYELVSIPKLEISMMQGFARLLINLLKKKELLSRADLELPWRPLYDMVERILYSKTEHLGLNWFPNSVENILKTLVKSCRPYFPADATAEMLEEWRPLMCPFDVTMQKAITYFEIFLPTSLPPELHHKGFKLWFDELIGLWVSVQNLPQWEGQLVNLFARLATDNIGYIDWDPYVPKIFTRILRSLNLPVGSSQVLVPRFLTNAYDIGHAVIWITAMMGGPSKLVQKHLAGLFNSITSFYHPSNNGRWLNKLMKLLQRLPNSVVRRLHRERYKKPSWLTPVPDSHKLTDQDVTDFVQCIIQPVLLAMFSKTGSLEAAQALQNLALMRPELVIPPVLERTYPALETLTEPHQLTATLSCVIGVARSLVSGGRWFPEGPTHMLPLLMRALPGVDPNDFSKCMITFQFIATFSTLVPLVDCSSVLQERNDLTEVERELCSATAEFEDFVLQFMDRCFGLIESSTLEQTREETETEKMTHLESLVELGLSSTFSTILTQCSKEIFMVALQKVFNFSTSHIFETRVAGRMVADMCRAAVKCCPEESLKLFVPHCCSVITQLTMNDDVLNDEELDKELLWNLQLLSEITRVDGRKLLLYREQLVKILQRTLHLTCKQGYTLSCNLLHHLLRSTTLIYPTEYCSVPGGFDKPPSEYFPIKDWGKPGDLWNLGIQWHVPSSEEVSFAFYLLDSFLQPELVKLQHCGDGKLEMSRDDILQSLTIVHNCLIGSGNLLPPLKGEPVTNLVPSMVSLEETKLYTGLEYDLSRENHREVIATVIRKLLNHILDNSEDDTKSLFLIIKIIGDLLQFQGSHKHEFDSRWKSFNLVKKSMENRVSIFT

SEQ ID NO: 899880 - protein, 325 aa, Homo sapiens
MAASCVLLHTGQKMPLIGLGTWKSEPGQVKAAVKYALSVGYRHIDCAAIYGNEPEIGEALKEDVGPGKAVPREELFVTSKLWNTKHHPEDVEPALRKTLADLQLEYLDLYLMHWPYAFERGDNPFPKNADGTICYDSTHYKETWKALEALVAKGLVQALGLSNFNSRQIDDILSVASVRPAVLQVECHPYLAQNELIAHCQARGLEVTAYSPLGSSDRAWRDPDEPVLLEEPVVLALAEKYGRSPAQILLRWQVQRKVICIPKSITPSRILQNIKVFDFTFSPEEMKQLNALNKNWRYIVPMLTVDGKRVPRDAGHPLYPFNDPY

SEQ ID NO: 899881 - protein, 325 aa, Homo sapiens; identical to SEQ ID NO: 899880

SEQ ID NO: 899882 - protein, 325 aa, Homo sapiens; identical to SEQ ID NO: 899880

SEQ ID NO: 899883 - protein, 325 aa, Homo sapiens; identical to SEQ ID NO: 899880

SEQ ID NO: 899884 - protein, 325 aa, Homo sapiens; identical to SEQ ID NO: 899880

SEQ ID NO: 899885 - protein, 283 aa, Homo sapiens
MAASCVLLHTGQKMPLIGLGTWKSEPGQVKAAVKYALSVGYRHIDCAAIYGNEPEIGEALKEDVGPGKAVPREELFVTSKLWNTKHHPEDVEPALRKTLADLQLEYLDLYLMHWPYAFERGDNPFPKNADGTICYDSTHYKETWKALEALVAKGLVQALGLSNFNSRQIDDILSVASVRPAVLQVECHPYLAQNELIAHCQARGLEVTAYSPLGSSDRAWRDPDEPVLLEEPVVLALAEKYGRSPAQILLRYGAVLGRGPWVGRQGLRDFLFQCLGEAEDLAL

SEQ ID NO: 899886 - protein, 214 aa, Homo sapiens
MHWPYAFERGDNPFPKNADGTICYDSTHYKETWKALEALVAKGLVQALGLSNFNSRQIDDILSVASVRPAVLQVECHPYLAQNELIAHCQARGLEVTAYSPLGSSDRAWRDPDEPVLLEEPVVLALAEKYGRSPAQILLRWQVQRKVICIPKSITPSRILQNIKVFDFTFSPEEMKQLNALNKNWRYIVPMLTVDGKRVPRDAGHPLYPFNDPY

SEQ ID NO: 899887 - protein, 210 aa, Homo sapiens
MAASCVLLHTGQKMPLIGLGTWKSEPGQVKAAVKYALSVGYRHIDCAAIYGNEPEIGEALKEDVGPGKAVPREELFVTSKLWNTKHHPEDVEPALRKTLADLQLEYLDLYLMHWPYAFERGDNPFPKNADGTICYDSTHYKETWKALEALVAKGLVQALGLSNFNSRQIDDILSVASVRPAVLQVAGPAESDLHPQKYHSFSNPSEHQGV

SEQ ID NO: 899888 - protein, 302 aa, Homo sapiens
MAASCVLLHTGQKMPLIGLGTWKSEPGQVKAAVKYALSVGYRHIDCAAIYGNEPEIGEALKEDVGPGKAVPREELFVTSKLWNTKHHPEDVEPALRKTLADLQLEYLDLYLMHWPYAFETWKALEALVAKGLVQALGLSNFNSRQIDDILSVASVRPAVLQVECHPYLAQNELIAHCQARGLEVTAYSPLGSSDRAWRDPDEPVLLEEPVVLALAEKYGRSPAQILLRWQVQRKVICIPKSITPSRILQNIKVFDFTFSPEEMKQLNALNKNWRYIVPMLTVDGKRVPRDAGHPLYPFNDPY

SEQ ID NO: 899889 - protein, 214 aa, Homo sapiens; identical to SEQ ID NO: 899886

SEQ ID NO: 899890 - protein, 210 aa, Homo sapiens; identical to SEQ ID NO: 899887

SEQ ID NO: 899891 - protein, 143 aa, Homo sapiens
MPLSGETTPSPRMLMGLYATTPPTTRRLGRLWRHWWLRGWCRRWACPTSTVGRLMTYSVWPPCVQLSCRWQVQRKVICIPKSITPSRILQNIKVFDFTFSPEEMKQLNALNKNWRYIVPMLTVDGKRVPRDAGHPLYPFNDPY

SEQ ID NO: 899892 - protein, 122 aa, Homo sapiens
MHWPYAFERGDNPFPKNADGTICYDSTHYKETWKALEALVAKGLVQALGLSNFNSRQIDDILSVASVRPAVLQVECHPYLAQNELIAHCQARGLEVTAYSPLGSSLIRITPCSRRGREFSSS

SEQ ID NO: 899893 - protein, 129 aa, Homo sapiens
MGLYATTPPTTRRLGRLWRHWWLRGWCRRWACPTSTVGRLMTYSVWPPCVQLSCRWQVQRKVICIPKSITPSRILQNIKVFDFTFSPEEMKQLNALNKNWRYIVPMLTVDGKRVPRDAGHPLYPFNDPY

SEQ ID NO: 899894 - protein, 127 aa, Homo sapiens
GWSRHACLGWAKQAGCHHFMVMGYSLAQVECHPYLAQNELIAHCQARGLEVTAYSPLGSSDRAWRDPDEPVLLEEPVVLALAEKYGRSPAQILLRYGAVLGRGPWVGRQGLRDFLFQCLGEAEDLAL

SEQ ID NO: 899895 - protein, 325 aa, Homo sapiens; identical to SEQ ID NO: 899880

SEQ ID NO: 899896 - protein, 325 aa, Homo sapiens; identical to SEQ ID NO: 899880

SEQ ID NO: 899897 - protein, 325 aa, Homo sapiens; identical to SEQ ID NO: 899880

SEQ ID NO: 899898 - protein, 325 aa, Homo sapiens; identical to SEQ ID NO: 899880

SEQ ID NO: 899899 - protein, 233 aa, Homo sapiens
MAASCVLLHTGQKMPLIGLGTWKSEPGQVKAAVKYALSVGYRHIDCAAIYGNEPEIGEALKEDVGPGKAVPREELFVTSKLWNTKHHPEDVEPALRKTLADLQLEYLDLYLMHWPYAFERGDNPFPKNADGTICYDSTHYKETWKALEALVAKGLVQALGLSNFNSRQIDDILSVASVRPAVLQVECHPYLAQNELIAHCQARGLEVTAYSPLGSSLIRITPCSRRGREFSSS

SEQ ID NO: 899900 - protein, 214 aa, Homo sapiens; identical to SEQ ID NO: 899886

SEQ ID NO: 899901 - protein, 214 aa, Homo sapiens; identical to SEQ ID NO: 899886

SEQ ID NO: 899902 - protein, 164 aa, Homo sapiens
MAASCVLLHTGQKMPLIGLGTWKSEPGQVKAAVKYALSVGYRHIDCAAIYGNEPEIGEALKEDVGPGKAVPREELFVTSKLWNTKHHPEDVEPALRKTLADLQLEYLDLYLMHWPYAFERGDNPFPKNADGTICYDSTHYKETWKALEALVAKGLVQGGRSSGK

SEQ ID NO: 899903 - protein, 119 aa, Homo sapiens
MAASCVLLHTGQKMPLIGLGTWKSEPGQVKAAVKYALSVGYRHIDCAAIYGNEPEIGEALKEDVGPGKAVPREELFVTSKLWNTKHHPEDVEPALRKTLADLQLEYLDLYLMHWPYAFE

SEQ ID NO: 899904 - protein, 129 aa, Homo sapiens
AAAYYYYYCSEFKLLTMYGDDRAWRDPDEPVLLEEPVVLALAEKYGRSPAQILLRWQVQRKVICIPKSITPSRILQNIKVFDFTFSPEEMKQLNALNKNWRYIVPMLTVDGKRVPRDAGHPLYPFNDPY

SEQ ID NO: 899905 - protein, 99 aa, Homo sapiens
PAKGEAGPAPCTAHVASATCLIVPRSSPNPRCGVSDQVPASSTSRIQRWRRYYLPALFSIPFRSFLGRRRRRSTLRVILYARPLPLPPGGTSPSPPDLS

SEQ ID NO: 899906 - protein, 99 aa, Homo sapiens; identical to SEQ ID NO: 899905

SEQ ID NO: 899907 - protein, 443 aa, Homo sapiens
MRRQVMAALVVSGAAEQGGRDGPGRGRAPRGRVANQIPPEILKNPQLQAAIRVLPSNYNFEIPKTIWRIQQAQAKKVALQMPEGLLLFACTIVDILERFTEAEVMVMGDVTYGACCVDDFTARALGADFLVHYGHSCLIPMDTSAQDFRVLYVFVDIRIDTTHLLDSLRLTFPPATALALVSTIQFVSTLQAAAQELKAEYRVSVPQCKPLSPGEILGCTSPRLSKEVEAVVYLGDGRFHLESVMIANPNVPAYRYDPYSKVLSREHYDHQRMQAARQEAIATARSAKSWGLILGTLGRQGSPKILEHLESRLRALGLSFVRLLLSEIFPSKLSLLPEVDVWVQVACPRLSIDWGTAFPKPLLTPYEAAVALRDISWQQPYPMDFYAGSSLGPWTVNHGQDRRPHAPGRPARGKVQEGSARPPSAVACEDCSCRDEKVAPLAP

SEQ ID NO: 899908 - protein, 443 aa, Homo sapiens; identical to SEQ ID NO: 899907

SEQ ID NO: 899909 - protein, 443 aa, Homo sapiens; identical to SEQ ID NO: 899907

SEQ ID NO: 899910 - protein, 443 aa, Homo sapiens; identical to SEQ ID NO: 899907

SEQ ID NO: 899911 - protein, 443 aa, Homo sapiens; identical to SEQ ID NO: 899907

SEQ ID NO: 899912 - protein, 772 aa, Homo sapiens
MRRQVMAALVVSGAAEQGGRDGPGRGRAPRGRVANQIPPEILKNPQLQAAIRVLPSNYNFEIPKTIWRIQQAQAKKVALQMPEGLLLFACTIVDILERFTEAEVMVMGDVTYGACCVDDFTARALGADFLVHYGHSCLIPMDTSAQDFRVLYVFVDIRIDTTHLLDSLRLTFPPATALALAAAQELKAEYRVSVPQCKPLSPGEILGCTSPRLSKEVEAVVYLGDGRFHLESVMIANPNVPAYRYDPYSKVLSREHYDHQRMQAARQEAIATARSAKSWGLILGTLGRQGSPKILEHLESRLRALGLSFVRLLLSEIFPSKLSLLPEVDVWVQVACPRLSIDWGTAFPKPLLTPYEAAVALRDISWQQPYPMDFYAGSSLGPWTVNHGQDRRPHAPGRPARGKVGGGFQEGGETAPGHWPPPCDRDGKRTGAERRETQGRRSETLTKVCDLRCRRGPRVPLRPWLARTAAAGTRRWRRWLLDALPGLRYQPPLWVRPAFCRCHGNALALRGPPSGRCCRSVPPRALCFRSGKDRFRCFRRSLPGIMAAQRPLRVLCLAGFRQSERGFREKTGALRKALRGRAELVCLSGPHPVPDPPGPEGARSDFGSCPPEEQPRGWWFSEQEADVFSALEEPAVCRGLEESLGMVAQALNRLGPFDGLLGFSQGAALAALVCALGQAGDPRFPLPRFILLVSGFCPRGIGFKESILQRPLSLPSLHVFGDTDKVIPSQESVQLASQFPGAITLTHSGGHFIPAAAPQRQAYLKFLDQFAE

SEQ ID NO: 899913 - protein, 539 aa, Homo sapiens
MIANPNVPAYRYDPYSKVLSREHYDHQRMQAARQEAIATARSAKSWGLILGTLGRQGSPKILEHLESRLRALGLSFVRLLLSEIFPSKLSLLPEVDVWVQVACPRLSIDWGTAFPKPLLTPYEAAVALRDISWQQPYPMDFYAGSSLGPWTVNHGQDRRPHAPGRPARGKVGGGFQEGGETAPGHWPPPCDRDGKRTGAERRETQGRRSETLTKVCDLRCRRGPRVPLRPWLARTAAAGTRRWRRWLLDALPGLRYQPPLWVRPAFCRCHGNALALRGPPSGRCCRSVPPRALCFRSGKDRFRCFRRSLPGIMAAQRPLRVLCLAGFRQSERGFREKTGALRKALRGRAELVCLSGPHPVPDPPGPEGARSDFGSCPPEEQPRGWWFSEQEADVFSALEEPAVCRGLEESLGMVAQALNRLGPFDGLLGFSQGAALAALVCALGQAGDPRFPLPRFILLVSGFCPRGIGFKESILQRPLSLPSLHVFGDTDKVIPSQESVQLASQFPGAITLTHSGGHFIPAAAPQRQAYLKFLDQFAE

SEQ ID NO: 899914 - protein, 251 aa, Homo sapiens
AGWYGPRLSGKDRFRCFRRSLPGIMAAQRPLRVLCLAGFRQSERGFREKTGALRKALRGRAELVCLSGPHPVPDPPGPEGARSDFGSCPPEEQPRGWWFSEQEADVFSALEEPAVCRGLEESLGMVAQALNRLGPFDGLLGFSQGAALAALVCALGQAGDPRFPLPRFILLVSGFCPRGIGFKESILQRPLSLPSLHVFGDTDKVIPSQESVQLASQFPGAITLTHSGGHFIPAAAPQRQAYLKFLDQFAE

SEQ ID NO: 899915 - protein, 573 aa, Homo sapiens
MRRQVMAALVVSGAAEQGGRDGPGRGRAPRGRVANQIPPEILKNPQLQAAIRVLPSNYNFEIPKTIWRIQQAQAKKVALQMPEGLLLFACTIVDILERFTEAEVMVMGDVTYGACCVDDFTARALGADFLVHYGHSCLIPMDTSAQDFRVLYVFVDIRIDTTHLLDSLRLTFPPATALALVSTIQFVSTLQAAAQELKAEYRVSVPQCKPLSPGEILGCTSPRLSKEVEAVVYLGDGRFHLESVMIANPNVPAYRYDPYSKVLSREHYDHQRMQAARQEAIATARSAKSWGLILGTLGRQGSPKILEHLESRLRALGLSFVRLLLSEIFPSKLSLLPEVDVWVQVACPRLSIDWGTAFPKPLLTPYEAAVALRDISWQQPYPMDFYAGSSLGPWTVNHGQDRRPHAPGRPARGKVGGGFQEGGETAPGHWPPPCDRDGKRTGAERRETQGRRSETLTKVCDLRCRRGPRVPLRPWLARTAAAGTRRWRRWLLDALPGLSRRVCNWPANFPEPSPSPTLVATSFQQLHPSVRPTSSSWTSLQSERSRNVSAPTSSSSRGSLRHPCPPRTLHSLL

SEQ ID NO: 899916 - protein, 443 aa, Homo sapiens; identical to SEQ ID NO: 899907

SEQ ID NO: 899917 - protein, 228 aa, Homo sapiens
MRRQVMAALVVSGAAEQGGRDGPGRGRAPRGRVANQIPPEILKNPQLQAAIRVLPSNYNFEIPKTIWRIQQAQAKKVALQMPEGLLLFACTIVDILERFTEAEVMVMGDVTYGACCVDDFTARALGADFLVHYGHSCLSMVGPGHLDGGGAGREAGCTFIFPMAVPSCPAWRHKVPPGFWGGLCLPALQVDLSFGFGCLGNGALSQMQVFERLLVVEQAGPRPGDREV

SEQ ID NO: 899918 - protein, 132 aa, Homo sapiens
MRRQVMAALVVSGAAEQGGRDGPGRGRAPRGRVANQIPPEILKNPQLQAAIRVLPSNYNFEIPKTIWRIQQAQAKKVALQMPEGLLLFACTIVDILERFTEAEVMVMGDVTYGACCGSLVFHIGFCHLVIYV

SEQ ID NO: 899919 - protein, 443 aa, Homo sapiens; identical to SEQ ID NO: 899907

SEQ ID NO: 899920 - protein, 239 aa, Homo sapiens
QAVLVRIFRWQVMAALVVSGAAEQGGRDGPGRGRAPRGRVANQIPPEILKNPQLQAAIRVLPSNYNFEIPKTIWRIQQAQAKKVALQMPEGLLLFACTIVDILERFTEAEVMVMGDVTYGACCVDDFTARALGADFLVHYGHSCLIPMDTSAQDFRVLYVFVDIRIDTTHLLDSLRLTFPPATALALVSTIQFVSTLQAAAQELKAEYRVSVPQCKPLSPGEILGCTSPRLSKEVEAVV

SEQ ID NO: 899921 - protein, 450 aa, Homo sapiens
QAVLVRIFRWQVMAALVVSGAAEQGGRDGPGRGRAPRGRVANQIPPEILKNPQLQAAIRVLPSNYNFEIPKTIWRIQQAQAKKVALQMPEGLLLFACTIVDILERFTEAEVMVMGDVTYGACCVDDFTARALGADFLVHYGHSCLIPMDTSAQDFRVLYVFVDIRIDTTHLLDSLRLTFPPATALALVSTIQFVSTLQAAAQELKAEYRVSVPQCKPLSPGEILGCTSPRLSKEVEAVVYLGDGRFHLESVMIANPNVPAYRYDPYSKVLSREHYDHQRMQAARQEAIATARSAKSWGLILGTLGRQGSPKILEHLESRLRALGLSFVRLLLSEIFPSKLSLLPEVDVWVQVACPRLSIDWGTAFPKPLLTPYEAAVALRDISWQQPYPMDFYAGSSLGPWTVNHGQDRRPHAPGRPARGKVQEGSARPPSAVACEDCSCRDEKVAPLAP

SEQ ID NO: 899922 - protein, 443 aa, Homo sapiens; identical to SEQ ID NO: 899907

SEQ ID NO: 899923 - protein, 664 aa, Homo sapiens
MRRQVMAALVVSGAAEQGGRDGPGRGRAPRGRVANQIPPEILKNPQLQAAIRVLPSNYNFEIPKTIWRIQQAQAKKVALQMPEGLLLFACTIVDILERFTEAEVMVMGDVTYGACCVDDFTARALGADFLVHYGHSCLIPMDTSAQDFRVLYVFVDIRIDTTHLLDSLRLTFPPATALALVSTIQFVSTLQAAAQELKAEYRVSVPQCKPLSPGEILGCTSPRLSKEVEAVVYLGDGRFHLESVMIANPNVPAYRYDPYSKVLSREHYDHQRMQAARQEAIATARSAKSWGLILGTLGRQGSPKILEHLESRLRALGLSFVRLLLSEIFPSKLSLLPEVDVWVQVACPRLSIDWGTAFPKPLLTPYEAAVALRDISWQQPYPMDFYAGSSLGPWTVNHGQDRRPHAPGRPARGKVGGGFQEGGETAPGHWPPPCDRDGKRTGAERRETQGRRSETLPKSATSGAGGVRASPFGRGLRGLQLQGREGGAAGSLTRSRASGSCPPEEQPRGWWFSEQEADVFSALEEPAVCRGLEESLGMVAQALNRLGPFDGLLGFSQGAALAALVCALGQAGDPRFPLPRFILLVSGFCPRGIGFKESILQRPLSLPSLHVFGDTDKVIPSQESVQLASQFPGAITLTHSGGHFIPAAAPQRQAYLKFLDQFAE

SEQ ID NO: 899924 - protein, 401 aa, Homo sapiens
MDFYAGSSLGPWTVNHGQDRRPHAPGRPARGKVGGGFQEGGETAPGHWPPPCDRDGKRTGAERRETQGRRSETLTKVCDLRCRRGPRVPLRPWLARTAAAGTRRWRRWLLDALPGLRYQPPLWVRPAFCRCHGNALALRGPPSGRCCRSVPPRALCFRSGKDRFRCFRRSLPGIMAAQRPLRVLCLAGFRQSERGFREKTGALRKALRGRAELVCLSGPHPVPDPPGPEGARSDFGSCPPEEQPRGWWFSEQEADVFSALEEPAVCRGLEESLGMVAQALNRLGPFDGLLGFSQGAALAALVCALGQAGDPRFPLPRFILLVSGFCPRGIGFKESILQRPLSLPSLHVFGDTDKVIPSQESVQLASQFPGAITLTHSGGHFIPAAAPQRQAYLKFLDQFAE

SEQ ID NO: 899925 - protein, 443 aa, Homo sapiens; identical to SEQ ID NO: 899907

SEQ ID NO: 899926 - protein, 443 aa, Homo sapiens; identical to SEQ ID NO: 899907

SEQ ID NO: 899927 - protein, 232 aa, Homo sapiens [sequence omitted]

SEQ ID NO: 899928 - protein, 1544 aa, Homo sapiens
MSGTQSTITDRFPLKKPIRHGSILNRESPTDKKQKVERIASHDFDPTDSSSKKTKSSSEESRSEIYGLVQRCVIIQKDDNGFGLTVSGDNPVFVQSVKEDGAAMRAGVQTGDRIIKVNGTLVTHSNHLEVVKLIKSGSYVALTVQGRPPGSPQIPLADSEVEPSVIGHMSPIMTSPHSPGASGNMERITSPVLMGEENNVVHNQKVEILRKMLQKEQERLQLLQEDYNRTPAQRLLKEIQEAKKHIPQLQEQLSKATGSAQDGAVVTPSRPLGDTLTVSEAETDPGDVLGRTDCSSGDASRPSSDNADSPKSGPKERIYLEENPEKSETIQDTDTQSLVGSPSTRIAPHIIGAEDDDFGTEHEQINGQCSCFQSIELLKSRPAHLAVFLHHVVSQFDPATLLCYLYSDLYKHTNSKETRRIFLEFHQFFLDRSAHLKVSVPDEMSADLEKRRPELIPEDLHRHYIQTMQERVHPEVQRHLEDFRQKRSMGLTLAESELTKLDAERDKDRLTLEKERTCAEQIVAKIEEVLMTAQAVEEDKSSTMQYVILMYMKHLGVKVKEPRNLEHKRGRIGFLPKIKQSMKKDKEGEEKGKRRGFPSILGPPRRPSRHDNSAIGRAMELQKARHPKHLSTPSSVSPEPQDSAKLRQSGLANEGTDAGYLPANSMSSVASGASFSQEGGKENDTGSKQVGETSAPGDTLDGTPRTLNTVFDFPPPPLDQVQEEECEVERVTEHGTPKPFRKFDSVAFGESQSEDEQFENDLETDPPNWQQLVSREVLLGLKPCEIKRQEVINELFYTERAHVRTLKVLDQVFYQRVSREGILSPSELRKIFSNLEDILQLHIGLNEQMKAVRKRNETSVIDQIGEDLLTWFSGPGEEKLKHAAATFCSNQPFALEMIKSRQKKDSRFQTFVQDAESNPLCRRLQLKDIIPTQMQRLTKYPLLLDNIAKYTEWPTEREKVKKAADHCRQILNYVNQAVKEAENKQRLEDYQRRLDTSSLKLSEYPNVEELRNLDLTKRKMIHEGPLVWKVNRDKTIDLYTLLLEDILVLLQKQDDRLVLRCHSKILASTADSKHTFSPVIKLSTVLVRQVATDNKALFVISMSDNGAQIYELVAQTVSEKTVWQDLICRMAASVKEQSTKPIPLPQSTPGEGDNDEEDPSKLKEEQHGISVTGLQSPDRDLGLESTLISSKPQSHSLSTSGKSEVRDLFVAERQFAKEQHTDGTLKEVGEDYQIAIPDSHLPVSEERWALDALRNLGLLKQLLVQQLGLTEKSVQEDWQHFPRYRTASQGPQTDSVIQNSENIKAYHSGEGHMPFRTGTGDIATCYSPRTSTESFAPRDSVGLAPQDSQASNILVMDHMIMTPEMPTMEPEGGLDDSGEHFFDAREAHSDENPSEGDGAVNKEEKDVNLRISGNYLILDGYDPVQESSTDEEVASSLTLQPMTGIPAVESTHQQQHSPQNTHSDGAISPFTPEFLVQQRWGAMEYSCFEIQSPSSCADSQSQIMEYIHKIEADLEHLKKVEESYTILCQRLAGSALTDKHSDKS

SEQ ID NO: 899929 - protein, 696 aa, Homo sapiens
MKAVRKRNETSVIDQIGEDLLTWFSGPGEEKLKHAAATFCSNQPFALEMIKSRQKKDSRFQTFVQDAESNPLCRRLQLKDIIPTQMQRLTKYPLLLDNIAKYTEWPTEREKVKKAADHCRQILNYVNQAVKEAENKQRLEDYQRRLDTSSLKLSEYPNVEELRNLDLTKRKMIHEGPLVWKVNRDKTIDLYTLLLEDILVLLQKQDDRLVLRCHSKILASTADSKHTFSPVIKLSTVLVRQVATDNKALFVISMSDNGAQIYELVAQTVSEKTVWQDLICRMAASVKEQSTKPIPLPQSTPGEGDNDEEDPSKLKEEQHGISVTGLQSPDRDLGLESTLISSKPQSHSLSTSGKSEVRDLFVAERQFAKEQHTDGTLKEVGEDYQIAIPDSHLPVSEERWALDALRNLGLLKQLLVQQLGLTEKSVQEDWQHFPRYRTASQGPQTDSVIQNSENIKAYHSGEGHMPFRTGTGDIATCYSPRTSTESFAPRDSVGLAPQDSQASNILVMDHMIMTPEMPTMEPEGGLDDSGEHFFDAREAHSDENPSEGDGAVNKEEKDVNLRISGNYLILDGYDPVQESSTDEEVASSLTLQPMTGIPAVESTHQQQHSPQNTHSDGAISPFTPEFLVQQRWGAMEYSCFEIQSPSSCADSQSQIMEYIHKIEADLEHLKKVEESYTILCQRLAGSALTDKHSDKS

SEQ ID NO: 899930 - protein, 696 aa, Homo sapiens; identical to SEQ ID NO: 899929

SEQ ID NO: 899931 - protein, 696 aa, Homo sapiens; identical to SEQ ID NO: 899929

SEQ ID NO: 899932 - protein, 857 aa, Homo sapiens
FFPQQLPMKDEIPFLKSCCCCCVFDFPPPPLDQVQEEECEVERVTEHGTPKPFRKFDSVAFGESQSEDEQFENDLETDPPNWQQLVSREVLLGLKPCEIKRQEVINELFYTERAHVRTLKVLDQVFYQRVSREGILSPSELRKIFSNLEDILQLHIGLNEQMKAVRKRNETSVIDQIGEDLLTWFSGPGEEKLKHAAATFCSNQPFALEMIKSRQKKDSRFQTFVQDAESNPLCRRLQLKDIIPTQMQRLTKYPLLLDNIAKYTEWPTEREKVKKAADHCRQILNYVNQAVKEAENKQRLEDYQRRLDTSSLKLSEYPNVEELRNLDLTKRKMIHEGPLVWKVNRDKTIDLYTLLLEDILVLLQKQDDRLVLRCHSKILASTADSKHTFSPVIKLSTVLVRQVATDNKALFVISMSDNGAQIYELVAQTVSEKTVWQDLICRMAASVKEQSTKPIPLPQSTPGEGDNDEEDPSKLKEEQHGISVTGLQSPDRDLGLESTLISSKPQSHSLSTSGKSEVRDLFVAERQFAKEQHTDGTLKEVGEDYQIAIPDSHLPVSEERWALDALRNLGLLKQLLVQQLGLTEKSVQEDWQHFPRYRTASQGPQTDSVIQNSENIKAYHSGEGHMPFRTGTGDIATCYSPRTSTESFAPRDSVGLAPQDSQASNILVMDHMIMTPEMPTMEPEGGLDDSGEHFFDAREAHSDENPSEGDGAVNKEEKDVNLRISGNYLILDGYDPVQESSTDEEVASSLTLQPMTGIPAVESTHQQQHSPQNTHSDGAISPFTPEFLVQQRWGAMEYSCFEIQSPSSCADSQSQIMEYIHKIEADLEHLKKVEESYTILCQRLAGSALTDKHSDKS

SEQ ID NO: 899933 - protein, 525 aa, Homo sapiens
MIHEGPLVWKVNRDKTIDLYTLLLEDILVLLQKQDDRLVLRCHSKILASTADSKHTFSPVIKLSTVLVRQVATDNKALFVISMSDNGAQIYELVAQTVSEKTVWQDLICRMAASVKEQSTKPIPLPQSTPGEGDNDEEDPSKLKEEQHGISVTGLQSPDRDLGLESTLISSKPQSHSLSTSGKSEVRDLFVAERQFAKEQHTDGTLKEVGEDYQIAIPDSHLPVSEERWALDALRNLGLLKQLLVQQLGLTEKSVQEDWQHFPRYRTASQGPQTDSVIQNSENIKAYHSGEGHMPFRTGTGDIATCYSPRTSTESFAPRDSVGLAPQDSQASNILVMDHMIMTPEMPTMEPEGGLDDSGEHFFDAREAHSDENPSEGDGAVNKEEKDVNLRISGNYLILDGYDPVQESSTDEEVASSLTLQPMTGIPAVESTHQQQHSPQNTHSDGAISPFTPEFLVQQRWGAMEYSCFEIQSPSSCADSQSQIMEYIHKIEADLEHLKKVEESYTILCQRLAGSALTDKHSDKS

SEQ ID NO: 899934 - protein, 208 aa, Homo sapiens
ALPPVWRCGIGRAATAWRMAPLLLQLAVLGAALAAAALVLKRDPAFTYEVIVVDDGSKDQTSKVAFKYCQKYGSDKVRVITLVKNRGKGGAIRMGIFSSRGEKILMADADGATKFPDVEKLEKGLNDLQPWPNQMAIACGSRAHLEKESIAQAFLTSVPSSQWYGGSHLFWVVVSPLVVQRDIRGTTPVGGFPNYFYFGRKQLSPDRF

SEQ ID NO: 899935 - protein, 261 aa, Homo sapiens
ALPPVWRCGIGRAATAWRMAPLLLQLAVLGAALAAAALVLISIVAFTTATKMPALHRHEEEKFFLNAKGQKETLPSIWDSPTKQLSVVVPSYNEEKRLPVMMDEALSYLEKRQKRDPAFTYEVIVVDDGSKDQTSKVAFKYCQKYGSDKVRVITLVKNRGKGGAIRMGIFSSRGEKILMADADGATKFPDVEKLEKGLNDLQPWPNQMAIACGSRAHLEKESIAQPLSGVVPLCQRNQGHTVWVQIIYSRSSFTDVFISTR

SEQ ID NO: 899936 - protein, 261 aa, Homo sapiens
MPKARKKLYPAYGTHLPNNFLSLCLHTMKKNGKRDPAFTYEVIVVDDGSKDQTSKVAFKYCQKYGSDKVRVITLVKNRGKGGAIRMGIFSSRGEKILMADADGATKFPDVEKLEKGLNDLQPWPNQMAIACGSRAHLEKESIAQRSYFRTLLMYGFHFLVWFLCVKGIRDTQCGFKLFTREAASRTFSSLHVERWAFDVELLYIAQFFKIPIAEIAVNWTEIEGSKLVPFWSWLQMGKDLLFIRLRYLTGAWRLEQTRKMN

SEQ ID NO: 899937 - protein, 227 aa, Homo sapiens
ALPPVWRCGIGRAATAWRMAPLLLQLAVLGAALAAAALVLISIVAFTTATKMPALHRHEEEKFFLNAKGQKETLPSIWDSPTKQLSVVVPSYNEEKRLPVMMDEALSYLEKRQKRDPAFTYEVIVVDDGSKDQTSKVAFKYCQKYGSDKVRVITLVKNRGKGGAIRMGIFSSRGEKILMADADGATKFPDVEKLEKGLNDLQPWPNQMAIACGSRAHLEKESIAQGI

SEQ ID NO: 899938 - protein, 189 aa, Homo sapiens
MAPLLLQLAVLGAALAAAALVLISIVAFTTATKMPALHRHEEEKFFLNAKGQKETLPSIWDSPTKQLSVVVPSYNEEKRLPVMMDEALSYLEKRQKRDPAFTYEVIVVDDGSKDQTSKVAFKYCQKYGSDKVRVITLVKNRGKGGAIRMGIFSSRGEKILMADADGATKFPDVEKLEKGLNDLQPWPGI

SEQ ID NO: 899939 - protein, 324 aa, Homo sapiens
MAPLLLQLAVLGAALAAAALVLISIVAFTTATKMPALHRHEEEKFFLNAKGQKETLPSIWDSPTKQLSVVVPSYNEEKRLPVMMDEALSYLEKRQKRDPAFTYEVIVVDDGSKDQTSKVAFKYCQKYGSDKVRVITLVKNRGKGGAIRMGIFSSRGEKILMADADGATKFPDVEKLEKGLNDLQPWPNQMAIACGSRAHLEKESIAQRSYFRTLLMYGFHFLVWFLCVKGIRDTQCGFKLFTREAASRTFSSLHVERWAFDVELLYIAQFFKIPIAEIAVNWTEIEGSKLVPFWSWLQMGKDLLFIRLRYLTGAWRLEQTRKMN

SEQ ID NO: 899940 - protein, 324 aa, Homo sapiens; identical to SEQ ID NO: 899939

SEQ ID NO: 899941 - protein, 224 aa, Homo sapiens
RFRKLLVVMLAVNDQTSKVAFKYCQKYGSDKVRVITLVKNRGKGGAIRMGIFSSRGEKILMADADGATKFPDVEKLEKGLNDLQPWPNQMAIACGSRAHLEKESIAQRSYFRTLLMYGFHFLVWFLCVKGIRDTQCGFKLFTREAASRTFSSLHVERWAFDVELLYIAQFFKIPIAEIAVNWTEIEGSKLVPFWSWLQMGKDLLFIRLRYLTGAWRLEQTRKMN

SEQ ID NO: 899942 - protein, 286 aa, Homo sapiens
MAPLLLQLAVLGAALAAAALVLISIVAFTTATKMPALHRHEEEKFFLNAKGQKETLPSIWDSPTKQLSVVVPSYNEEKRLPVMMDEALSYLEKRQKRDPAFTYEVIVVDDGSKDQTSKVAFKYCQKYGSDKVRVITLVKNRGKGGAIRMNQMAIACGSRAHLEKESIAQRSYFRTLLMYGFHFLVWFLCVKGIRDTQCGFKLFTREAASRTFSSLHVERWAFDVELLYIAQFFKIPIAEIAVNWTEIEGSKLVPFWSWLQMGKDLLFIRLRYLTGAWRLEQTRKMN

SEQ ID NO: 899943 - protein, 110 aa, Homo sapiens
ALPPVWRCGIGRAATAWRMAPLLLQLAVLGAALAAAALVLISIVAFTTATKMPALHRHEEEKFFLNAKGQKETLPSIWDSPTKQLSVVVPSYNEEKRLPVMMDEALSYAR

SEQ ID NO: 899944 - protein, 158 aa, Homo sapiens
MKLKGLGKRCKRREDLEIRFILIQNRAGKTRLAKWYMQFDDDEKQKLIEEVHAVVTVRDAKHTNFVEFRNFKIIYRRYAGLYFCICVDVNDNNLAYLEAIHNFVEVLNEYFHNVCELDLVFNFYKVYTVVDEMFLAGEIRETSQTKVLKQLLMLQSLE

SEQ ID NO: 899945 - protein, 95 aa, Homo sapiens
VMVGVSVLLIIQSVMLVVLFPQSSDSISAPRTQDSGIAPGCGSRFPFPGPWPTQQSFPQLPRRKGPSWVWATREETAPHCLWALAVGRGHRVCPE

SEQ ID NO: 899946 - protein, 142 aa, Homo sapiens
MIRFILIQNRAGKTRLAKWYMQFDDDEKQKLIEEVHAVVTVRDAKHTNFVEFRNFKIIYRRYAGLYFCICVDVNDNNLAYLEAIHNFVEVLNEYFHNVCELDLVFNFYKVYTVVDEMFLAGEIRETSQTKVLKQLLMLQSLE

SEQ ID NO: 899947 - protein, 144 aa, Homo sapiens
MVWIRFILIQNRAGKTRLAKWYMQFDDDEKQKLIEEVHAVVTVRDAKHTNFVEFRNFKIIYRRYAGLYFCICVDVNDNNLAYLEAIHNFVEVLNEYFHNVCELDLVFNFYKVYTVVDEMFLAGEIRETSQTKVLKQLLMLQSLE

SEQ ID NO: 899948 - protein, 122 aa, Homo sapiens
MVVGEEVLLPHIEEVHAVVTVRDAKHTNFVEFRNFKIIYRRYAGLYFCICVDVNDNNLAYLEAIHNFVEVLNEYFHNVCELDLVFNFYKVYTVVDEMFLAGEIRETSQTKVLKQLLMLQSLE

SEQ ID NO: 899949 - protein, 142 aa, Homo sapiens; identical to SEQ ID NO: 899946

SEQ ID NO: 899950 - protein, 163 aa, Homo sapiens
GPWARAAKGQPARQWEEVRARAHPRGLLPQPLPEAGVQWHDLGSLQPPSPGFKCFSCLSLPSSWYYRLAPLVKLQLPGVCAREGRRVFLPEVRSSSGPYNCTLSRSCPVAAGPGPLGSGRGSPCSGTLRSFTAAMLASTSASVWMSMTTTWLTWRPFTTSWRS

SEQ ID NO: 899951 - protein, 104 aa, Homo sapiens
MIRFILIQNRAGKTRLAKWYMQFDDDEKQKLIEEVHAVVTVRDAKHTNFVEVLNEYFHNVCELDLVFNFYKVYTVVDEMFLAGEIRETSQTKVLKQLLMLQSLE

SEQ ID NO: 899952 - protein, 142 aa, Homo sapiens; identical to SEQ ID NO: 899946

SEQ ID NO: 899953 - protein, 142 aa, Homo sapiens; identical to SEQ ID NO: 899946

SEQ ID NO: 899954 - protein, 120 aa, Homo sapiens
RHETRTTKRIEEVHAVVTVRDAKHTNFVEFRNFKIIYRRYAGLYFCICVDVNDNNLAYLEAIHNFVEVLNEYFHNVCELDLVFNFYKVYTVVDEMFLAGEIRETSQTKVLKQLLMLQSLE

SEQ ID NO: 899955 - protein, 156 aa, Homo sapiens
MIRFILIQNRAGKTRLAKWYMQFDDDEKQKLIEEVHAVVTVRDAKHTNFVEVLASSVADSLSVLQFRNFKIIYRRYAGLYFCICVDVNDNNLAYLEAIHNFVEVLNEYFHNVCELDLVFNFYKVYTVVDEMFLAGEIRETSQTKVLKQLLMLQSLE

SEQ ID NO: 899956 - protein, 106 aa, Homo sapiens
MVLASSVADSLSVLQFRNFKIIYRRYAGLYFCICVDVNDNNLAYLEAIHNFVEVLNEYFHNVCELDLVFNFYKVYTVVDEMFLAGEIRETSQTKVLKQLLMLQSLE

SEQ ID NO: 899957 - protein, 153 aa, Homo sapiens
MIRFILIQNRAGKTRLAKWYMQFDDDEKQKLIEEVHAVVTVRDAKHTNFVEFRNFKIIYRRYAGLYFCICVDVNDNNLAYLEAIHNFVEVLNEYFHNVCELDLVFNFYKVYTVVDEMFLAGEIRETSQTKVLKQLSLPLPRPVANPAVLPSAA

SEQ ID NO: 899958 - protein, 553 aa, Homo sapiens
MATDTSQGELVHPKALPLIVGAQLIHADKLGEKVEDSTMPIRRTVNSTRETPPKSKLAEGEEEKPEPDISSEESVSTVEEQENETPPATSSEAEQPKGEPENEEKEENKSSEETKKDEKDQSKEKEKKVKKTIPSWATLSASQLARAQKQTPMASSPRPKMDAILTEAIKACFQKSGASVVAIRKYIIHKYPSLELERRGYLLKQALKRELNRGVIKQVKGKGASGSFVVVQKSRKTPQKSRNRKNRSSAVDPEPQVKLEDVLPLAFTRLCEPKEASYSLIRKYVSQYYPKLRVDIRPQLLKNALQRAVERGQLEQITGKGASGTFQLKKSGEKPLLGGSLMEYAILSAIAAMNEPKTCSTTALKKYVLENHPGTNSNYQMHLLKKTLQKCEKNGWMEQISGKGFSGTFQLCFPYYPSPGVLFPKKEPDDSRDEDEDEDESSEEDSEDEEPPPKRRLQKKTPAKSPGKAASVKQRGSKPAPKVSAAQRGKARPLPKKAPPKAKTPAKKTRPSSTVIKKPSGGSSKKPATSARKEVKLPGKGKSTMKKSFRVKK

SEQ ID NO: 899959 - protein, 553 aa, Homo sapiens; identical to SEQ ID NO: 899958

SEQ ID NO: 899960 - protein, 560 aa, Homo sapiens
AESSAAGTGGQRWRRRLAAAGAAPRGRAGRGRQDRPNAEKVEDSTMPIRRTVNSTRETPPKSKLAEGEEEKPEPDISSEESVSTVEEQENETPPATSSEAEQPKGEPENEEKEENKSSEETKKDEKDQSKEKEKKVKKTIPSWATLSASQLARAQKQTPMASSPRPKMDAILTEAIKACFQKSGASVVAIRKYIIHKYPSLELERRGYLLKQALKRELNRGVIKQVKGKGASGSFVVVQKSRKTPQKSRNRKNRSSAVDPEPQVKLEDVLPLAFTRLCEPKEASYSLIRKYVSQYYPKLRVDIRPQLLKNALQRAVERGQLEQITGKGASGTFQLKKSGEKPLLGGSLMEYAILSAIAAMNEPKTCSTTALKKYVLENHPGTNSNYQMHLLKKTLQKCEKNGWMEQISGKGFSGTFQLCFPYYPSPGVLFPKKEPDDSRDEDEDEDESSEEDSEDEEPPPKRRLQKKTPAKSPGKAASVKQRGSKPAPKVSAAQRGKARPLPKKAPPKAKTPAKKTRPSSTVIKKPSGGSSKKPATSARKEVKLPGKGKSTMKKSFRVKK

SEQ ID NO: 899961 - protein, 457 aa, Homo sapiens
QSGTRHKPYRLGRAVLIGRGSEKDQSKEKEKKVKKTIPSWATLSASQLARAQKQTPMASSPRPKMDAILTEAIKACFQKSGASVVAIRKYIIHKYPSLELERRGYLLKQALKRELNRGVIKQVKGKGASGSFVVVQKSRKTPQKSRNRKNRSSAVDPEPQVKLEDVLPLAFTRLCEPKEASYSLIRKYVSQYYPKLRVDIRPQLLKNALQRAVERGQLEQITGKGASGTFQLKKSGEKPLLGGSLMEYAILSAIAAMNEPKTCSTTALKKYVLENHPGTNSNYQMHLLKKTLQKCEKNGWMEQISGKGFSGTFQLCFPYYPSPGVLFPKKEPDDSRDEDEDEDESSEEDSEDEEPPPKRRLQKKTPAKSPGKAASVKQRGSKPAPKVSAAQRGKARPLPKKAPPKAKTPAKKTRPSSTVIKKPSGGSSKKPATSARKEVKLPGKGKSTMKKSFRVKK

SEQ ID NO: 899962 - protein, 526 aa, Homo sapiens
MATDTSQGELVHPKALPLIVGAQLIHADKLGEKVEDSTMPIRRTVNSTRETPPKSKLAEGEEEKPEPDISSEESVSTVEEQENETPPATSSEAEQPKGEPENEEKEENKSSEETKKDEKDQSKEKEKKVKKTIPSWATLSASQLARAQKQTPMASSPRPKMDAILTEAIKACFQKSGASVVAIRKYIIHKYPSLELERRGYLLKQALKRELNRGVIKQNRSSAVDPEPQVKLEDVLPLAFTRLCEPKEASYSLIRKYVSQYYPKLRVDIRPQLLKNALQRAVERGQLEQITGKGASGTFQLKKSGEKPLLGGSLMEYAILSAIAAMNEPKTCSTTALKKYVLENHPGTNSNYQMHLLKKTLQKCEKNGWMEQISGKGFSGTFQLCFPYYPSPGVLFPKKEPDDSRDEDEDEDESSEEDSEDEEPPPKRRLQKKTPAKSPGKAASVKQRGSKPAPKVSAAQRGKARPLPKKAPPKAKTPAKKTRPSSTVIKKPSGGSSKKPATSARKEVKLPGKGKSTMKKSFRVKK

SEQ ID NO: 899963 - protein, 289 aa, Homo sapiens
AESSAAGTGGQRWRRRLAAAGAAPRGRAGRGRQDRPNAEKVEDSTMPIRRTVNSTRETPPKSKLAEGEEEKPEPDISSEESVSTVEEQENETPPATSSEAEQPKGEPENEEKEENKSSEETKKDEKDQSKEKEKKVKKTIPSWATLSASQLARAQKQTPMASSPRPKMDAILTEAIKACFQKSGASVVAIRKYIIHKYPSLELERRGYLLKQALKRELNRGVIKQVKGKGASGSFVVVQKSRKTPQKSRNRKNRSSAVDPEPQKLPTVSSGNMCLSIILSLEWTSGLSC

SEQ ID NO: 899964 - protein, 212 aa, Homo sapiens
MEYAILSAIAAMNEPKTCSTTALKKYVLENHPGTNSNYQMHLLKKTLQKCEKNGWMEQISGKGFSGTFQLCFPYYPSPGVLFPKKEPDDSRDEDEDEDESSEEDSEDEEPPPKRRLQKKTPAKSPGKAASVKQRGSKPAPKVSAAQRGKARPLPKKAPPKAKTPAKKTRPSSTVIKKPSGGSSKKPATSARKEVKLPGKGKSTMKKSFRVKK

SEQ ID NO: 899965 - protein, 102 aa, Homo sapiens
AESSAAGTGGQRWRRRLAAAGAAPRGRAGRGRQDRPNAEKVEDSTMPIRRTVNSTRETPPKSKLAEGEEEKPEPDISSEESVSTVEGCRRKPQPSPQGRPHL

SEQ ID NO: 899966 - protein, 553 aa, Homo sapiens; identical to SEQ ID NO: 899958

SEQ ID NO: 899967 - protein, 553 aa, Homo sapiens; identical to SEQ ID NO: 899958

SEQ ID NO: 899968 - protein, 553 aa, Homo sapiens; identical to SEQ ID NO: 899958

SEQ ID NO: 899969 - protein, 553 aa, Homo sapiens; identical to SEQ ID NO: 899958

SEQ ID NO: 899970 - protein, 282 aa, Homo sapiens
MATDTSQGELVHPKALPLIVGAQLIHADKLGEKVEDSTMPIRRTVNSTRETPPKSKLAEGEEEKPEPDISSEESVSTVEEQENETPPATSSEAEQPKGEPENEEKEENKSSEETKKDEKDQSKEKEKKVKKTIPSWATLSASQLARAQKQTPMASSPRPKMDAILTEAIKACFQKSGASVVAIRKYIIHKYPSLELERRGYLLKQALKRELNRGVIKQVKGKGASGSFVVVQKSRKTPQKSRNRKNRSSAVDPEPQKLPTVSSGNMCLSIILSLEWTSGLSC

SEQ ID NO: 899971 - protein, 133 aa, Homo sapiens
MATDTSQGELVHPKALPLIVGAQLIHADKLGEKVEDSTMPIRRTVNSTRETPPKSKLAEGEEEKPEPDISSEESVSTVEEQENETPPATSSEAEQPKGEPENEEKEENKSSEETKKERADSIHSTLFIIGQNS

SEQ ID NO: 899972 - protein, 133 aa, Homo sapiens; identical to SEQ ID NO: 899971

SEQ ID NO: 899973 - protein, 221 aa, Homo sapiens
MATDTSQGELVHPKALPLIVGAQLIHADKLGEKVEDSTMPIRRTVNSTRETPPKSKLAEGEEEKPEPDISSEESVSTVEEQENETPPATSSEAEQPKGEPENEEKEENKSSEETKKDEKDQSKEKEKKVKKTIPSWATLSASQLARAQKQTPMASSPRPKMDAILTEAIKACFQKSGASVVAIRKYIIHKYPSLELERRGYLLKQALKRELNRGVIKQVFS

SEQ ID NO: 899974 - protein, 133 aa, Homo sapiens; identical to SEQ ID NO: 899971

SEQ ID NO: 899975 - protein, 553 aa, Homo sapiens; identical to SEQ ID NO: 899958

SEQ ID NO: 899976 - protein, 401 aa, Homo sapiens
MASSPRPKMDAILTEAIKACFQKSGASVVAIRKYIIHKYPSLELERRGYLLKQALKRELNRGVIKQVKGKGASGSFVVVQKSRKTPQKSRNRKNRSSAVDPEPQVKLEDVLPLAFTRLCEPKEASYSLIRKYVSQYYPKLRVDIRPQLLKNALQRAVERGQLEQITGKGASGTFQLKKSGEKPLLGGSLMEYAILSAIAAMNEPKTCSTTALKKYVLENHPGTNSNYQMHLLKKTLQKCEKNGWMEQISGKGFSGTFQLCFPYYPSPGVLFPKKEPDDSRDEDEDEDESSEEDSEDEEPPPKRRLQKKTPAKSPGKAASVKQRGSKPAPKVSAAQRGKARPLPKKAPPKAKTPAKKTRPSSTVIKKPSGGSSKKPATSARKEVKLPGKGKSTMKKSFRVKK

SEQ ID NO: 899977 - protein, 408 aa, Homo sapiens
MKSLPMPMASSPRPKMDAILTEAIKACFQKSGASVVAIRKYIIHKYPSLELERRGYLLKQALKRELNRGVIKQVKGKGASGSFVVVQKSRKTPQKSRNRKNRSSAVDPEPQVKLEDVLPLAFTRLCEPKEASYSLIRKYVSQYYPKLRVDIRPQLLKNALQRAVERGQLEQITGKGASGTFQLKKSGEKPLLGGSLMEYAILSAIAAMNEPKTCSTTALKKYVLENHPGTNSNYQMHLLKKTLQKCEKNGWMEQISGKGFSGTFQLCFPYYPSPGVLFPKKEPDDSRDEDEDEDESSEEDSEDEEPPPKRRLQKKTPAKSPGKAASVKQRGSKPAPKVSAAQRGKARPLPKKAPPKAKTPAKKTRPSSTVIKKPSGGSSKKPATSARKEVKLPGKGKSTMKKSFRVKK

SEQ ID NO: 899978 - protein, 584 aa, Homo sapiens
MATDTSQGELVHPKALPLIVGAQLIHADKLGEKVEDSTMPIRRTVNSTRETPPKSKLAEGEEEKPEPDISSEESVSTVEEQENETPPATSSEAEQPKGEPENEEKEENKSSEETKKDEKDQSKEKEKKVKKTIPSWATLSASQLARAQKQTPMASSPRPKMDAILTEAIKACFQKSGASVVAIRKYIIHKYPSLELERRGYLLKQALKRELNRGVIKQVKGKGASGSFVVVQKSRKTPQKSRNRKNRSSAVDPEPQVKLEDVLPLAFTRLCEPKEASYSLIRKYVSQYYPKLRVDIRPQLLKNALQRAVERGQLEQITGKGASGTFQELRPTWCRGVLSWPALGECCLDAFLFLLGKQLKKSGEKPLLGGSLMEYAILSAIAAMNEPKTCSTTALKKYVLENHPGTNSNYQMHLLKKTLQKCEKNGWMEQISGKGFSGTFQLCFPYYPSPGVLFPKKEPDDSRDEDEDEDESSEEDSEDEEPPPKRRLQKKTPAKSPGKAASVKQRGSKPAPKVSAAQRGKARPLPKKAPPKAKTPAKKTRPSSTVIKKPSGGSSKKPATSARKEVKLPGKGKSTMKKSFRVKK

SEQ ID NO: 899979 - protein, 125 aa, Homo sapiens
AGWYRPRGYRRPRRSSKTLRMKSRHLRELQKKTPAKSPGKAASVKQRGSKPAPKVSAAQRGKARPLPKKAPPKAKTPAKKTRPSSTVIKKPSGGSSKKPATSARKEVKLPGKGKSTMKKSFRVKK

SEQ ID NO: 899980 - protein, 553 aa, Homo sapiens; identical to SEQ ID NO: 899958

SEQ ID NO: 899981 - protein, 344 aa, Homo sapiens
MATDTSQGELVHPKALPLIVGAQLIHADKLGEKVEDSTMPIRRTVNSTRETPPKSKLAEGEEEKPEPDISSEESVSTVEEQENETPPATSSEAEQPKGEPENEEKEENKSSEETKKDEKDQSKEKEKKVKKTIPSWATLSASQLARAQKQTPMASSPRPKMDAILTEAIKACFQKSGASVVAIRKYIIHKYPSLELERRGYLLKQALKRELNRGVIKQVKGKGASGSFVVVQKSRKTPQKSRNRKNRSSAVDPEPQVKLEDVLPLAFTRLCEPKEASYSLIRKYVSQYYPKLRVDIRPQLLKNALQRAVERGQLEQITGKGASGTFQKWGFAVLPRLLLNSWVQ

SEQ ID NO: 899982 - protein, 344 aa, Homo sapiens; identical to SEQ ID NO: 899981

SEQ ID NO: 899983 - protein, 344 aa, Homo sapiens; identical to SEQ ID NO: 899981

SEQ ID NO: 899984 - protein, 180 aa, Homo sapiens
MATDTSQGELVHPKALPLIVGAQLIHADKLGEKVEDSTMPIRRTVNSTRETPPKSKLAEGEEEKPEPDISSEESVSTVEEQENETPPATSSEAEQPKGEPENEEKEENKSSEETKKDEKDQSKEKEKKVKKTIPSWATLSAILFFVWRQSFALVAQAGVQWHDLGSPQPPSPGFKQFFCL

SEQ ID NO: 899985 - protein, 71 aa, Homo sapiens
TVHIRGGRGRKEEEGFQRESSSEDARVHGFLEDKFSTADTNIRTSMYLLGDTRTVLRTQNLEAKPPAFYAS

SEQ ID NO: 899986 - protein, 418 aa, Homo sapiens
MAGRLPACVVDCGTGYTKLGYAGNTEPQFIIPSCIAIKESAKVGDQAQRRVMKGVDDLDFFIGDEAIEKPTYATKWPIRHGIVEDWDLMERFMEQVIFKYLRAEPEDHYFLLTEPPLNTPENREYTAEIMFESFNVPGLYIAVQAVLALAASWTSRQVGERTLTGTVIDSGDGVTHVIPVAEGYVIGSCIKHIPIAGRDITYFIQQLLRDREVGIPPEQSLETAKAVKERYSYVCPDLVKEFNKYDTDGSKWIKQYTGINAISKKEFSIDVGYERFLGPEIFFHPEFANPDFTQPISEVVDEVIQNCPIDVRRPLYKNIVLSGGSTMFRDFGRRLQRDLKRTVDARLKLSEELSGGRLKPKPIDVQVITHHMQRYAVWFGGSMLASTPEFYQVCHTKKDYEEIGPSICRHNPVFGVMS

SEQ ID NO: 899987 - protein, 418 aa, Homo sapiens; identical to SEQ ID NO: 899986

SEQ ID NO: 899988 - protein, 418 aa, Homo sapiens; identical to SEQ ID NO: 899986

SEQ ID NO: 899989 - protein, 159 aa, Homo sapiens
MAGRLPACVVDCGTGYTKLGYAGNTEPQFIIPSCIAIKESAKVGDQAQRRVMKGVDDLDFFIGDEAIEKPTYATKWPIRHGIVEDWDLMERFMEQVIFKYLRAEPEDHYFLLTEPPLNTPENSCSCLSCILDLKTSRRTDVDRYGNRQWRWCHSCHSCG

SEQ ID NO: 899990 - protein, 356 aa, Homo sapiens
MLEIQNHSLSSLPWPIRHGIVEDWDLMERFMEQVIFKYLRAEPEDHYFLLTEPPLNTPENREYTAEIMFESFNVPGLYIAVQAVLALAASWTSRQVGERTLTGTVIDSGDGVTHVIPVAEGYVIGSCIKHIPIAGRDITYFIQQLLRDREVGIPPEQSLETAKAVKERYSYVCPDLVKEFNKYDTDGSKWIKQYTGINAISKKEFSIDVGYERFLGPEIFFHPEFANPDFTQPISEVVDEVIQNCPIDVRRPLYKNIVLSGGSTMFRDFGRRLQRDLKRTVDARLKLSEELSGGRLKPKPIDVQVITHHMQRYAVWFGGSMLASTPEFYQVCHTKKDYEEIGPSICRHNPVFGVMS

SEQ ID NO: 899991 - protein, 327 aa, Homo sapiens
LGTRLGVESAEAELKTIIFFVTEPPLNTPENREYTAEIMFESFNVPGLYIAVQAVLALAASWTSRQVGERTLTGTVIDSGDGVTHVIPVAEGYVIGSCIKHIPIAGRDITYFIQQLLRDREVGIPPEQSLETAKAVKERYSYVCPDLVKEFNKYDTDGSKWIKQYTGINAISKKEFSIDVGYERFLGPEIFFHPEFANPDFTQPISEVVDEVIQNCPIDVRRPLYKNIVLSGGSTMFRDFGRRLQRDLKRTVDARLKLSEELSGGRLKPKPIDVQVITHHMQRYAVWFGGSMLASTPEFYQVCHTKKDYEEIGPSICRHNPVFGVMS

SEQ ID NO: 899992 - protein, 420 aa, Homo sapiens
MAGRLPACVVDCGTGYTKLGYAGNTEPQFIIPSCIAIKESAKVGDQAQRRVMKGVDDLDFFIGDEAIEKPTYATKWPIRHGIVEDWDLMERFMEQVIFKYLRAEPEDHYFLLTEPPLNTPENREYTAEIMFESFNVPGLYIAVQAVLALAASWTSRQVGERTLTGTVIDSGDGVTHVIPVAEGYVIGSCIKHIPIAGRDITYFIQQLLRDREVGIPPEQSLETAKAVKERYSYVCPDLVKEFNKYDTDGSKWIKQYTGINAISKKEFSIDVGYERFLGPEIFFHPEFANPDFTQPISEVVDEVIQNCPIDVRRPLYKNIVLSGGSTMFRDFGRRLQRDLKRTVDARLKLSEELSGGRLKPKPIDVQVITHHMQRYAVWFGGSMLASTPEFYQVCHTKKDYEEIGPSICRHNPVFGVMSQQ

SEQ ID NO: 899993 - protein, 399 aa, Homo sapiens
MAGRLPACVVDCGTGYTKLGYAGNTEPQFIIPSCIAIKESAKVGDQAQRRVMKGVDDLDFFIGDEAIEKPTYATKWPIRHGIVEDWDLMERFMEQVIFKYLRAEPEDHYFLLTEPPLNTPENREYTAEIMFESFNVPGLYIAVQAVLALAASWTSRQVGERTLTGTVIDSGDGVTHVIPVAEGYVIGSCIKHIPIAGRDITYFIQQLLRDREVGIPPEQSLETAKAVKERYSYVCPDLVKEFNKYDTDGSKWIKQYTGINAISKKEFSIDVGYERFLGPEIFFHPEFANPDFTQPISEVVDEVIQNCPIDVRRPLYKNIVLSGGSTMFRDFGRRLQRDLKRTVDARLKLSEELSGGRLKPKPIDVQVITHHMQRYAVWFGGSMLASTLEVSKVATQKGL

SEQ ID NO: 899994 - protein, 366 aa, Homo sapiens
MAGRLPACVVDCGTGYTKLGYAGNTEPQFIIPSCIAIKESAKVGDQAQRRVMKGVDDLDFFIGDEAIEKPTYATKWPIRHGIVEDWDLMERFMEQVIFKYLRAEPEDHYFLLTEPPLNTPENREYTAEIMFESFNVPGLYIAVQAVLALAASWTSRQVGERTLTGTVIDSGDGVTHVIPVAEGYVIGSCIKHIPIAGRDITYFIQQLLRDREVGIPPEQSLETAKAVKERYSYVCPDLVKEFNKYDTDGSKWIKQYTGINAISKKEFSIDVGYERFLGPEIFFHPEFANPDFTQPISEVVDEVIQNCPIDVRRPLYKNIVLSGGSTMFRDFGRRLQRDLKRTVDARLKLSEELSGGRLKVGFPNYW

SEQ ID NO: 899995 - protein, 250 aa, Homo sapiens
MAGRLPACVVDCGTGYTKLGYAGNTEPQFIIPSCIAIKESAKVGDQAQRRVMKGVDDLDFFIGDEAIEKPTYATKWPIRHGIVEDWDLMERFMEQVIFKYLRAEPEDHYFLLTEPPLNTPENREYTAEIMFESFNVPGLYIAVQAVLALAASWTSRQVGERTLTGTVIDSGDGVTHVIPVAEGYVIGSCIKHIPIAGRDITYFIQQLLRDREVGIPPEQSLETAKAVKERYSYVCPDLVKEFNNAFGTKS

SEQ ID NO: 899996 - protein, 119 aa, Homo sapiens
MHIASCKKSDCCAVFYPLWPRSRDNAGIRAPTGFCEPLSAPRPDSEARSRLQFEAPCAAPWWPEAVTVAAEGASRCIRSAPWPPSGGRRPLLSRLRGRPGVSAARPGRPLVAGGRYCRG

SEQ ID NO: 899997 - protein, 119 aa, Homo sapiens; identical to SEQ ID NO: 899996

SEQ ID NO: 899998 - protein, 125 aa, Homo sapiens
MAGRLPACVVDCGTGYTKLGYAGNTEPQFIIPSCIAIKESAKVGDQAQRRVMKGVDDLDFFIGDEAIEKPTYATKWPIRHGIVEDWDLMERFMEQVIFKYLRAEPEDHYFLLIVKLISFENFWLT

SEQ ID NO: 899999 - protein, 109 aa, Homo sapiens
MHIASCKKSDCCAVFYPLWPRSRDNAGIRAPTGFCEPLSAPRPDSEARSRLQFEAPCAAPWWPEAVTVAAEGASRCIRSAPCPAIYIPCFSNTRRGLSMGPTWGGDTRR

SEQ ID NO: 900000 - protein, 135 aa, Homo sapiens [sequence omitted]

SEQ ID NO: 900001 - protein, 418 aa, Homo sapiens; identical to SEQ ID NO: 899986

SEQ ID NO: 900002 - protein, 418 aa, Homo sapiens; identical to SEQ ID NO: 899986

SEQ ID NO: 900003 - protein, 418 aa, Homo sapiens; identical to SEQ ID NO: 899986

SEQ ID NO: 900004 - protein, 418 aa, Homo sapiens; identical to SEQ ID NO: 899986

SEQ ID NO: 900005 - protein, 418 aa, Homo sapiens; identical to SEQ ID NO: 899986

SEQ ID NO: 900006 - protein, 418 aa, Homo sapiens; identical to SEQ ID NO: 899986

SEQ ID NO: 900007 - protein, 84 aa, Homo sapiens
VDVQVITHHMQRYAVGLEINAGRLKPKPIDVQVITHHMQRYAVWFGGSMLASTPEFYQVCHTKKDYEEIGPSICRHNPVFGVMS

SEQ ID NO: 900008 - protein, 235 aa, Homo sapiens [sequence omitted]

SEQ ID NO: 900009 - protein, 119 aa, Homo sapiens; identical to SEQ ID NO: 899996

SEQ ID NO: 900010 - protein, 125 aa, Homo sapiens
MAGRLPACVVDCGTGYTKLGYAGNTEPQFIIPSCIAIKESAKVGDQAQRRVMKGVDDLDFFIGDEAIEKPTYATKWPIRHGIVEDWDLMERFMEQVIFKYLRAEPEDHYFLLTEPPWSSGLLGAS

SEQ ID NO: 900011 - protein, 119 aa, Homo sapiens; identical to SEQ ID NO: 899996

SEQ ID NO: 900012 - protein, 1264 aa, Homo sapiens
MEAKDQKKHRKKNSGPKAAKKKKRLLQDLQLGDEEDARKRNPKAFAVQSAVRMARSFHRTQDLKTKKHHIPVVDRTPLEPPPIVVVVMGPPKVGKSTLIQCLIRNFTRQKLTEIRGPVTIVSGKKRRLTIIECGCDINMMIDLAKVADLVLMLIDASFGFEMETFEFLNICQVHGFPKIMGVLTHLDSFKHNKQLKKTKKRLKHRFWTEVYPGAKLFYLSGMVHGEYQNQEIHNLGRFITVMKFRPLTWQTSHPYILADRMEDLTNPEDIRTNIKCDRKVSLYGYLRGAHLKNKSQIHMPGVGDFAVSDISFLPDPCALPEQQKKRCLNEKEKLVYAPLSGVGGVLYDKDAVYVDLGGSHVFQDEVGPTHELVQSLISTHSTIDAKMASSRVTLFSDSKPLGSEDIDNQGLMMPKEEKQMDLNTGRMRRKAIFGDEDESGDSDDEEDDEMSEDDGLENGSSDEEAEEEENAEMTDQYMAVKGIKRRKLELEEDSEMDLPAFADSDDDLERSSAEEGEAEEADESSEEEDCTAGEKGISGSKAAGEGSKAGLSPANCQSDRVNLEKSLLMKKAALPTFDSGHCTAEEVFASEDESEESSSLSAEEEDSENEEAIRKKLSKPSQVSSGQKLGPQNFIDETSDIENLLKEEEDYKEENNDSKETSGALKWKEDLSRKAAEAFLRQQQAAPNLRKLIYGTVTEDNEEEDDDTLEELGGLFRVNQPDRECKHKADSLDCSRFLVEAPHDWDLEEVMNSIRDCFVTGKWEDDKDAAKVLAEDEELYGDFEDLETGDVHKGKSGPNTQNEDIEKEVKEEIDPDEEESAKKKHLDKKRKLKEMFDAEYDEGESTYFDDLKGEMQKQAQLNRAEFEDQDDEARVQYEGFRPGMYVRIEIENVPCEFVQNFDPHYPIILGGLGNSEGNVGYVQMRLKKHRWYKKILKSRDPIIFSVGWRRFQTIPLYYIEDHNGRQRLLKYTPQHMHCGAAFWGPITPQGTGFLAIQSVSGIMPDFRIAATGVVLDLDKSIKIVKKLKLTGFPYKIFKNTSFIKGMFNSALEVAKFEGAVIRTVSGIRGQIKKALRAPEGAFRASFEDKLLMSDIVFMRTWYPVSIPAFYNPVTSLLKPVGEKDTWSGMRTTGQLRLAHGVRLKANKDSLYKPILRQKKHFNSLHIPAGKVPKDRRRPAVIREPHERKILALLDALSTVHSQKMKKAKEQRHLHNKEHFRAKQKEEEEKLKRQKDLRKKLFRIQGQKERRNQKSSLKGAEGQLQ

SEQ ID NO: 900013 - protein, 1282 aa, Homo sapiens
MEAKDQKKHRKKNSGPKAAKKKKRLLQDLQLGDEEDARKRNPKAFAVQSAVRMARSFHRTQDLKTKKHHIPVVDRTPLEPPPIVVVVMGPPKVGKSTLIQCLIRNFTRQKLTEIRGPVTIVSGKKRRLTIIECGCDINMMIDLAKVADLVLMLIDASFGFEMETFEFLNICQVHGFPKIMGVLTHLDSFKHNKQLKKTKKRLKHRFWTEVYPGAKLFYLSGMVHGEYQNQEIHNLGRFITVMKFRPLTWQTSHPYILADRMEDLTNPEDIRTNIKCDRKVSLYGYLRGAHLKNKSQIHMPGVGDFAVSDISFLPDPCALPEQQKKRCLNEKEKLVYAPLSGVGGVLYDKDAVYVDLGGSHVFQDEVGPTHELVQSLISTHSTIDAKMASSRVTLFSDSKPLGSEDIDNQGLMMPKEEKQMDLNTGRMRRKAIFGDEDESGDSDDEEDDEMSEDDGLENGSSDEEAEEEENAEMTDQYMAVKGIKRRKLELEEDSEMDLPAFADSDDDLERSSAEEGEAEEADESSEEEDCTAGEKGISGSKAAGEGSKAGLSPANCQSDRVNLEKSLLMKKAALPTFDSGHCTAEEVFASEDESEESSSLSAEEEDSENEEAIRKKLSKPSQVSSGQKLGPQNFIDETSDIENLLKEEEDYKEENNDSKETSGALKWKEDLSRKAAEAFLRQQQAAPNLRKLIYGTVTEDNEEEDDDTLEELGGLFRVNQPDRECKHKADSLDCSRFLVEAPHDWDLEEVMNSIRDCFVTGKWEDDKDAAKVLAEDEELYGDFEDLETGDVHKGKSGPNTQNEDIEKEVKEEIDPDEEESAKKKHLDKKRKLKEMFDAEYDEGESTYFDDLKGEMQKQAQLNRAEFEDQDDEARVQYEGFRPGMYVRIEIENVPCEFVQNFDPHYPIILGGLGNSEGNVGYVQMRLKKHRWYKKILKSRDPIIFSVGWRRFQTIPLYYIEDHNGRQRLLKYTPQHMHCGAAFWGPITPQGTGFLAIQSVSGIMPDFRIAATGVVLDLDKSIKIVKKLKLTGFPYKIFKNTSFIKGMFNSALEVAKFEGAVIRTVSGIRGQIKKALRAPEGAFRASFEDKLLMSDIVFMRTWYPVSIPAFYNPVTSLLKPVGEKDTWSGMRTTGQLRLAHGVRLKANKDSLYKPILRQKKHFNSLHIPKALQKALPFKNKPKTQAKAGKVPKDRRRPAVIREPHERKILALLDALSTVHSQKMKKAKEQRHLHNKEHFRAKQKEEEEKLKRQKDLRKKLFRIQGQKERRNQKSSLKGAEGQLQ

SEQ ID NO: 900014 - protein, 1195 aa, Homo sapiens
MEAKDQKKHRKKNSGPKAAKKKKRLLQDLQLGDEEDARKRNPKAFAVQSAVRMARSFHRTQDLKTKKHHIPVVDRTPLEPPPIVVVVMGPPKVGKSTLIQCLIRNFTRQKLTEIRGPVTIVSGKKRRLTIIECGCDINMMIDLAKVADLVLMLIDASFGFEMETFEFLNICQVHGFPKIMGVLTHLDSFKHNKQLKKTKKRLKHRFWTEVYPGAKLFYLSGMVHGEYQNQEIHNLGRFITVMKFRPLTWQTSHPYILADRMEDLTNPEDIRTNIKCDRKVSLYGYLRGAHLKNKSQIHMPGVGDFAVSDISFLPDPCALPEQQKKRCLNEKEKLVYAPLSGVGGVLYDKDAVYVDLGGSHVFQDEVGPTHELVQSLISTHSTIDAKMASSRVTLFSDSKPLGSEDIDNQGLMMPKEEKQMDLNTGRMRRKAIFGDEDESGDSDDEEDDEMSEDDGLENGSSDEEAEEEENAEMTDQYMAVKGIKRRKLELEEDSEMDLPAFADSDDDLERSSAEEGEAEEADESSEEEDCTAGEKGISGSKAAGEGSKAGLSPANCQSDRVNLEKSLLMKKAALPTFDSGHCTAEEVFASEDESEESSSLSAEEEDSENEEAIRKKLSKPSQVSSGQKLGPQNFIDETSDIENLLKEEEDYKEENNDSKETSGALKWKEDLSRKAAEAFLRQQQAAPNLRKLIYGTVTEDNEEEDDDTLEELGGLFRVNQPDRECKHKADSLDCSRFLVEAPHDWDLEEVMNSIRDCFVTGKWEDDKDAAKVLAEDEELYGDFEDLETGDVHKGKSGPNTQNEDIEKEVKEEIDPDEEESAKKKHLDKKRKLKEMFDAEYDEGESTYFDDLKGEMQKQAQLNRAEFEDQDDEARVQYEGFRPGMYVRIEIENVPCEFVQNFDPHYPIILGGLGNSEGNVGYVQMRLKKHRWYKKILKSRDPIIFSVGWRRFQTIPLYYIEDHNGRQRLLKYTPQHMHCGAAFWGPITPQGTGFLAIQSVSGIMPDFRIAATGVVLDLDKSIKIVKKLKLTGFPYKIFKNTSFIKGMFNSALEVAKFEGAVIRTVSGIRGQIKKALRAPEGAFRASFEDKLLMSDIVFMRTWYPVSIPAFYNPVTSLLKPVGEKDTWSGMRTTGQLRLAHGVRLKANKDSLYKPILRQKKHFNSLHIPKALQKALPFKNKPKTQAKAGKVPKDRRR

SEQ ID NO: 900015 - protein, 385 aa, Homo sapiens
MEAKDQKKHRKKNSGPKAAKKKKRLLQDLQLGDEEDARKRNPKAFAVQSAVRMARSFHRTQDLKTKKHHIPVVDRTPLEPPPIVVVVMGPPKVGKSTLIQCLIRNFTRQKLTEIRGPVTIVSGKKRRLTIIECGCDINMMIDLAKVADLVLMLIDASFGFEMETFEFLNICQVHGFPKIMGVLTHLDSFKHNKQLKKTKKRLKHRFWTEVYPGAKLFYLSGMVHGEYQNQEIHNLGRFITVMKFRPLTWQTSHPYILADRMEDLTNPEDIRTNIKCDRKVSLYGYLRGAHLKNKSQIHMPGVGDFAVSDISFLPDPCALPEQQKKRCLNEKEKLVYAPLSGVGGVLYDKDAVYVDLGGSHVFQDEVGPTHELVQSLMTWGCRDLK

SEQ ID NO: 900016 - protein, 1282 aa, Homo sapiens; identical to SEQ ID NO: 900013

SEQ ID NO: 900017 - protein, 225 aa, Homo sapiens
SESDSHGGIGARRSDQQSGLRTARASSSLVDNLVLSDIVFMRTWYPVSIPAFYNPVTSLLKPVGEKDTWSGMRTTGQLRLAHGVRLKANKDSLYKPILRQKKHFNSLHIPKALQKALPFKNKPKTQAKAGKVPKDRRRPAVIREPHERKILALLDALSTVHSQKMKKAKEQRHLHNKEHFRAKQKEEEEKLKRQKDLRKKLFRIQGQKERRNQKSSLKGAEGQLQ

SEQ ID NO: 900018 - protein, 1226 aa, Homo sapiens
MEAKDQKKHRKKNSGPKAAKKKKRLLQDLQLGDEEDARKRNPKAFAVQSAVRMARSFHRTQDLKTKKHHIPVVDRTPLEPPPIVVVVMGPPKVGKSTLIQCLIRNFTRQKLTEIRGPVTIVSGKKRRLTIIECGCDINMMIDLAKVADLVLMLIDASFGFEMETFEFLNICQVHGFPKIMGVLTHLDSFKHNKQLKKTKKRLKHRFWTEVYPGAKLFYLSGMVHGEYQNQEIHNLGRFITVMKFRPLTWQTSHPYILADRMEDLTNPEDIRTNIKCDRKVSLYGYLRGAHLKNKSQIHMPGVGDFAVSDISFLPDPCALPEQQKKRCLNEKEKLVYAPLSGVGGVLYDKDAVYVDLGGSHVFQDEVGPTHELVQSLISTHSTIDAKMASSRVTLFSDSKPLGSEDIDNQGLMMPKEEKQMDLNTGRMRRKAIFGDEDESGDSDDEEDDEMSEDDGLENGSSDEEAEEEENAEMTDQYMAVKGIKRRKLELEEDSEMDLPAFADSDDDLERSSAEEGEAEEADESSEEEDCTAGEKGISGSKAAGEGSKAGLSPANCQSDRVNLEKSLLMKKAALPTFDSGHCTAEEVFASEDESEESSSLSAEEEDSENEEAIRKKLSKPSQVSSGQKLGPQNFIDETSDIENLLKEEEDYKEENNDSKETSGALKWKEDLSRKAAEAFLRQQQAAPNLRKLIYGTVTEDNEEEDDDTLEELGGLFRVNQPDRECKHKADSLDCSRFLVEAPHDWDLEEVMNSIRDCFVTGKWEDDKDAAKVLAEDEELYGDFEDLETGDVHKGKSGPNTQNEDIEKEVKEEIDPDEEESAKKKHLDKKRKLKEMFDAEYDEGESTYFDDLKGEMQKQAQLNRAEFEDQDDEARVQYEGFRPGMYVRIEIENVPCEFVQNFDPHYPIILGGLGNSEGNVGYVQMRLKKHRWYKKILKSRDPIIFSVGWRRFQTIPLYYIEDHNGRQRLLKYTPQHMHCGAAFWGPITPQGTGFLAIQSVSGIMPDFRIAATGVVLDLDKSIKIVKKLKLTGFPYKIFKNTSFIKGMFNSALEVAKFEGAVIRTVSGIRGQIKKALRAPEGAFRASFEDKLLMSDIVFMRTWYPVSIPAFYNPVTSLLKPVGEKDTWSGMRTTGQLRLAHGVRLKANKDSLYKPILRQKKHFNSLHIPKALQKALPFKNKPKTQAKAGKVPKDRRRPAVIREPHERKLGCWDWVHSHDLGLSRFKVM

SEQ ID NO: 900019 - protein, 2442 aa, Homo sapiens
MAENLLDGPPNPKRAKLSSPGFSANDSTDFGSLFDLENDLPDELIPNGGELGLLNSGNLVPDAASKHKQLSELLRGGSGSSINPGIGNVSASSPVQQGLGGQAQGQPNSANMASLSAMGKSPLSQGDSSAPSLPKQAASTSGPTPAASQALNPQAQKQVGLATSSPATSQTGPGICMNANFNQTHPGLLNSNSGHSLINQASQGQAQVMNGSLGAAGRGRGAGMPYPTPAMQGASSSVLAETLTQVSPQMTGHAGLNTAQAGGMAKMGITGNTSPFGQPFSQAGGQPMGATGVNPQLASKQSMVNSLPTFPTDIKNTSVTNVPNMSQMQTSVGIVPTQAIATGPTADPEKRKLIQQQLVLLLHAHKCQRREQANGEVRACSLPHCRTMKNVLNHMTHCQAGKACQVAHCASSRQIISHWKNCTRHDCPVCLPLKNASDKRNQQTILGSPASGIQNTIGSVGTGQQNATSLSNPNPIDPSSMQRAYAALGLPYMNQPQTQLQPQVPGQQPAQPQTHQQMRTLNPLGNNPMNIPAGGITTDQQPPNLISESALPTSLGATNPLMNDGSNSGNIGTLSTIPTAAPPSSTGVRKGWHEHVTQDLRSHLVHKLVQAIFPTPDPAALKDRRMENLVAYAKKVEGDMYESANSRDEYYHLLAEKIYKIQKELEEKRRSRLHKQGILGNQPALPAPGAQPPVIPQAQPVRPPNGPLSLPVNRMQVSQGMNSFNPMSLGNVQLPQAPMGPRAASPMNHSVQMNSMGSVPGMAISPSRMPQPPNMMGAHTNNMMAQAPAQSQFLPQNQFPSSSGAMSVGMGQPPAQTGVSQGQVPGAALPNPLNMLGPQASQLPCPPVTQSPLHPTPPPASTAAGMPSLQHTTPPGMTPPQPAAPTQPSTPVSSSGQTPTPTPGSVPSATQTQSTPTVQAAAQAQVTPQPQTPVQPPSVATPQSSQQQPTPVHAQPPGTPLSQAAASIDNRVPTPSSVASAETNSQQPGPDVPVLEMKTETQAEDTEPDPGESKGEPRSEMMEEDLQGASQVKEETDIAEQKSEPMEVDEKKPEVKVEVKEEEESSSNGTASQSTSPSQPRKKIFKPEELRQALMPTLEALYRQDPESLPFRQPVDPQLLGIPDYFDIVKNPMDLSTIKRKLDTGQYQEPWQYVDDVWLMFNNAWLYNRKTSRVYKFCSKLAEVFEQEIDPVMQSLGYCCGRKYEFSPQTLCCYGKQLCTIPRDAAYYSYQNRYHFCEKCFTEIQGENVTLGDDPSQPQTTISKDQFEKKKNDTLDPEPFVDCKECGRKMHQICVLHYDIIWPSGFVCDNCLKKTGRPRKENKFSAKRLQTTRLGNHLEDRVNKFLRRQNHPEAGEVFVRVVASSDKTVEVKPGMKSRFVDSGEMSESFPYRTKALFAFEEIDGVDVCFFGMHVQEYGSDCPPPNTRRVYISYLDSIHFFRPRCLRTAVYHEILIGYLEYVKKLGYVTGHIWACPPSEGDDYIFHCHPPDQKIPKPKRLQEWYKKMLDKAFAERIIHDYKDIFKQATEDRLTSAKELPYFEGDFWPNVLEESIKELEQEEEERKKEESTAASETTEGSQGDSKNAKKKNNKKTNKNKSSISRANKKKPSMPNVSNDLSQKLYATMEKHKEVFFVIHLHAGPVINTLPPIVDPDPLLSCDLMDGRDAFLTLARDKHWEFSSLRRSKWSTLCMLVELHTQGQDRFVYTCNECKHHVETRWHCTVCEDYDLCINCYNTKSHAHKMVKWGLGLDDEGSSQGEPQSKSPQESRRLSIQRCIQSLVHACQCRNANCSLPSCQKMKRVVQHTKGCKRKTNGGCPVCKQLIALCCYHAKHCQENKCPVPFCLNIKHKLRQQQIQHRLQQAQLMRRRMATMNTRNVPQQSLPSPTSAPPGTPTQQPSTPQTPQPPAQPQPSPVSMSPAGFPSVARTQPPTTVSTGKPTSQVPAPPPPAQPPPAAVEAARQIEREAQQQQHLYRVNINNSMPPGRTGMGTPGSQMAPVSLNVPRPNQVSGPVMPSMPPGQWQQAPLPQQQPMPGLPRPVISMQAQAAVAGPRMPSVQPPRSISPSALQDLLRTLKSPSSPQQQQQVLNILKSNPQLMAAFIKQRTAKYVANQPGMQPQPGLQSQPGMQPQPGMHQQPSLQNLNAMQAGVPRPGVPPQQQAMGGLNPQGQALNIMNPGHNPNMASMNPQYREMLRRQLLQQQQQQQQQQQQQQQQQQGSAGMAGGMAGHGQFQQPQGPGGYPPAMQQQQRMQQHLPLQGSSMGQMAAQMGQLGQMGQPGLGADSTPNIQQALQQRILQQQQMKQQIGSPGQPNPMSPQQHMLSGQPQASHLPGQQIATSLSNQVRSPAPVQSPRPQSQPPHSSPSPRIQPQPSPHHVSPQTGSPHPGLAVTMASSIDQGHLGNPEQSAMLPQLNTPSRSALSSELSLVGDTTGDTLEKFVEGL

SEQ ID NO: 900020 - protein, 2442 aa, Homo sapiens; identical to SEQ ID NO: 900019

SEQ ID NO: 900021 - protein, 2780 aa, Homo sapiens
RPMPRLEPTFEIDEEEEEEDENELFPREYFRRLSSQDVLRCQSSSKRKSKDEEEDEESDDADDFGSLFDLENDLPDELIPNGGELGLLNSGNLVPDAASKHKQLSELLRGGSGSSINPGIGNVSASSPVQQGLGGQAQGQPNSANMASLSAMGKSPLSQGDSSAPSLPKQAASTSGPTPAASQALNPQAQKQVGLATSSPATSQTGPGICMNANFNQTHPGLLNSNSGHSLINQASQGQAQVMNGSLGAAGRGRGAGMPYPTPAMQGASSSVLAETLTQVSPQMTGHAGLNTAQAGGMAKMGITGNTSPFGQPFSQAGGQPMGATGVNPQLASKQSMVNSLPTFPTDIKNTSVTNVPNMSQMQTSVGIVPTQAIATGPTADPEKRKLIQQQLVLLLHAHKCQRREQANGEVRACSLPHCRTMKNVLNHMTHCQAGKACQVAHCASSRQIISHWKNCTRHDCPVCLPLKNASDKRNQQTILGSPASGIQNTIGSVGTGQQNATSLSNPNPIDPSSMQRAYAALGLPYMNQPQTQLQPQVPGQQPAQPQTHQQMRTLNPLGNNPMNIPAGGITTDQQPPNLISESALPTSLGATNPLMNDGSNSGNIGTLSTIPTAAPPSSTGVRKGWHEHVTQDLRSHLVHKLVQAIFPTPDPAALKDRRMENLVAYAKKVEGDMYESANSRDEYYHLLAEKIYKIQKELEEKRRSRLHKQGILGNQPALPAPGAQPPVIPQAQPVRPPNGPLSLPVNRMQVSQGMNSFNPMSLGNVQLPQAPMGPRAASPMNHSVQMNSMGSVPGMAISPSRMPQPPNMMGAHTNNMMAQAPAQSQFLPQNQFPSSSGAMSVGMGQPPAQTGVSQGQVPGAALPNPLNMLGPQASQLPCPPVTQSPLHPTPPPASTAAGMPSLQHTTPPGMTPPQPAAPTQPSTPVSSSGQTPTPTPGSVPSATQTQSTPTVQAAAQAQVTPQPQTPVQPPSVATPQSSQQQPTPVHAQPPGTPLSQAAASIDNRVPTPSSVASAETNSQQPGPDVPVLEMKTETQAEDTEPDPGESKGEPRSEMMEEDLQGASQVKEETDIAEQKSEPMEVDEKKPEVKVEVKEEEESSSNGTASQSTSPSQPRKKIFKPEELRQALMPTLEALYRQDPESLPFRQPVDPQLLGIPDYFDIVKNPMDLSTIKRKLDTGQYQEPWQYVDDVWLMFNNAWLYNRKTSRVYKFCSKLAEVFEQEIDPVMQSLGYCCGRKYEFSPQTLCCYGKQLCTIPRDAAYYSYQNRYHFCEKCFTEIQGENVTLGDDPSQPQTTISKDQFEKKKNDTLDPEPFVDCKECGRKMHQICVLHYDIIWPSGFVCDNCLKKTGRPRKENKFSAKRLQTTRLGNHLEDRVNKFLRRQNHPEAGEVFVRVVASSDKTVEVKPGMKSRFVDSGEMSESFPYRTKALFAFEEIDGVDVCFFGMHVQEYGSDCPPPNTRKFSSSFQGVSFSEPCEDRPGLLSVPEEPVSLHRGLKKMKPQLTNQSSLVLFSIKLAGNEAVEMTAVSVFCVASLCGTPLLPNAGKPGELGLGQPGTCTRGSKLCHEGFMCSQESGQEGTKSGFSQFALTVALCAEWCHSSFCSVTKTEFHLTDWQQVGDWLVFGFWFVCLFITSCLVASVNTIKRKTGQSQHCGRPRWEDNWTTGVCDKSEQQSETLALQKNKLSGHDGTCLVILTMWESEAGGLLEPMRLRLQGAVTASPHCSLNDRARPCLKSKLPGCCLLLVFDFRFEGYPEFKHVPPSHRRVYISYLDSIHFFRPRCLRTAVYHEILIGYLEYVKKLGYVTGHIWACPPSEGDDYIFHCHPPDQKIPKPKRLQEWYKKMLDKAFAERIIHDYKDIFKQATEDRLTSAKELPYFEGDFWPNVLEESIKELEQEEEERKKEESTAASETTEGSQGDSKNAKKKNNKKTNKNKSSISRANKKKPSMPNVSNDLSQKLYATMEKHKEVFFVIHLHAGPVINTLPPIVDPDPLLSCDLMDGRDAFLTLARDKHWEFSSLRRSKWSTLCMLVELHTQGQDRFVYTCNECKHHVETRWHCTVCEDYDLCINCYNTKSHAHKMVKWGLGLDDEGSSQGEPQSKSPQESRRLSIQRCIQSLVHACQCRNANCSLPSCQKMKRVVQHTKGCKRKTNGGCPVCKQLIALCCYHAKHCQENKCPVPFCLNIKHKLRQQQIQHRLQQAQLMRRRMATMNTRNVPQQSLPSPTSAPPGTPTQQPSTPQTPQPPAQPQPSPVSMSPAGFPSVARTQPPTTVSTGKPTSQVPAPPPPAQPPPAAVEAARQIEREAQQQQHLYRVNINNSMPPGRTGMGTPGSQMAPVSLNVPRPNQVSGPVMPSMPPGQWQQAPLPQQQPMPGLPRPVISMQAQAAVAGPRMPSVQPPRSISPSALQDLLRTLKSPSSPQQQQQVLNILKSNPQLMAAFIKQRTAKYVANQPGMQPQPGLQSQPGMQPQPGMHQQPSLQNLNAMQAGVPRPGVPPQQQAMGGLNPQGQALNIMNPGHNPNMASMNPQYREMLRRQLLQQQQQQQQQQQQQQQQQQGSAGMAGGMAGHGQFQQPQGPGGYPPAMQQQQRMQQHLPLQGSSMGQMAAQMGQLGQMGQPGLGADSTPNIQQALQQRILQQQQMKQQIGSPGQPNPMSPQQHMLSGQPQASHLPGQQIATSLSNQVRSPAPVQSPRPQSQPPHSSPSPRIQPQPSPHHVSPQTGSPHPGLAVTMASSIDQGHLGNPEQSAMLPQLNTPSRSALSSELSLVGDTTGDTLEKFVEGL

SEQ ID NO: 900022 - protein, 2397 aa, Homo sapiens
RPMPRLEPTFEIDEEEEEEDENELFPREYFRRLSSQDVLRCQSSSKRKSKDEEEDEESDDADDFGSLFDLENDLPDELIPNGGELGLLNSGNLVPDAASKHKQLSELLRGGSGSSINPGIGNVSASSPVQQGLGGQAQGQPNSANMASLSAMGKSPLSQGDSSAPSLPKQAASTSGPTPAASQALNPQAQKQVGLATSSPATSQTGPGICMNANFNQTHPGLLNSNSGHSLINQASQGQAQVMNGSLGAAGRGRGAGMPYPTPAMQGASSSVLAETLTQVSPQMTGHAGLNTAQAGGMAKMGITGNTSPFGQPFSQAGGQPMGATGVNPQLASKQSMVNSLPTFPTDIKNTSVTNVPNMSQMQTSVGIVPTQAIATGPTADPEKRKLIQQQLVLLLHAHKCQRREQANGEVRACSLPHCRTMKNVLNHMTHCQAGKACQVAHCASSRQIISHWKNCTRHDCPVCLPLKNASDKRNQQTILGSPASGIQNTIGSVGTGQQNATSLSNPNPIDPSSMQRAYAALGLPYMNQPQTQLQPQVPGQQPAQPQTHQQMRTLNPLGNNPMNIPAGGITTDQQPPNLISESALPTSLGATNPLMNDGSNSGNIGTLSTIPTAAPPSSTGVRKGWHEHVTQDLRSHLVHKLVQAIFPTPDPAALKDRRMENLVAYAKKVEGDMYESANSRDEYYHLLAEKIYKIQKELEEKRRSRLHKQGILGNQPALPAPGAQPPVIPQAQPVRPPNGPLSLPVNRMQVSQGMNSFNPMSLGNVQLPQAPMGPRAASPMNHSVQMNSMGSVPGMAISPSRMPQPPNMMGAHTNNMMAQAPAQSQFLPQNQFPSSSGAMSVGMGQPPAQTGVSQGQVPGAALPNPLNMLGPQASQLPCPPVTQSPLHPTPPPASTAAGMPSLQHTTPPGMTPPQPAAPTQPSTPVSSSGQTPTPTPGSVPSATQTQSTPTVQAAAQAQVTPQPQTPVQPPSVATPQSSQQQPTPVHAQPPGTPLSQAAASIDNRVPTPSSVASAETNSQQPGPDVPVLEMKTETQAEDTEPDPGESKGEPRSEMMEEDLQGASQVKEETDIAEQKSEPMEVDEKKPEVKVEVKEEEESSSNGTASQSTSPSQPRKKIFKPEELRQALMPTLEALYRQDPESLPFRQPVDPQLLGIPDYFDIVKNPMDLSTIKRKLDTGQYQEPWQYVDDVWLMFNNAWLYNRKTSRVYKFCSKLTISKDQFEKKKNDTLDPEPFVDCKECGRKMHQICVLHYDIIWPSGFVCDNCLKKTGRPRKENKFSAKRLQTTRLGNHLEDRVNKFLRRQNHPEAGEVFVRVVASSDKTVEVKPGMKSRFVDSGEMSESFPYRTKALFAFEEIDGVDVCFFGMHVQEYGSDCPPPNTRRVYISYLDSIHFFRPRCLRTAVYHEILIGYLEYVKKLGYVTGHIWACPPSEGDDYIFHCHPPDQKIPKPKRLQEWYKKMLDKAFAERIIHDYKDIFKQATEDRLTSAKELPYFEGDFWPNVLEESIKELEQEEEERKKEESTAASETTEGSQGDSKNAKKKNNKKTNKNKSSISRANKKKPSMPNVSNDLSQKLYATMEKHKEVFFVIHLHAGPVINTLPPIVDPDPLLSCDLMDGRDAFLTLARDKHWEFSSLRRSKWSTLCMLVELHTQGQDRFVYTCNECKHHVETRWHCTVCEDYDLCINCYNTKSHAHKMVKWGLGLDDEGSSQGEPQSKSPQESRRLSIQRCIQSLVHACQCRNANCSLPSCQKMKRVVQHTKGCKRKTNGGCPVCKQLIALCCYHAKHCQENKCPVPFCLNIKHKLRQQQIQHRLQQAQLMRRRMATMNTRNVPQQSLPSPTSAPPGTPTQQPSTPQTPQPPAQPQPSPVSMSPAGFPSVARTQPPTTVSTGKPTSQVPAPPPPAQPPPAAVEAARQIEREAQQQQHLYRVNINNSMPPGRTGMGTPGSQMAPVSLNVPRPNQVSGPVMPSMPPGQWQQAPLPQQQPMPGLPRPVISMQAQAAVAGPRMPSVQPPRSISPSALQDLLRTLKSPSSPQQQQQVLNILKSNPQLMAAFIKQRTAKYVANQPGMQPQPGLQSQPGMQPQPGMHQQPSLQNLNAMQAGVPRPGVPPQQQAMGGLNPQGQALNIMNPGHNPNMASMNPQYREMLRRQLLQQQQQQQQQQQQQQQQQQGSAGMAGGMAGHGQFQQPQGPGGYPPAMQQQQRMQQHLPLQGSSMGQMAAQMGQLGQMGQPGLGADSTPNIQQALQQRILQQQQMKQQIGSPGQPNPMSPQQHMLSGQPQASHLPGQQIATSLSNQVRSPAPVQSPRPQSQPPHSSPSPRIQPQPSPHHVSPQTGSPHPGLAVTMASSIDQGHLGNPEQSAMLPQLNTPSRSALSSELSLVGDTTGDTLEKFVEGL

SEQ ID NO: 900023 - protein, 2226 aa, Homo sapiens
MKKRRKRMKMNFSLENTSVVCLRRMYSGVSPLLRGSLKMKKKMKSQMMLMMGITGNTSPFGQPFSQAGGQPMGATGVNPQLASKQSMVNSLPTFPTDIKNTSVTNVPNMSQMQTSVGIVPTQAIATGPTADPEKRKLIQQQLVLLLHAHKCQRREQANGEVRACSLPHCRTMKNVLNHMTHCQAGKACQVAHCASSRQIISHWKNCTRHDCPVCLPLKNASDKRNQQTILGSPASGIQNTIGSVGTGQQNATSLSNPNPIDPSSMQRAYAALGLPYMNQPQTQLQPQVPGQQPAQPQTHQQMRTLNPLGNNPMNIPAGGITTDQQPPNLISESALPTSLGATNPLMNDGSNSGNIGTLSTIPTAAPPSSTGVRKGWHEHVTQDLRSHLVHKLVQAIFPTPDPAALKDRRMENLVAYAKKVEGDMYESANSRDEYYHLLAEKIYKIQKELEEKRRSRLHKQGILGNQPALPAPGAQPPVIPQAQPVRPPNGPLSLPVNRMQVSQGMNSFNPMSLGNVQLPQAPMGPRAASPMNHSVQMNSMGSVPGMAISPSRMPQPPNMMGAHTNNMMAQAPAQSQFLPQNQFPSSSGAMSVGMGQPPAQTGVSQGQVPGAALPNPLNMLGPQASQLPCPPVTQSPLHPTPPPASTAAGMPSLQHTTPPGMTPPQPAAPTQPSTPVSSSGQTPTPTPGSVPSATQTQSTPTVQAAAQAQVTPQPQTPVQPPSVATPQSSQQQPTPVHAQPPGTPLSQAAASIDNRVPTPSSVASAETNSQQPGPDVPVLEMKTETQAEDTEPDPGESKGEPRSEMMEEDLQGASQVKEETDIAEQKSEPMEVDEKKPEVKVEVKEEEESSSNGTASQSTSPSQPRKKIFKPEELRQALMPTLEALYRQDPESLPFRQPVDPQLLGIPDYFDIVKNPMDLSTIKRKLDTGQYQEPWQYVDDVWLMFNNAWLYNRKTSRVYKFCSKLAEVFEQEIDPVMQSLGYCCGRKYEFSPQTLCCYGKQLCTIPRDAAYYSYQNRYHFCEKCFTEIQGENVTLGDDPSQPQTTISKDQFEKKKNDTLDPEPFVDCKECGRKMHQICVLHYDIIWPSGFVCDNCLKKTGRPRKENKFSAKRLQTTRLGNHLEDRVNKFLRRQNHPEAGEVFVRVVASSDKTVEVKPGMKSRFVDSGEMSESFPYRTKALFAFEEIDGVDVCFFGMHVQEYGSDCPPPNTRRVYISYLDSIHFFRPRCLRTAVYHEILIGYLEYVKKLGYVTGHIWACPPSEGDDYIFHCHPPDQKIPKPKRLQEWYKKMLDKAFAERIIHDYKDIFKQATEDRLTSAKELPYFEGDFWPNVLEESIKELEQEEEERKKEESTAASETTEGSQGDSKNAKKKNNKKTNKNKSSISRANKKKPSMPNVSNDLSQKLYATMEKHKEVFFVIHLHAGPVINTLPPIVDPDPLLSCDLMDGRDAFLTLARDKHWEFSSLRRSKWSTLCMLVELHTQGQDRFVYTCNECKHHVETRWHCTVCEDYDLCINCYNTKSHAHKMVKWGLGLDDEGSSQGEPQSKSPQESRRLSIQRCIQSLVHACQCRNANCSLPSCQKMKRVVQHTKGCKRKTNGGCPVCKQLIALCCYHAKHCQENKCPVPFCLNIKHKLRQQQIQHRLQQAQLMRRRMATMNTRNVPQQSLPSPTSAPPGTPTQQPSTPQTPQPPAQPQPSPVSMSPAGFPSVARTQPPTTVSTGKPTSQVPAPPPPAQPPPAAVEAARQIEREAQQQQHLYRVNINNSMPPGRTGMGTPGSQMAPVSLNVPRPNQVSGPVMPSMPPGQWQQAPLPQQQPMPGLPRPVISMQAQAAVAGPRMPSVQPPRSISPSALQDLLRTLKSPSSPQQQQQVLNILKSNPQLMAAFIKQRTAKYVANQPGMQPQPGLQSQPGMQPQPGMHQQPSLQNLNAMQAGVPRPGVPPQQQAMGGLNPQGQALNIMNPGHNPNMASMNPQYREMLRRQLLQQQQQQQQQQQQQQQQQQGSAGMAGGMAGHGQFQQPQGPGGYPPAMQQQQRMQQHLPLQGSSMGQMAAQMGQLGQMGQPGLGADSTPNIQQALQQRILQQQQMKQQIGSPGQPNPMSPQQHMLSGQPQASHLPGQQIATSLSNQVRSPAPVQSPRPQSQPPHSSPSPRIQPQPSPHHVSPQTGSPHPGLAVTMASSIDQGHLGNPEQSAMLPQLNTPSRSALSSELSLVGDTTGDTLEKFVEGL

SEQ ID NO: 900024 - protein, 2012 aa, Homo sapiens
ATEPVPVIQRGDECGHVGSRQPKQACHRDRCLVLLFLTLSTCWGLRPPSSMQRAYAALGLPYMNQPQTQLQPQVPGQQPAQPQTHQQMRTLNPLGNNPMNIPAGGITTDQQPPNLISESALPTSLGATNPLMNDGSNSGNIGTLSTIPTAAPPSSTGVRKGWHEHVTQDLRSHLVHKLVQAIFPTPDPAALKDRRMENLVAYAKKVEGDMYESANSRDEYYHLLAEKIYKIQKELEEKRRSRLHKQGILGNQPALPAPGAQPPVIPQAQPVRPPNGPLSLPVNRMQVSQGMNSFNPMSLGNVQLPQAPMGPRAASPMNHSVQMNSMGSVPGMAISPSRMPQPPNMMGAHTNNMMAQAPAQSQFLPQNQFPSSSGAMSVGMGQPPAQTGVSQGQVPGAALPNPLNMLGPQASQLPCPPVTQSPLHPTPPPASTAAGMPSLQHTTPPGMTPPQPAAPTQPSTPVSSSGQTPTPTPGSVPSATQTQSTPTVQAAAQAQVTPQPQTPVQPPSVATPQSSQQQPTPVHAQPPGTPLSQAAASIDNRVPTPSSVASAETNSQQPGPDVPVLEMKTETQAEDTEPDPGESKGEPRSEMMEEDLQGASQVKEETDIAEQKSEPMEVDEKKPEVKVEVKEEEESSSNGTASQSTSPSQPRKKIFKPEELRQALMPTLEALYRQDPESLPFRQPVDPQLLGIPDYFDIVKNPMDLSTIKRKLDTGQYQEPWQYVDDVWLMFNNAWLYNRKTSRVYKFCSKLAEVFEQEIDPVMQSLGYCCGRKYEFSPQTLCCYGKQLCTIPRDAAYYSYQNRYHFCEKCFTEIQGENVTLGDDPSQPQTTISKDQFEKKKNDTLDPEPFVDCKECGRKMHQICVLHYDIIWPSGFVCDNCLKKTGRPRKENKFSAKRLQTTRLGNHLEDRVNKFLRRQNHPEAGEVFVRVVASSDKTVEVKPGMKSRFVDSGEMSESFPYRTKALFAFEEIDGVDVCFFGMHVQEYGSDCPPPNTRRVYISYLDSIHFFRPRCLRTAVYHEILIGYLEYVKKLGYVTGHIWACPPSEGDDYIFHCHPPDQKIPKPKRLQEWYKKMLDKAFAERIIHDYKDIFKQATEDRLTSAKELPYFEGDFWPNVLEESIKELEQEEEERKKEESTAASETTEGSQGDSKNAKKKNNKKTNKNKSSISRANKKKPSMPNVSNDLSQKLYATMEKHKEVFFVIHLHAGPVINTLPPIVDPDPLLSCDLMDGRDAFLTLARDKHWEFSSLRRSKWSTLCMLVELHTQGQDRFVYTCNECKHHVETRWHCTVCEDYDLCINCYNTKSHAHKMVKWGLGLDDEGSSQGEPQSKSPQESRRLSIQRCIQSLVHACQCRNANCSLPSCQKMKRVVQHTKGCKRKTNGGCPVCKQLIALCCYHAKHCQENKCPVPFCLNIKHKLRQQQIQHRLQQAQLMRRRMATMNTRNVPQQSLPSPTSAPPGTPTQQPSTPQTPQPPAQPQPSPVSMSPAGFPSVARTQPPTTVSTGKPTSQVPAPPPPAQPPPAAVEAARQIEREAQQQQHLYRVNINNSMPPGRTGMGTPGSQMAPVSLNVPRPNQVSGPVMPSMPPGQWQQAPLPQQQPMPGLPRPVISMQAQAAVAGPRMPSVQPPRSISPSALQDLLRTLKSPSSPQQQQQVLNILKSNPQLMAAFIKQRTAKYVANQPGMQPQPGLQSQPGMQPQPGMHQQPSLQNLNAMQAGVPRPGVPPQQQAMGGLNPQGQALNIMNPGHNPNMASMNPQYREMLRRQLLQQQQQQQQQQQQQQQQQQGSAGMAGGMAGHGQFQQPQGPGGYPPAMQQQQRMQQHLPLQGSSMGQMAAQMGQLGQMGQPGLGADSTPNIQQALQQRILQQQQMKQQIGSPGQPNPMSPQQHMLSGQPQASHLPGQQIATSLSNQVRSPAPVQSPRPQSQPPHSSPSPRIQPQPSPHHVSPQTGSPHPGLAVTMASSIDQGHLGNPEQSAMLPQLNTPSRSALSSELSLVGDTTGDTLEKFVEGL

SEQ ID NO: 900025 - protein, 1894 aa, Homo sapiens
RPMPRLEPTFEIDEEEEEEDENELFPREYFRRLSSQDVLRCQSSSKRKSKDEEEDEESDDADDFGSLFDLENDLPDELIPNGGELGLLNSGNLVPDAASKHKQLSELLRGGSGSSINPGIGNVSASSPVQQGLGGQAQGQPNSANMASLSAMGKSPLSQGDSSAPSLPKQAASTSGPTPAASQALNPQAPMGPRAASPMNHSVQMNSMGSVPGMAISPSRMPQPPNMMGAHTNNMMAQAPAQSQFLPQNQFPSSSGAMSVGMGQPPAQTGVSQGQVPGAALPNPLNMLGPQASQLPCPPVTQSPLHPTPPPASTAAGMPSLQHTTPPGMTPPQPAAPTQPSTPVSSSGQTPTPTPGSVPSATQTQSTPTVQAAAQAQVTPQPQTPVQPPSVATPQSSQQQPTPVHAQPPGTPLSQAAASIDNRVPTPSSVASAETNSQQPGPDVPVLEMKTETQAEDTEPDPGESKGEPRSEMMEEDLQGASQVKEETDIAEQKSEPMEVDEKKPEVKVEVKEEEESSSNGTASQSTSPSQPRKKIFKPEELRQALMPTLEALYRQDPESLPFRQPVDPQLLGIPDYFDIVKNPMDLSTIKRKLDTGQYQEPWQYVDDVWLMFNNAWLYNRKTSRVYKFCSKLAEVFEQEIDPVMQSLGYCCGRKYEFSPQTLCCYGKQLCTIPRDAAYYSYQNRYHFCEKCFTEIQGENVTLGDDPSQPQTTISKDQFEKKKNDTLDPEPFVDCKECGRKMHQICVLHYDIIWPSGFVCDNCLKKTGRPRKENKFSAKRLQTTRLGNHLEDRVNKFLRRQNHPEAGEVFVRVVASSDKTVEVKPGMKSRFVDSGEMSESFPYRTKALFAFEEIDGVDVCFFGMHVQEYGSDCPPPNTRRVYISYLDSIHFFRPRCLRTAVYHEILIGYLEYVKKLGYVTGHIWACPPSEGDDYIFHCHPPDQKIPKPKRLQEWYKKMLDKAFAERIIHDYKDIFKQATEDRLTSAKELPYFEGDFWPNVLEESIKELEQEEEERKKEESTAASETTEGSQGDSKNAKKKNNKKTNKNKSSISRANKKKPSMPNVSNDLSQKLYATMEKHKEVFFVIHLHAGPVINTLPPIVDPDPLLSCDLMDGRDAFLTLARDKHWEFSSLRRSKWSTLCMLVELHTQGQDRFVYTCNECKHHVETRWHCTVCEDYDLCINCYNTKSHAHKMVKWGLGLDDEGSSQGEPQSKSPQESRRLSIQRCIQSLVHACQCRNANCSLPSCQKMKRVVQHTKGCKRKTNGGCPVCKQLIALCCYHAKHCQENKCPVPFCLNIKHKLRQQQIQHRLQQAQLMRRRMATMNTRNVPQQSLPSPTSAPPGTPTQQPSTPQTPQPPAQPQPSPVSMSPAGFPSVARTQPPTTVSTGKPTSQVPAPPPPAQPPPAAVEAARQIEREAQQQQHLYRVNINNSMPPGRTGMGTPGSQMAPVSLNVPRPNQVSGPVMPSMPPGQWQQAPLPQQQPMPGLPRPVISMQAQAAVAGPRMPSVQPPRSISPSALQDLLRTLKSPSSPQQQQQVLNILKSNPQLMAAFIKQRTAKYVANQPGMQPQPGLQSQPGMQPQPGMHQQPSLQNLNAMQAGVPRPGVPPQQQAMGGLNPQGQALNIMNPGHNPNMASMNPQYREMLRRQLLQQQQQQQQQQQQQQQQQQGSAGMAGGMAGHGQFQQPQGPGGYPPAMQQQQRMQQHLPLQGSSMGQMAAQMGQLGQMGQPGLGADSTPNIQQALQQRILQQQQMKQQIGSPGQPNPMSPQQHMLSGQPQASHLPGQQIATSLSNQVRSPAPVQSPRPQSQPPHSSPSPRIQPQPSPHHVSPQTGSPHPGLAVTMASSIDQGHLGNPEQSAMLPQLNTPSRSALSSELSLVGDTTGDTLEKFVEGL

SEQ ID NO: 900026 - protein, 2442 aa, Homo sapiens; identical to SEQ ID NO: 900019

SEQ ID NO: 900027 - protein, 1490 aa, Homo sapiens
SVLSDHSQLSQAAASIDNRVPTPSSVASAETNSQQPGPDVPVLEMKTETQAEDTEPDPGESKGEPRSEMMEEDLQGASQVKEETDIAEQKSEPMEVDEKKPEVKVEVKEEEESSSNGTASQSTSPSQPRKKIFKPEELRQALMPTLEALYRQDPESLPFRQPVDPQLLGIPDYFDIVKNPMDLSTIKRKLDTGQYQEPWQYVDDVWLMFNNAWLYNRKTSRVYKFCSKLAEVFEQEIDPVMQSLGYCCGRKYEFSPQTLCCYGKQLCTIPRDAAYYSYQNRYHFCEKCFTEIQGENVTLGDDPSQPQTTISKDQFEKKKNDTLDPEPFVDCKECGRKMHQICVLHYDIIWPSGFVCDNCLKKTGRPRKENKFSAKRLQTTRLGNHLEDRVNKFLRRQNHPEAGEVFVRVVASSDKTVEVKPGMKSRFVDSGEMSESFPYRTKALFAFEEIDGVDVCFFGMHVQEYGSDCPPPNTRRVYISYLDSIHFFRPRCLRTAVYHEILIGYLEYVKKLGYVTGHIWACPPSEGDDYIFHCHPPDQKIPKPKRLQEWYKKMLDKAFAERIIHDYKDIFKQATEDRLTSAKELPYFEGDFWPNVLEESIKELEQEEEERKKEESTAASETTEGSQGDSKNAKKKNNKKTNKNKSSISRANKKKPSMPNVSNDLSQKLYATMEKHKEVFFVIHLHAGPVINTLPPIVDPDPLLSCDLMDGRDAFLTLARDKHWEFSSLRRSKWSTLCMLVELHTQGQDRFVYTCNECKHHVETRWHCTVCEDYDLCINCYNTKSHAHKMVKWGLGLDDEGSSQGEPQSKSPQESRRLSIQRCIQSLVHACQCRNANCSLPSCQKMKRVVQHTKGCKRKTNGGCPVCKQLIALCCYHAKHCQENKCPVPFCLNIKHKLRQQQIQHRLQQAQLMRRRMATMNTRNVPQQSLPSPTSAPPGTPTQQPSTPQTPQPPAQPQPSPVSMSPAGFPSVARTQPPTTVSTGKPTSQVPAPPPPAQPPPAAVEAARQIEREAQQQQHLYRVNINNSMPPGRTGMGTPGSQMAPVSLNVPRPNQVSGPVMPSMPPGQWQQAPLPQQQPMPGLPRPVISMQAQAAVAGPRMPSVQPPRSISPSALQDLLRTLKSPSSPQQQQQVLNILKSNPQLMAAFIKQRTAKYVANQPGMQPQPGLQSQPGMQPQPGMHQQPSLQNLNAMQAGVPRPGVPPQQQAMGGLNPQGQALNIMNPGHNPNMASMNPQYREMLRRQLLQQQQQQQQQQQQQQQQQQGSAGMAGGMAGHGQFQQPQGPGGYPPAMQQQQRMQQHLPLQGSSMGQMAAQMGQLGQMGQPGLGADSTPNIQQALQQRILQQQQMKQQIGSPGQPNPMSPQQHMLSGQPQASHLPGQQIATSLSNQVRSPAPVQSPRPQSQPPHSSPSPRIQPQPSPHHVSPQTGSPHPGLAVTMASSIDQGHLGNPEQSAMLPQLNTPSRSALSSELSLVGDTTGDTLEKFVEGL

SEQ ID NO: 900028 - protein, 1153 aa, Homo sapiens
MHQICVLHYDIIWPSGFVCDNCLKKTGRPRKENKFSAKRLQTTRLGNHLEDRVNKFLRRQNHPEAGEVFVRVVASSDKTVEVKPGMKSRFVDSGEMSESFPYRTKALFAFEEIDGVDVCFFGMHVQEYGSDCPPPNTRRVYISYLDSIHFFRPRCLRTAVYHEILIGYLEYVKKLGYVTGHIWACPPSEGDDYIFHCHPPDQKIPKPKRLQEWYKKMLDKAFAERIIHDYKDIFKQATEDRLTSAKELPYFEGDFWPNVLEESIKELEQEEEERKKEESTAASETTEGSQGDSKNAKKKNNKKTNKNKSSISRANKKKPSMPNVSNDLSQKLYATMEKHKEVFFVIHLHAGPVINTLPPIVDPDPLLSCDLMDGRDAFLTLARDKHWEFSSLRRSKWSTLCMLVELHTQGQDRFVYTCNECKHHVETRWHCTVCEDYDLCINCYNTKSHAHKMVKWGLGLDDEGSSQGEPQSKSPQESRRLSIQRCIQSLVHACQCRNANCSLPSCQKMKRVVQHTKGCKRKTNGGCPVCKQLIALCCYHAKHCQENKCPVPFCLNIKHKLRQQQIQHRLQQAQLMRRRMATMNTRNVPQQSLPSPTSAPPGTPTQQPSTPQTPQPPAQPQPSPVSMSPAGFPSVARTQPPTTVSTGKPTSQVPAPPPPAQPPPAAVEAARQIEREAQQQQHLYRVNINNSMPPGRTGMGTPGSQMAPVSLNVPRPNQVSGPVMPSMPPGQWQQAPLPQQQPMPGLPRPVISMQAQAAVAGPRMPSVQPPRSISPSALQDLLRTLKSPSSPQQQQQVLNILKSNPQLMAAFIKQRTAKYVANQPGMQPQPGLQSQPGMQPQPGMHQQPSLQNLNAMQAGVPRPGVPPQQQAMGGLNPQGQALNIMNPGHNPNMASMNPQYREMLRRQLLQQQQQQQQQQQQQQQQQQGSAGMAGGMAGHGQFQQPQGPGGYPPAMQQQQRMQQHLPLQGSSMGQMAAQMGQLGQMGQPGLGADSTPNIQQALQQRILQQQQMKQQIGSPGQPNPMSPQQHMLSGQPQASHLPGQQIATSLSNQVRSPAPVQSPRPQSQPPHSSPSPRIQPQPSPHHVSPQTGSPHPGLAVTMASSIDQGHLGNPEQSAMLPQLNTPSRSALSSELSLVGDTTGDTLEKFVEGL

SEQ ID NO: 900029 - protein, 1269 aa, Homo sapiens
RPMPRLEPTFEIDEEEEEEDENELFPREYFRRLSSQDVLRCQSSSKRKSKDEEEDEESDDADDFGSLFDLENDLPDELIPNGGELGLLNSGNLVPDAASKHKQLSELLRGGSGSSINPGIGNVSASSPVQQGLGGQAQGQPNSANMASLSAMGKSPLSQGDSSAPSLPKQAASTSGPTPAASQALNPQAQKQVGLATSSPATSQTGPGICMNANFNQTHPGLLNSNSGHSLINQASQGQAQVMNGSLGAAGRGRGAGMPYPTPAMQGASSSVLAETLTQVSPQMTGHAGLNTAQAGGMAKVSELKHFQYFLPNRGLSLRVMRKMGPRGPLLFFLLGSPRATHAWKRQISFQDKDLCPISVFKMRILKEVGQLAGQAVYSVRAVYSVRAVYSVRAVYSVRAVYRGSQGDSKNAKKKNNKKTNKNKSSISRANKKKPSMPNVSNDLSQKLYATMEKHKEVFFVIHLHAGPVINTLPPIVDPDPLLSCDLMDGRDAFLTLARDKHWEFSSLRRSKWSTLCMLVELHTQGQDRFVYTCNECKHHVETRWHCTVCEDYDLCINCYNTKSHAHKMVKWGLGLDDEGSSQGEPQSKSPQESRRLSIQRCIQSLVHACQCRNANCSLPSCQKMKRVVQHTKGCKRKTNGGCPVCKQLIALCCYHAKHCQENKCPVPFCLNIKHKLRQQQIQHRLQQAQLMRRRMATMNTRNVPQQSLPSPTSAPPGTPTQQPSTPQTPQPPAQPQPSPVSMSPAGFPSVARTQPPTTVSTGKPTSQVPAPPPPAQPPPAAVEAARQIEREAQQQQHLYRVNINNSMPPGRTGMGTPGSQMAPVSLNVPRPNQVSGPVMPSMPPGQWQQAPLPQQQPMPGLPRPVISMQAQAAVAGPRMPSVQPPRSISPSALQDLLRTLKSPSSPQQQQQVLNILKSNPQLMAAFIKQRTAKYVANQPGMQPQPGLQSQPGMQPQPGMHQQPSLQNLNAMQAGVPRPGVPPQQQAMGGLNPQGQALNIMNPGHNPNMASMNPQYREMLRRQLLQQQQQQQQQQQQQQQQQQGSAGMAGGMAGHGQFQQPQGPGGYPPAMQQQQRMQQHLPLQGSSMGQMAAQMGQLGQMGQPGLGADSTPNIQQALQQRILQQQQMKQQIGSPGQPNPMSPQQHMLSGQPQASHLPGQQIATSLSNQVRSPAPVQSPRPQSQPPHSSPSPRIQPQPSPHHVSPQTGSPHPGLAVTMASSIDQGHLGNPEQSAMLPQLNTPSRSALSSELSLVGDTTGDTLEKFVEGL

SEQ ID NO: 900030 - protein, 1461 aa, Homo sapiens
RPMPRLEPTFEIDEEEEEEDENELFPREYFRRLSSQDVLRCQSSSKRKSKDEEEDEESDDADDFGSLFDLENDLPDELIPNGGELGLLNSGNLVPDAASKHKQLSELLRGGSGSSINPGIGNVSASSPVQQGLGGQAQGQPNSANMASLSAMGKSPLSQGDSSAPSLPKQAASTSGPTPAASQALNPQAQKQVGLATSSPATSQTGPGICMNANFNQTHPGLLNSNSGHSLINQASQGQAQVMNGSLGAAGRGRGAGMPYPTPAMQGASSSVLAETLTQVSPQMTGHAGLNTAQAGGMAKMGITGNTSPFGQPFSQAGGQPMGATGVNPQLASKQSMVNSLPTFPTDIKNTSVTNVPNMSQMQTSVGIVPTQAIATGPTADPEKRKLIQQQLVLLLHAHKCQRREQANGEVRACSLPHCRTMKNVLNHMTHCQAGKACQVAHCASSRQIISHWKNCTRHDCPVCLPLKNASDKRNQQTILGSPASGIQNTIGSVGTGQQNATSLSNPNPIDPSSMQRAYAALGLPYMNQPQTQLQPQVPGQQPAQPQTHQQMRTLNPLGNNPMNIPAGGITTDQQPPNLISESALPTSLGATNPLMNDGSNSGNIGTLSTIPTAAPPSSTGVRKGWHEHVTQDLRSHLVHKLVQAIFPTPDPAALKDRRMENLVAYAKKVEGDMYESANSRDEYYHLLAEKIYKIQKELEEKRRSRLHKQGILGNQPALPAPGAQPPVIPQAQPVRPPNGPLSLPVNRMQVSQGMNSFNPMSLGNVQLPQAPMGPRAASPMNHSVQMNSMGSVPGMAISPSRMPQPPNMMGAHTNNMMAQAPAQSQFLPQNQFPSSSGAMSVGMGQPPAQTGVSQGQVPGAALPNPLNMLGPQASQLPCPPVTQSPLHPTPPPASTAAGMPSLQHTTPPGMTPPQPAAPTQPSTPVSSSGQTPTPTPGSVPSATQTQSTPTVQAAAQAQVTPQPQTPVQPPSVATPQSSQQQPTPVHAQPPGTPLSQAAASIDNRVPTPSSVASAETNSQQPGPDVPVLEMKTETQAEDTEPDPGESKGEPRSEMMEEDLQGASQVKEETDIAEQKSEPMEVDEKKPEVKVEVKEEEESSSNGTASQSTSPSQPRKKIFKPEELRQALMPTLEALYRQDPESLPFRQPVDPQLLGIPDYFDIVKNPMDLSTIKRKLDTGQYQEPWQYVDDVWLMFNNAWLYNRKTSRVYKFCSKLAEVFEQEIDPVMQSLGYCCGRKYEFSPQTLCCYGKQLCTIPRDAAYYSYQNRYHFCEKCFTEIQGENVTLGDDPSQPQTTISKDQFEKKKNDTLDPEPFVDCKECGRKMHQICVLHYDIIWPSGFVCDNCLKKTGRPRKENKFSAKRLQTTRLGNHLEDRVNKFLRRQNHPEAGEVFVRVVASSDKTVEVKPGMKSRFVDSGEMSESFPYRTKALFAFEEIDGVDVCFFGMHVQEYGSDCPPPNTR

SEQ ID NO: 900031 - protein, 1461 aa, Homo sapiens; identical to SEQ ID NO: 900030

SEQ ID NO: 900032 - protein, 1240 aa, Homo sapiens
RPMPRLEPTFEIDEEEEEEDENELFPREYFRRLSSQDVLRCQSSSKRKSKDEEEDEESDDADDFGSLFDLENDLPDELIPNGGELGLLNSGNLVPDAASKHKQLSELLRGGSGSSINPGIGNVSASSPVQQGLGGQAQGQPNSANMASLSAMGKSPLSQGDSSAPSLPKQAASTSGPTPAASQALNPQAQKQVGLATSSPATSQTGPGICMNANFNQTHPGLLNSNSGHSLINQASQGQAQVMNGSLGAAGRGRGAGMPYPTPAMQGASSSVLAETLTQVSPQMTGHAGLNTAQAGGMAKMGITGNTSPFGQPFSQAGGQPMGATGVNPQLASKQSMVNSLPTFPTDIKNTSVTNVPNMSQMQTSVGIVPTQAIATGPTADPEKRKLIQQQLVLLLHAHKCQRREQANGEVRACSLPHCRTMKNVLNHMTHCQAGKACQVAHCASSRQIISHWKNCTRHDCPVCLPLKNASDKRNQQTILGSPASGIQNTIGSVGTGQQNATSLSNPNPIDPSSMQRAYAALGLPYMNQPQTQLQPQVPGQQPAQPQTHQQMRTLNPLGNNPMNIPAGGITTDQQPPNLISESALPTSLGATNPLMNDGSNSGNIGTLSTIPTAAPPSSTGVRKGWHEHVTQDLRSHLVHKLVQAIFPTPDPAALKDRRMENLVAYAKKVEGDMYESANSRDEYYHLLAEKIYKIQKELEEKRRSRLHKQGILGNQPALPAPGAQPPVIPQAQPVRPPNGPLSLPVNRMQVSQGMNSFNPMSLGNVQLPQAPMGPRAASPMNHSVQMNSMGSVPGMAISPSRMPQPPNMMGAHTNNMMAQAPAQSQFLPQNQFPSSSGAMSVGMGQPPAQTGVSQGQVPGAALPNPLNMLGPQASQLPCPPVTQSPLHPTPPPASTAAGMPSLQHTTPPGMTPPQPAAPTQPSTPVSSSGQTPTPTPGSVPSATQTQSTPTVQAAAQAQVTPQPQTPVQPPSVATPQSSQQQPTPVHAQPPGTPLSQAAASIDNRVPTPSSVASAETNSQQPGPDVPVLEMKTETQAEDTEPDPGESKGEPRSEMMEEDLQGASQVKEETDIAEQKSEPMEVDEKKPEVKVEVKEEEESSSNGTASQSTSPSQPRKKIFKPEELRQALMPTLEALYRQDPESLPFRQPVDPQLLGIPDYFDIVKNPMDLSTIKRKLDTGQYQEPWQYVDDVWLMFNNAWLYNRKTSRVYKFCSKLAEVFEQEIDPVMQSLGYCCGRKVQF

SEQ ID NO: 900033 - protein, 103 aa, Homo sapiens [sequence omitted]

SEQ ID NO: 900034 - protein, 865 aa, Homo sapiens
RPMPRLEPTFEIDEEEEEEDENELFPREYFRRLSSQDVLRCQSSSKRKSKDEEEDEESDDADDFGSLFDLENDLPDELIPNGGELGLLNSGNLVPDAASKHKQLSELLRGGSGSSINPGIGNVSASSPVQQGLGGQAQGQPNSANMASLSAMGKSPLSQGDSSAPSLPKQAASTSGPTPAASQALNPQAQKQVGLATSSPATSQTGPGICMNANFNQTHPGLLNSNSGHSLINQASQGQAQVMNGSLGAAGRGRGAGMPYPTPAMQGASSSVLAETLTQVSPQMTGHAGLNTAQAGGMAKMGITGNTSPFGQPFSQAGGQPMGATGVNPQLASKQSMVNSLPTFPTDIKNTSVTNVPNMSQMQTSVGIVPTQAIATGPTADPEKRKLIQQQLVLLLHAHKCQRREQANGEVRACSLPHCRTMKNVLNHMTHCQAGKACQVAHCASSRQIISHWKNCTRHDCPVCLPLKNASDKRNQQTILGSPASGIQNTIGSVGTGQQNATSLSNPNPIDPSSMQRAYAALGLPYMNQPQTQLQPQVPGQQPAQPQTHQQMRTLNPLGNNPMNIPAGGITTDQQPPNLISESALPTSLGATNPLMNDGSNSGNIGTLSTIPTAAPPSSTGVRKGWHEHVTQDLRSHLVHKLVQAIFPTPDPAALKDRRMENLVAYAKKVEGDMYESANSRDEYYHLLAEKIYKIQKELEEKRRSRLHKQGILGNQPALPAPGAQPPVIPQAQPVRPPNGPLSLPVNRMQVSQGMNSFNPMSLGNVQLPQAPMGPRAASPMNHSVQMNSMGSVPGMAISPSRMPQPPNMMGAHTNNMMAQAPAQSQFLPQNQFPSSSGAMSVGMGQPPAQTGVSQVLCPTGTVAP

SEQ ID NO: 900035 - protein, 850 aa, Homo sapiens
RPMPRLEPTFEIDEEEEEEDENELFPREYFRRLSSQDVLRCQSSSKRKSKDEEEDEESDDADDFGSLFDLENDLPDELIPNGGELGLLNSGNLVPDAASKHKQLSELLRGGSGSSINPGIGNVSASSPVQQGLGGQAQGQPNSANMASLSAMGKSPLSQGDSSAPSLPKQAASTSGPTPAASQALNPQAQKQVGLATSSPATSQTGPGICMNANFNQTHPGLLNSNSGHSLINQASQGQAQVMNGSLGAAGRGRGAGMPYPTPAMQGASSSVLAETLTQVSPQMTGHAGLNTAQAGGMAKMGITGNTSPFGQPFSQAGGQPMGATGVNPQLASKQSMVNSLPTFPTDIKNTSVTNVPNMSQMQTSVGIVPTQAIATGPTADPEKRKLIQQQLVLLLHAHKCQRREQANGEVRACSLPHCRTMKNVLNHMTHCQAGKACQVAHCASSRQIISHWKNCTRHDCPVCLPLKNASDKRNQQTILGSPASGIQNTIGSVGTGQQNATSLSNPNPIDPSSMQRAYAALGLPYMNQPQTQLQPQVPGQQPAQPQTHQQMRTLNPLGNNPMNIPAGGITTDQQPPNLISESALPTSLGATNPLMNDGSNSGNIGTLSTIPTAAPPSSTGVRKGWHEHVTQDLRSHLVHKLVQAIFPTPDPAALKDRRMENLVAYAKKVEGDMYESANSRDEYYHLLAEKIYKIQKELEEKRRSRLHKQGILGNQPALPAPGAQPPVIPQAQPVRPPRMNSFNPMSLGNVQLPQAPMGPRAASPMNHSVQMNSMGSVPGMAISPSRMPQPPNMMGAHTNNMMAQAPAQSQFLPQNQFPSSSGAMSVGMGQPPAQTGVSQVLCPTGTVAP

SEQ ID NO: 900036 - protein, 439 aa, Homo sapiens
RPMPRLEPTFEIDEEEEEEDENELFPREYFRRLSSQDVLRCQSSSKRKSKDEEEDEESDDADDFGSLFDLENDLPDELIPNGGELGLLNSGNLVPDAASKHKQLSELLRGGSGSSINPGIGNVSASSPVQQGLGGQAQGQPNSANMASLSAMGKSPLSQGDSSAPSLPKQAASTSGPTPAASQALNPQAQKQVGLATSSPATSQTGPGICMNANFNQTHPGLLNSNSGHSLINQASQGQAQVMNGSLGAAGRGRGAGMPYPTPAMQGASSSVLAETLTQVSPQMTGHAGLNTAQAGGMAKMGITGNTSPFGQPFSQAGGQPMGATGVNPQLASKQSMVNSLPTFPTDIKNTSVTNVPNMSQMQTSVGIVPTQAIATGPTADPEKRKLIQQQLVLLLHAHKCQRREPLELNPQLASKQSMVNSLPTFPTDIKNTSVTNVP

SEQ ID NO: 900037 - protein, 94 aa, Homo sapiens
MAENLLDGPPNPKRAKLSSPGFSANDSTDNMNDDSSNLKEGSKDNPEPLKCKQVWPKGTKRGLSKWRQNKERKTGFKLNLYTPPETPMEPDEQV

SEQ ID NO: 900038 - protein, 68 aa, Homo sapiens
MAENLLDGPPNPKRAKLSSPGFSANDSTDTPILKPVSLLRKRDVKNSPLEPDTSTPLKKKKGWPKGKS

SEQ ID NO: 900039 - protein, 2442 aa, Homo sapiens; identical to SEQ ID NO: 900019

SEQ ID NO: 900040 - protein, 2476 aa, Homo sapiens
RPMPRLEPTFEIDEEEEEEDENELFPREYFRRLSSQDVLRCQSSSKRKSKDEEEDEESDDADDFGSLFDLENDLPDELIPNGGELGLLNSGNLVPDAASKHKQLSELLRGGSGSSINPGIGNVSASSPVQQGLGGQAQGQPNSANMASLSAMGKSPLSQGDSSAPSLPKQAASTSGPTPAASQALNPQAQKQVGLATSSPATSQTGPGICMNANFNQTHPGLLNSNSGHSLINQASQGQAQVMNGSLGAAGRGRGAGMPYPTPAMQGASSSVLAETLTQVSPQMTGHAGLNTAQAGGMAKMGITGNTSPFGQPFSQAGGQPMGATGVNPQLASKQSMVNSLPTFPTDIKNTSVTNVPNMSQMQTSVGIVPTQAIATGPTADPEKRKLIQQQLVLLLHAHKCQRREQANGEVRACSLPHCRTMKNVLNHMTHCQAGKACQVAHCASSRQIISHWKNCTRHDCPVCLPLKNASDKRNQQTILGSPASGIQNTIGSVGTGQQNATSLSNPNPIDPSSMQRAYAALGLPYMNQPQTQLQPQVPGQQPAQPQTHQQMRTLNPLGNNPMNIPAGGITTDQQPPNLISESALPTSLGATNPLMNDGSNSGNIGTLSTIPTAAPPSSTGVRKGWHEHVTQDLRSHLVHKLVQAIFPTPDPAALKDRRMENLVAYAKKVEGDMYESANSRDEYYHLLAEKIYKIQKELEEKRRSRLHKQGILGNQPALPAPGAQPPVIPQAQPVRPPNGPLSLPVNRMQVSQGMNSFNPMSLGNVQLPQAPMGPRAASPMNHSVQMNSMGSVPGMAISPSRMPQPPNMMGAHTNNMMAQAPAQSQFLPQNQFPSSSGAMSVGMGQPPAQTGVSQGQVPGAALPNPLNMLGPQASQLPCPPVTQSPLHPTPPPASTAAGMPSLQHTTPPGMTPPQPAAPTQPSTPVSSSGQTPTPTPGSVPSATQTQSTPTVQAAAQAQVTPQPQTPVQPPSVATPQSSQQQPTPVHAQPPGTPLSQAAASIDNRVPTPSSVASAETNSQQPGPDVPVLEMKTETQAEDTEPDPGESKGEPRSEMMEEDLQGASQVKEETDIAEQKSEPMEVDEKKPEVKVEVKEEEESSSNGTASQSTSPSQPRKKIFKPEELRQALMPTLEALYRQDPESLPFRQPVDPQLLGIPDYFDIVKNPMDLSTIKRKLDTGQYQEPWQYVDDVWLMFNNAWLYNRKTSRVYKFCSKLAEVFEQEIDPVMQSLGYCCGRKYEFSPQTLCCYGKQLCTIPRDAAYYSYQNRYHFCEKCFTEIQGENVTLGDDPSQPQTTISKDQFEKKKNDTLDPEPFVDCKECGRKMHQICVLHYDIIWPSGFVCDNCLKKTGRPRKENKFSAKRLQTTRLGNHLEDRVNKFLRRQNHPEAGEVFVRVVASSDKTVEVKPGMKSRFVDSGEMSESFPYRTKALFAFEEIDGVDVCFFGMHVQEYGSDCPPPNTRRVYISYLDSIHFFRPRCLRTAVYHEILIGYLEYVKKLGYVTGHIWACPPSEGDDYIFHCHPPDQKIPKPKRLQEWYKKMLDKAFAERIIHDYKDIFKQATEDRLTSAKELPYFEGDFWPNVLEESIKELEQEEEERKKEESTAASETTEGSQGDSKNAKKKNNKKTNKNKSSISRANKKKPSMPNVSNDLSQKLYATMEKHKEVFFVIHLHAGPVINTLPPIVDPDPLLSCDLMDGRDAFLTLARDKHWEFSSLRRSKWSTLCMLVELHTQGQDRFVYTCNECKHHVETRWHCTVCEDYDLCINCYNTKSHAHKMVKWGLGLDDEGSSQGEPQSKSPQESRRLSIQRCIQSLVHACQCRNANCSLPSCQKMKRVVQHTKGCKRKTNGGCPVCKQLIALCCYHAKHCQENKCPVPFCLNIKHKLRQQQIQHRLQQAQLMRRRMATMNTRNVPQQSLPSPTSAPPGTPTQQPSTPQTPQPPAQPQPSPVSMSPAGFPSVARTQPPTTVSTGKPTSQVPAPPPPAQPPPAAVEAARQIEREAQQQQHLYRVNINNSMPPGRTGMGTPGSQMAPVSLNVPRPNQVSGPVMPSMPPGQWQQAPLPQQQPMPGLPRPVISMQAQAAVAGPRMPSVQPPRSISPSALQDLLRTLKSPSSPQQQQQVLNILKSNPQLMAAFIKQRTAKYVANQPGMQPQPGLQSQPGMQPQPGMHQQPSLQNLNAMQAGVPRPGVPPQQQAMGGLNPQGQALNIMNPGHNPNMASMNPQYREMLRRQLLQQQQQQQQQQQQQQQQQQGSAGMAGGMAGHGQFQQPQGPGGYPPAMQQQQRMQQHLPLQGSSMGQMAAQMGQLGQMGQPGLGADSTPNIQQALQQRILQQQQMKQQIGSPGQPNPMSPQQHMLSGQPQASHLPGQQIATSLSNQVRSPAPVQSPRPQSQPPHSSPSPRIQPQPSPHHVSPQTGSPHPGLAVTMASSIDQGHLGNPEQSAMLPQLNTPSRSALSSELSLVGDTTGDTLEKFVEGL

SEQ ID NO: 900041 - protein, 2438 aa, Homo sapiens
RPMPRLEPTFEIDEEEEEEDENELFPREYFRRLSSQDVLRCQSSSKRKSKDEEEDEESDDADDFGSLFDLENDLPDELIPNGGELGLLNSGNLVPDAASKHKQLSELLRGGSGSSINPGIGNVSASSPVQQGLGGQAQGQPNSANMASLSAMGKSPLSQGDSSAPSLPKQAASTSGPTPAASQALNPQAQKQVGLATSSPATSQTGPGICMNANFNQTHPGLLNSNSGHSLINQASQGQAQVMNGSLGAAGRGRGAGMPYPTPAMQGASSSVLAETLTQVSPQMTGHAGLNTAQAGGMAKMGITGNTSPFGQPFSQAGGQPMGATGVNPQLASKQSMVNSLPTFPTDIKNTSVTNVPNMSQMQTSVGIVPTQAIATGPTADPEKRKLIQQQLVLLLHAHKCQRREQANGEVRACSLPHCRTMKNVLNHMTHCQAGKACQAILGSPASGIQNTIGSVGTGQQNATSLSNPNPIDPSSMQRAYAALGLPYMNQPQTQLQPQVPGQQPAQPQTHQQMRTLNPLGNNPMNIPAGGITTDQQPPNLISESALPTSLGATNPLMNDGSNSGNIGTLSTIPTAAPPSSTGVRKGWHEHVTQDLRSHLVHKLVQAIFPTPDPAALKDRRMENLVAYAKKVEGDMYESANSRDEYYHLLAEKIYKIQKELEEKRRSRLHKQGILGNQPALPAPGAQPPVIPQAQPVRPPNGPLSLPVNRMQVSQGMNSFNPMSLGNVQLPQAPMGPRAASPMNHSVQMNSMGSVPGMAISPSRMPQPPNMMGAHTNNMMAQAPAQSQFLPQNQFPSSSGAMSVGMGQPPAQTGVSQGQVPGAALPNPLNMLGPQASQLPCPPVTQSPLHPTPPPASTAAGMPSLQHTTPPGMTPPQPAAPTQPSTPVSSSGQTPTPTPGSVPSATQTQSTPTVQAAAQAQVTPQPQTPVQPPSVATPQSSQQQPTPVHAQPPGTPLSQAAASIDNRVPTPSSVASAETNSQQPGPDVPVLEMKTETQAEDTEPDPGESKGEPRSEMMEEDLQGASQVKEETDIAEQKSEPMEVDEKKPEVKVEVKEEEESSSNGTASQSTSPSQPRKKIFKPEELRQALMPTLEALYRQDPESLPFRQPVDPQLLGIPDYFDIVKNPMDLSTIKRKLDTGQYQEPWQYVDDVWLMFNNAWLYNRKTSRVYKFCSKLAEVFEQEIDPVMQSLGYCCGRKYEFSPQTLCCYGKQLCTIPRDAAYYSYQNRYHFCEKCFTEIQGENVTLGDDPSQPQTTISKDQFEKKKNDTLDPEPFVDCKECGRKMHQICVLHYDIIWPSGFVCDNCLKKTGRPRKENKFSAKRLQTTRLGNHLEDRVNKFLRRQNHPEAGEVFVRVVASSDKTVEVKPGMKSRFVDSGEMSESFPYRTKALFAFEEIDGVDVCFFGMHVQEYGSDCPPPNTRRVYISYLDSIHFFRPRCLRTAVYHEILIGYLEYVKKLGYVTGHIWACPPSEGDDYIFHCHPPDQKIPKPKRLQEWYKKMLDKAFAERIIHDYKDIFKQATEDRLTSAKELPYFEGDFWPNVLEESIKELEQEEEERKKEESTAASETTEGSQGDSKNAKKKNNKKTNKNKSSISRANKKKPSMPNVSNDLSQKLYATMEKHKEVFFVIHLHAGPVINTLPPIVDPDPLLSCDLMDGRDAFLTLARDKHWEFSSLRRSKWSTLCMLVELHTQGQDRFVYTCNECKHHVETRWHCTVCEDYDLCINCYNTKSHAHKMVKWGLGLDDEGSSQGEPQSKSPQESRRLSIQRCIQSLVHACQCRNANCSLPSCQKMKRVVQHTKGCKRKTNGGCPVCKQLIALCCYHAKHCQENKCPVPFCLNIKHKLRQQQIQHRLQQAQLMRRRMATMNTRNVPQQSLPSPTSAPPGTPTQQPSTPQTPQPPAQPQPSPVSMSPAGFPSVARTQPPTTVSTGKPTSQVPAPPPPAQPPPAAVEAARQIEREAQQQQHLYRVNINNSMPPGRTGMGTPGSQMAPVSLNVPRPNQVSGPVMPSMPPGQWQQAPLPQQQPMPGLPRPVISMQAQAAVAGPRMPSVQPPRSISPSALQDLLRTLKSPSSPQQQQQVLNILKSNPQLMAAFIKQRTAKYVANQPGMQPQPGLQSQPGMQPQPGMHQQPSLQNLNAMQAGVPRPGVPPQQQAMGGLNPQGQALNIMNPGHNPNMASMNPQYREMLRRQLLQQQQQQQQQQQQQQQQQQGSAGMAGGMAGHGQFQQPQGPGGYPPAMQQQQRMQQHLPLQGSSMGQMAAQMGQLGQMGQPGLGADSTPNIQQALQQRILQQQQMKQQIGSPGQPNPMSPQQHMLSGQPQASHLPGQQIATSLSNQVRSPAPVQSPRPQSQPPHSSPSPRIQPQPSPHHVSPQTGSPHPGLAVTMASSIDQGHLGNPEQSAMLPQLNTPSRSALSSELSLVGDTTGDTLEKFVEGL

SEQ ID NO: 900042 - protein, 2442 aa, Homo sapiens; identical to SEQ ID NO: 900019

SEQ ID NO: 900043 - protein, 1722 aa, Homo sapiens
MNSFNPMSLGNVQLPQAPMGPRAASPMNHSVQMNSMGSVPGMAISPSRMPQPPNMMGAHTNNMMAQAPAQSQFLPQNQFPSSSGAMSVGMGQPPAQTGVSQGQVPGAALPNPLNMLGPQASQLPCPPVTQSPLHPTPPPASTAAGMPSLQHTTPPGMTPPQPAAPTQPSTPVSSSGQTPTPTPGSVPSATQTQSTPTVQAAAQAQVTPQPQTPVQPPSVATPQSSQQQPTPVHAQPPGTPLSQAAASIDNRVPTPSSVASAETNSQQPGPDVPVLEMKTETQAEDTEPDPGESKGEPRSEMMEEDLQGASQVKEETDIAEQKSEPMEVDEKKPEVKVEVKEEEESSSNGTASQSTSPSQPRKKIFKPEELRQALMPTLEALYRQDPESLPFRQPVDPQLLGIPDYFDIVKNPMDLSTIKRKLDTGQYQEPWQYVDDVWLMFNNAWLYNRKTSRVYKFCSKLAEVFEQEIDPVMQSLGYCCGRKYEFSPQTLCCYGKQLCTIPRDAAYYSYQNRYHFCEKCFTEIQGENVTLGDDPSQPQTTISKDQFEKKKNDTLDPEPFVDCKECGRKMHQICVLHYDIIWPSGFVCDNCLKKTGRPRKENKFSAKRLQTTRLGNHLEDRVNKFLRRQNHPEAGEVFVRVVASSDKTVEVKPGMKSRFVDSGEMSESFPYRTKALFAFEEIDGVDVCFFGMHVQEYGSDCPPPNTRRVYISYLDSIHFFRPRCLRTAVYHEILIGYLEYVKKLGYVTGHIWACPPSEGDDYIFHCHPPDQKIPKPKRLQEWYKKMLDKAFAERIIHDYKDIFKQATEDRLTSAKELPYFEGDFWPNVLEESIKELEQEEEERKKEESTAASETTEGSQGDSKNAKKKNNKKTNKNKSSISRANKKKPSMPNVSNDLSQKLYATMEKHKEVFFVIHLHAGPVINTLPPIVDPDPLLSCDLMDGRDAFLTLARDKHWEFSSLRRSKWSTLCMLVELHTQGQDRFVYTCNECKHHVETRWHCTVCEDYDLCINCYNTKSHAHKMVKWGLGLDDEGSSQGEPQSKSPQESRRLSIQRCIQSLVHACQCRNANCSLPSCQKMKRVVQHTKGCKRKTNGGCPVCKQLIALCCYHAKHCQENKCPVPFCLNIKHKLRQQQIQHRLQQAQLMRRRMATMNTRNVPQQSLPSPTSAPPGTPTQQPSTPQTPQPPAQPQPSPVSMSPAGFPSVARTQPPTTVSTGKPTSQVPAPPPPAQPPPAAVEAARQIEREAQQQQHLYRVNINNSMPPGRTGMGTPGSQMAPVSLNVPRPNQVSGPVMPSMPPGQWQQAPLPQQQPMPGLPRPVISMQAQAAVAGPRMPSVQPPRSISPSALQDLLRTLKSPSSPQQQQQVLNILKSNPQLMAAFIKQRTAKYVANQPGMQPQPGLQSQPGMQPQPGMHQQPSLQNLNAMQAGVPRPGVPPQQQAMGGLNPQGQALNIMNPGHNPNMASMNPQYREMLRRQLLQQQQQQQQQQQQQQQQQQGSAGMAGGMAGHGQFQQPQGPGGYPPAMQQQQRMQQHLPLQGSSMGQMAAQMGQLGQMGQPGLGADSTPNIQQALQQRILQQQQMKQQIGSPGQPNPMSPQQHMLSGQPQASHLPGQQIATSLSNQVRSPAPVQSPRPQSQPPHSSPSPRIQPQPSPHHVSPQTGSPHPGLAVTMASSIDQGHLGNPEQSAMLPQLNTPSRSALSSELSLVGDTTGDTLEKFVEGL

SEQ ID NO: 900044 - protein, 2442 aa, Homo sapiens; identical to SEQ ID NO: 900019

SEQ ID NO: 900045 - protein, 1422 aa, Homo sapiens
MMEEDLQGASQVKEETDIAEQKSEPMEVDEKKPEVKVEVKEEEESSSNGTASQSTSPSQPRKKIFKPEELRQALMPTLEALYRQDPESLPFRQPVDPQLLGIPDYFDIVKNPMDLSTIKRKLDTGQYQEPWQYVDDVWLMFNNAWLYNRKTSRVYKFCSKLAEVFEQEIDPVMQSLGYCCGRKYEFSPQTLCCYGKQLCTIPRDAAYYSYQNRYHFCEKCFTEIQGENVTLGDDPSQPQTTISKDQFEKKKNDTLDPEPFVDCKECGRKMHQICVLHYDIIWPSGFVCDNCLKKTGRPRKENKFSAKRLQTTRLGNHLEDRVNKFLRRQNHPEAGEVFVRVVASSDKTVEVKPGMKSRFVDSGEMSESFPYRTKALFAFEEIDGVDVCFFGMHVQEYGSDCPPPNTRRVYISYLDSIHFFRPRCLRTAVYHEILIGYLEYVKKLGYVTGHIWACPPSEGDDYIFHCHPPDQKIPKPKRLQEWYKKMLDKAFAERIIHDYKDIFKQATEDRLTSAKELPYFEGDFWPNVLEESIKELEQEEEERKKEESTAASETTEGSQGDSKNAKKKNNKKTNKNKSSISRANKKKPSMPNVSNDLSQKLYATMEKHKEVFFVIHLHAGPVINTLPPIVDPDPLLSCDLMDGRDAFLTLARDKHWEFSSLRRSKWSTLCMLVELHTQGQDRFVYTCNECKHHVETRWHCTVCEDYDLCINCYNTKSHAHKMVKWGLGLDDEGSSQGEPQSKSPQESRRLSIQRCIQSLVHACQCRNANCSLPSCQKMKRVVQHTKGCKRKTNGGCPVCKQLIALCCYHAKHCQENKCPVPFCLNIKHKLRQQQIQHRLQQAQLMRRRMATMNTRNVPQQSLPSPTSAPPGTPTQQPSTPQTPQPPAQPQPSPVSMSPAGFPSVARTQPPTTVSTGKPTSQVPAPPPPAQPPPAAVEAARQIEREAQQQQHLYRVNINNSMPPGRTGMGTPGSQMAPVSLNVPRPNQVSGPVMPSMPPGQWQQAPLPQQQPMPGLPRPVISMQAQAAVAGPRMPSVQPPRSISPSALQDLLRTLKSPSSPQQQQQVLNILKSNPQLMAAFIKQRTAKYVANQPGMQPQPGLQSQPGMQPQPGMHQQPSLQNLNAMQAGVPRPGVPPQQQAMGGLNPQGQALNIMNPGHNPNMASMNPQYREMLRRQLLQQQQQQQQQQQQQQQQQQGSAGMAGGMAGHGQFQQPQGPGGYPPAMQQQQRMQQHLPLQGSSMGQMAAQMGQLGQMGQPGLGADSTPNIQQALQQRILQQQQMKQQIGSPGQPNPMSPQQHMLSGQPQASHLPGQQIATSLSNQVRSPAPVQSPRPQSQPPHSSPSPRIQPQPSPHHVSPQTGSPHPGLAVTMASSIDQGHLGNPEQSAMLPQLNTPSRSALSSELSLVGDTTGDTLEKFVEGL

SEQ ID NO: 900046 - protein, 937 aa, Homo sapiens [sequence omitted]

SEQ ID NO: 900047 - protein, 675 aa, Homo sapiens
LGKRENWLSEWWLKTASCRNANCSLPSCQKMKRVVQHTKGCKRKTNGGCPVCKQLIALCCYHAKHCQENKCPVPFCLNIKHKLRQQQIQHRLQQAQLMRRRMATMNTRNVPQQSLPSPTSAPPGTPTQQPSTPQTPQPPAQPQPSPVSMSPAGFPSVARTQPPTTVSTGKPTSQVPAPPPPAQPPPAAVEAARQIEREAQQQQHLYRVNINNSMPPGRTGMGTPGSQMAPVSLNVPRPNQVSGPVMPSMPPGQWQQAPLPQQQPMPGLPRPVISMQAQAAVAGPRMPSVQPPRSISPSALQDLLRTLKSPSSPQQQQQVLNILKSNPQLMAAFIKQRTAKYVANQPGMQPQPGLQSQPGMQPQPGMHQQPSLQNLNAMQAGVPRPGVPPQQQAMGGLNPQGQALNIMNPGHNPNMASMNPQYREMLRRQLLQQQQQQQQQQQQQQQQQQGSAGMAGGMAGHGQFQQPQGPGGYPPAMQQQQRMQQHLPLQGSSMGQMAAQMGQLGQMGQPGLGADSTPNIQQALQQRILQQQQMKQQIGSPGQPNPMSPQQHMLSGQPQASHLPGQQIATSLSNQVRSPAPVQSPRPQSQPPHSSPSPRIQPQPSPHHVSPQTGSPHPGLAVTMASSIDQGHLGNPEQSAMLPQLNTPSRSALSSELSLVGDTTGDTLEKFVEGL

SEQ ID NO: 900048 - protein, 1496 aa, Homo sapiens
RPMPRLEPTFEIDEEEEEEDENELFPREYFRRLSSQDVLRCQSSSKRKSKDEEEDEESDDADDFGSLFDLENDLPDELIPNGGELGLLNSGNLVPDAASKHKQLSELLRGGSGSSINPGIGNVSASSPVQQGLGGQAQGQPNSANMASLSAMGKSPLSQGDSSAPSLPKQAASTSGPTPAASQALNPQAQKQVGLATSSPATSQTGPGICMNANFNQTHPGLLNSNSGHSLINQASQGQAQVMNGSLGAAGRGRGAGMPYPTPAMQGASSSVLAETLTQVSPQMTGHAGLNTAQAGGMAKMGITGNTSPFGQPFSQAGGQPMGATGVNPQLASKQSMVNSLPTFPTDIKNTSVTNVPNMSQMQTSVGIVPTQAIATGPTADPEKRKLIQQQLVLLLHAHKCQRREQANGEVRACSLPHCRTMKNVLNHMTHCQAGKACQVAHCASSRQIISHWKNCTRHDCPVCLPLKNASDKRNQQTILGSPASGIQNTIGSVGTGQQNATSLSNPNPIDPSSMQRAYAALGLPYMNQPQTQLQPQVPGQQPAQPQTHQQMRTLNPLGNNPMNIPAGGITTDQQPPNLISESALPTSLGATNPLMNDGSNSGNIGTLSTIPTAAPPSSTGVRKGWHEHVTQDLRSHLVHKLVQAIFPTPDPAALKDRRMENLVAYAKKVEGDMYESANSRDEYYHLLAEKIYKIQKELEEKRRSRLHKQGILGNQPALPAPGAQPPVIPQAQPVRPPNGPLSLPVNRMQVSQGMNSFNPMSLGNVQLPQAPMGPRAASPMNHSVQMNSMGSVPGMAISPSRMPQPPNMMGAHTNNMMAQAPAQSQFLPQNQFPSSSGAMSVGMGQPPAQTGVSQGQVPGAALPNPLNMLGPQASQLPCPPVTQSPLHPTPPPASTAAGMPSLQHTTPPGMTPPQPAAPTQPSTPVSSSGQTPTPTPGSVPSATQTQSTPTVQAAAQAQVTPQPQTPVQPPSVATPQSSQQQPTPVHAQPPGTPLSQAAASIDNRVPTPSSVASAETNSQQPGPDVPVLEMKTETQAEDTEPDPGESKGEPRSEMMEEDLQGASQVKEETDIAEQKSEPMEVDEKKPEVKVEVKEEEESSSNGTASQSTSPSQPRKKIFKPEELRQALMPTLEALYRQDPESLPFRQPVDPQLLGIPDYFDIVKNPMDLSTIKRKLDTGQYQEPWQYVDDVWLMFNNAWLYNRKTSRVYKFCSKLAEVFEQEIDPVMQSLGYCCGRKYEFSPQTLCCYGKQLCTIPRDAAYYSYQNRYHFCEKCFTEIQGENVTLGDDPSQPQTTISKDQFEKKKNDTLDPEPFVDCKECGRKMHQICVLHYDIIWPSGFVCDNCLKKTGRPRKENKFSAKRLQTTRLGNHLEDRVNKFLRRQNHPEAGEVFVRVVASSDKTVEVKPGMKSRYVTGHIWACPPSEGDDYIFHCHPPDQKIPKPKRLQEWYKKMLDKAFAERIIHDYKVPGAEGRWWLLSQLRGGYLCAFFLHSHTC

SEQ ID NO: 900049 - protein, 1237 aa, Homo sapiens
RPMPRLEPTFEIDEEEEEEDENELFPREYFRRLSSQDVLRCQSSSKRKSKDEEEDEESDDADDFGSLFDLENDLPDELIPNGGELGLLNSGNLVPDAASKHKQLSELLRGGSGSSINPGIGNVSASSPVQQGLGGQAQGQPNSANMASLSAMGKSPLSQGDSSAPSLPKQAASTSGPTPAASQALNPQAQKQVGLATSSPATSQTGPGICMNANFNQTHPGLLNSNSGHSLINQASQGQAQVMNGSLGAAGRGRGAGMPYPTPAMQGASSSVLAETLTQVSPQMTGHAGLNTAQAGGMAKMGITGNTSPFGQPFSQAGGQPMGATGVNPQLASKQSMVNSLPTFPTDIKNTSVTNVPNMSQMQTSVGIVPTQAIATGPTADPEKRKLIQQQLVLLLHAHKCQRREQANGEVRACSLPHCRTMKNVLNHMTHCQAGKACQVAHCASSRQIISHWKNCTRHDCPVCLPLKNASDKRNQQTILGSPASGIQNTIGSVGTGQQNATSLSNPNPIDPSSMQRAYAALGLPYMNQPQTQLQPQVPGQQPAQPQTHQQMRTLNPLGNNPMNIPAGGITTDQQPPNLISESALPTSLGATNPLMNDGSNSGNIGTLSTIPTAAPPSSTGVRKGWHEHVTQDLRSHLVHKLVQAIFPTPDPAALKDRRMENLVAYAKKVEGDMYESANSRDEYYHLLAEKIYKIQKELEEKRRSRLHKQGILGNQPALPAPGAQPPVIPQAQPVRPPNGPLSLPVNRMQVSQGMNSFNPMSLGNVQLPQAPMGPRAASPMNHSVQMNSMGSVPGMAISPSRMPQPPNMMGAHTNNMMAQAPAQSQFLPQNQFPSSSGAMSVGMGQPPAQTGVSQGQVPGAALPNPLNMLGPQASQLPCPPVTQSPLHPTPPPASTAAGMPSLQHTTPPGMTPPQPAAPTQPSTPVSSSGQTPTPTPGSVPSATQTQSTPTVQAAAQAQVTPQPQTPVQPPSVATPQSSQQQPTPVHAQPPGTPLSQAAASIDNRVPTPSSVASAETNSQQPGPDVPVLEMKTETQAEDTEPDPGESKGEPRSEMMEEDLQGASQVKEETDIAEQKSEPMEVDEKKPEVKVEVKEEEESSSNGTASQSTSPSQPRKKIFKPEELRQALMPTLEALYRQDPESLPFRQPVDPQLLGIPDYFDIVKNPMDLSTIKRKLDTGQYQEPWQYVDDVWLMFNNAWLYNRKTSRVYKFCSKLNIQGTADRVNFLLKDLCKLTGR

SEQ ID NO: 900050 - protein, 1027 aa, Homo sapiens
RPMPRLEPTFEIDEEEEEEDENELFPREYFRRLSSQDVLRCQSSSKRKSKDEEEDEESDDADDFGSLFDLENDLPDELIPNGGELGLLNSGNLVPDAASKHKQLSELLRGGSGSSINPGIGNVSASSPVQQGLGGQAQGQPNSANMASLSAMGKSPLSQGDSSAPSLPKQAASTSGPTPAASQALNPQAQKQVGLATSSPATSQTGPGICMNANFNQTHPGLLNSNSGHSLINQASQGQAQVMNGSLGAAGRGRGAGMPYPTPAMQGASSSVLAETLTQVSPQMTGHAGLNTAQAGGMAKMGITGNTSPFGQPFSQAGGQPMGATGVNPQLASKQSMVNSLPTFPTDIKNTSVTNVPNMSQMQTSVGIVPTQAIATGPTADPEKRKLIQQQLVLLLHAHKCQRREQANGEVRACSLPHCRTMKNVLNHMTHCQAGKACQVAHCASSRQIISHWKNCTRHDCPVCLPLKNASDKRNQQTILGSPASGIQNTIGSVGTGQQNATSLSNPNPIDPSSMQRAYAALGLPYMNQPQTQLQPQVPGQQPAQPQTHQQMRTLNPLGNNPMNIPAGGITTDQQPPNLISESALPTSLGATNPLMNDGSNSGNIGTLSTIPTAAPPSSTGVRKGWHEHVTQDLRSHLVHKLVQAIFPTPDPAALKDRRMENLVAYAKKVEGDMYESANSRDEYYHLLAEKIYKIQKELEEKRRSRLHKQGILGNQPALPAPGAQPPVIPQAQPVRPPNGPLSLPVNRMQVSQGMNSFNPMSLGNVQLPQAPMGPRAASPMNHSVQMNSMGSVPGMAISPSRMPQPPNMMGAHTNNMMAQAPAQSQFLPQNQFPSSSGAMSVGMGQPPAQTGVSQGQVPGAALPNPLNMLGPQASQLPCPPVTQSPLHPTPPPASTAAGMPSLQHTTPPGMTPPQPAAPTQPSTPVSSSGQTPTPTPGSVPSATQTQSTPTVQAAAQAQVTPQPQTPVQPPSVATPQSSQQQPTPVHAQPPGTPVSLSVSAVFGPRLLEDNFPIKIVCQARRGGSHL

SEQ ID NO: 900051 - protein, 765 aa, Homo sapiens
RPMPRLEPTFEIDEEEEEEDENELFPREYFRRLSSQDVLRCQSSSKRKSKDEEEDEESDDADDFGSLFDLENDLPDELIPNGGELGLLNSGNLVPDAASKHKQLSELLRGGSGSSINPGIGNVSASSPVQQGLGGQAQGQPNSANMASLSAMGKSPLSQGDSSAPSLPKQAASTSGPTPAASQALNPQAQKQVGLATSSPATSQTGPGICMNANFNQTHPGLLNSNSGHSLINQASQGQAQVMNGSLGAAGRGRGAGMPYPTPAMQGASSSVLAETLTQVSPQMTGHAGLNTAQAGGMAKMGITGNTSPFGQPFSQAGGQPMGATGVNPQLASKQSMVNSLPTFPTDIKNTSVTNVPNMSQMQTSVGIVPTQAIATGPTADPEKRKLIQQQLVLLLHAHKCQRREQANGEVRACSLPHCRTMKNVLNHMTHCQAGKACQVAHCASSRQIISHWKNCTRHDCPVCLPLKNASDKRNQQTILGSPASGIQNTIGSVGTGQQNATSLSNPNPIDPSSMQRAYAALGLPYMNQPQTQLQPQVPGQQPAQPQTHQQMRTLNPLGNNPMNIPAGGITTDQQPPNLISESALPTSLGATNPLMNDGSNSGNIGTLSTIPTAAPPSSTGVRKGWHEHVTQDLRSHLVHKLVQAIFPTPDPAALKDRRMENLVAYAKKVEGDMYESANSRDEYYHLLAEKIYKIQKELEEKRRSRLHKQGILGNQPALPAPGAQPPVIPQAQPVRPPSKDFISYCHPLACFLGFPSCWGVFLRT

SEQ ID NO: 900052 - protein, 283 aa, Homo sapiens
RPMPRLEPTFEIDEEEEEEDENELFPREYFRRLSSQDVLRCQSSSKRKSKDEEEDEESDDADDFGSLFDLENDLPDELIPNGGELGLLNSGNLVPDAASKHKQLSELLRGGSGSSINPGIGNVSASSPVQQGLGGQAQGQPNSANMASLSAMGKSPLSQGDSSAPSLPKQAASTSGPTPAASQALNPQAPMGPRAASPMNHSVQMNSMGSVPGMAISPSRMPQPPNMMGAHTNNMMAQAPAQSQFLPQNQFPSSSGAMSVGMGQPPAQTGVSQVLCPTGTVAP

SEQ ID NO: 900053 - protein, 350 aa, Homo sapiens
RPMPRLEPTFEIDEEEEEEDENELFPREYFRRLSSQDVLRCQSSSKRKSKDEEEDEESDDADDFGSLFDLENDLPDELIPNGGELGLLNSGNLVPDAASKHKQLSELLRGGSGSSINPGIGNVSASSPVQQGLGGQAQGQPNSANMASLSAMGKSPLSQGDSSAPSLPKQAASTSGPTPAASQALNPQAQKQVGLATSSPATSQTGPGICMNANFNQTHPGLLNSNSGHSLINQASQGQAQVMNGSLGAAGRGRGAGMPYPTPAMQGASSSVLAETLTQVSPQMTGHAGLNTAQAGGMAKVSELKHFQYFLPNRGLSLRVMRKMGPRGPLLFFLLGSPRATHAWKRQISF

SEQ ID NO: 900054 - protein, 167 aa, Homo sapiens
MPIRPDLQQLEKCIDDALRKNDFKPLKTLLQIDICEDVKIKCSKQFFHKVDNLICRELNKEDIHNVSAILVSVGRCGKNISVLGQAGLLTMIKQGLIQKMVAWFEKSKDIIQSQGNSKDEAVLNMIEDLVDLLLGHTMMSGMKVTKPVCGKGLGPRHLVPVVIGLQE

SEQ ID NO: 900055 - protein, 993 aa, Homo sapiens
MSEASMIVSGADRYTMRSPVLFSNTSIPPRRRRIKPPLQMTSSAEKPSVSQTSENRVDNAASLKSRSSEGRHRRDNIDKHIKTAKCVENTENKNVEFPNQNFSELQDVIPDSQAAEKRDHTILPGVLDNICGNKIHSKWACWTPVTNIELCNNQRASTSSGDTLNQDIVINKKLTKQKSSSSISDHNSEGTGKVKYKKEQTDHIKIDKAEVEVCKKHNQQQNHPKYSGQKNTENAKQSDWPVESETTFKSVLLNKTIEESLIYRKKYILSKDVNTATCDKNPSASKNVQSHRKAEKELTSELNSWDSKQKKMREKSKGKEFTNVAESLISQINKRYKTKDDIKSTRKLKESLINSGFSNKPVVQLSKEKVQKKSYRKLKTTFVNVTSECPVNDVYNFNLNGADDPIIKLGIQEFQATAKEACADRSIRLVGPRNHDELKSSVKTKDKKIITNHQKKNLFSDTETEYRCDDSKTDISWLREPKSKPQLIDYSRNKNVKNHKSGKSRSSLEKGQPSSKMTPSKNITKKMDKTIPEGRIRLPRKATKTKKNYKDLSNSESECEQEFSHSFKENIPVKEENIHSRMKTVKLPKKQQKVFCAETEKELSKQWKNSSLLKDAIRDNCLDLSPRSLSGSPSSIEVTRCIEKITEKDFTQDYDCITKSISPYPKTSSLESLNSNSGVGGTIKSPKNNEKNFLCASESCSPTPRPLFLARHTPTKSNTIVNRKKISSLVLTQETQNSNSYSDVSRYSSEERFMEIESPHINENYIQSKREESHLASSLSKSSEGREKTWFDMPCDATHVSGPTQHLSRKRIYIEDNLSNSNEVEMEEKGERRANLLPKKLCKIEDADHHIHKMSESVSSLSTNDFSIPWETWQNEFAGIEMTYETYERLNSEFKRRNNIRHKMLSYFTTQSWKTAQQHLRTMNHQSQDSRIKKLDKFQFIIIEELENFEKDSQSLKDLEKEFVDFWEKIFQKFSALSKKRTTEASSFENFIG

SEQ ID NO: 900056 - protein, 993 aa, Homo sapiens; identical to SEQ ID NO: 900055

SEQ ID NO: 900057 - protein, 1469 aa, Homo sapiens
MPIRPDLQQLEKCIDDALRKNDFKPLKTLLQIDICEDVKIKCSKQFFHKVDNLICRELNKEDIHNVSAILVSVGRCGKNISVLGQAGLLTMIKQGLIQKMVAWFEKSKDIIQSQGNSKDEAVLNMIEDLVDLLLVIHDVSDEGKKQVVESFVPRICSLVIDSRVNICIQQEIIKKMNAMLDKMPQDARKILSNQEMLILMSSMGERILDAGDYDLQVAIVEALCRMTTEKQRQELAHQWFSMDFIAKAFKRIKDSEFETDCRIFLNLVNGMLGDKRRVFTFPCLSAFLDKYELQIPSDEKLEEFWIDFNLGSQTLSFYIAGDNDDHQWEAVTVPEEKVQIYSIEVRESKKLLTIILKNTVKISKREGKELLLYFDASLEITNVTQKIFGATKHRESIRKQGISVAKTSLHILFDASGSQILVPESQISPVGEELVSLKEKSKSPKEFAKPSKYIKNSDKGNRNNSQLEKTTPSKRKMSEASMIVSGADRYTMRSPVLFSNTSIPPRRRRIKPPLQMTSSAEKPSVSQTSENRVDNAASLKSRSSEGRHRRDNIDKHIKTAKCVENTENKNVEFPNQNFSELQDVIPDSQAAEKRDHTILPGVLDNICGNKIHSKWACWTPVTNIELCNNQRASTSSGDTLNQDIVINKKLTKQKSSSSISDHNSEGTGKVKYKKEQTDHIKIDKAEVEVCKKHNQQQNHPKYSGQKNTENAKQSDWPVESETTFKSVLLNKTIEESLIYRKKYILSKDVNTATCDKNPSASKNVQSHRKAEKELTSELNSWDSKQKKMREKSKGKEFTNVAESLISQINKRYKTKDDIKSTRKLKESLINSGFSNKPVVQLSKEKVQKKSYRKLKTTFVNVTSECPVNDVYNFNLNGADDPIIKLGIQEFQATAKEACADRSIRLVGPRNHDELKSSVKTKDKKIITNHQKKNLFSDTETEYRCDDSKTDISWLREPKSKPQLIDYSRNKNVKNHKSGKSRSSLEKGQPSSKMTPSKNITKKMDKTIPEGRIRLPRKATKTKKNYKDLSNSESECEQEFSHSFKENIPVKEENIHSRMKTVKLPKKQQKVFCAETEKELSKQWKNSSLLKDAIRDNCLDLSPRSLSGSPSSIEVTRCIEKITEKDFTQDYDCITKSISPYPKTSSLESLNSNSGVGGTIKSPKNNEKNFLCASESCSPTPRPLFLARHTPTKSNTIVNRKKISSLVLTQETQNSNSYSDVSRYSSEERFMEIESPHINENYIQSKREESHLASSLSKSSEGREKTWFDMPCDATHVSGPTQHLSRKRIYIEDNLSNSNEVEMEEKGERRANLLPKKLCKIEDADHHIHKMSESVSSLSTNDFSIPWETWQNEFAGIEMTYETYERLNSEFKRRNNIRHKMLSYFTTQSWKTAQQHLRTMNHQSQDSRIKKLDKFQFIIIEELENFEKDSQSLKDLEKEFVDFWEKIFQKFSALSKKRTTEASSFENFIG

SEQ ID NO: 900058 - protein, 1469 aa, Homo sapiens; identical to SEQ ID NO: 900057

SEQ ID NO: 900059 - protein, 200 aa, Homo sapiens
MPIRPDLQQLEKCIDDALRKNDFKPLKTLLQIDICEDVKIKCSKQFFHKVDNLICRELNKEDIHNVSAILVSVGRCGKNISVLGQAGLLTMIKQGLIQKMVAWFEKSKDIIQSQGNSKDEAVLNMIEDLVDLLLVIHDVSDEGKKQVVESFVPRICSLVIDSRVNICIQQEIIKKMNAMLDKMPQDARKILSNQEMLILM

SEQ ID NO: 900060 - protein, 134 aa, Homo sapiens
NTAISRNPSGLPTPTIKWMKNEEALDTESSERLVLLAGGSLEISDVTEDDAGTYFCIADNGNETIEAQAELTVQAQPEFLKQPTNIYAHESMDIVFECEVTGKPTPTVKWVKNGDMVIPSDYFKIVVFGDPLDQ

SEQ ID NO: 900061 - protein, 1481 aa, Homo sapiens
GPGRAGLEQRRRGSRACSEGPAEARGREGGKGSAALSPPLPLTLGEEMAAERGARRLLSTPSFWLYCLLLLGRRAPGAAAARSGSAPQSPGASIRTFTPFYFLVEPVDTLSVRGSSVILNCSAYSEPSPKIEWKKDGTFLNLVSDDRRQLLPDGSLFISNVVHSKHNKPDEGYYQCVATVESLGTIISRTAKLIVAGLPRFTSQPEPSSVYAGNNAILNCEVNADLVPFVRWEQNRQPLLLDDRVIKLPSGMLVISNATEGDGGLYRCVVESGGPPKYSDEVELKVLPDPEVISDLVFLKQPSPLVRVIGQDVVLPCVASGLPTPTIKWMKNEEALDTESSERLVLLAGGSLEISDVTEDDAGTYFCIADNGNETIEAQAELTVQAQPEFLKQPTNIYAHESMDIVFECEVTGKPTPTVKWVKNGDMVIPSDYFKIVKEHNLQVLGLVKSDEGFYQCIAENDVGNAQAGAQLIILEHAPATTGPLPSAPRDVVASLVSTRFIKLTWRTPASDPHGDNLTYSVFYTKEGIARERVENTSHPGEMQVTIQNLMPATVYIFRVMAQNKHGSGESSAPLRVETQPEVQLPGPAPNLRAYAASPTSITVTWETPVSGNGEIQNYKLYYMEKGTDKEQDVDVSSHSYTINGLKKYTEYSFRVVAYNKHGPGVSTPDVAVRTLSDVPSAAPQNLSLEVRNSKSIMIHWQPPAPATQNGQITGYKIRYRKASRKSDVTETLVSGTQLSQLIEGLDRGTEYNFRVAALTINGTGPATDWLSAETFESDLDETRVPEVPSSLHVRPLVTSIVVSWTPPENQNIVVRGYAIGYGIGSPHAQTIKVDYKQRYYTIENLDPSSHYVITLKAFNNVGEGIPLYESAVTRPHTVPDPTPMMPPVGVQASILSHDTIRITWADNSLPKHQKITDSRYYTVRWKTNIPANTKYKNANATTLSYLVTGLKPNTLYEFSVMVTKGRRSSTWSMTAHGTTFELVPTSPPKDVTVVSKEGKPKTIIVNWQPPSEANGKITGYIIYYSTDVNAEIHDWVIEPVVGNRLTHQIQELTLDTPYYFKIQARNSKGMGPMSEAVQFRTPKASGSGGKGSRLPDLGSDYKPPMSGSNSPHGSPTSPLDSNMLLVIIVSVGVITIVVVVIIAVFCTRRTTSHQKKKRAACKSVNGSHKYKGNSKDVKPPDLWIHHERLELKPIDKSPDPNPIMTDTPIPRNSQDITPVDNSMDSNIHQRRNSYRGHESEDSMSTLAGRRGMRPKMMMPFDSQPPQPVISAHPIHSLDNPHHHFHSSSLASPARSHLYHPGSPWPIGTSMSLSDRANSTESVRNTPSTDTMPASSSQTCCTDHQDPEGATSSSYLASSQEEDSGQSLPTAHVRPSHPLKSFAVPAIPPPGPPTYDPALPSTPLLSQQALNHHIHSVKTASIGTLGRSRPPMPVVVPSAPEVQETTRMLEDSESSYEPDELTKEMAHLEGLMKDLNAITTA

SEQ ID NO: 900062 - protein, 1473 aa, Homo sapiens
GPGRAGLEQRRRGSRACSEGPAEARGREGGKGSAALSPPLPLTLGEEMAAERGARRLLSTPSFWLYCLLLLGRRAPGAAAARSGSAPQSPGASIRTFTPFYFLVEPVDTLSVRGSSVILNCSAYSEPSPKIEWKKDGTFLNLVSDDRRQLLPDGSLFISNVVHSKHNKPDEGYYQCVATVESLGTIISRTAKLIVAGLPRFTSQPEPSSVYAGNNAILNCEVNADLVPFVRWEQNRQPLLLDDRVIKLPSGMLVISNATEGDGGLYRCVVESGGPPKYSDEVELKVLPDPEVISDLVFLKQPSPLVRVIGQDVVLPCVASGLPTPTIKWMKNEEALDTESSERLVLLAGGSLEISDVTEDDAGTYFCIADNGNETIEAQAELTVQAQPEFLKQPTNIYAHESMDIVFECEVTGKPTPTVKWVKNGDMVIPSDYFKIVKEHNLQVLGLVKSDEGFYQCIAENDVGNAQAGAQLIILEHAPATTGPLPSAPRDVVASLVSTRFIKLTWRTPASDPHGDNLTYSVFYTKEGIARERVENTSHPGEMQVTIQNLMPATVYIFRVMAQNKHGSGESSAPLRVETQPEVQLPGPAPNLRAYAASPTSITVTWETPVSGNGEIQNYKLYYMEKGTDKEQDVDVSSHSYTINGLKKYTEYSFRVVAYNKHGPGVSTQTYEHDDVSVYMLEVRNSKSIMIHWQPPAPATQNGQITGYKIRYRKASRKSDVTETLVSGTQLSQLIEGLDRGTEYNFRVAALTINGTGPATDWLSAETFESDLDETRVPEVPSSLHVRPLVTSIVVSWTPPENQNIVVRGYAIGYGIGSPHAQTIKVDYKQRYYTIENLDPSSHYVITLKAFNNVGEGIPLYESAVTRPHTVPDPTPMMPPVGVQASILSHDTIRITWADNSLPKHQKITDSRYYTVRWKTNIPANTKYKNANATTLSYLVTGLKPNTLYEFSVMVTKGRRSSTWSMTAHGTTFELVPTSPPKDVTVVSKEGKPKTIIVNWQPPSEANGKITGYIIYYSTDVNAEIHDWVIEPVVGNRLTHQIQELTLDTPYYFKIQARNSKGMGPMSEAVQFRTPKASGSGGKGSRLPDLGSDYKPPMSGSNSPHGSPTSPLDSNMLLVIIVSVGVITIVVVVIIAVFCTRRTTSHQKKKRAACKSVNGSHKYKGNSKDVKPPDLWIHHERLELKPIDKSPDPNPIMTDTPIPRNSQDITPVDNSMDSNIHQRRNSYRGHESEDSMSTLAGRRGMRPKMMMPFDSQPPQPVISAHPIHSLDNPHHHFHSSSLASPARSHLYHPGSPWPIGTSMSLSDRANSTESVRNTPSTDTMPASSSQTCCTDHQDPEGATSSSYLASSQEEDSGQSLPTAHVRPSHPLKSFAVPAIPPPGPPTYDPALPSTPLLSQQALNHHIHSVKTASIGTLGRSRPPMPVVVPSAPEVQETTRMLEDSESSYEPDELTKEMAHLEGLMKDLNAITTA

SEQ ID NO: 900063 - protein, 160 aa, Homo sapiens
GLTVACGLTVACGLTVASCCTDHQDPEGATSSSYLASSQEEDSGQSLPTAHVRPSHPLKSFAVPAIPPPGPPTYDPALPSTPLLSQQALNHHIHSVKTASIGTLGRSRPPMPVVVPSAPEVQETTRMLEDSESSYEPDELTKEMAHLEGLMKDLNAITTA

SEQ ID NO: 900064 - protein, 1508 aa, Homo sapiens
GPGRAGLEQRRRGSRACSEGPAEARGREGGKGSAALSPPLPLTLGEEMAAERGARRLLSTPSFWLYCLLLLGRRAPGAAAARSGSAPQSPGASIRTFTPFYFLVEPVDTLSVRGSSVILNCSAYSEPSPKIEWKKDGTFLNLVSDDRRQLLPDGSLFISNVVHSKHNKPDEGYYQCVATVESLGTIISRTAKLIVAGLPRFTSQPEPSSVYAGNNAILNCEVNADLVPFVRWEQNRQPLLLDDRVIKLPSGMLVISNATEGDGGLYRCVVESGGPPKYSDEVELKVLPDPEVISDLVFLKQPSPLVRVIGQDVVLPCVASGLPTPTIKWMKNEEALDTESSERLVLLAGGSLEISDVTEDDAGTYFCIADNGNETIEAQAELTVQAQPEFLKQPTNIYAHESMDIVFECEVTGKPTPTVKWVKNGDMVIPSDYFKIVKEHNLQVLGLVKSDEGFYQCIAENDVGNAQAGAQLIILEHAPATTGPLPSAPRDVVASLVSTRFIKLTWRTPASDPHGDNLTYSVFYTKEGIARERVENTSHPGEMQVTIQNLMPATVYIFRVMAQNKHGSGESSAPLRVETQPEVQLPGPAPNLRAYAASPTSITVTWETPVSGNGEIQNYKLYYMEKGTDKEQDVDVSSHSYTINGLKKYTEYSFRVVAYNKHGPGVSTPDVAVRTLSDVPSAAPQNLSLEVRNSKSIMIHWQPPAPATQNGQITGYKIRYRKASRKSDVTETLVSGTQLSQLIEGLDRGTEYNFRVAALTINGTGPATDWLSAETFESDLDETRVPEVPSSLHVRPLVTSIVVSWTPPENQNIVVRGYAIGYGIGSPHAQTIKVDYKQRYYTIENLDPSSHYVITLKAFNNVGEGIPLYESAVTRPHTDTSEVDLFVINAPYTPVPDPTPMMPPVGVQASILSHDTIRITWADNSLPKHQKITDSRYYTVRWKTNIPANTKYKNANATTLSYLVTGLKPNTLYEFSVMVTKGRRSSTWSMTAHGTTFELVPTSPPKDVTVVSKEGKPKTIIVNWQPPSEANGKITGYIIYYSTDVNAEIHDWVIEPVVGNRLTHQIQELTLDTPYYFKIQARNSKGMGPMSEAVQFRTPKADSSDKMPNDQASGSGGKGSRLPDLGSDYKPPMSGSNSPHGSPTSPLDSNMLLVIIVSVGVITIVVVVIIAVFCTRRTTSHQKKKRAACKSVNGSHKYKGNSKDVKPPDLWIHHERLELKPIDKSPDPNPIMTDTPIPRNSQDITPVDNSMDSNIHQRRNSYRGHESEDSMSTLAGRRGMRPKMMMPFDSQPPQPVISAHPIHSLDNPHHHFHSSSLASPARSHLYHPGSPWPIGTSMSLSDRANSTESVRNTPSTDTMPASSSQTCCTDHQDPEGATSSSYLASSQEEDSGQSLPTAHVRPSHPLKSFAVPAIPPPGPPTYDPALPSTPLLSQQALNHHIHSVKTASIGTLGRSRPPMPVVVPSAPEVQETTRMLEDSESSYEPDELTKEMAHLEGLMKDLNAITTA

SEQ ID NO: 900065 - protein, 1508 aa, Homo sapiens; identical to SEQ ID NO: 900064

SEQ ID NO: 900066 - protein, 1474 aa, Homo sapiens
GPGRAGLEQRRRGSRACSEGPAEARGREGGKGSAALSPPLPLTLGEEMAAERGARRLLSTPSFWLYCLLLLGRRAPGAAAARSGSAPQSPGASIRTFTPFYFLVEPVDTLSVRGSSVILNCSAYSEPSPKIEWKKDGTFLNLVSDDRRQLLPDGSLFISNVVHSKHNKPDEGYYQCVATVESLGTIISRTAKLIVAGLPRFTSQPEPSSVYAGNNAILNCEVNADLVPFVRWEQNRQPLLLDDRVIKLPSGMLVISNATEGDGGLYRCVVESGGPPKYSDEVELKVLPDPEVISDLVFLKQPSPLVRVIGQDVVLPCVASGLPTPTIKWMKNEEALDTESSERLVLLAGGSLEISDVTEDDAGTYFCIADNGNETIEAQAELTVQAQPEFLKQPTNIYAHESMDIVFECEVTGKPTPTVKWVKNGDMVIPSDYFKIVKEHNLQVLGLVKSDEGFYQCIAENDVGNAQAGAQLIILEHAPATTGPLPSAPRDVVASLVSTRFIKLTWRTPASDPHGDNLTYSVFYTKEGIARERVENTSHPGEMQVTIQNLMPATVYIFRVMAQNKHGSGESSAPLRVETQPEVQLPGPAPNLRAYAASPTSITVTWETPVSGNGEIQNYKLYYMEKGTDKEQDVDVSSHSYTINGLKKYTEYSFRVVAYNKHGPGVSTPDVAVRTLSDVPSAAPQNLSLEVRNSKSIMIHWQPPAPATQNGQITGYKIRYRKASRKSDVTETLVSGTQLSQLIEGLDRGTEYNFRVAALTINGTGPATDWLSAETFESDLDETRVPEVPSSLHVRPLVTSIVVSWTPPENQNIVVRGYAIGYGIGSPHAQTIKVDYKQRYYTIENLDPSSHYVITLKAFNNVGEGIPLYESAVTRPHTVPDPTPMMPPVGVQASILSHDTIRITWADNSLPKHQKITDSRYYTVRWKTNIPANTKYKNANATTLSYLVTGLKPNTLYEFSVMVTKGRRSSTWSMTAHGTTFELVPTSPPKDVTVVSKEGKPKTIIVNWQPPSEANGKITGYIIYYSTDVNAEIHDWVIEPVVGNRLTHQIQELTLDTPYYFKIQARNSKGMGPMSEAVQFRTPKASGSGGKGSRLPDLGSDYKPPMSGSNSPHGSPTSPLDSNMLLVIIVSVGVITIVVVVIIAVFCTRRTTSHQKKKRAACKSVNGSHKYKGNSKDVKPPDLWIHHERLELKPIDKSPDPNPIMTDTPIPRNSQDITPVDNSMDSNIHQRRNSYRGHESEDSMSTLAGRRGMRPKMMMPFDSQPPQPVISAHPIHSLDNPHHHFHSSSLASPARSHLYHPGSPWPIGTSMSLSDRANSTESVRNTPSTDTMPASSSQTCCTDHQDPEGATSSSYLASSQEEDSGQSLPTAHVRPSHPLKSFAVPAIPPPGPPTYDPALPSTPLLSQQALNHHIHSVKTASIGTLGRSRPPMPVVVPSAPEVQETTRMLEDSESRLLEPGGGLTKGDWAGGGIN

SEQ ID NO: 900067 - protein, 896 aa, Homo sapiens
GPGRAGLEQRRRGSRACSEGPAEARGREGGKGSAALSPPLPLTLGEEMAAERGARRLLSTPSFWLYCLLLLGRRAPGAAAARSGSAPQSPGASIRTFTPFYFLVEPVDTLSVRGSSVILNCSAYSEPSPKIEWKKDGTFLNLVSDDRRQLLPDGSLFISNVVHSKHNKPDEGYYQCVATVESLGTIISRTAKLIVAGLPRFTSQPEPSSVYAGNNAILNCEVNADLVPFVRWEQNRQPLLLDDRVIKLPSGMLVISNATEGDGGLYRCVVESGGPPKYSDEVELKVLPDPEVISDLVFLKQPSPLVRVIGQDVVLPCVASGLPTPTIKWMKNEEALDTESSERLVLLAGGSLEISDVTEDDAGTYFCIADNGNETIEAQAELTVQAQPEFLKQPTNIYAHESMDIVFECEVTGKPTPTVKWVKNGDMVIPSDYFKIVKEHNLQVLGLVKSDEGFYQCIAENDVGNAQAGAQLIILEHAPATTGPLPSAPRDVVASLVSTRFIKLTWRTPASDPHGDNLTYSVFYTKEGIARERVENTSHPGEMQVTIQNLMPATVYIFRVMAQNKHGSGESSAPLRVETQPEVQLPGPAPNLRAYAASPTSITVTWETPVSGNGEIQNYKLYYMEKGTDKEQDVDVSSHSYTINGLKKYTEYSFRVVAYNKHGPGVSTPDVAVRTLSDVPSAAPQNLSLEVRNSKSIMIHWQPPAPATQNGQITGYKIRYRKASRKSDVTETLVSGTQLSQLIEGLDRGTEYNFRVAALTINGTGPATDWLSAETFESDLDETRVPEVPSSLHVRPLVTSIVVSWTPPENQNIVVRGYAIGYGIGSPHAQTIKVDYKQRYYTIENLDPSSHYVITLKAFNNVGEGIPLYESAVTRPHTVPDPTPMMPPITPHPKKK

SEQ ID NO: 900068 - protein, 551 aa, Homo sapiens
GPGRAGLEQRRRGSRACSEGPAEARGREGGKGSAALSPPLPLTLGEEMAAERGARRLLSTPSFWLYCLLLLGRRAPGAAAARSGSAPQSPGASIRTFTPFYFLVEPVDTLSVRGSSVILNCSAYSEPSPKIEWKKDGTFLNLVSDDRRQLLPDGSLFISNVVHSKHNKPDEGYYQCVATVESLGTIISRTAKLIVAGLPRFTSQPEPSSVYAGNNAILNCEVNADLVPFVRWEQNRQPLLLDDRVIKLPSGMLVISNATEGDGGLYRCVVESGGPPKYSDEVELKVLPDPEVISDLVFLKQPSPLVRVIGQDVVLPCVASGLPTPTIKWMKNEEALDTESSERLVLLAGGSLEISDVTEDDAGTYFCIADNGNETIEAQAELTVQAQPEFLKQPTNIYAHESMDIVFECEVTGKPTPTVKWVKNGDMVIPSDYFKIVKEHNLQVLGLVKSDEGFYQCIAENDVGNAQAGAQLIILEHDVAIPTLPPTSLTSATTDHLAPATTGPLPSAPRDVVASLVSTRFIKLTWRTPASDPHGDNLTYSVFYTKEGIAR

SEQ ID NO: 900069 - protein, 301 aa, Homo sapiens
GPGRAGLEQRRRGSRACSEGPAEARGREGGKGSAALSPPLPLTLGEEMAAERGARRLLSTPSFWLYCLLLLGRRAPGAAAARSGSAPQSPGASIRTFTPFYFLVEPVDTLSVRGSSVILNCSAYSEPSPKIEWKKDGTFLNLVSDDRRQLLPDGSLFISNVVHSKHNKPDEGYYQCVATVESLGTIISRTAKLIVAGLPRFTSQPEPSSVYAGNNAILNCEVNADLVPFVRWEQNRQPLLLDDRVIKLPSGMLVISNATEGDGGLYRCVVESGGPPKYSDEVELKVLPDPEVISEWKHLCR

SEQ ID NO: 900070 - protein, 1508 aa, Homo sapiens; identical to SEQ ID NO: 900064

SEQ ID NO: 900071 - protein, 1508 aa, Homo sapiens; identical to SEQ ID NO: 900064

SEQ ID NO: 900072 - protein, 267 aa, Homo sapiens
DWYRPGFMGWTAISIKGETSYRGHESEDSMSTLAGRRGMRPKMMMPFDSQPPQPVISAHPIHSLDNPHHHFHSSSLASPARSHLYHPGSPWPIGTSMSLSDRANSTESVRNTPSTDTMPASSSQTCCTDHQDPEGATSSSYLASSQEEDSGQSLPTAHVRPSHPLKSFAVPAIPPPGPPTYDPALPSTPLLSQQALNHHIHSVKTASIGTLGRSRPPMPVVVPSAPEVQETTRMLEDSESSYEPDELTKEMAHLEGLMKDLNAITTA

SEQ ID NO: 900073 - protein, 1508 aa, Homo sapiens; identical to SEQ ID NO: 900064

SEQ ID NO: 900074 - protein, 1508 aa, Homo sapiens; identical to SEQ ID NO: 900064

SEQ ID NO: 900075 - protein, 1163 aa, Homo sapiens
GPGRAGLEQRRRGSRACSEGPAEARGREGGKGSAALSPPLPLTLGEEMAAERGARRLLSTPSFWLYCLLLLGRRAPGAAAARSGSAPQSPGASIRTFTPFYFLVEPVDTLSVRGSSVILNCSAYSEPSPKIEWKKDGTFLNLVSDDRRQLLPDGSLFISNVVHSKHNKPDEGYYQCVATVESLGTIISRTAKLIVAGLPRFTSQPEPSSVYAGNNAILNCEVNADLVPFVRWEQNRQPLLLDDRVIKLPSGMLVISNATEGDGGLYRCVVESGGPPKYSDEVELKVLPDPEVISDLVFLKQPSPLVRVIGQDVVLPCVASGLPTPTIKWMKNEEALDTESSERLVLLAGGSLEISDVTEDDAGTYFCIADNGNETIEAQAELTVQAQPEFLKQPTNIYAHESMDIVFECEVTGKPTPTVKWVKNGDMVIPSDYFKIVKEHNLQVLGLVKSDEGFYQCIAENDVGNAQAGAQLIILEHAPATTGPLPSAPRDVVASLVSTRFIKLTWRTPASDPHGDNLTYSVFYTKEGIARERVENTSHPGEMQVTIQNLMPATVYIFRVMAQNKHGSGESSAPLRVETQPEVQLPGPAPNLRAYAASPTSITVTWETPVSGNGEIQNYKLYYMEKGTDKEQDVDVSSHSYTINGLKKYTEYSFRVVAYNKHGPGVSTPDVAVRTLSDVPSAAPQNLSLEVRNSKSIMIHWQPPAPATQNGQITGYKIRYRKASRKSDVTETLVSGTQLSQLIEGLDRGTEYNFRVAALTINGTGPATDWLSAETFESDLDETRVPEVPSSLHVRPLVTSIVVSWTPPENQNIVVRGYAIGYGIGSPHAQTIKVDYKQRYYTIENLDPSSHYVITLKAFNNVGEGIPLYESAVTRPHTVPDPTPMMPPVGVQASILSHDTIRITWADNSLPKHQKITDSRYYTVRWKTNIPANTKYKNANATTLSYLVTGLKPNTLYEFSVMVTKGRRSSTWSMTAHGTTFELVPTSPPKDVTVVSKEGKPKTIIVNWQPPSEANGKITGYIIYYSTDVNAEIHDWVIEPVVGNRLTHQIQELTLDTPYYFKIQARNSKGMGPMSEAVQFRTPKASGSGGKGSRLPDLGSDYKPPMSGSNSPHGSPTSPLDSNMLLVIIVSVGVITIVVVVIIAVFCTRRTTSHQKKEEAPDA

SEQ ID NO: 900076 - protein, 808 aa, Homo sapiens
GPGRAGLEQRRRGSRACSEGPAEARGREGGKGSAALSPPLPLTLGEEMAAERGARRLLSTPSFWLYCLLLLGRRAPGAAAARSGSAPQSPGASIRTFTPFYFLVEPVDTLSVRGSSVILNCSAYSEPSPKIEWKKDGTFLNLVSDDRRQLLPDGSLFISNVVHSKHNKPDEGYYQCVATVESLGTIISRTAKLIVAGLPRFTSQPEPSSVYAGNNAILNCEVNADLVPFVRWEQNRQPLLLDDRVIKLPSGMLVISNATEGDGGLYRCVVESGGPPKYSDEVELKVLPDPEVISDLVFLKQPSPLVRVIGQDVVLPCVASGLPTPTIKWMKNEEALDTESSERLVLLAGGSLEISDVTEDDAGTYFCIADNGNETIEAQAELTVQAQPEFLKQPTNIYAHESMDIVFECEVTGKPTPTVKWVKNGDMVIPSDYFKIVKEHNLQVLGLVKSDEGFYQCIAENDVGNAQAGAQLIILEHAPATTGPLPSAPRDVVASLVSTRFIKLTWRTPASDPHGDNLTYSVFYTKEGIARERVENTSHPGEMQVTIQNLMPATVYIFRVMAQNKHGSGESSAPLRVETQPEVQLPGPAPNLRAYAASPTSITVTWETPVSGNGEIQNYKLYYMEKGTDKEQDVDVSSHSYTINGLKKYTEYSFRVVAYNKHGPGVSTQTYEHDDVSVYMLEVRNSKSIMIHWQPPAPATQNGQITGYKIRYRKASRKSDVTETLVSGTQLSQLIEGLDRGTEYNFRVAALTINGTGPATDWLSAETFESDLDGKNNNWQDWNTIDTSCSQMSQTGKPQTWGGYGSSL

SEQ ID NO: 900077 - protein, 340 aa, Homo sapiens
GPGRAGLEQRRRGSRACSEGPAEARGREGGKGSAALSPPLPLTLGEEMAAERGARRLLSTPSFWLYCLLLLGRRAPGAAAARSGSAPQSPGASIRTFTPFYFLVEPVDTLSVRGSSVILNCSAYSEPSPKIEWKKDGTFLNLVSDDRRQLLPDGSLFISNVVHSKHNKPDEGYYQCVATVESLGTIISRTAKLIVAGLPRFTSQPEPSSVYAGNNAILNCEVNADLVPFVRWEQNRQPLLLDDRVIKLPSGMLVISNATEGDGGLYRCVVESGGPPKYSDEVELKVLPDPEVISDLVFLKQPSPLVRVIGQDVVLPCVASGLPTPTIKWMKNEEALDTER

SEQ ID NO: 900078 - protein, 213 aa, Homo sapiens
MSKSESPKEPEQLRKLFIGGLSFETTDESLRSHFEQWGTLTDCVVMRDPNTKRSRGFGFVTYATVEEVDAAMNARPHKVDGRVVEPKRAVSREDSQRPGAHLTVKKIFVGGIKEDTEEHHLRDYFEQYGKIEVIEIMTDRGSGKKRGFAFVTFDDHDSVDKIVIQKYHTVNGHNCEVRKALSKQEMASASSSQRGRSGSGNFGGGRGGWFRWE

SEQ ID NO: 900079 - protein, 197 aa, Homo sapiens
FQCRAGLNAEIAVTWAFQMQWGTLTDCVVMRDPNTKRSRGFGFVTYATVEEVDAAMNARPHKVDGRVVEPKRAVSREDSQRPGAHLTVKKIFVGGIKEDTEEHHLRDYFEQYGKIEVIEIMTDRGSGKKRGFAFVTFDDHDSVDKIVIQKYHTVNGHNCEVRKALSKQEMASASSSQRGRSGSGNFGGGRGGWFRWE

SEQ ID NO: 900080 - protein, 240 aa, Homo sapiens
RQHHNTHDEAVGLNRQRISARGRRRRSIVKVSLHPAVMSKSESPKEPEHFETTDESLRSHFEQWGTLTDCVVMRDPNTKRSRGFGFVTYATVEEVDAAMNARPHKVDGRVVEPKRAVSREDSQRPGAHLTVKKIFVGGIKEDTEEHHLRDYFEQYGKIEVIEIMTDRGSGKKRGFAFVTFDDHDSVDKIVIQKYHTVNGHNCEVRKALSKQEMASASSSQRGRSGSGNFGGGRGGWFRWE

SEQ ID NO: 900081 - protein, 208 aa, Homo sapiens
MSKSESPKEPEQLRKLFIGGLSFETTDESLRSHFEQWGTLTDCVVMRDPNTKRSRGFGFVTYATVEEVDAAMNARPHKVDGRVVEPKRAVSREDSQRPGAHLTVKKIFVGGIKEDTEEHHLRDYFEQYGKIEVIEIMTDRGSGKKRGFAFVTFDDHDSVDKIVIQKYHTVNGHNCEVRKALSKQEMASASSSQRGRSGSGNFGGGRGR

SEQ ID NO: 900082 - protein, 586 aa, Homo sapiens
ESIQRSGSSMKEEPLGSGMNAVRTWMQGAGVLDANTAAQSGVGLARAHFEKQPPSNLRKSNFFHFVLALYDRQGQPVEIERTAFVGFVEKEKEANSEKTNNGIHYRIQLLYSNGIRTEQDFYVRLIDSMTKQAIVYEGQDKSPEMCRVLLTHEIMCSRCCDKKSCGNRNETPSDPVIIDRFFLKFFLKCNQNCLKNAGNPRDMRRFQVVVSTTVNVDGHVLAVSDNMFVHNNSKHGRRARRLDPSEGTPSYLEHATPCIKAISPSEGWTTGGATVIIIGDNFFDGLQVIFGTMLVWSELITPHAIRVQTPPRHIPGVVEVTLSYKSKQFCKGTPGRFIYTALNEPTIDYGFQRLQKVIPRHPGDPERLPKEVILKRAADLVEALYGMPHNNQEIILKRAADIAEALYSVPRNHNQLPALANTSVHAGMMGVNSFSGQLAVNVSEASQATNQGFTRNSSSVSPHGYVPSTTPQQTNYNSVTTSMNGYGSAAMSNLGGSPTFLNGSAANSPYAIVPSSPTMASSTSLPSNCSSSSGIFSFSPANMVSAVKQKSAFAPVVRPQTSPPPTCTSTNGNSLQAISGMIVPPM

SEQ ID NO: 900083 - protein, 91 aa, Homo sapiens
SAALLKSFANAFYLAQHLDPGGNSCSYCDKSFRQLSHLQQHTRIHTGDRPYKCPHPGCEKAFTQLSNLQSHQRQHNGNSLQAISGMIVPPM

SEQ ID NO: 900084 - protein, 187 aa, Homo sapiens
AFPFVFLRFCVGGGPGISRVYALFYGECNPTREWAVSSELSPSFQEQNKMNKVEQKSQESVSFKDVTVGFTQEEWQHLDPSQRALYRDVMLENYSNLVSVGYCVHKPEVIFRLQQGEEPWKQEEEFPSQSFPEVWTADHLKERSQENQSKHLWEVVFINNEMLTKEQGDVIGIPFNVDAPEMLMPLD

SEQ ID NO: 900085 - protein, 150 aa, Homo sapiens
AFPFVFLRFCVGGGPGISRVYALFYGECNPTREWAVSSELSPSFQEQNKMNKVEQKSQESVSFKDVTVGFTQEEWQHLDPSQRALYRDVMLENYSNLVSVGYCVHKPEVIFRLQQGEEPWKQEEEFPSQSFPGELICTAQIHIRGFVVSQ

SEQ ID NO: 900086 - protein, 811 aa, Homo sapiens
MFQVEQKSQESVSFKDVTVGFTQEEWQHLDPSQRALYRDVMLENYSNLVSVGYCVHKPEVIFRLQQGEEPWKQEEEFPSQSFPEVWTADHLKERSQENQSKHLWEVVFINNEMLTKEQGDVIGIPFNVDVSSFPSRKMFCQCDSCGMSFNTVSELVISKINYLGKKSDEFNACGKLLLNIKHDETHTQEKNEVLKNRNTLSHHEETLQHEKIQTLEHNFEYSICQETLLEKAVFNTQKRENAEENNCDYNEFGRTLCDSSSLLFHQISPSRDNHYEFSDCEKFLCVKSTLSKPHGVSMKHYDCGESGNNFRRKLCLSHLQKGDKGEKHFECNECGKAFWEKSHLTRHQRVHTGQKPFQCNECEKAFWDKSNLTKHQRSHTGEKPFECNECGKAFSHKSALTLHQRTHTGEKPYQCNACGKTFCQKSDLTKHQRTHTGLKPYECYECGKSFRVTSHLKVHQRTHTGEKPFECLECGKSFSEKSNLTQHQRIHIGDKSYECNACGKTFYHKSLLTRHQIIHTGWKPYECYECGKTFCLKSDLTVHQRTHTGQKPFACPECGKFFSHKSTLSQHYRTHTGEKPYECHECGKIFYNKSYLTKHNRTHTGEKPYECNECGKAFYQKSQLTQHQRIHIGEKPYKCNECGKAFCHKSALIVHQRTHTQEKPYKCNECGKSFCVKSGLIFHERKHTGEKPYECNECGKFFRHKSSLTVHHRAHTGEKSCQCNECGKIFYRKSELAQHQRSHTGEKPYECNTCRKTFSQKSNLIVHQRRHIGENLMNEMDIRNFQPQVSLHNASEYSHCGESPDDILNVQ

SEQ ID NO: 900087 - protein, 699 aa, Homo sapiens
MLTKEQGDVIGIPFNVDVSSFPSRKMFCQCDSCGMSFNTVSELVISKINYLGKKSDEFNACGKLLLNIKHDETHTQEKNEVLKNRNTLSHHEETLQHEKIQTLEHNFEYSICQETLLEKAVFNTQKRENAEENNCDYNEFGRTLCDSSSLLFHQISPSRDNHYEFSDCEKFLCVKSTLSKPHGVSMKHYDCGESGNNFRRKLCLSHLQKGDKGEKHFECNECGKAFWEKSHLTRHQRVHTGQKPFQCNECEKAFWDKSNLTKHQRSHTGEKPFECNECGKAFSHKSALTLHQRTHTGEKPYQCNACGKTFCQKSDLTKHQRTHTGLKPYECYECGKSFRVTSHLKVHQRTHTGEKPFECLECGKSFSEKSNLTQHQRIHIGDKSYECNACGKTFYHKSLLTRHQIIHTGWKPYECYECGKTFCLKSDLTVHQRTHTGQKPFACPECGKFFSHKSTLSQHYRTHTGEKPYECHECGKIFYNKSYLTKHNRTHTGEKPYECNECGKAFYQKSQLTQHQRIHIGEKPYKCNECGKAFCHKSALIVHQRTHTQEKPYKCNECGKSFCVKSGLIFHERKHTGEKPYECNECGKFFRHKSSLTVHHRAHTGEKSCQCNECGKIFYRKSELAQHQRSHTGEKPYECNTCRKTFSQKSNLIVHQRRHIGENLMNEMDIRNFQPQVSLHNASEYSHCGESPDDILNVQ

SEQ ID NO: 900088 - protein, 860 aa, Homo sapiens
AFPFVFLRFCVGGGPGISRVYALFYGECNPTREWAVSSELSPSFQEQNKMNKVEQKSQESVSFKDVTVGFTQEEWQHLDPSQRALYRDVMLENYSNLVSVGYCVHKPEVIFRLQQGEEPWKQEEEFPSQSFPEVWTADHLKERSQENQSKHLWEVVFINNEMLTKEQGDVIGIPFNVDVSSFPSRKMFCQCDSCGMSFNTVSELVISKINYLGKKSDEFNACGKLLLNIKHDETHTQEKNEVLKNRNTLSHHEETLQHEKIQTLEHNFEYSICQETLLEKAVFNTQKRENAEENNCDYNEFGRTLCDSSSLLFHQISPSRDNHYEFSDCEKFLCVKSTLSKPHGVSMKHYDCGESGNNFRRKLCLSHLQKGDKGEKHFECNECGKAFWEKSHLTRHQRVHTGQKPFQCNECEKAFWDKSNLTKHQRSHTGEKPFECNECGKAFSHKSALTLHQRTHTGEKPYQCNACGKTFCQKSDLTKHQRTHTGLKPYECYECGKSFRVTSHLKVHQRTHTGEKPFECLECGKSFSEKSNLTQHQRIHIGDKSYECNACGKTFYHKSLLTRHQIIHTGWKPYECYECGKTFCLKSDLTVHQRTHTGQKPFACPECGKFFSHKSTLSQHYRTHTGEKPYECHECGKIFYNKSYLTKHNRTHTGEKPYECNECGKAFYQKSQLTQHQRIHIGEKPYKCNECGKAFCHKSALIVHQRTHTQEKPYKCNECGKSFCVKSGLIFHERKHTGEKPYECNECGKFFRHKSSLTVHHRAHTGEKSCQCNECGKIFYRKSELAQHQRSHTGEKPYECNTCRKTFSQKSNLIVHQRRHIGENLMNEMDIRNFQPQVSLHNASEYSHCGESPDDILNVQ

SEQ ID NO: 900089 - protein, 111 aa, Homo sapiens [sequence omitted]

SEQ ID NO: 900090 - protein, 860 aa, Homo sapiens; identical to SEQ ID NO: 900088

SEQ ID NO: 900091 - protein, 139 aa, Homo sapiens
AFPFVFLRFCVGGGPGISRVYALFYGECNPTREWAVSSELSPSFQEQNKMNKVEQKSQESVSFKDVTVGFTQEEWQHLDPSQRALYRDVMLENYSNLVSVGYCVHKPEVIFRLQQGEEPWKQEEEFPSQSFPESGQLIT

SEQ ID NO: 900092 - protein, 860 aa, Homo sapiens; identical to SEQ ID NO: 900088

SEQ ID NO: 900093 - protein, 860 aa, Homo sapiens; identical to SEQ ID NO: 900088

SEQ ID NO: 900094 - protein, 146 aa, Homo sapiens
AFPFVFLRFCVGGGPGISRVYALFYGECNPTREWAVSSELSPSFQEQNKMNKVEQKSQESVSFKDVTVGFTQEEWQHLDPSQRALYRDVMLENYSNLVSVGYCVHKPEVIFRLQQGEEPWKQEEEFPSQSFPEMGFHHVPGLVLNS

SEQ ID NO: 900095 - protein, 111 aa, Homo sapiens [sequence omitted]

SEQ ID NO: 900096 - protein, 244 aa, Homo sapiens
MRFRIYKRKVLILTLVVAACGFVLWSSNGRQRKNEALAPPLLDAEPARGAGGRGGDHPSVAVGIRRVSNVSAASLVPAVPQPEADNLTLRYRSLVYQLNFDQTLRNVDKAGTWAPRELVLVVQVHNRPEYLRLLLDSLRKAQGIDNVLVIFSHDFWSTEINQLIAGVNFCPVLQVFFPFSIQLYPNEFPGSDPRDCPRDLPKNAALKLGCINAEYPDSFGHYREAKFSQTKHHWWWKLHLCGKE

SEQ ID NO: 900097 - protein, 244 aa, Homo sapiens; identical to SEQ ID NO: 900096

SEQ ID NO: 900098 - protein, 226 aa, Homo sapiens
MRFRIYKRKVLILTLVVAACGFVLWSSNGRQRKNEALAPPLLDAEPARGAGGRGGDHPSVAVGIRRVSNVSAASLVPAVPQPEADNLTLRYRSLVYQLNFDQTLRNVDKAGTWAPRELVLVVQVHNRPEYLRLLLDSLRTEINQLIAGVNFCPVLQVFFPFSIQLYPNEFPGSDPRDCPRDLPKNAALKLGCINAEYPDSFGHYREAKFSQTKHHWWWKLHLCGKE

SEQ ID NO: 900099 - protein, 244 aa, Homo sapiens; identical to SEQ ID NO: 900096

SEQ ID NO: 900100 - protein, 284 aa, Homo sapiens
AGGPRCAAGQLRVVITVPAGVRRGRVAQFWPSRAPVRMRTMRFRIYKRKVLILTLVVAACGFVLWSSNGRQRKNEALAPPLLDAEPARGAGGRGGDHPSVAVGIRRVSNVSAASLVPAVPQPEADNLTLRYRSLVYQLNFDQTLRNVDKAGTWAPRELVLVVQVHNRPEYLRLLLDSLRKAQGIDNVLVIFSHDFWSTEINQLIAGVNFCPVLQVFFPFSIQLYPNEFPGSDPRDCPRDLPKNAALKLGCINAEYPDSFGHYREAKFSQTKHHWWWKLHLCGKE

SEQ ID NO: 900101 - protein, 244 aa, Homo sapiens; identical to SEQ ID NO: 900096

SEQ ID NO: 900102 - protein, 244 aa, Homo sapiens; identical to SEQ ID NO: 900096

SEQ ID NO: 900103 - protein, 199 aa, Homo sapiens
MGDGAGGRGGDHPSVAVGIRRVSNVSAASLVPAVPQPEADNLTLRYRSLVYQLNFDQTLRNVDKAGTWAPRELVLVVQVHNRPEYLRLLLDSLRKAQGIDNVLVIFSHDFWSTEINQLIAGVNFCPVLQVFFPFSIQLYPNEFPGSDPRDCPRDLPKNAALKLGCINAEYPDSFGHYREAKFSQTKHHWWWKLHLCGKE

SEQ ID NO: 900104 - protein, 129 aa, Homo sapiens [sequence omitted]

SEQ ID NO: 900105 - protein, 532 aa, Homo sapiens
RLRRGPSAAAVAPSGGPQRFKRFSCFSLRSSWDYRHVPTHPATKMPEEMDKPLISLHLVDSDSSLAKVPDEAPKVGILGSGDFARSLATRLVGSGFKVVVGSRNPKRTARLFPSAAQVTFQEEAVSSPEVIFVAVFREHYSSLCSLSDQLAGKILVDVSNPTEQEHLQHRESNAEYLASLFPTCTVVKAFNVISAWTLQAGPRDGNRQVPICGDQPEAKRAVSEMALAMGFMPVDMGSLASAWEVEAMPLRLLPAWKVPTLLALGLFVCFYAYNFVRDVLQPYVQESQNKFFKLPVSVVNTTLPCVAYVLLSLVYLPGVLAAALQLRRGTKYQRFPDWLDHWLQHRKQIGLLSFFCAALHALYSFCLPLRRAHRYDLVNLAVKQVLANKSHLWVEEEVWRMEIYLSLGVLALGTLSLLAVTSLPSIANSLNWREFSFVQSSLGFVALVLSTLHTLTYGWTRAFEESRYKFYLPPTFTLTLLVPCVVILAKALFLLPCISRRLARIRRGWERESTIKFTLPTDHALAEKTSHV

SEQ ID NO: 900106 - protein, 532 aa, Homo sapiens; identical to SEQ ID NO: 900105

SEQ ID NO: 900107 - protein, 532 aa, Homo sapiens; identical to SEQ ID NO: 900105

SEQ ID NO: 900108 - protein, 532 aa, Homo sapiens; identical to SEQ ID NO: 900105

SEQ ID NO: 900109 - protein, 540 aa, Homo sapiens
TAFAADLQLPRSLRAAGRRATKMPEEMDKPLISLHLVDSDSSLAKVPDEAPKVGILGSGDFARSLATRLVGSGFKVVVGSRNPKRTARLFPSAAQVTFQEEAVSSPEVIFVAVFREHYSSLCSLSDQLAGKILVDVSNPTEQEHLQHRESNAEYLASLFPTCTVVKAFNVISAWTLQAGPRDGNRQVPICGDQPEAKRAVSEMALAMGFMPVDMGSLASAWEVEAMPLRLLPAWKVPTLLALGLFVCFYAYNFVRDVLQPYVQESQNKFFKLPVSVVNTTLPCVAYVLLSLVYLPGVLAAALQLRRGTKYQRFPDWLDHWLQHRKQIGLLSFFCAALHALYSFCLPLRRAHRYDLVNLAVKQVLANKSHLWVEEEVWRMEIYLSLGVLALGTLSLLAVTSLPSIANSLNWREFSFVQSSLGFVALVLSTLHTLTYGWTRAFEESRYKFYLPPTFTLTLLVPCVVILAKALFLLPCISRRLARIRRGWERESTIKFTLPTDHAPEPVRFSFLGGAKWYNCVQIGGLRSKFLGLKCMQYYSE

SEQ ID NO: 900110 - protein, 532 aa, Homo sapiens; identical to SEQ ID NO: 900105

SEQ ID NO: 900111 - protein, 532 aa, Homo sapiens; identical to SEQ ID NO: 900105

SEQ ID NO: 900112 - protein, 128 aa, Homo sapiens
GCAREPESRLPKLGSWENLGPGLTEKRRGKEAGQEEGAWRTPAGGRGAAGLSVTPLSPPRPAPPAGEGPRCPPGRPAPARRRKGWRVERRGGRGSAWDAPGHRARSLRPGAGQVRGQDVGRTWCMAAS

SEQ ID NO: 900113 - protein, 445 aa, Homo sapiens
MLKKQSAGLVLWGAILFVAWNALLLLFFWTRPAPGRPPSVSALDGDPASLTREVIRLAQDAEVELERQRGLLQQIGDALSSQRGRVPTAAPPAQPRVPVTPAPAVIPILVIACDRSTVRRCLDKLLHYRPSAELFPIIVSQDCGHEETAQAIASYGSAVTHIRQPDLSSIAVPPDHRKFQGYYKIARHYRWALGQVFRQFRFPAAVVVEDDLEVAPDFFEYFRATYPLLKADPSLWCVSAWNDNGKEQMVDASRPELLYRTDFFPGLGWLLLAELWAELEPKWPKAFWDDWMRRPEQRQGRACIRPEISRTMTFGRKGVSHGQFFDQHLKFIKLNQQFVHFTQLDLSYLQREAYDRDFLARVYGAPQLQVEKVRTNDRKELGEVRVQYTGRDSFKAFAKALGVMDDLKSGVPRAGYRGIVTFQFRGRRVHLAPPPTWEGYDPSWN

SEQ ID NO: 900114 - protein, 83 aa, Homo sapiens
GPALGIGPGAWIATRGGPRLLAETGRAGTRLTQKSASWAMPLLRPVSSHEPQHKTDGPVLTVDNFPCLSKRWDSIWDLSITRL

SEQ ID NO: 900115 - protein, 445 aa, Homo sapiens; identical to SEQ ID NO: 900113

SEQ ID NO: 900116 - protein, 445 aa, Homo sapiens; identical to SEQ ID NO: 900113

SEQ ID NO: 900117 - protein, 445 aa, Homo sapiens; identical to SEQ ID NO: 900113

SEQ ID NO: 900118 - protein, 445 aa, Homo sapiens; identical to SEQ ID NO: 900113

SEQ ID NO: 900119 - protein, 445 aa, Homo sapiens; identical to SEQ ID NO: 900113

SEQ ID NO: 900120 - protein, 445 aa, Homo sapiens; identical to SEQ ID NO: 900113

SEQ ID NO: 900121 - protein, 445 aa, Homo sapiens; identical to SEQ ID NO: 900113

SEQ ID NO: 900122 - protein, 445 aa, Homo sapiens; identical to SEQ ID NO: 900113

SEQ ID NO: 900123 - protein, 266 aa, Homo sapiens
MLKKQSAGLVLWGAILFVAWNALLLLFFWTRPAPGRPPSVSALDGDPASLTREVIRLAQDAEVELERQRGLLQQIGDALSSQRGRVPTAAPPAQPRVPVTPAPAVIPILVIACDRSTVRRCLDKLLHYRPSAELFPIIVSQDCGHEETAQAIASYGSAVTHIRQPDLSSIAVPPDHRKFQGYYKIARHYRWALGQVFRQFRFPAAVVVEDDLEVAPDFFEYFRATYPLLKADPSLWCVSAWNDNGKEQMVDAMAGWRGLGGFLFLA

SEQ ID NO: 900124 - protein, 169 aa, Homo sapiens
MLKKQSAGLVLWGAILFVAWNALLLLFFWTRPAPGRPPSVSALDGDPASLTREVIRLAQDAEVELERQRGLLQQIGDALSSQRGRVPTAAPPAQPRVPVTPAPAVIPILVIACDRSTVRRCLDKLLHYRPSAELFPIIVSQAPCPHRPGRHGRMERTWWIFVSCLTSVS

SEQ ID NO: 900125 - protein, 122 aa, Homo sapiens
GCAREPESRLPKLGSWENLGPGLTEKRRGKEAGQEEGAWRTPAGGRGAAGLSVTPLSPPRPAPPAGEGPRCPPGRPAPARRRKGWRVERRGGRGSAWDAPGHRARSLRPGAGQVRGQDVGRT

SEQ ID NO: 900126 - protein, 445 aa, Homo sapiens; identical to SEQ ID NO: 900113

SEQ ID NO: 900127 - protein, 445 aa, Homo sapiens; identical to SEQ ID NO: 900113

SEQ ID NO: 900128 - protein, 445 aa, Homo sapiens; identical to SEQ ID NO: 900113

SEQ ID NO: 900129 - protein, 445 aa, Homo sapiens; identical to SEQ ID NO: 900113

SEQ ID NO: 900130 - protein, 445 aa, Homo sapiens; identical to SEQ ID NO: 900113

SEQ ID NO: 900131 - protein, 445 aa, Homo sapiens; identical to SEQ ID NO: 900113

SEQ ID NO: 900132 - protein, 445 aa, Homo sapiens; identical to SEQ ID NO: 900113

SEQ ID NO: 900133 - protein, 169 aa, Homo sapiens; identical to SEQ ID NO: 900124

SEQ ID NO: 900134 - protein, 232 aa, Homo sapiens
RTTFPRGLRDCREEWGRCLTSGTVITSLFGGTVMAREMTILGSAVLTLLLAGYLAQQYLPLPTPKVIGIDLGTTYCSVGVFFPGTGKVKVIPDENGHISIPSMVSFTDNDVYVGYESVELADSNPQNTIYDAKRFIGKIFTAEELEAEIGRYPFKVLNKNGMVEFSVTSNETITVSPEYVGSRLLLKLKEMAEAYLGMPVANAVISVPAEFDLKQRNSTIEAANLAGNSTLD

SEQ ID NO: 900135 - protein, 504 aa, Homo sapiens
RTTFPRGLRDCREEWGRCLTSGTVITSLFGGTVMAREMTILGSAVLTLLLAGYLAQQYLPLPTPKVIGIDLGTTYCSVGVFFPGTGKVKVIPDENGHISIPSMVSFTDNDVYVGYESVELADSNPQNTIYDAKRFIGKIFTAEELEAEIGRYPFKVLNKNGMVEFSVTSNETITVSPEYVGSRLLLKLKEMAEAYLGMPVANAVISVPAEFDLKQRNSTIEAANLAGLKILRVINEPTAAAMAYGLHKADVFHVLVIDLGGGTLDVSLLNKQGGMFLTRAMSGNNKLGGQDFNQRLLQYLYKQIYQTYGFVPSRKEEIHRLRQAVEMVKLNLTLHQSAQLSVLLTVEEQDRKEPHSSDTELPKDKLSSADDHRVNSGFGRGLSDKKSGESQVLFETEISRKLFDTLNEDLFQKILVPIQQVLKEGHLEKTEIDEVVLVGGSTRIPRIRQVIQEFFGKDPNTSVDPDLAVVTGVAIQAGIDGGSWPLQVSALEIPNKHLQKTNFN

SEQ ID NO: 900136 - protein, 517 aa, Homo sapiens
RTTFPRGLRDCREEWGRCLTSGTVITSLFGGTVMAREMTILGSAVLTLLLAGYLAQQYLPLPTPKVIGIDLGTTYCSVGVFFPGTGKVKVIPDENGHISIPSMVSFTDNDVYVGYESVELADSNPQNTIYDAKRFIGKIFTAEELEAEIGRYPFKKRGFCLREAENKKFGEKLWGGSFSVTSNETITVSPEYVGSRLLLKLKEMAEAYLGMPVANAVISVPAEFDLKQRNSTIEAANLAGLKILRVINEPTAAAMAYGLHKADVFHVLVIDLGGGTLDVSLLNKQGGMFLTRAMSGNNKLGGQDFNQRLLQYLYKQIYQTYGFVPSRKEEIHRLRQAVEMVKLNLTLHQSAQLSVLLTVEEQDRKEPHSSDTELPKDKLSSADDHRVNSGFGRGLSDKKSGESQVLFETEISRKLFDTLNEDLFQKILVPIQQVLKEGHLEKTEIDEVVLVGGSTRIPRIRQVIQEFFGKDPNTSVDPDLAVVTGVAIQAGIDGGSWPLQVSALEIPNKHLQKTNFN

SEQ ID NO: 900137 - protein, 504 aa, Homo sapiens; identical to SEQ ID NO: 900135

SEQ ID NO: 900138 - protein, 402 aa, Homo sapiens
MVSFTDNDVYVGYESVELADSNPQNTIYDAKRFIGKIFTAEELEAEIGRYPFKVLNKNGMVEFSVTSNETITVSPEYVGSRLLLKLKEMAEAYLGMPVANAVISVPAEFDLKQRNSTIEAANLAGLKILRVINEPTAAAMAYGLHKADVFHVLVIDLGGGTLDVSLLNKQGGMFLTRAMSGNNKLGGQDFNQRLLQYLYKQIYQTYGFVPSRKEEIHRLRQAVEMVKLNLTLHQSAQLSVLLTVEEQDRKEPHSSDTELPKDKLSSADDHRVNSGFGRGLSDKKSGESQVLFETEISRKLFDTLNEDLFQKILVPIQQVLKEGHLEKTEIDEVVLVGGSTRIPRIRQVIQEFFGKDPNTSVDPDLAVVTGVAIQAGIDGGSWPLQVSALEIPNKHLQKTNFN

SEQ ID NO: 900139 - protein, 307 aa, Homo sapiens
RTTFPRGLRDCREEWGRCLTSGTVITSLFGGTVMAREMTILGSAVLTLLLAGYLAQQYLPLPTPKVIGIDLGTTYCSVGVFFPGTGKVKVIPDENGHISIPSMVSFTDNDVYVGYESVELADSNPQNTIYDAKRFIGKIFTAEELEAEIGRYPFKVLNKNGMVEFSVTSNETITVSPEYVGSRLLLKLKEMAEAYLGMPVANAVISVPAEFDLKQRNSTIEAANLAGLKILRVINEPTAAAMAYGLHKADVFHVLVIDLGGGTLDVSLLNKQGGMFLTRAMSGNNKLGGQDFNQRLLQYLYKQIGIL

SEQ ID NO: 900140 - protein, 361 aa, Homo sapiens
EPSRPPRAPIGRPATQPSPPLPSLLTIVCGEGSERVENQGTCALTSRLRLGAEGPRRAWPAGGYKEAVVRARPAQCCRAPGRRVGLRCARRTSEAAGSGAGPPGPLQGRSGSSWAPRPGRRTEERRKGAGGTRPRPAAAMNSNVENLPPHIIRLVYKEVTTLTADPPDGIKVFPNEEDLTDLQVTIEGPEGTPYAGGLFRMKLLLGKDFPASPPKGYFLTKIFHPNVGANGEICVNVLKRDWTAELGIRHVLLTIKCLLIHPNPESALNEEAGRLLLENYEEYAARARLLTEIHGGAGGPSGRAEAGRALASGTEASSTDPGAPGGPGGAEGPMAKKHAGERDKKLAAKKKTDKKRALRRL

SEQ ID NO: 900141 - protein, 229 aa, Homo sapiens
MNSNVENLPPHIIRLVYKEVTTLTADPPDGIKVFPNEEDLTDLQVTIEGPEGTPYAGGLFRMKLLLGKDFPASPPKGYFLTKIFHPNVGANGEICVNVLKRDWTAELGIRHVLLTIKCLLIHPNPESALNEEAGRLLLENYEEYAARARLLTEIHGGAGGPSGRAEAGRALASGTEASSTDPGAPGGPGGAEGPMAKKHAGERDRVGQKRAEGLCVDGSLFTDHFVSHC

SEQ ID NO: 900142 - protein, 386 aa, Homo sapiens
EPSRPPRAPIGRPATQPSPPLPSLLTIVCGEGSERVENQGTCALTSRLRLGAEGPRRAWPAGGYKEAVVRARPAQCCRAPGRRVGLRCARRTSEAAGSGAGPPGPLQGRSGSSWAPRPGRRTEERRKGAGGTRPRPAAAMNSNVENLPPHIIRLVYKEVTTLTADPPDGIKVFPNEEDLTDLQVTIEGPEGTPYAGGLFRMKLLLGKDFPASPPKGYFLTKIFHPNVGANGEICVNVLKRDWTAELGIRHVLLTIKCLLIHPNPDGPVCSQRSTGAPAGPAAGPKPVGPWPVALKLPPPTLGPQGAREGLRVPWPRSMLASAIRSWRPRKRRTRSGRCGGCSGLSSSFHRDPNLSCPLPPTLSLSYLNYGWGRGGYRGHWDLDLFF

SEQ ID NO: 900143 - protein, 361 aa, Homo sapiens; identical to SEQ ID NO: 900140

SEQ ID NO: 900144 - protein, 393 aa, Homo sapiens
EPSRPPRAPIGRPATQPSPPLPSLLTIVCGEGSERVENQGTCALTSRLRLGAEGPRRAWPAGGYKEAVVRARPAQCCRAPGRRVGLRCARRTSEAAGSGAGPPGPLQGRSGSSWAPRPGRRTEERRKGAGGTRPRPAAAMNSNVENLPPHIIRLVYKEVTTLTADPPDGIKVFPNEEDLTDLQVTIEGPEGTPYAGGLFRMKLLLGKDFPASPPKGYFLTKIFHPNVGANGEICVNVLKRDWTAELGIRHVLLTIKCLLIHPNPESALNEEAGRLLLENYEEYAARARLLTEIHGGAGGPSGRAEAGRALASGTEASSTDPGAPGGPGGAEGPMAKKHAGERDKKLAAKKLLADQAEARRSKTKEARKRREERLQAKKEEIIKTLSKEEETKK

SEQ ID NO: 900145 - protein, 279 aa, Homo sapiens
QLQQQVYKEAVLYGSKVARRGGGLVYAVRGGRRRQRGAERGRRGLSRAAAAAVGPPAPAGGPKNLPPHIIRLVYKEVTTLTADPPDGIKVFPNEEDLTDLQVTIEGPEGTPYAGGLFRMKLLLGKDFPASPPKGYFLTKIFHPNVGANGEICVNVLKRDWTAELGIRHVLLTIKCLLIHPNPESALNEEAGRLLLENYEEYAARARLLTEIHGGAGGPSGRAEAGRALASGTEASSTDPGAPGGPGGAEGPMAKKHAGERDKKLAAKKKTDKKRALRRL

SEQ ID NO: 900146 - protein, 279 aa, Homo sapiens; identical to SEQ ID NO: 900145

SEQ ID NO: 900147 - protein, 161 aa, Homo sapiens [sequence omitted]

SEQ ID NO: 900148 - protein, 189 aa, Homo sapiens
EPSRPPRAPIGRPATQPSPPLPSLLTIVCGEGSERVENQGTCALTSRLRLGAEGPRRAWPAGGYERGSGARAAGSVLPGTGAAGWSTLCAADVGGSGERSGAAGASPGPQRQQLGPPPRPADRRTQEGGRGDPPPAGRSHELQRGEPTPAHHPPGVQGGDDTDRRPTRWHQGLSQRGGPHRPPGHHRGP

SEQ ID NO: 900149 - protein, 149 aa, Homo sapiens
PSTLMSTVRVPRSCPPERWVPAKFLTGVNIVVRDHSTRTCVTIKCLLIHPNPESALNEEAGRLLLENYEEYAARARLLTEIHGGAGGPSGRAEAGRALASGTEASSTDPGAPGGPGGAEGPMAKKHAGERDKKLAAKKKTDKKRALRRL

SEQ ID NO: 900150 - protein, 173 aa, Homo sapiens
MRLVGPVVNLAEVTLLLGKDFPASPPKGYFLTKIFHPNVGANGEICVNVLKRDWTAELGIRHVLLTIKCLLIHPNPESALNEEAGRLLLENYEEYAARARLLTEIHGGAGGPSGRAEAGRALASGTEASSTDPGAPGGPGGAEGPMAKKHAGERDKKLAAKKKTDKKRALRRL

SEQ ID NO: 900151 - protein, 361 aa, Homo sapiens; identical to SEQ ID NO: 900140

SEQ ID NO: 900152 - protein, 367 aa, Homo sapiens
EPSRPPRAPIGRPATQPSPPLPSLLTIVCGEGSERVENQGTCALTSRLRLGAEGPRRAWPAGGYKEAVVRARPAQCCRAPGRRVGLRCARRTSEAAGSGAGPPGPLQGRSGSSWAPRPGRRTEERRKGAGGTRPRPAAAMNSNVENLPPHIIRLVYKEVTTLTADPPDGIKVFPNEEDLTDLQVTIEGPEGTPYAGGLFRMKLLLGKDFPASPPKGYFLTKIFHPNVGANGEICVNVLKRDWTAELGIRHVLLTIKCLLIHPNPESALNEEAGRLLLENYEEYAARARLLTEIHGGAGGPSGRAEAGRALASGTEASSTDPGAPGGPGGAEGPMAKKHAGERDKKLAAKKKTDKKRALRGEGSLLFT

SEQ ID NO: 900153 - protein, 224 aa, Homo sapiens
DAWVDPRVRLPPHIIRLVYKEVTTLTADPPDGIKVFPNEEDLTDLQVTIEGPEGTPYAGGLFRMKLLLGKDFPASPPKGYFLTKIFHPNVGANGEICVNVLKRDWTAELGIRHVLLTIKCLLIHPNPESALNEEAGRLLLENYEEYAARARLLTEIHGGAGGPSGRAEAGRALASGTEASSTDPGAPGGPGGAEGPMAKKHAGERDKKLAAKKKTDKKRALRRL

SEQ ID NO: 900154 - protein, 279 aa, Homo sapiens
VPARSLWGESWAWRAPLGVLQGRLQTPFSTAGSWRLFSHWREGSVGLNSLVAENFGVYKRGGELTPNDACFAGEVGEMTLTADPPDGIKVFPNEEDLTDLQVTIEGPEGTPYAGGLFRMKLLLGKDFPASPPKGYFLTKIFHPNVGANGEICVNVLKRDWTAELGIRHVLLTIKCLLIHPNPESALNEEAGRLLLENYEEYAARARLLTEIHGGAGGPSGRAEAGRALASGTEASSTDPGAPGGPGGAEGPMAKKHAGERDKKLAAKKKTDKKRALRRL

SEQ ID NO: 900155 - protein, 390 aa, Homo sapiens
EPSRPPRAPIGRPATQPSPPLPSLLTIVCGEGSERVENQGTCALTSRLRLGAEGPRRAWPAGGYKEAVVRARPAQCCRAPGRRVGLRCARRTSEAAGSGAGPPGPLQGRSGSSWAPRPGRRTEERRKGAGGTRPRPAAAMNSNVENLPPHIIRLVYKEVTTLTADPPDGIKVFPNEEDLTDLQVTIEGPEGTPYAGGLFRMKLLLGKDFPASPPKGYFLTKIFHPNVGANGEICVNVLKRDWTAELGIRHVLLLSWKDKQCQTQDTQVLLRSAQEHLTMQRVTIKCLLIHPNPESALNEEAGRLLLENYEEYAARARLLTEIHGGAGGPSGRAEAGRALASGTEASSTDPGAPGGPGGAEGPMAKKHAGERDKKLAAKKKTDKKRALRRL

SEQ ID NO: 900156 - protein, 342 aa, Homo sapiens
METTFYDDALNASFLPSESGPYGYSNPKILKQSMTLNLADPVGSLKPHLRAKNSDLLTSPDVGLLKLASPELERLIIQSSNGHITTTPTPTQFLCPKNVTDEQEGFAEGFVRALAELHSQNTLPSVTSAAQPVNGAGMVAPAVASVAGGSGSGGFSASLHSEPPVYANLSNFNPGALSSGGGAPSYGAAGLAFPAQPQQQQQPPHHLPQQMPVQHPRLQALKEEPQTVPEMPGETPPLSPIDMESQERIKAERKRMRNRIAASKCRKRKLERIARLEEKVKTLKAQNSELASTANMLREQVAQLKQKVMNHVNSGCQLHANAAVANILKRDRRGLRGNEEKK

SEQ ID NO: 900157 - protein, 342 aa, Homo sapiens; identical to SEQ ID NO: 900156

SEQ ID NO: 900158 - protein, 342 aa, Homo sapiens; identical to SEQ ID NO: 900156

SEQ ID NO: 900159 - protein, 354 aa, Homo sapiens
MTAKMETTFYDDALNASFLPSESGPYGYSNPKILKQSMTLNLADPVGSLKPHLRAKNSDLLTSPDVGLLKLASPELERLIIQSSNGHITTTPTPTQFLCPKNVTDEQEGFAEGFVRALAELHSQNTLPSVTSAAQPVNGAGMVAPAVASVAGGSGSGGFSASLHSEPPVYANLSNFNPGALSSGGGAPSYGAAGLAFPAQPQQQQQPPHHLPQQMPVQHPRLQALKEEPQTVPEMPGETPPLSPIDMESQERIKAERKRMRNRIAASKCRKRKLERIARLEEKVKTLKAQNSELASTANMLREQVAQLKQKVMNHVNSGCQLHANAAVANILKRDRRGQGLLQFRRRGREFSSS

SEQ ID NO: 900160 - protein, 223 aa, Homo sapiens
MTAKMETTFYDDALNASFLPSESGPYGYSNPKILKQSMTLNLADPVGSLKPHLRAKNSDLLTSPDVGLLKLASPELERLIIQSSNGHITTTPTPTQFLCPKNVTDEQEGFAEGFVRALAELHSQNTLPSVTSAAQPVNGAGMVAPAVASVAGGSGSGGFSASLHSEPPVYANLSNFNPGALSSGGGAPSYGAAGLAFPAQPQQERERDTARDAVSTGVRPERS

SEQ ID NO: 900161 - protein, 342 aa, Homo sapiens; identical to SEQ ID NO: 900156

SEQ ID NO: 900162 - protein, 132 aa, Homo sapiens
MPVQHPRLQALKEEPQTVPEMPGETPPLSPIDMESQERIKAERKRMRNRIAASKCRKRKLERIARLEEKVKTLKAQNSELASTANMLREQVAQLKQKVMNHVNSGCQLHANAAVANILKRDRRGLRGNEEKK

SEQ ID NO: 900163 - protein, 319 aa, Homo sapiens
MTAKMETTFYDDALNASFLPSESGPYGYSNPKILKQSMTLNLADPVGSLKPHLRAKNSDLLTSPDVGLLKLASPELERLIIQSSNGHITTTPTPTQFLCPKNVTDEQEGFAEGFVRALAELHSQNTLPSVTSAAQPVNGAGMVAPAVASVAGGSGSGGFSASLHSEPPVYANLSNFNPGALSSGGGAPSYGAAGLAFPAQPQQQQQPPHHLPQQMPVQHPRLQALKEEPQTVPEMPGETPPLSPIDMESQERIKAERKRMRNRIAASKCRKRKLERIARLEQCLATMHAPQSELIPLSQQCQGTRSTEFCTSHIPMTIS

SEQ ID NO: 900164 - protein, 57 aa, Homo sapiens
MPTGKQLADIGYKTFSTSMMLLTVYGGYLCSVRVYHYFQWRRAQRQAAEEQKTSGIM

SEQ ID NO: 900165 - protein, 57 aa, Homo sapiens; identical to SEQ ID NO: 900164

SEQ ID NO: 900166 - protein, 57 aa, Homo sapiens; identical to SEQ ID NO: 900164

SEQ ID NO: 900167 - protein, 133 aa, Homo sapiens
MRRSCSIQVRCRLGPSRGCQSHCLRAHLGQSPLAASSHPLVCRPGALEFTRFCCVADRELHCFLPKPKLLAAVGDKMPTGKQLADIGYKTFSTSMMLLTVYGGYLCSVRVYHYFQWRRAQRQAAEEQKTSGIM

SEQ ID NO: 900168 - protein, 57 aa, Homo sapiens; identical to SEQ ID NO: 900164

SEQ ID NO: 900169 - protein, 57 aa, Homo sapiens; identical to SEQ ID NO: 900164

SEQ ID NO: 900170 - protein, 57 aa, Homo sapiens; identical to SEQ ID NO: 900164

SEQ ID NO: 900171 - protein, 392 aa, Homo sapiens
MSTRESFNPESYELDKSFRLTRFTELKGTGCKVPQDVLQKLLESLQENHFQEDEQFLGAVMPRLGIGMDTCVIPLRHGGLSLVQTTDYIYPIVDDPYMMGRIACANVLSDLYAMGVTECDNMLMLLGVSNKMTDRERDKVMPLIIQGFKDAAEEAGTSVTGGQTVLNPWIVLGGVATTVCQPNEFIMPDNAVPGDVLVLTKPLGTQVAVAVHQWLDIPEKWNKIKLVVTQEDVELAYQEAMMNMARLNRTAAGLMHTFNAHAATDITGFGILGHAQNLAKQQRNEVSFVIHNLPVLAKMAAVSKACGNMFGLMHGTCPETSGGLLICLPREQAARFCAEIKSPKYGEGHQAWIIGIVEKGNRTARIIDKPRIIEVAPQVATQNVNPTPGATS

SEQ ID NO: 900172 - protein, 392 aa, Homo sapiens; identical to SEQ ID NO: 900171

SEQ ID NO: 900173 - protein, 392 aa, Homo sapiens; identical to SEQ ID NO: 900171

SEQ ID NO: 900174 - protein, 321 aa, Homo sapiens
MSTRESFNPESYELDKSFRLTRFTELKGTGCKVPQDVLQKLLESLQENHFQEDEQFLGAVMPRLGIGMDTCVIPLRHGGLSLVQTTDYIYPIVDDPYMMGRIACANVLSDLYAMGVTECDNMLMLLGVSNKMTDRERDKVMPLIIQGFKDAAEEAGTSVTGGQTVLNPWIVLGGVATTVCQPNEFIMPDNAVPGDVLVLTKPLGTQVAVAVHQWLDIPEKWNKIKLVVTQEDVELAYQEAMMNMARLNRTGGLLICLPREQAARFCAEIKSPKYGEGHQAWIIGIVEKGNRTARIIDKPRIIEVAPQVATQNVNPTPGATS

SEQ ID NO: 900175 - protein, 200 aa, Homo sapiens
MSTRESFNPESYELDKSFRLTRFTELKGTGCKVPQDVLQKLLESLQENHFQEDEQFLGAVMPRLGIGMDTCVIPLRHGGLSLVQTTDYIYPIVDDPYMMGRIACANVLSDLYAMGVTECDNMLMLLGVSNKMTDRERDKVMPLIIQGFKDAAEEAGTSVTGGQTVLNPWIVLGGVATTVCQPNEFIMPDNAVPGDVLVLT

SEQ ID NO: 900176 - protein, 195 aa, Homo sapiens
MSTRESFNPESYELDKSFRLTRFTELKGTGCKVPQDVLQKLLESLQENHFQEDEQFLGAVMPRLGIGMDTCVIPLRHGGLSLVQTTDYIYPIVDDPYMMGRIACANVLSDLYAMGVTECDNMLMLLGVSNKMTDRERDKVMPLIIQGFKDAAEEAGTSVTGGQTVLNPWIVLGGVATTVCQPNEFIILRNGIRLN

SEQ ID NO: 900177 - protein, 152 aa, Homo sapiens
MMNMARLNRTAAGLMHTFNAHAATDITGFGILGHAQNLAKQQRNEVSFVIHNLPVLAKMAAVSKACGNMFGLMHGTCPETSGGLLICLPREQAARFCAEIKSPKYGEGHQAWIIGIVEKGNRTARIIDKPRIIEVAPQVATQNVNPTPGATS

SEQ ID NO: 900178 - protein, 321 aa, Homo sapiens; identical to SEQ ID NO: 900174

SEQ ID NO: 900179 - protein, 51 aa, Homo sapiens
MHTFNAHAATDITGFGILGHAQNLAKQQRNEVSFVIHNLPVLAKMAAVSKA

SEQ ID NO: 900180 - protein, 392 aa, Homo sapiens; identical to SEQ ID NO: 900171

SEQ ID NO: 900181 - protein, 392 aa, Homo sapiens; identical to SEQ ID NO: 900171

SEQ ID NO: 900182 - protein, 325 aa, Homo sapiens
MDTCVIPLRHGGLSLVQTTDYIYPIVDDPYMMGRIACANVLSDLYAMGVTECDNMLMLLGVSNKMTDRERDKVMPLIIQGFKDAAEEAGTSVTGGQTVLNPWIVLGGVATTVCQPNEFIMPDNAVPGDVLVLTKPLGTQVAVAVHQWLDIPEKWNKIKLVVTQEDVELAYQEAMMNMARLNRTAAGLMHTFNAHAATDITGFGILGHAQNLAKQQRNEVSFVIHNLPVLAKMAAVSKACGNMFGLMHGTCPETSGGLLICLPREQAARFCAEIKSPKYGEGHQAWIIGIVEKGNRTARIIDKPRIIEVAPQVATQNVNPTPGATS

SEQ ID NO: 900183 - protein, 392 aa, Homo sapiens; identical to SEQ ID NO: 900171

SEQ ID NO: 900184 - protein, 392 aa, Homo sapiens; identical to SEQ ID NO: 900171

SEQ ID NO: 900185 - protein, 200 aa, Homo sapiens; identical to SEQ ID NO: 900175

SEQ ID NO: 900186 - protein, 101 aa, Homo sapiens
PHAATQQPVPPLKGRWPALKDPRAPSRRERGGPAPAAAPRQASPRGAQARARAPAAAGAAGRGIFIQATLKGARPRPVHCGSGPRPVFGRRRRAQSEPVDP

SEQ ID NO: 900187 - protein, 105 aa, Homo sapiens
PPAKGPARGAAKKRRLPAPPPRTAQPRRPAPTLPTTSTFSLLNCFPCPPALVVGEDGDLKPASSLRLQGDSKPPPAHPLWRWQMGGPAVPEPPGLKFWGINMDES

SEQ ID NO: 900188 - protein, 105 aa, Homo sapiens; identical to SEQ ID NO: 900187

SEQ ID NO: 900189 - protein, 105 aa, Homo sapiens; identical to SEQ ID NO: 900187

SEQ ID NO: 900190 - protein, 77 aa, Homo sapiens
EAICFRVCGARSVVLLLVAVRLHTLLSCPLEQPAGTEWILEEGVTTGPPRKPRADIYNLRSPDEFIVGQNQALIEPG

SEQ ID NO: 900191 - protein, 77 aa, Homo sapiens; identical to SEQ ID NO: 900190

SEQ ID NO: 900192 - protein, 77 aa, Homo sapiens; identical to SEQ ID NO: 900190

SEQ ID NO: 900193 - protein, 107 aa, Homo sapiens [sequence omitted]

SEQ ID NO: 900194 - protein, 69 aa, Homo sapiens
ADSRGFSTSTTFRLHTAMVLPLEQPAGTEWILEEGVTTGPPRKPRADIYNLRSPDEFIVGQNQALIEPG

SEQ ID NO: 900195 - protein, 77 aa, Homo sapiens; identical to SEQ ID NO: 900190

SEQ ID NO: 900196 - protein, 47 aa, Homo sapiens
MSFWSWKSHCLLHGPEKPLAGVNDDFTFFPIRSTMLTSYILPVSSDT

SEQ ID NO: 900197 - protein, 79 aa, Homo sapiens
LEDPLALIAFRTDNIHTVFLMRRFIRYGPVPLEQPAGTEWILEEGVTTGPPRKPRADIYNLRSPDEFIVGQNQALIEPG

SEQ ID NO: 900198 - protein, 77 aa, Homo sapiens; identical to SEQ ID NO: 900190

SEQ ID NO: 900199 - protein, 107 aa, Homo sapiens [sequence omitted]

SEQ ID NO: 900200 - protein, 77 aa, Homo sapiens; identical to SEQ ID NO: 900190

SEQ ID NO: 900201 - protein, 112 aa, Homo sapiens
MASFDLLTFYRWRPFPRRCGKWGEHNWPLKEKRRETCADHAQFPRAPQPPRVQRGKKSLPCAGKNSGEHSETAPKCAIVGVLLQQEYNLRLSLFCLLYTSILEKRREEREKR

SEQ ID NO: 900202 - protein, 77 aa, Homo sapiens; identical to SEQ ID NO: 900190

SEQ ID NO: 900203 - protein, 77 aa, Homo sapiens; identical to SEQ ID NO: 900190

SEQ ID NO: 900204 - protein, 102 aa, Homo sapiens
EAICFRVCGARSVVLLLVAVRLHTLLSCPLEQPAGTEWILEEGVTTGPPRKPRADIYNLRSPDENWRWNMRGALWKEKDRPCAFMKVKIWLNQFHKVTVYIA

SEQ ID NO: 900205 - protein, 77 aa, Homo sapiens; identical to SEQ ID NO: 900190

SEQ ID NO: 900206 - protein, 102 aa, Homo sapiens; identical to SEQ ID NO: 900204

SEQ ID NO: 900207 - protein, 69 aa, Homo sapiens; identical to SEQ ID NO: 900194

SEQ ID NO: 900208 - protein, 77 aa, Homo sapiens; identical to SEQ ID NO: 900190

SEQ ID NO: 900209 - protein, 79 aa, Homo sapiens; identical to SEQ ID NO: 900197

SEQ ID NO: 900210 - protein, 593 aa, Homo sapiens
MKLQAVMETLLQRQQRARQELEARQQLPPDPPAAPPGRARAAPDEDREPESARMQRAQMAALAAMRAAAAGLGHPASPGGSEDGPPGSEEEDAAREGTPGSPGRGREGPGEEHFEDMASDEDMKPKWEEEEMEEDLGEDEEEEEEDYEDEEEEEDEEGLGPPGPASLGTTALFPRKAQPPQAFRGDGVPRVLGGQERPGPGPAHPGGAAHVAPQLQPPDHGDWTYEEQFKQLYELDGDPKRKEFLDDLFSFMQKRGTPVNRIPIMAKQVLDLFMLYVLVTEKGGLVEVINKKLWREITKGLNLPTSITSAAFTLRTQYMKYLYPYECEKRGLSNPNELQAAIDSNRREGRRQSFGGSLFAYSPGGAHGMLSSPKLPVSSLGLAASTNGSSITPAPKIKKEEDSAIPITVPGRLPVSLAGHPVVAAQAAAVQAAAAQAAVAAQAAALEQLREKLESAEPPEKKMALVADEQQRLMQRALQQNFLAMAAQLPMSIRINSQASESRQDSAVNLTGTNGSNSISMSVEINGIMYTGVLFAQPPAPTPTSAPNKGGGGGGGSSSNAGGRGGNTGTSGGQAGPAGLSTPSTSTSNNSLP

SEQ ID NO: 900211 - protein, 368 aa, Homo sapiens
MSHPTWLYELDGDPKRKEFLDDLFSFMQKRGTPVNRIPIMAKQVLDLFMLYVLVTEKGGLVEVINKKLWREITKGLNLPTSITSAAFTLRTQYMKYLYPYECEKRGLSNPNELQAAIDSNRREGRRQSFGGSLFAYSPGGAHGMLSSPKLPVSSLGLAASTNGSSITPAPKIKKEEDSAIPITVPGRLPVSLAGHPVVAAQAAAVQAAAAQAAVAAQAAALEQLREKLESAEPPEKKMALVADEQQRLMQRALQQNFLAMAAQLPMSIRINSQASESRQDSAVNLTGTNGSNSISMSVEINGIMYTGVLFAQPPAPTPTSAPNKGGGGGGGSSSNAGGRGGNTGTSGGQAGPAGLSTPSTSTSNNSLP

SEQ ID NO: 900212 - protein, 108 aa, Homo sapiens
MPPLHSSLGDRVREKFIPRSTPLGLPCGPPRIFLNSAWHMSSVLALGVLFAQPPAPTPTSAPNKGGGGGGGSSSNAGGRGGNTGTSGGQAGPAGLSTPSTSTSNNSLP

SEQ ID NO: 900213 - protein, 553 aa, Homo sapiens
MKLQAVMETLLQRQQRARQELEARQQLPPDPPAAPPGRARAAPDEDREPESARMQRAQMAALAAMRAAAAGLGHPASPGGSEDGPPGSEEEDAAREGTPGSPGRGREGPGEEHFEDMASDEDMKPKWEEEEMEEDLGEDEEEEEEDYEDEEEEEDEEGLGPPGPASLGTTALFPRKAQPPQAFRGDGVPRVLGGQERPGPGPAHPGGAAHVAPQLQPPDHGDWTYEEQFKQLYELDGDPKRKEFLDDLFSFMQKRGTPVNRIPIMAKQVLDLFMLYVLVTEKGGLVEVINKKLWREITKGLNLPTSITSAAFTLRTQYMKYLYPYECEKRGLSNPNELQAAIDSNRREGRRQSFGGSLFAYSPGGAHGMLSSPKLPVSSLGLAASTNGSSITPAPKIKKEEDSAIPITVPGRLPVSLAGHPVVAAQAAAVQAAAAQAAVAAQAAALEQLREKLESAEPPEKKMALVADEQQRLMQRALQQNFLAMAAQLPMSIRINSQASESRQDSAVNLTGTNGSNSISMSVEINGIMYTGRTPEATPCLDLASPAAVNSGP

SEQ ID NO: 900214 - protein, 1099 aa, Homo sapiens
VGACARGAQARAFFPFLSFLCYPRFRCLFCLQFAIPASRMEQLNELELLMEKSFWEEAELPAELFQKKVVASFPRTVLSTGMDNRYLVLAVNTVQNKEGNCEKRLVITASQSLENKELCILRNDWCSVPVEPGDIIHLEGDCTSDTWIIDKDFGYLILYPDMLISGTSIASSIRCMRRAVLSETFRSSDPATRQMLIGTVLHEVFQKAINNSFAPEKLQELAFQTIQEIRHLKEMYRLNLSQDEIKQEVEDYLPSFCKWAGDFMHKNTSTDFPQMQLSLPSDNSKDNSTCNIEVVKPMDIEESIWSPRFGLKGKIDVTVGVKIHRGYKTKYKIMPLELKTGKESNSIEHRSQVVLYTLLSQERRADPEAGLLLYLKTGQMYPVPANHLDKRELLKLRNQMAFSLFHRISKSATRQKTQLASLPQIIEEEKTCKYCSQIGNCALYSRAVEQQMDCSSVPIVMLPKIEEETQHLKQTHLEYFSLWCLMLTLESQSKDNKKNHQNIWLMPASEMEKSGSCIGNLIRMEHVKIVCDGQYLHNFQCKHGAIPVTNLMAGDRVIVSGEERSLFALSRGYVKEINMTTVTCLLDRNLSVLPESTLFRLDQEEKNCDIDTPLGNLSKLMENTFVSKKLRDLIIDFREPQFISYLSSVLPHDAKDTVACILKGLNKPQRQAMKKVLLSKDYTLIVGMPGTGKTTTICTLVRILYACGFSVLLTSYTHSAVDNILLKLAKFKIGFLRLGQIQKVHPAIQQFTEQEICRSKSIKSLALLEELYNSQLIVATTCMGINHPIFSRKIFDFCIVDEASQISQPICLGPLFFSRRFVLVGDHQQLPPLVLNREARALGMSESLFKRLEQNKSAVVQLTVQYRMNSKIMSLSNKLTYEGKLECGSDKVANAVINLRHFKDVKLELEFYADYSDNPWLMGVFEPNNPVCFLNTDKVPAPEQVEKGGVSNVTEAKLIVFLTSIFVKAGCSPSDIGIIAPYRQQLKIINDLLARSIGMVEVNTVDKYQGRDKSIVLVSFVRSNKDGTVGELLKDWRRLNVAITRAKHKLILLGCVPSLNCYPPLEKLLNHLNSEKLIIDLPSREHESLCHILGDFQRE

SEQ ID NO: 900215 - protein, 872 aa, Homo sapiens
VGACARGAQARAFFPFLSFLCYPRFRCLFCLQFAIPASRMEQLNELELLMEKSFWEEAELPAELFQKKVVASFPRTVLSTGMDNRYLVLAVNTVQNKEGNCEKRLVITASQSLENKELCILRNDWCSVPVEPGDIIHLEGDCTSDTWIIDKDFGYLILYPDMLISGTSIASSIRCMRRAVLSETFRSSDPATRQMLIGTVLHEVFQKAINNSFAPEKLQELAFQTIQEIRHLKEMYRLNLSQDEIKQEVEDYLPSFCKWAGDFMHKNTSTDFPQMQLSLPSDNSKDNSTCNIEVVKPMDIEESIWSPRFGLKGKIDVTVGVKIHRGYKTKYKIMPLELKTGKESNSIEHRSQVVLYTLLSQERRADPEAGLLLYLKTGQMYPVPANHLDKRELLKLRNQMAFSLFHRISKSATRQKTQLASLPQIIEEEKTCKYCSQIGNCALYSRAVEQQMDCSSVPIVMLPKIEEETQHLKQTHLEYFSLWCLMLTLESQSKDNKKNHQNIWLMPASEMEKSGSCIGNLIRMEHVKIVCDGQYLHNFQCKHGAIPVTNLMAGDRVIVSGEERSLFALSRGYVKEINMTTVTCLLDRNLSVLPESTLFRLDQEEKNCDIDTPLGNLSKLMENTFVSKKLRDLIIDFREPQFISYLSSVLPHDAKDTVACILKGLNKPQRQAMKKVLLSKDYTLIVGMPGTGKTTTICTLVRILYACGFSVLLTSYTHSAVDNILLKLAKFKIGFLRLGQIQKVHPAIQQFTEQEICRSKSIKSLALLEELYNSQLIVATTCMGINHPIFSRKIFDFCIVDEASQISQPICLGPLFFSRRFVLVGDHQQLPPLVLNREARALGMSESLFKRLEQNKSAVVQLTVQYRMNRYL

SEQ ID NO: 900216 - protein, 227 aa, Homo sapiens [sequence omitted]

SEQ ID NO: 900217 - protein, 443 aa, Homo sapiens
LFLNLNVGLNKPQRQAMKKVLLSKDYTLIVGMPGTGKTTTICTLVRILYACGFSVLLTSYTHSAVDNILLKLAKFKIGFLRLGQIQKVHPAIQQFTEQEICRSKSIKSLALLEELYNSQLIVATTCMGINHPIFSRKIFDFCIVDEASQISQPICLGPLFFSRRFVLVGDHQQLPPLVLNREARALGMSESLFKRLEQNKSAVVQLTVQYRMNSKIMSLSNKLTYEGKLECGSDKVANAVINLRHFKDVKLELEFYADYSDNPWLMGVFEPNNPVCFLNTDKVPAPEQVEKGGVSNVTEAKLIVFLTSIFVKAGCSPSDIGIIAPYRQQLKIINDLLARSIGMVEVNTVDKYQGRDKSIVLVSFVRSNKDGTVGELLKDWRRLNVAITRAKHKLILLGCVPSLNCYPPLEKLLNHLNSEKLIIDLPSREHESLCHILGDFQRE

SEQ ID NO: 900218 - protein, 588 aa, Homo sapiens
VGACARGAQARAFFPFLSFLCYPRFRCLFCLQFAIPASRMEQLNELELLMEKSFWEEAELPAELFQKKVVASFPRTVLSTGMDNRYLVLAVNTVQNKEGNCEKRLVITASQSLENKELCILRNDWCSVPVEPGDIIHLEGDCTSDTWIIDKDFGYLILYPDMLISGTSIASSIRCMRRAVLSETFRSSDPATRQMLIGTVLHEVFQKAINNSFAPEKLQELAFQTIQEIRHLKEMYRLNLSQDEIKQEVEDYLPSFCKWAGDFMHKNTSTDFPQMQLSLPSDNSKDNSTCNIEVVKPMDIEESIWSPRFGLKGKIDVTVGVKIHRGYKTKYKIMPLELKTGKESNSIEHRSQVVLYTLLSQERRADPEAGLLLYLKTGQMYPVPANHLDKRELLKLRNQMAFSLFHRISKSATRQKTQLASLPQIIEEEKTCKYCSQIGNCALYSRAVEQQMDCSSVPIVMLPKIEEETQHLKQTHLEYFSLWCLMLTLESQSKDNKKNHQNIWLMPASEMEKSGSCIGNLIRMEHVKIVCDGQYLHNFQCKHGAIPVTNLMAGDRVIVSGEERSLFALSRGYVKEINMTTVTCLLDR

SEQ ID NO: 900219 - protein, 840 aa, Homo sapiens
VGACARGAQARAFFPFLSFLCYPRFRCLFCLQFAIPASRMEQLNELELLMEKSFWEEAELPAELFQKKVVASFPRTVLSTGMDNRYLVLAVNTVQNKEGNCEKRLVITASQSLENKELCILRNDWCSVPVEPGDIIHLEGDCTSDTWIIDKDFGYLILYPDMLISGTSIASSIRCMRRAVLSETFRSSDPATRQMLIGTVLHEVFQKAINNSFAPEKLQELAFQTIQEIRHLKEMYRLNLSQDEIKQEVEDYLPSFCKWAGDFMHKNTSTDFPQMQLSLPSDNSKDNSTCNIEVVKPMDIEESIWSPRFGLKGKIDVTVGVKIHRGYKTKYKIMPLELKTGKESNSIEHRSQVVLYTLLSQERRADPEAGLLLYLKTGQMYPVPANHLDKRELLKLRNQMAFSLFHRISKSATRQKTQLASLPQIIEEEKTCKYCSQIGNCALYSRAVEQQMDCSSVPIVMLPKIEEETQHLKQTHLEYFSLWCLMLTLESQSKDNKKNHQNIWLMPASEMEKSGSCIGNLIRMEHVKIVCDGQYLHNFQCKHGAIPVTNLMAGDRVIVSGEERSLFALSRGYVKEINMTTVTCLLDRNLSVLPESTLFRLDQEEKNCDIDTPLGNLSKLMENTFVSKKLRDLIIDFREPQFISYLSSVLPHDAKDTVACILKGLNKPQRQAMKKVLLSKDYTLIVGMPGTGKTTTICTLVRILYACGFSVLLTSYTHSAVDNILLKLAKFKIGFLRLGQIQKVHPAIQQFTEQEICRSKSIKSLALLEELYNSQLIVATTCMGINHPIFSRKIFDFCIVDEASQISQPICLGPLFFSRRFVLVGDHQQLPPLVLNREAR

SEQ ID NO: 900220 - protein, 840 aa, Homo sapiens; identical to SEQ ID NO: 900219

SEQ ID NO: 900221 - protein, 840 aa, Homo sapiens; identical to SEQ ID NO: 900219

SEQ ID NO: 900222 - protein, 477 aa, Homo sapiens
VGACARGAQARAFFPFLSFLCYPRFRCLFCLQFAIPASRMEQLNELELLMEKSFWEEAELPAELFQKKVVASFPRTVLSTGMDNRYLVLAVNTVQNKEGNCEKRLVITASQSLENKELCILRNDWCSVPVEPGDIIHLEGDCTSDTWIIDKDFGYLILYPDMLISGTSIASSIRCMRRAVLSETFRSSDPATRQMLIGTVLHEVFQKAINNSFAPEKLQELAFQTIQEIRHLKEMYRLNLSQDEIKQEVEDYLPSFCKWAGDFMHKNTSTDFPQMQLSLPSDNSKDNSTCNIEVVKPMDIEESIWSPRFGLKGKIDVTVGVKIHRGYKTKYKIMPLELKTGKESNSIEHRSQVVLYTLLSQERRADPEAGLLLYLKTGQMYPVPANHLDKRELLKLRNQMAFSLFHRISKSATRQKTQLASLPQIIEEEKTCKYCSQIGNCALYSRAVEQQMDCSSVPIVMLPKIEEETQIYTGAGS

SEQ ID NO: 900223 - protein, 111 aa, Homo sapiens
MSLLPRRAPPVSMRLLAAALLLLLLALYTARVDGSKCKCSRKGPKIRYSDVKKLEMKPKYPHCEEKMVIITTKSVSRYRGQEHCLHPKLQSTKRFIKWYNAWNEKRRVYEE

SEQ ID NO: 900224 - protein, 111 aa, Homo sapiens; identical to SEQ ID NO: 900223

SEQ ID NO: 900225 - protein, 111 aa, Homo sapiens; identical to SEQ ID NO: 900223

SEQ ID NO: 900226 - protein, 111 aa, Homo sapiens; identical to SEQ ID NO: 900223

SEQ ID NO: 900227 - protein, 111 aa, Homo sapiens; identical to SEQ ID NO: 900223

SEQ ID NO: 900228 - protein, 111 aa, Homo sapiens; identical to SEQ ID NO: 900223

SEQ ID NO: 900229 - protein, 77 aa, Homo sapiens
HQDDSSSIPLVCATLNNHVNEANTIRCSVRDTIVIITTKSVSRYRGQEHCLHPKLQSTKRFIKWYNAWNEKRRVYEE

SEQ ID NO: 900230 - protein, 111 aa, Homo sapiens; identical to SEQ ID NO: 900223

SEQ ID NO: 900231 - protein, 111 aa, Homo sapiens; identical to SEQ ID NO: 900223

SEQ ID NO: 900232 - protein, 112 aa, Homo sapiens
MSAEVPEAASAEEQKEMEDKVTSPEKAEEAKLKARYPHLGQKPGGSDFLRKRLQKGQKYFDSGDYNMAKAKMKNKQLPTAAPDKTEVTGDHIPTPQDLPQRKPSLVASKLAG

SEQ ID NO: 900233 - protein, 112 aa, Homo sapiens; identical to SEQ ID NO: 900232

SEQ ID NO: 900234 - protein, 112 aa, Homo sapiens; identical to SEQ ID NO: 900232

SEQ ID NO: 900235 - protein, 131 aa, Homo sapiens
MSAEVPEAASAEEQKSEHNMLPWSLQPSIPNSLEEMEDKVTSPEKAEEAKLKARYPHLGQKPGGSDFLRKRLQKGQKYFDSGDYNMAKAKMKNKQLPTAAPDKTEVTGDHIPTPQDLPQRKPSLVASKLAG

SEQ ID NO: 900236 - protein, 106 aa, Homo sapiens
YGICDQASEEMEDKVTSPEKAEEAKLKARYPHLGQKPGGSDFLRKRLQKGQKYFDSGDYNMAKAKMKNKQLPTAAPDKTEVTGDHIPTPQDLPQRKPSLVASKLAG

SEQ ID NO: 900237 - protein, 164 aa, Homo sapiens
EWYQRRVAITAGGRKKGSVWTTASGRSGVKGSTMSAEVPEAASAEEQKSEHNMLPWSLQPSIPNSLEEMEDKVTSPEKAEEAKLKARYPHLGQKPGGSDFLRKRLQKGQKYFDSGDYNMAKAKMKNKQLPTAAPDKTEVTGDHIPTPQDLPQRKPSLVASKLAG

SEQ ID NO: 900238 - protein, 90 aa, Homo sapiens
RVVSTQSRHYGRGKEKRKCLDDSEREKRGQVGRGAVREGQAGSGVRGPWPAERFAAPCRHKAAAIFAGGGGPAGPGRAGTGGGRVASATR

SEQ ID NO: 900239 - protein, 88 aa, Homo sapiens
IMAGTTASWIFGVKGSTMSAEVPEAASAEEQKEMEDKVTSPEKAEEAKLKARYPHLGQKPGGSDFLRKRLQKGQKYFDSGDYNMAKAW

SEQ ID NO: 900240 - protein, 112 aa, Homo sapiens; identical to SEQ ID NO: 900232

SEQ ID NO: 900241 - protein, 112 aa, Homo sapiens; identical to SEQ ID NO: 900232

SEQ ID NO: 900242 - protein, 90 aa, Homo sapiens; identical to SEQ ID NO: 900238

SEQ ID NO: 900243 - protein, 112 aa, Homo sapiens; identical to SEQ ID NO: 900232

SEQ ID NO: 900244 - protein, 145 aa, Homo sapiens
EWYQRRVAITAGGRKKGSVWTTASGRSGVKGSTMSAEVPEAASAEEQKEMEDKVTSPEKAEEAKLKARYPHLGQKPGGSDFLRKRLQKGQKYFDSGDYNMAKAKMKNKQLPTAAPDKTEVTGDHIPTPQDLPQRKPSLVASKLAG

SEQ ID NO: 900245 - protein, 130 aa, Homo sapiens
AAATNGCEVRQERRPLKEKRKCLDDSEREKRGQEMEDKVTSPEKAEEAKLKARYPHLGQKPGGSDFLRKRLQKGQKYFDSGDYNMAKAKMKNKQLPTAAPDKTEVTGDHIPTPQDLPQRKPSLVASKLAG

SEQ ID NO: 900246 - protein, 142 aa, Homo sapiens
MWARIGISGPTLVTMVSEESPAFSVFTCKGRILVLASHGGVRPEEEMEDKVTSPEKAEEAKLKARYPHLGQKPGGSDFLRKRLQKGQKYFDSGDYNMAKAKMKNKQLPTAAPDKTEVTGDHIPTPQDLPQRKPSLVASKLAG

SEQ ID NO: 900247 - protein, 146 aa, Homo sapiens
RVVSTQSRHYGRGKEKRKCLDDSEREKRGQSEHNMLPWSLQPSIPNSLEEMEDKVTSPEKAEEAKLKARYPHLGQKPGGSDFLRKRLQKGQKYFDSGDYNMAKAKMKNKQLPTAAPDKTEVTGDHIPTPQDLPQRKPSLVASKLAG

SEQ ID NO: 900248 - protein, 112 aa, Homo sapiens; identical to SEQ ID NO: 900232

SEQ ID NO: 900249 - protein, 112 aa, Homo sapiens; identical to SEQ ID NO: 900232

SEQ ID NO: 900250 - protein, 112 aa, Homo sapiens; identical to SEQ ID NO: 900232

SEQ ID NO: 900251 - protein, 66 aa, Homo sapiens
SRVLLEACDVSRRIIHIQIIGQFCKEAELILHFYHSIPAVANRGLDISHSVIVNLRIKTLTLIRFY

SEQ ID NO: 900252 - protein, 105 aa, Homo sapiens
WVSGEGQGLGLSFKMVPTCPSLSPPWPGTRGWGCFRLSGAAGLALEWGSLLAWNSLTLGASSPGGGARKLPPSLWGISPFKQVELCSGAASCSQCADVRGQNDFY

SEQ ID NO: 900253 - protein, 515 aa, Homo sapiens
MAAPEPARAAPPPPPPPPPPPGADRVVKAVPFPPTHRLTSEEVFDLDGIPRVDVLKNHLVKEGRVDEEIALRIINEGAAILRREKTMIEVEAPITVCGDIHGQFFDLMKLFEVGGSPANTRYLFLGDYVDRGYFSIEHVLGTEDISINPHNNINECVLYLWVLKILYPSTLFLLRGNHECRHLTEYFTFKQECKIKYSERVYEACMEAFDSLPLAALLNQQFLCVHGGLSPEIHTLDDIRRLDRFKEPPAFGPMCDLLWSDPSEDFGNEKSQEHFSHNTVRGCSYFYNYPAVCEFLQNNNLLSIIRAHEAQDAGYRMYRKSQTTGFPSLITIFSAPNYLDVYNNKAAVLKYENNVMNIRQFNCSPHPYWLPNFMDVFTWSLPFVGEKVTEMLVNVLSICSDDELMTEGEDQFDVGSAAARKEIIRNKIRAIGKMARVFSVLREESESVLTLKGLTPTGMLPSGVLAGGRQTLQSGNDVMQLAVPQMDWGTPHSFANNSHNACREFLLFFSSCLSS

SEQ ID NO: 900254 - protein, 525 aa, Homo sapiens
MAAPEPARAAPPPPPPPPPPPGADRVVKAVPFPPTHRLTSEEVFDLDGIPRVDVLKNHLVKEGRVDEEIALRIINEGAAILRREKTMIEVEAPITVCGDIHGQFFDLMKLFEVGGSPANTRYLFLGDYVDRGYFSIECVLYLWVLKILYPSTLFLLRGNHECRHLTEYFTFKQECKIKYSERVYEACMEAFDSLPLAALLNQQFLCVHGGLSPEIHTLDDIRRLDRFKEPPAFGPMCDLLWSDPSEDFGNEKSQEHFSHNTVRGCSYFYNYPAVCEFLQNNNLLSIIRAHEAQDAGYRMYRKSQTTGFPSLITIFSAPNYLDVYNNKAAVLKYENNVMNIRQFNCSPHPYWLPNFMDVFTWSLPFVGEKVTEMLVNVLSICSDDELMTEGEDQFDVGSAAARKEIIRNKIRAIGKMARVFSVLREESESVLTLKGLTPTGMLPSGVLAGGRQTLQSATVEAIEAEKAIRGFSPPHRICSFEEAKGLDRINERMPPRKDAVQQDGFNSLNTAHATENHGTGNHTAQ

SEQ ID NO: 900255 - protein, 525 aa, Homo sapiens; identical to SEQ ID NO: 900254

SEQ ID NO: 900256 - protein, 283 aa, Homo sapiens
AEVALEYPGYHIIHFSHNTVRGCSYFYNYPAVCEFLQNNNLLSIIRAHEAQDAGYRMYRKSQTTGFPSLITIFSAPNYLDVYNNKAAVLKYENNVMNIRQFNCSPHPYWLPNFMDVFTWSLPFVGEKVTEMLVNVLSICSDDELMTEGEDQFDVGSAAARKEIIRNKIRAIGKMARVFSVLREESESVLTLKGLTPTGMLPSGVLAGGRQTLQSATVEAIEAEKAIRGFSPPHRICSFEEAKGLDRINERMPPRKDAVQQDGFNSLNTAHATENHGTGNHTAQ

SEQ ID NO: 900257 - protein, 391 aa, Homo sapiens
MAAPEPARAAPPPPPPPPPPPGADRVVKAVPFPPTHRLTSEEVFDLDGIPRVDVLKNHLVKEGRVDEEIALRIINEGAAILRREKTMIEVEAPITVCGDIHGQFFDLMKLFEVGGSPANTRYLFLGDYVDRGYFSIECVLYLWVLKILYPSTLFLLRGNHECRHLTEYFTFKQECKIKYSERVYEACMEAFDSLPLAALLNQQFLCVHGGLSPEIHTLDDIRRLDRFKEPPAFGPMCDLLWSDPSEDFGNEKSQEHFSHNTVRGCSYFYNYPAVCEFLQNNNLLSIIRAHEAQDAGYRMYRKSQTTGFPSLITIFSAPNYLDVYNNKAAVLKYENNVMNIRQFNCSPHPYWLPNFMDVFTWSLPFVGEKGIIFIFKKNLFYYCYIYSSLLS

SEQ ID NO: 900258 - protein, 415 aa, Homo sapiens
MAAPEPARAAPPPPPPPPPPPGADRVVKAVPFPPTHRLTSEEVFDLDGIPRVDVLKNHLVKEGRVDEEIALRIINEGAAILRREKTMIEVEAPITVCGDIHGQFFDLMKLFEVGGSPANTRYLFLGDYVDRGYFSIECVLYLWVLKILYPSTLFLLRGNHECRHLTEYFTFKQECKIKYSERVYEACMEAFDSLPLAALLNQQFLCVHGGLSPEIHTLDDIRRLDRFKEPPAFGPMCDLLWSDPSEDFGNEKSQEHFSHNTVRGCSYFYNYPAVCEFLQNNNLLSIIRAHEAQDAGYRMYRKSQTTGFPSLITIFSAPNYLDVYNNKAAVLKYENNVMNIRQFNCSPHPYWLPNFMDVFTWSLPFVGEKVTEMLVNVLSICSDDELMTEGEDQFDGMIIHLTIFFFTVKWYFFTA

SEQ ID NO: 900259 - protein, 525 aa, Homo sapiens; identical to SEQ ID NO: 900254

SEQ ID NO: 900260 - protein, 534 aa, Homo sapiens
MAAPEPARAAPPPPPPPPPPPGADRVVKAVPFPPTHRLTSEEVFDLDGIPRVDVLKNHLVKEGRVDEEIALRIINEGAAILRREKTMIEVEAPITVCGDIHGQFFDLMKLFEVGGSPANTRYLFLGDYVDRGYFSIECVLYLWVLKILYPSTLFLLRGNHECRHLTEYFTFKQECKIKYSERVYEACMEAFDSLPLAALLNQQFLCVHGGLSPEIHTLDDIRRLDRFKEPPAFGPMCDLLWSDPSEDFGNEKSQEHFSHNTVRGCSYFYNYPAVCEFLQNNNLLSIIRAHEAQDAGYRMYRKSQTTGFPSLITIFSAPNYLDVYNNKAAVLKYENNVMNIRQFNCSPHPYWLPNFMDVFTWSLPFVGEKVTEMLVNVLSICSDDELMTEGEDQFDERLIYGNKKVGSAAARKEIIRNKIRAIGKMARVFSVLREESESVLTLKGLTPTGMLPSGVLAGGRQTLQSATVEAIEAEKAIRGFSPPHRICSFEEAKGLDRINERMPPRKDAVQQDGFNSLNTAHATENHGTGNHTAQ

SEQ ID NO: 900261 - protein, 497 aa, Homo sapiens
MAAPEPARAAPPPPPPPPPPPGADRVVKAVPFPPTHRLTSEEVFDLDGIPRVDVLKNHLVKEGRVDEEIALRIINEGAAILRREKTMIEVEAPITVCGDIHGQFFDLMKLFEVGGSPANTRYLFLGDYVDRGYFSIECVLYLWVLKILYPSTLFLLRGNHECRHLTEYFTFKQECKIKYSERVYEACMEAFDSLPLAALLNQQFLCVHGGLSPEIHTLDDIRRLDRFKEPPAFGPMCDLLWSDPSEDFGNEKSQEHFSHNTVRGCSYFYNYPAVCEFLQNNNLLSIIRAHEAQDAGYRMYRKSQTTGFPSLITIFSAPNYLDVYNNKAAVLKYENNVMNIRQFNCSPHPYWLPNFMDVFTWSLPFVGEKVTEMLVNVLSICSDDELMTEGEDQFDVGSAAARKEIIRNKIRAIGKMARVFSVLREESESVLTLKGLTPTGMLPSGVLAGGRQTLQSGNDVMQLAVPQMDWGTPHSFANNSHNACREFLLFFSSCLSS

SEQ ID NO: 900262 - protein, 270 aa, Homo sapiens
MAAPEPARAAPPPPPPPPPPPGADRVVKAVPFPPTHRLTSEEVFDLDGIPRVDVLKNHLVKEGRVDEEIALRIINEGAAILRREKTMIEVEAPITVCGDIHGQFFDLMKLFEVGGSPANTRYLFLGDYVDRGYFSIECVLYLWVLKILYPSTLFLLRGNHECRHLTEYFTFKQECKIKYSERVYEACMEAFDSLPLAALLNQQFLCVHGGLSPEIHTLDDIRRLDRFKEPPAFGPMCDLLWSDPSEDFGNEKSQEHFSHNTVRGCSYFYN

SEQ ID NO: 900263 - protein, 222 aa, Homo sapiens
MTDVADCLKVFMTGTKNIAMWVGSKDCSFRPQIHMLIEDHIGALNKWYKYNHDLPARIIVYRAGVGDGQLKTLIEYEVPQLLSSVAESSSNTSSRLSVIVVRKKCMPRFFTEMNRTVQNPPLGTVVDSEATRNEWYDFYLISQVACRGTVSPTYYNVIYDDNGLKPDHMQRLTFKLCHLYYNWPGIVSVPAPCQYAHKLTFLVAQSIHKEPSLELANHLFYL

SEQ ID NO: 900264 - protein, 194 aa, Homo sapiens [sequence omitted]

SEQ ID NO: 900265 - protein, 219 aa, Homo sapiens
HLYSVIFNQHKNNFEWFSRCIFQRTMTDVADCLKVFMTGALNKWYKYNHDLPARIIVYRAGVGDGQLKTLIEYEVPQLLSSVAESSSNTSSRLSVIVVRKKCMPRFFTEMNRTVQNPPLGTVVDSEATRNEWYDFYLISQVACRGTVSPTYYNVIYDDNGLKPDHMQRLTFKLCHLYYNWPGIVSVPAPCQYAHKLTFLVAQSIHKEPSLELANHLFYL

SEQ ID NO: 900266 - protein, 218 aa, Homo sapiens
NIQHDIVVQSKNTKPKLWNSALSETRLMLQIAESFFTGALNKWYKYNHDLPARIIVYRAGVGDGQLKTLIEYEVPQLLSSVAESSSNTSSRLSVIVVRKKCMPRFFTEMNRTVQNPPLGTVVDSEATRNEWYDFYLISQVACRGTVSPTYYNVIYDDNGLKPDHMQRLTFKLCHLYYNWPGIVSVPAPCQYAHKLTFLVAQSIHKEPSLELANHLFYL

SEQ ID NO: 900267 - protein, 222 aa, Homo sapiens; identical to SEQ ID NO: 900263

SEQ ID NO: 900268 - protein, 266 aa, Homo sapiens [sequence omitted]

SEQ ID NO: 900269 - protein, 164 aa, Homo sapiens
MKSFPAWLLFFHERGLSQDLVATGSATAENVLPCGFLSSCPWPEVPALMAAPHLQLLCSPLPKPYGLLCICTHPVPQTHYIIKCFSKMELNIIWSIWLQRQKMKRKEKKKGRLFPNKKKIKQLKLKIFKIKLPYNFITIPILSSGFNLGNFYIPPIIGLLGDFP

SEQ ID NO: 900270 - protein, 95 aa, Homo sapiens
RIHKCTVFDTLRCTGERISPTPYLCLQYVSTPAQPPRQESFLPAALAPGPVLFSSMVCLRLPGGSCMAASDSDTDGAELPTGFGWGHQTTFLGGG

SEQ ID NO: 900271 - protein, 266 aa, Homo sapiens [sequence omitted]

SEQ ID NO: 900272 - protein, 266 aa, Homo sapiens [sequence omitted]

SEQ ID NO: 900273 - protein, 164 aa, Homo sapiens; identical to SEQ ID NO: 900269

SEQ ID NO: 900274 - protein, 116 aa, Homo sapiens
MAAPHLQLLCSPLPKPYGLLCICTHPVPQTHYIIKCFSKMELNIIWSIWLQRQKMKRKEKKKGRLFPNKKKIKQLKLKIFKIKLPYNFITIPILSSGFNLGNFYIPPIIGLLGDFP

SEQ ID NO: 900275 - protein, 164 aa, Homo sapiens
THASADAWVTHACGPTRPLPAALAPGPVLFSSMVCLRLPGGSCMAASDSDTDGAELPTGFGWGHQTEAACVTGSFVSPQHVSWSYSTSECHFFNGTERVRFLDRYFHNQEEYVRFDSDVGEFRAVTELGRPDRRVLEQPEGPPGRHESAGRWWTPTADTTTGLV

SEQ ID NO: 900276 - protein, 176 aa, Homo sapiens
MPGRQDTKARAAGGHLLQTQLRGWCESFTVQRRVHPKVTVYPSKTQPLQHHNLLVCSVSGFYPGSIEVRWFRNGQEEKTGVVSTGLIHNGDWTFQTLVMLETVPRSGEVYTCQVEHPSVTSPLTVEWRARSESAQSKMLSGVGGFVLGLLFLGAGLFIYFRNQKGHSGLQPRGFLS

SEQ ID NO: 900277 - protein, 166 aa, Homo sapiens
MEMKSFPAWLLFFHERGLSQDLVATGSATAENVLPCGFLSSCPWPEVPALMAAPHLQLLCSPLPKPYGLLCICTHPVPQTHYIIKCFSKMELNIIWSIWLQRQKMKRKEKKKGRLFPNKKKIKQLKLKIFKIKLPYNFITIPILSSGFNLGNFYIPPIIGLLGDFP

SEQ ID NO: 900278 - protein, 198 aa, Homo sapiens
IVSSLFIQRVGLKEWDTGESGRCGAGKAKDFWKGEGRGDTIETHTGCGEFTVQLGVHPKVTVYPSKTQPLQHHNLLVCSVSGFYPGSIEVRWFRNGQEEKTGVVSTGLIHNGDWTFQTLVMLETVPRSGEVYTCQVEHPSVTSPLTVEWRARSESAQSKMLSGVGGFVLGLLFLGAGLFIYFRNQKGHSGLQPRGFLS

SEQ ID NO: 900279 - protein, 96 aa, Homo sapiens
TRFNSIFEKHLIMNVFVVQGEYRCTGGHRYTCQVEHPSVTSPLTVEWRARSESAQSKMLSGVGGFVLGLLFLGAGLFIYFRNQKGHSGLQPRGFLS

SEQ ID NO: 900280 - protein, 164 aa, Homo sapiens; identical to SEQ ID NO: 900269

SEQ ID NO: 900281 - protein, 155 aa, Homo sapiens
MLETVPRSGEVYTCQVEHPSVTSPLTVEWSEQLSDFPALMAAPHLQLLCSPLPKPYGLLCICTHPVPQTHYIIKCFSKMELNIIWSIWLQRQKMKRKEKKKGRLFPNKKKIKQLKLKIFKIKLPYNFITIPILSSGFNLGNFYIPPIIGLLGDFP

SEQ ID NO: 900282 - protein, 253 aa, Homo sapiens
MVCLKLPGGSSLAALTVTLMVLSSRLAFAGDTRPRFLELRKSECHFFNGTERVRYLDRYFHNQEEFLRFDSDVGEYRAVTELGRPVAESWNSQKDLLEQKRGQVDNYCRHNYGVGESFTVQRRVHPQVTVYPAKTQPLQHHNLLVCSVSGFYPGSIEVRWFRNGQNGDWTFQTLVMLETVPRSGEVYTCQVEHPSVTSPLTVEWRARSESAQSKMLSGVGGFVLGLLFLGAGLFIYFRNQKGHSGLQPTGFLS

SEQ ID NO: 900283 - protein, 172 aa, Homo sapiens
MVCLKLPGGSSLAALTVTLMVLSSRLAFAGDTRPRFLELRKSECHFFNGTERVRYLDRYFHNQEEFLRFDSDVGEYRAVTELGRPVAESWNSQKDLLEQKRGQVDNYCRHNYGVGESFTVQRRGARSESAQSKMLSGVGGFVLGLLFLGAGLFIYFRNQKGHSGLQPTGFLS

SEQ ID NO: 900284 - protein, 164 aa, Homo sapiens; identical to SEQ ID NO: 900269

SEQ ID NO: 900285 - protein, 148 aa, Homo sapiens
VYRCHLEDTKARAAGGHLLQTQLRGWCESFTVQRRVHPKVTVYPSKTQPLQHHNLLVCSVSGFYPGSIEVRWFRNGQEEKTGVVSTGLIHNGDWTFQTLVMLETVPRSGEVYTCQVEHPSVTSPLTVEWKPPESAQSKMLSGIETPDG

SEQ ID NO: 900286 - protein, 111 aa, Homo sapiens
PTRPRTRGSTHACGPTRPLPAALAPGPVLFSSMVCLRLPGGSCMAASDSDTDGAELPTGFGWGHQTTFLGATLRLSVISSMGRSGCGSWTDTSITRRSTCASTATWGSSGR

SEQ ID NO: 900287 - protein, 164 aa, Homo sapiens; identical to SEQ ID NO: 900269

SEQ ID NO: 900288 - protein, 164 aa, Homo sapiens; identical to SEQ ID NO: 900269

SEQ ID NO: 900289 - protein, 129 aa, Homo sapiens
MLETVPRSGEVYTCQVEHPSVTSPLTVEWSEQLSDFINFSPTKKGTVLIPECQVSPLRHPIFICSMFSSPSAQVTGGSPVGVSRNTCTSWRSSLACQAGEAVPLLNLPMMSQVRVTHPPRAPGTASGSE

SEQ ID NO: 900290 - protein, 116 aa, Homo sapiens; identical to SEQ ID NO: 900274

SEQ ID NO: 900291 - protein, 164 aa, Homo sapiens; identical to SEQ ID NO: 900269

SEQ ID NO: 900292 - protein, 124 aa, Homo sapiens
MVCLKLPGGSSLAALTVTLMVLSSRLAFAGDTRPRFLELRKSECHFFNGTERVRYLDRYFHNQEEFLRFDSDVGEYRAVTELGRPVAESWNSQKDLLEQKRGQVDNYCRHNYGVGESFTVQRRG

SEQ ID NO: 900293 - protein, 164 aa, Homo sapiens; identical to SEQ ID NO: 900269

SEQ ID NO: 900294 - protein, 72 aa, Homo sapiens
MAASLSVSSQEAACVTGSFVSPQHVSWSYSTSECHFFNGTERVRFLDRYFHNQEEYVRFDSDVGEFRAVTEL

SEQ ID NO: 900295 - protein, 266 aa, Homo sapiens [sequence omitted]

SEQ ID NO: 900296 - protein, 825 aa, Homo sapiens
MAAGKFASLPRNMPVNHQFPLASSMDLLSSRSPLAEHRPDAYQDVSIHGTLPRKKKGPPPIRSCDDFSHMGTLPHSKSPRQNSPVTQDGIQESPWQDRHGETFTFRDPHLLDPTVEYVKFSKERHIMDRTPEKLKKELEEELLLSSEDLRSHAWYHGRIPRQVSENLVQRDGDFLVRDSLSSPGNFVLTCQWKNLAQHFKINRTVLRLSEAYSRVQYQFEMESFDSIPGLVRCYVGNRRPISQQSGAIIFQPINRTVPLRCLEEHYGTSPGQAREGSLTKGRPDVAKRLSLTMGGVQAREQNLPRGNLLRNKEKSGSQPACLDHMQDRRALSLKAHQSESYLPIGCKLPPQSSGVDTSPCPNSPVFRTGSEPALSPAVVRRVSSDARAGEALRGSDSQLCPKPPPKPCKVPFLKVPSSPSAWLNSEANYCELNPAFATGCGRGAKLPSCAQGSHTELLTAKQNEAPGPRNSGVNYLILDDDDRERPWEPAAAQMEKGQWDKGEFVTPLLETVSSFRPNEFESKFLPPENKPLETAMLKRAKELFTNNDPKVIAQHVLSMDCRVARILGVSEEMRRNMGVSSGLELITLPHGHQLRLDIIERHNTMAIGIAVDILGCTGTLEDRAATLSKIIQVAVELKDSMGDLYSFSALMKALEMPQITRLEKTWTALRHQYTQTAILYEKQLKPFSKLLHEGRESTCVPPNNVSVPLLMPLVTLMERQAVTFEGTDMWEKNDQSCEIMLNHLATARFMAEAADSYRMNAERILAGFQPDEEMNEICKTEFQMRLLWGSKGAQVNQTERYEKFNQILTALSRKLEPPPVKQAEL

SEQ ID NO: 900297 - protein, 66 aa, Homo sapiens
MNEICKTEFQMRLLWGSKGAQVNQTERYEKFNQILTALSRLAEEDKPREDKRREVLVLTKEYSCLL

SEQ ID NO: 900298 - protein, 699 aa, Homo sapiens
MDRTPEKLKKELEEELLLSSEDLRSHAWYHGRIPRQVSENLVQRDGDFLVRDSLSSPGNFVLTCQWKNLAQHFKINRTVLRLSEAYSRVQYQFEMESFDSIPGLVRCYVGNRRPISQQSGAIIFQPINRTVPLRCLEEHYGTSPGQAREGSLTKGRPDVAKRLSLTMGGVQAREQNLPRGNLLRNKEKSGSQPACLDHMQDRRALSLKAHQSESYLPIGCKLPPQSSGVDTSPCPNSPVFRTGSEPALSPAVVRRVSSDARAGEALRGSDSQLCPKPPPKPCKVPFLKVPSSPSAWLNSEANYCELNPAFATGCGRGAKLPSCAQGSHTELLTAKQNEAPGPRNSGVNYLILDDDDRERPWEPAAAQMEKGQWDKGEFVTPLLETVSSFRPNEFESKFLPPENKPLETAMLKRAKELFTNNDPKVIAQHVLSMDCRVARILGVSEEMRRNMGVSSGLELITLPHGHQLRLDIIERHNTMAIGIAVDILGCTGTLEDRAATLSKIIQVAVELKDSMGDLYSFSALMKALEMPQITRLEKTWTALRHQYTQTAILYEKQLKPFSKLLHEGRESTCVPPNNVSVPLLMPLVTLMERQAVTFEGTDMWEKNDQSCEIMLNHLATARFMAEAADSYRMNAERILAGFQPDEEMNEICKTEFQMRLLWGSKGAQVNQTERYEKFNQILTALSRKLEPPPVKQAEL

SEQ ID NO: 900299 - protein, 813 aa, Homo sapiens [sequence omitted]

SEQ ID NO: 900300 - protein, 280 aa, Homo sapiens
IPRQAVLHRQVVLHRQVVLHRQVVLHRQVVLMGVSSGLELITLPHGHQLRLDIIERHNTMAIGIAVDILGCTGTLEDRAATLSKIIQVAVELKDSMGDLYSFSALMKALEMPQITRLEKTWTALRHQYTQTAILYEKQLKPFSKLLHEGRESTCVPPNNVSVPLLMPLVTLMERQAVTFEGTDMWEKNDQSCEIMLNHLATARFMAEAADSYRMNAERILAGFQPDEEMNEICKTEFQMRLLWGSKGAQVNQTERYEKFNQILTALSRKLEPPPVKQAEL

SEQ ID NO: 900301 - protein, 866 aa, Homo sapiens
MAAGKFASLPRNMPVNHQFPLASSMDLLSSRSPLAEHRPDAYQDVSIHGTLPRKKKGPPPIRSCDDFSHMGTLPHSKSPRQNSPVTQDGIQESPWQDRHGETFTFRDPHLLDPTVEYVKFSKERHIMDRTPEKLKKELEEELLLSSEDLRSHAWYHGRIPRQVSENLVQRDGDFLVRDSLSSPGNFVLTCQWKNLAQHFKINRTVLRLSEAYSRVQYQFEMESFDSIPGLVRCYVGNRRPISQQSGAIIFQPINRTVPLRCLEEHYGTSPGQAREGSLTKGRPDVAKRLSLTMGGVQAREQNLPRGNLLRNKEKSGSQPACLDHMQDRRALSLKAHQSESYLPIGCKLPPQSSGVDTSPCPNSPVFRTGSEPALSPAVVRRVSSDARAGEALRGSDSQLCPKPPPKPCKVPFLKVPSSPSAWLNSEANYCELNPAFATGCGRGAKLPSCAQGSHTELLTAKQNEAPGPRNSGVNYLILDDDDRERPWEPAAAQMEKGQWDKGEFVTPLLETVSSFRPNEFESKFLPPENKPLETAMLKRAKELFTNNDPKVIAQHVLSMDCRVARILGVSEEMRRNMGVSSGLELITLPHGHQLRLDIIERHNTMAIGIAVDILGCTGTLEDRAATLSKIIQVAVELKDSMGDLYSFSALMKALEMPQITRLEKTWTALRHQYTQTAILYEKQLKPFSKLLHEGRESTCVPPNNVSVPLLMPLVTLMERQAVTFEGTDMWEKNDQSCEIMLNHLATARFMAEAADSYRMNAERILAGFQPDEEMNEICKTEFQMRLLWGSKGAQVNQTERYEKFNQILTALSRKLEPPPVKQADAPLPPPRPPRLPSPPPAPPPAAVIMCKSDNIQAFSIHRILNV

SEQ ID NO: 900302 - protein, 508 aa, Homo sapiens
MPVNHQFPLASSMDLLSSRSPLAEHRPDAYQDVSIHGTLPRKKKGPPPIRSCDDFSHMGTLPHSKSPRQNSPVTQDGIQESPWQDRHGETFTFRDPHLLDPTVEYVKFSKERHIMDRTPEKLKKELEEELLLSSEDLRSHAWYHGRIPRQVSENLVQRDGDFLVRDSLSSPGNFVLTCQWKNLAQHFKINRTVLRLSEAYSRVQYQFEMESFDSIPGLVRCYVGNRRPISQQSGAIIFQPINRTVPLRCLEEHYGTSPGQAREGSLTKGRPDVAKRLSLTMGGVQAREQNLPRGNLLRNKEKSGSQPACLDHMQDRRALSLKAHQSESYLPIGCKLPPQSSGVDTSPCPNSPVFRTGSEPALSPAVVRRVSSDARAGEALRGSDSQLCPKPPPKPCKVPFLKVPSSPSAWLNSEANYCELNPAFATGCGRGAKLPSCAQGSHTELLTAKQNEAPGPRNSGVNYLILDDDDRERPWEPAAAQMEKGQWDKGEFVTPLLETVSSFRPNEL

SEQ ID NO: 900303 - protein, 169 aa, Homo sapiens
MPVNHQFPLASSMDLLSSRSPLAEHRPDAYQDVSIHGTLPRKKKGPPPIRSCDDFSHMGTLPHSKSPRQNSPVTQDGIQESPWQDRHGETFTFRDPHLLDPTVEYVKFSKERHIMDRTPEKLKKELEEELLLSSEDLRSHAWYHGRIPRQVPGLVPSRAYTAALRQCTD

SEQ ID NO: 900304 - protein, 813 aa, Homo sapiens [sequence omitted]

SEQ ID NO: 900305 - protein, 706 aa, Homo sapiens
DISEPQGDYDNLSRVIQLSQDANPGGQATGTARLHHIINSPVAVSENLVQRDGDFLVRDSLSSPGNFVLTCQWKNLAQHFKINRTVLRLSEAYSRVQYQFEMESFDSIPGLVRCYVGNRRPISQQSGAIIFQPINRTVPLRCLEEHYGTSPGQAREGSLTKGRPDVAKRLSLTMGGVQAREQNLPRGNLLRNKEKSGSQPACLDHMQDRRALSLKAHQSESYLPIGCKLPPQSSGVDTSPCPNSPVFRTGSEPALSPAVVRRVSSDARAGEALRGSDSQLCPKPPPKPCKVPFLKVPSSPSAWLNSEANYCELNPAFATGCGRGAKLPSCAQGSHTELLTAKQNEAPGPRNSGVNYLILDDDDRERPWEPAAAQMEKGQWDKGEFVTPLLETVSSFRPNEFESKFLPPENKPLETAMLKRAKELFTNNDPKVIAQHVLSMDCRVARILGVSEEMRRNMGVSSGLELITLPHGHQLRLDIIERHNTMAIGIAVDILGCTGTLEDRAATLSKIIQVAVELKDSMGDLYSFSALMKALEMPQITRLEKTWTALRHQYTQTAILYEKQLKPFSKLLHEGRESTCVPPNNVSVPLLMPLVTLMERQAVTFEGTDMWEKNDQSCEIMLNHLATARFMAEAADSYRMNAERILAGFQPDEEMNEICKTEFQMRLLWGSKGAQVNQTERYEKFNQILTALSRKLEPPPVKQAEL

SEQ ID NO: 900306 - protein, 592 aa, Homo sapiens
MPVNHQFPLASSMDLLSSRSPLAEHRPDAYQDVSIHGTLPRKKKGPPPIRSCDDFSHMGTLPHSKSPRQNSPVTQDGIQESPWQDRHGETFTFRDPHLLDPTVEYVKFSKERHIMDRTPEKLKKELEEELLLSSEDLRSHAWYHGRIPRQVSENLVQRDGDFLVRDSLSSPGNFVLTCQWKNLAQHFKINRTVLRLSEAYSRVQYQFEMESFDSIPGLVRCYVGNRRPISQQSGAIIFQPINRTVPLRCLEEHYGTSPGQAREGSLTKGRPDVAKRLSLTMGGVQAREQNLPRGNLLRNKEKSGSQPACLDHMQDRRALSLKAHQSESYLPIGCKLPPQSSGVDTSPCPNSPVFRTGSEPALSPAVVRRVSSDARAGEALRGSDSQLCPKPPPKPCKVPFLKVPSSPSAWLNSEANYCELNPAFATGCGRGAKLPSCAQGSHTELLTAKQNEAPGPRNSGVNYLILDDDDRERPWEPAAAQMEKGQWDKGEFVTPLLETVSSFRPNEFESKFLPPENKPLETAMLKRAKELFTNNDPKVIAQHVLSMDCRVARILGVSEEMRRNMGVSSGLELITLPHGHQLRLDIIERSQG

SEQ ID NO: 900307 - protein, 227 aa, Homo sapiens
MKEHNTMAIGIAVDILGCTGTLEDRAATLSKIIQVAVELKDSMGDLYSFSALMKALEMPQITRLEKTWTALRHQYTQTAILYEKQLKPFSKLLHEGRESTCVPPNNVSVPLLMPLVTLMERQAVTFEGTDMWEKNDQSCEIMLNHLATARFMAEAADSYRMNAERILAGFQPDEEMNEICKTEFQMRLLWGSKGAQVNQTERYEKFNQILTALSRKLEPPPVKQAEL

SEQ ID NO: 900308 - protein, 196 aa, Homo sapiens
MQDRRALSLKAHQSESYLPIGCKLPPQSSGVDTSPCPNSPVFRTGSEPALSPAVVRRVSSDARAGEALRGSDSQLCPKPPPKPCKVPFLKVPSSPSAWLNSEANYCELNPAFATGCGRGAKLPSCAQGSHTELLTAKQNEAPGPRNSGVNYLILDDDDRERPWEPAAAQMEKGQWDKGEFVTPLLETVSSFRPNEL

SEQ ID NO: 900309 - protein, 51 aa, Homo sapiens
MAQKQPCSWLIWFSFLLVPLALNLTADLLAFRHNTMAIGIAVDILGCTGTL

SEQ ID NO: 900310 - protein, 35 aa, Homo sapiens
DEQLTVFSKIPPGETARSWKSSQERSQPGVGDPSR

SEQ ID NO: 900311 - protein, 846 aa, Homo sapiens
MSSSHFASRHRKDISTEMIRTKIAHRKSLSQKENRHKEYERNRHFGLKDVNIPTLEGRILVELDETSQGLVPEKTNVKPRAMKTILGDQRKQMLQKYKEEKQLQKLKEQREKAKRGIFKVGRYRPDMPCFLLSNQNAVKAEPKKAIPSSVRITRSKAKDQMEQTKIDNESDVRAIRPGPRQTSEKKVSDKEKKVVQPVMPTSLRMTRSATQAAKQVPRTVSSTTARKPVTRAANENEPEGKVPSKGRPAKNVETKPDKGISCKVDSEENTLNSQTNATSGMNPDGVLSKMENLPEINTAKIKGKNSFAPKDFMFQPLDGLKTYQVTPMTPRSANAFLTPSYTWTPLKTEVDESQATKEILAQKCKTYSTKTIQQDSNKLPCPLGPLTVWHEEHVLNKNEATTKNLNGLPIKEVPSLERNEGRIAQPHHGVPYFRNILQSETEKLTSHCFEWDRKLELDIPDDAKDLIRTAVGQTRLLMKERFKQFEGLVDDCEYKRGIKETTCTDLDGFWDMVSFQIEDVIHKFNNLIKLEESGWQVNNNMNHNMNKNVFRKKVVSGIASKPKQDDAGRIAARNRLAAIKNAMRERIRQEECAETAVSVIPKEVDKIVFDAGFFRVESPVKLFSGLSVSSEGPSQRLGTPKSVNKAVSQSRNEMGIPQQTTSPENAGPQNTKSEHVKKTLFLSIPESRSSIEDAQCPGLPDLIEENHVVNKTDLKVDCLSSERMSLPLLAGGVADDINTNKKEGISDVVEGMELNSSITSQDVLMSSPEKNTASQNSILEEGETKISQSELFDNKSLTTECHLLDSPGLNCSNPFTQLERRHQEHARHISFGGNLITFSPLQPGEF

SEQ ID NO: 900312 - protein, 870 aa, Homo sapiens
MNCNLNFLNNENSCKLGFVLFLDRMSSSHFASRHRKDISTEMIRTKIAHRKSLSQKENRHKEYERNRHFGLKDVNIPTLEGRILVELDETSQGLVPEKTNVKPRAMKTILGDQRKQMLQKYKEEKQLQKLKEQREKAKRGIFKVGRYRPDMPCFLLSNQNAVKAEPKKAIPSSVRITRSKAKDQMEQTKIDNESDVRAIRPGPRQTSEKKVSDKEKKVVQPVMPTSLRMTRSATQAAKQVPRTVSSTTARKPVTRAANENEPEGKVPSKGRPAKNVETKPDKGISCKVDSEENTLNSQTNATSGMNPDGVLSKMENLPEINTAKIKGKNSFAPKDFMFQPLDGLKTYQVTPMTPRSANAFLTPSYTWTPLKTEVDESQATKEILAQKCKTYSTKTIQQDSNKLPCPLGPLTVWHEEHVLNKNEATTKNLNGLPIKEVPSLERNEGRIAQPHHGVPYFRNILQSETEKLTSHCFEWDRKLELDIPDDAKDLIRTAVGQTRLLMKERFKQFEGLVDDCEYKRGIKETTCTDLDGFWDMVSFQIEDVIHKFNNLIKLEESGWQVNNNMNHNMNKNVFRKKVVSGIASKPKQDDAGRIAARNRLAAIKNAMRERIRQEECAETAVSVIPKEVDKIVFDAGFFRVESPVKLFSGLSVSSEGPSQRLGTPKSVNKAVSQSRNEMGIPQQTTSPENAGPQNTKSEHVKKTLFLSIPESRSSIEDAQCPGLPDLIEENHVVNKTDLKVDCLSSERMSLPLLAGGVADDINTNKKEGISDVVEGMELNSSITSQDVLMSSPEKNTASQNSILEEGETKISQSELFDNKSLTTECHLLDSPGLNCSNPFTQLERRHQEHARHISFGGNLITFSPLQPGEF

SEQ ID NO: 900313 - protein, 633 aa, Homo sapiens
MITQRSLSITVMHNEPGRELKENEPEGKVPSKGRPAKNVETKPDKGISCKVDSEENTLNSQTNATSGMNPDGVLSKMENLPEINTAKIKGKNSFAPKDFMFQPLDGLKTYQVTPMTPRSANAFLTPSYTWTPLKTEVDESQATKEILAQKCKTYSTKTIQQDSNKLPCPLGPLTVWHEEHVLNKNEATTKNLNGLPIKEVPSLERNEGRIAQPHHGVPYFRNILQSETEKLTSHCFEWDRKLELDIPDDAKDLIRTAVGQTRLLMKERFKQFEGLVDDCEYKRGIKETTCTDLDGFWDMVSFQIEDVIHKFNNLIKLEESGWQVNNNMNHNMNKNVFRKKVVSGIASKPKQDDAGRIAARNRLAAIKNAMRERIRQEECAETAVSVIPKEVDKIVFDAGFFRVESPVKLFSGLSVSSEGPSQRLGTPKSVNKAVSQSRNEMGIPQQTTSPENAGPQNTKSEHVKKTLFLSIPESRSSIEDAQCPGLPDLIEENHVVNKTDLKVDCLSSERMSLPLLAGGVADDINTNKKEGISDVVEGMELNSSITSQDVLMSSPEKNTASQNSILEEGETKISQSELFDNKSLTTECHLLDSPGLNCSNPFTQLERRHQEHARHISFGGNLITFSPLQPGEF

SEQ ID NO: 900314 - protein, 842 aa, Homo sapiens
MSSSHFASRHRKDISTEMIRTKIAHRKSLSQKENRHKEYERNRHFGLKDVNIPTLEGRILVELDETSQGLVPEKTNVKPRAMKTILGDQRKQMLQKYKEEKQLQKLKEQREKAKRGIFKVGRYRPDMPCFLLSNQNAVKAEPKKAIPSSVRITRSKAKDQMEQTKIDNESDVRAIRPGPRQTSEKKVSDKEKKVVQPVMPTSLRMTRSATQAAKQVPRTVSSTTARKPVTRAANENEPEGKVPSKGRPAKNVETKPDKGISCKVDSEENTLNSQTNATSGMNPDGVLSKMENLPEINTAKIKGKNSFAPKDFMFQPLDGLKTYQVTPMTPRSANAFLTPSYTWTPLKTEVDESQATKEILAQKCKTYSTKTIQQDSNKLPCPLGPLTVWHEEHVLNKNEATTKNLNGLPIKEVPSLERNEGRIAQPHHGVPYFRNILQSETEKLTSHCFEWDRKLELDIPDDAKDLIRTAVGQTRLLMKERFKQFEGLVDDCEYKRGIKETTCTDLDGFWDMVSFQIEDVIHKFNNLIKLEESGWQVNNNMNHNMNKNVFRKKVVSGIASKPKQDDAGRIAARNRLAAIKNAMRERIRQEECAETAVSVIPKEVDKIVFDAGFFRVESPVKLFSGLSVSSEGPSQRLGTPKSVNKAVSQSRNEMGIPQQTTSPENAGPQNTKSEHVKKTLFLSIPESRSSIEDAQCPGLPDLIEENHVVNKTDLKVDCLSSERMSLPLLAGGVADDINTNKKEGISDVVEGMELNSSITSQDVLMSSPEKNTASQNSILEEGETKISQSELFDNKSLTTECHLLDSVGSCYVARAGLEVLGSSDPTTSASRVAGTTARSKLQ

SEQ ID NO: 900315 - protein, 849 aa, Homo sapiens
MSSSHFASRHRKDISTEMIRTKIAHRKSLSQKENRHKEYERNRHFGLKDVNIPTLEGRILVELDETSQGLVPEKTNVKPRAMKTILGDQRKQMLQKYKEEKQLQKLKEQREKAKRGIFKVGRYRPDMPCFLLSNQNAVKAEPKKAIPSSVRITRSKAKDQMEQTKIDNESDVRAIRPGPRQTSEKKVSDKEKKVVQPVMPTSLRMTRSATQAAKQVPRTVSSTTARKPVTRAANENEPEGKVPSKGRPAKNVETKPDKGISCKVDSEENTLNSQTNATSGMNPDGVLSKMENLPEINTAKIKGKNSFAPKDFMFQPLDGLKTYQVTPMTPRSANAFLTPSYTWTPLKTEVDESQATKEILAQKCKTYSTKTIQQDSNKLPCPLGPLTVWHEEHVLNKNEATTKNLNGLPIKEVPSLERNEGRIAQPHHGVPYFRNILQSETEKLTSHCFEWDRKLELDIPDDAKDLIRTAVGQTRLLMKERFKQFEGLVDDCEYKRGIKETTCTDLDGFWDMVSFQIEDVIHKFNNLIKLEESGWQVNNNMNHNMNKNVFRKKVVSGIASKPKQDDAGRIAARNRLAAIKNAMRERIRQEECAETAVSVIPKEVDKIVFDAGFFRVESPVKLFSGLSVSSEGPSQRLGTPKSVNKAVSQSRNEMGIPQQTTSPENAGPQNTKSEHVKKTLFLSIPESRSSIEDAQCPGLPDLIEENHVVNKTDLKVDCLSSERMSLPLLAGGVADDINTNKKEGISDVVEGMELNSSITSQDVLMSSPEKNTASQNSILEEGETKISQSELFDNKSLTTECHLLDSVGSCYVARAGLEVLGSSDPTTSASRVAGTTGVHHRTRFIFVIN

SEQ ID NO: 900316 - protein, 148 aa, Homo sapiens
NVCHNFRNILQSETEKLTSHCFEWDRKLELDIPDDAKDLIRTAVGQTRLLMKERFKQFEGLVDDCEYKRGIKETTCTDLDGFWDMVSFQIEDVIHKFNNLIKLEESGWQVNNNMNHNMNKNVFRVSLWVLYPIFFFLVKELLYIHPNF

SEQ ID NO: 900317 - protein, 846 aa, Homo sapiens; identical to SEQ ID NO: 900311

SEQ ID NO: 900318 - protein, 344 aa, Homo sapiens [sequence omitted]

SEQ ID NO: 900319 - protein, 320 aa, Homo sapiens
MPRLRVHGACLPTKSVLFLFYHRLTMLREASDEIVAEKEAEVKLPEDSSCTEDLSSCTSVPEMNEDGNRKESNCAKDLRSQPPTRIPTLVDKETNTDEAANDNMAVRPKERSSLSSRQHPFVRSSVIVRSQTFSPGERNQYICRLNRSDSDSSTLAKKSLFVRNSTERRSLRVKRTVCQSVLRRTTQECPVRTSLDLELDLQASLTRQSRLNDELQALRDLRQKLEELKAQGETDLPPGVLEDERFQRLLKQAEKQAEQSKEEQKQGLNAEKLMRQVSKDVCRLREQSQKVPRQVQSFREKIAYFTRAKISIPSLPADDV

SEQ ID NO: 900320 - protein, 344 aa, Homo sapiens [sequence omitted]

SEQ ID NO: 900321 - protein, 580 aa, Homo sapiens
ASQSLSEDKDLNECAREPLYEGTADVEKSLPKRRVIHLLGEKTTCVSAAVSDESVAGDSGVYEAFVKQPSEMEDVTYSEEDVAIVETAQVQIGLRYNAKSSSFMVIIAQLRNLHAFLIPHTSKVYFRVAVLPSSTDVSCLFRTKVHPPTESILFNDVFRVAISQTALQQKTLRVDLCSVSKHRREECLAGTQISLADLPFSSEVFTLWYNLLPSKQMPCKKNEENEDSVFQPNQPLVDSIDLDAVSALLARTSAELLAVEQELAQEEEEESGQEEPRGPDGDWLTMLREASDEIVAEKEAEVKLPEDSSCTEDLSSCTSVPEMNEDGNRKESNCAKDLRSQPPTRIPTLVDKETNTDEAANDNMAVRPKERSSLSSRQHPFVRSSVIVRSQTFSPGERNQYICRLNRSDSDSSTLAKKSLFVRNSTERRSLRVKRTVCQSVLRRTTQECPVRTSLDLELDLQASLTRQSRLNDELQALRDLRQKLEELKAQGETDLPPGVLEDERFQRLLKQAEKQAEQSKEEQKQGLNAEKLMRQVSKDVCRLREQSQKVPRQVQSFREKIAYFTRAKISIPSLPADDV

SEQ ID NO: 900322 - protein, 344 aa, Homo sapiens [sequence omitted]

SEQ ID NO: 900323 - protein, 109 aa, Homo sapiens
LRPWLLGCKEAPSIMRQEGGEVEVTTACITRVFVIPFLTIQTVCQSVLRRTTQECPVRTSLDLELDLQASLTRQSRLNDELQALRDLRQKLEELKAQGETDLPPGVLED

SEQ ID NO: 900324 - protein, 772 aa, Homo sapiens
MGDEDDDESCAVELRITEANLTGHEEKVSVENFELLKVLGTGAYGKVFLVRKAGGHDAGKLYAMKVLRKAALVQRAKTQEHTRTERSVLELVRQAPFLVTLHYAFQTDAKLHLILDYVSGGEMFTHLYQRQYFKEAEVRVYGGEIVLALEHLHKLGIIYRDLKLENVLLDSEGHIVLTDFGLSKEFLTEEKERTFSFCGTIEYMAPEIIRSKTGHGKAVDWWSLGILLFELLTGASPFTLEGERNTQAEVSRRILKCSPPFPPRIGPVAQDLLQRLLCKDPKKRLGAGPQGAQEVRNHPFFQGLDWVALAARKIPAPFRPQIRSELDVGNFAEEFTRLEPVYSPPGSPPPGDPRIFQGYSFVAPSILFDHNNAVMTDGLEAPGAGDRPGRAAVARSAMMQDSPFFQQYELDLREPALGQGSFSVCRRCRQRQSGQEFAVKILSRRLEANTQREVAALRLCQSHPNVVNLHEVHHDQLHTYLVLELLRGGELLEHIRKKRHFSESEASQILRSLVSAVSFMHEEAGVVHRDLKPENILYADDTPGAPVKIIDFGFARLRPQSPGVPMQTPCFTLQYAAPELLAQQGYDESCDLWSLGVILYMMLSGQVPFQGASGQGGQSQAAEIMCKIREGRFSLDGEAWQGVSEEAKELVRGLLTVDPAKRLKLEGLRGSSWLQDGSARSSPPLRTPDVLESSGPAVRSGLNATFMAFNRGKREGFFLKSVENAPLAKRRKQKLRSATASRRGSPAPANPGRAPVASKGAPRRANGPLPPS

SEQ ID NO: 900325 - protein, 766 aa, Homo sapiens
MGDEDDDESCAVELRITEANLTGHEEKVSVENFELLKVLGTGAYGKVFLVRKAGGHDAGKLYAMKVLRKAALVQRAKTQEHTRTERSVLELVRQAPFLVTLHYAFQTDAKLHLILDYVSGGEMFTHLYQRQYFKEAEVRVYGGEIVLALEHLHKLGIIYRDLKLENVLLDSEGHIVLTDFGLSKEFLTEEKERTFSFCGTIEYMAPEIIRSKTGHGKAVDWWSLGILLFELLTGASPFTLEGERNTQAEVSRRILKCSPPFPPRIGPVAQDLLQRLLCKDPKKRLGAGPQGAQEVRNHPFFQGLDWVALAARKIPAPFRPQIRSELDVGNFAEEFTRLEPVYSPPGSPPPGDPRIFQGYSFVAPSILFDHNNAVMTDGLEAPGAGDRPGRAAVARSAMMQQYELDLREPALGQGSFSVCRRCRQRQSGQEFAVKILSRRLEANTQREVAALRLCQSHPNVVNLHEVHHDQLHTYLVLELLRGGELLEHIRKKRHFSESEASQILRSLVSAVSFMHEEAGVVHRDLKPENILYADDTPGAPVKIIDFGFARLRPQSPGVPMQTPCFTLQYAAPELLAQQGYDESCDLWSLGVILYMMLSGQVPFQGASGQGGQSQAAEIMCKIREGRFSLDGEAWQGVSEEAKELVRGLLTVDPAKRLKLEGLRGSSWLQDGSARSSPPLRTPDVLESSGPAVRSGLNATFMAFNRGKREGFFLKSVENAPLAKRRKQKLRSATASRRGSPAPANPGRAPVASKGAPRRANGPLPPS

SEQ ID NO: 900326 - protein, 666 aa, Homo sapiens
IQWLCPGDPLYRQMTFSGGSPYPEQGQELEELGRVSGRKPQHPSCSYQLGIIYRDLKLENVLLDSEGHIVLTDFGLSKEFLTEEKERTFSFCGTIEYMAPEIIRSKTGHGKAVDWWSLGILLFELLTGASPFTLEGERNTQAEVSRRILKCSPPFPPRIGPVAQDLLQRLLCKDPKKRLGAGPQGAQEVRNHPFFQGLDWVALAARKIPAPFRPQIRSELDVGNFAEEFTRLEPVYSPPGSPPPGDPRIFQGYSFVAPSILFDHNNAVMTDGLEAPGAGDRPGRAAVARSAMMQDSPFFQQYELDLREPALGQGSFSVCRRCRQRQSGQEFAVKILSRRLEANTQREVAALRLCQSHPNVVNLHEVHHDQLHTYLVLELLRGGELLEHIRKKRHFSESEASQILRSLVSAVSFMHEEAGVVHRDLKPENILYADDTPGAPVKIIDFGFARLRPQSPGVPMQTPCFTLQYAAPELLAQQGYDESCDLWSLGVILYMMLSGQVPFQGASGQGGQSQAAEIMCKIREGRFSLDGEAWQGVSEEAKELVRGLLTVDPAKRLKLEGLRGSSWLQDGSARSSPPLRTPDVLESSGPAVRSGLNATFMAFNRGKREGFFLKSVENAPLAKRRKQKLRSATASRRGSPAPANPGRAPVASKGAPRRANGPLPPS

SEQ ID NO: 900327 - protein, 109 aa, Homo sapiens
LHTYLVLELLRGGELLEHIRKKRHFSESEASQILRSLVSAVSFMHEEAGVVHRDLKPEVGELPRRRGGAVAPGAASDHYPAALANILYADDTPGAPVKIIDFGFARLRP

SEQ ID NO: 900328 - protein, 766 aa, Homo sapiens; identical to SEQ ID NO: 900325

SEQ ID NO: 900329 - protein, 740 aa, Homo sapiens
ARPGRSRHVTGAARSPSRAGPSDPPAMGDEDDDESCAVELRITEANLTGHEEKVSVENFELLKVLGTGAYGKVFLVRKAGGHDAGKLYAMKVLRKAALVQRAKTQEHTRTERSVLELVRQAPFLVTLHYAFQTDAKLHLILDYVSGGEMFTHLYQRQYFKEAEVRVYGGEIVLALEHLHKLGIIYRDLKLENVLLDSEGHIVLTDFGLSKEFLTEEKERTFSFCGTIEYMAPEIIRSKTGHGKAVDWWSLGILLFELLTGASPFTLEGERNTQAEVSRRILKCSPPFPPRIGPVAQDLLQRLLCKDPKKRLGAGPQGAQEVRNHPFFQGLDWVALAARKIPAPFRPQIRSELDVGNFAEEFTRLEPVYSPPGSPPPGDPRIFQGYSFVAPSILFDHNNAVMTDGLEAPGAGDRPGRAAVARSAMMQDSPFFQQYELDLREPALGQGSFSVCRRCRQRQSGQEFAVKILSRRLEANTQREVAALRLCQSHPNVVNLHEVHHDQNILYADDTPGAPVKIIDFGFARLRPQSPGVPMQTPCFTLQYAAPELLAQQGYDESCDLWSLGVILYMMLSGQVPFQGASGQGGQSQAAEIMCKIREGRFSLDGEAWQGVSEEAKELVRGLLTVDPAKRLKLEGLRGSSWLQDGSARSSPPLRTPDVLESSGPAVRSGLNATFMAFNRGKREGFFLKSVENAPLAKRRKQKLRSATASRRGSPAPANPGRAPVASKGAPRRANGPLPPS

SEQ ID NO: 900330 - protein, 619 aa, Homo sapiens
MARQKAMSFGKKVKSTSKDGLYHFTRSLSQGPLLIKTEIAGIALSLLIGMEDLQTEQSSSCHCGKNQGHLLKGQDRMRGLYSPSFFSPGFFLIQTEVSRRILKCSPPFPPRIGPVAQDLLQRLLCKDPKKRLGAGPQGAQEVRNHPFFQGLDWVALAARKIPAPFRPQIRSELDVGNFAEEFTRLEPVYSPPGSPPPGDPRIFQGYSFVAPSILFDHNNAVMTDGLEAPGAGDRPGRAAVARSAMMQDSPFFQQYELDLREPALGQGSFSVCRRCRQRQSGQEFAVKILSRRLEANTQREVAALRLCQSHPNVVNLHEVHHDQLHTYLVLELLRGGELLEHIRKKRHFSESEASQILRSLVSAVSFMHEEAGVVHRDLKPENILYADDTPGAPVKIIDFGFARLRPQSPGVPMQTPCFTLQYAAPELLAQQGYDESCDLWSLGVILYMMLSGQVPFQGASGQGGQSQAAEIMCKIREGRFSLDGEAWQGVSEEAKELVRGLLTVDPAKRLKLEGLRGSSWLQDGSARSSPPLRTPDVLESSGPAVRSGLNATFMAFNRGKREGFFLKSVENAPLAKRRKQKLRSATASRRGSPAPANPGRAPVASKGAPRRANGPLPPS

SEQ ID NO: 900331 - protein, 1582 aa, Homo sapiens
ARGPTGCLLSQRRPLITVAMPGGLLLGDVAPNFEANTTVGRIRFHDFLGDSWGILFSHPRDFTPVCTTELGRAAKLAPEFAKRNVKLIALSIDSVEDHLAWSKDINAYNCEEPTEKLPFPIIDDRNRELAILLGMLDPAEKDEKGMPVTARVVFVFGPDKKLKLSILYPATTGRNFDEILRVVISLQLTAEKRVATPVDWKDGDSVMVLPTIPEEEAKKTFPERSLHQRAPIWQEIPPLHTPALSLLEKLVLLSQRMSAANCVFLQQFHKHILVSSQPRFLGCYTNGLLNENGKKKKKKKKKKKKKIGEKEPLKLEDGRCGEYFELFEDKSMSSLPGCIGLDAATATVESEEIAELQQAVVEELGISMEELRHFIDEELEKMDCVQQRKKQLAELETWVIQKESEVAHVDQLFDDASRAVTNCESLVKDFYSKLGLQYRDSSSEDESSRPTEIIEIPDEDDDVLSIDSGDAGSRTPKDQKLREAMAALRKSAQDVQKFMDAVNKKSSSQDLHKGTLSQMSGELSKDGDLIVSMRILGKKRTKTWHKGTLIAIQTVGPGKKYKVKFDNKGKSLLSGNHIAYDYHPPADKLYVGSRVVAKYKDGNQVWLYAGIVAETPNVKNKLRFLIFFDDGYASYVTQSELYPICRPLKKTWEDIEDISCRDFIEEYVTAYPNRPMVLLKSGQLIKTEWEGTWWKSRVEEVDGSLVRILFLDDKRCEWIYRGSTRLEPMFSMKTSSASALEKKQGQLRTRPNMGAVRSKGPVVQYTQDLTGTGTQFKPVEPPQPTAPPAPPFPPAPPLSPQAGDSDLESQLAQSRKQVAKKSTSFRPGSVGSGHSSPTSPALSENVSGGKPGINQTYRSPLGSTASAPAPSALPAPPAPPVFHGMLERAPAEPSYRAPMEKLFYLPHVCSYTCLSRVRPMRNEQYRGKNPLLVPLLYDFRRMTARRRVNRKMGFHVIYKTPCGLCLRTMQEIERYLFETGCDFLFLEMFCLDPYVLVDRKFQPYKPFYYILDITYGKEDVPLSCVNEIDTTPPPQVAYSKERIPGKGVFINTGPEFLVGCDCKDGCRDKSKCACHQLTIQATACTPGGQINPNSGYQYKRLEECLPTGVYECNKRCKCDPNMCTNRLVQHGLQVRLQLFKTQNKGWGIRCLDDIAKGSFVCIYAGKILTDDFADKEGLEMGDEYFANLDHIESVENFKEGYESDAPCSSDSSGVDLKDQEDGNSGTEDPEESNDDSSDDNFCKDEDFSTSSVWRSYATRRQTRGQKENGLSETTSKDSHPPDLGPPHIPVPPSIPVGGCNPPSSEETPKNKVASWLSCNSVSEGGFADSDSHSSFKTNEGGEGRAGGSRMEAEKASTSGLGIKDEGDIKQAKKEDTDDRNKMSVVTESSRNYGYNPSPVKPEGLRRPPSKTSMHQSRRLMASAQSNPDDVLTLSSSTESEGESGTSRKPTAGQTSATAVDSDDIQTISSGSEGDDFEDKKNMTGPMKRQVAVKSTRGFALKSTHGIAIKSTNMASVDKGESAPVRKNTRQFYDGEESCYIIDAKLEGNLGRYLNVRPLSPPLDAGLSHGPQISFNILYKPFS

SEQ ID NO: 900332 - protein, 397 aa, Homo sapiens
MSSLPGCIGLDAATATVESEEIAELQQAVVEELGISMEELRHFIDEELEKMDCVQQRKKQLAELETWVIQKESEVAHVDQLFDDASRAVTNCESLVKDFYSKLGLQYRDSSSEDESSRPTEIIEIPDEDDDVLSIDSGDAGSRTPKDQKLREAMAALRKSAQDVQKFMDAVNKKSSSQDLHKGTLSQMSGELSKDGDLIVSMRILGKKRTKTWHKGTLIAIQTVGPGKKYKVKFDNKGKSLLSGNHIAYDYHPPADKLYVGSRVVAKYKDGNQVWLYAGIVAETPNVKNKLRFLIFFDDGYASYVTQSELYPICRPLKKTWEDIEDISCRDFIEEYVTAYPNRPMVLLKSGQLIKTEWEGTWWKSRVEEVDGSLVRILFLVLFFSTILEAEVGGGGT

SEQ ID NO: 900333 - protein, 1291 aa, Homo sapiens
MSSLPGCIGLDAATATVESEEIAELQQAVVEELGISMEELRHFIDEELEKMDCVQQRKKQLAELETWVIQKESEVAHVDQLFDDASRAVTNCESLVKDFYSKLGLQYRDSSSEDESSRPTEIIEIPDEDDDVLSIDSGDAGSRTPKDQKLREAMAALRKSAQDVQKFMDAVNKKSSSQDLHKGTLSQMSGELSKDGDLIVSMRILGKKRTKTWHKGTLIAIQTVGPGKKYKVKFDNKGKSLLSGNHIAYDYHPPADKLYVGSRVVAKYKDGNQVWLYAGIVAETPNVKNKLRFLIFFDDGYASYVTQSELYPICRPLKKTWEDIEDISCRDFIEEYVTAYPNRPMVLLKSGQLIKTEWEGTWWKSRVEEVDGSLVRILFLDDKRCEWIYRGSTRLEPMFSMKTSSASALEKKQGQLRTRPNMGAVRSKGPVVQYTQDLTGTGTQFKPVEPPQPTAPPAPPFPPAPPLSPQAGDSDLESQLAQSRKQVAKKSTSFRPGSVGSGHSSPTSPALSENVSGGKPGINQTYRSPLGSTASAPAPSALPAPPAPPVFHGMLERAPAEPSYRAPMEKLFYLPHVCSYTCLSRVRPMRNEQYRGKNPLLVPLLYDFRRMTARRRVNRKMGFHVIYKTPCGLCLRTMQEIERYLFETGCDFLFLEMFCLDPYVLVDRKFQPYKPFYYILDITYGKEDVPLSCVNEIDTTPPPQVAYSKERIPGKGVFINTGPEFLVGCDCKDGCRDKSKCACHQLTIQATACTPGGQINPNSGYQYKRLEECLPTGVYECNKRCKCDPNMCTNRLVQHGLQVRLQLFKTQNKGWGIRCLDDIAKGSFVCIYAGKILTDDFADKEGLEMGDEYFANLDHIESVENFKEGYESDAPCSSDSSGVDLKDQEDGNSGTEDPEESNDDSSDDNFCKDEDFSTSSVWRSYATRRQTRGQKENGLSETTSKDSHPPDLGPPHIPVPPSIPVGGCNPPSSEETPKNKVASWLSCNSVSEGGFADSDSHSSFKTNEGGEGRAGGSRMEAEKASTSGLGIKDEGDIKQAKKEDTDDRNKMSVVTESSRNYGYNPSPVKPEGLRRPPSKTSMHQSRRLMASAQSNPDDVLTLSSSTESEGESGTSRKPTAGQTSATAVDSDDIQTISSGSEGDDFEDKKNMTGPMKRQVAVKSTRGFALKSTHGIAIKSTNMASVDKGESAPVRKNTRQFYDGEESCYIIDAKLEGNLGRYLNHSCSPNLFVQNVFVDTHDLRFPWVAFFASKRIRAGTELTWDYNYEVGSVEGKELLCCCGAIECRGRLL

SEQ ID NO: 900334 - protein, 1276 aa, Homo sapiens
MSSLPGCIGLDAATATVESEEIAELQQAVVEELGISMEELRHFIDEELEKMDCVQQRKKQLAELETWVIQKESEVAHVDQLFDDASRAVTNCESLVKDFYSKLGLQYRDSSSEDESSRPTEIIEIPDEDDDVLSIDSGDAGSRTPKDQKLREAMAALRKSAQDVQKFMDAVNKKSSSQDLHKGTLSQMSGELSKDGDLIVSMRILGKKRTKTWHKGTLIAIQTVGPGKKYKVKFDNKGKSLLSGNHIAYDYHPPADKLYVGSRVVAKYKDGNQVWLYAGIVAETPNVKNKLRFLIFFDDGYASYVTQSELYPICRPLKKTWEDIEDISCRDFIEEYVTAYPNRPMVLLKSGQLIKTEWEGTWWKSRVEEVDGSLVRILFLDDKRCEWIYRGSTRLEPMFSMKTSSASALEKKQGQLRTRPNMGAVRSKGPVVQYTQDLTGTGTQFKPVEPPQPTAPPAPPFPPAPPLSPQAGDSDLESQLAQSRKQVAKKSTSFRPGSVGSGHSSPTSPALSENVSGGKPGINQTYRSPLGSTASAPAPSALPAPPAPPVFHGMLERAPAEPSYRAPMEKLFYLPHVCSYTCLSRVRPMRNEQYRGKNPLLVPLLYDFRRMTARRRVNRKWTMQEIERYLFETGCDFLFLEMFCLDPYVLVDRKFQPYKPFYYILDITYGKEDVPLSCVNEIDTTPPPQVAYSKERIPGKGVFINTGPEFLVGCDCKDGCRDKSKCACHQLTIQATACTPGGQINPNSGYQYKRLEECLPTGVYECNKRCKCDPNMCTNRLVQHGLQVRLQLFKTQNKGWGIRCLDDIAKGSFVCIYAGKILTDDFADKEGLEMGDEYFANLDHIESVENFKEGYESDAPCSSDSSGVDLKDQEDGNSGTEDPEESNDDSSDDNFCKDEDFSTSSVWRSYATRRQTRGQKENGLSETTSKDSHPPDLGPPHIPVPPSIPVGGCNPPSSEETPKNKVASWLSCNSVSEGGFADSDSHSSFKTNEGGEGRAGGSRMEAEKASTSGLGIKDEGDIKQAKKEDTDDRNKMSVVTESSRNYGYNPSPVKPEGLRRPPSKTSMHQSRRLMASAQSNPDDVLTLSSSTESEGESGTSRKPTAGQTSATAVDSDDIQTISSGSEGDDFEDKKNMTGPMKRQVAVKSTRGFALKSTHGIAIKSTNMASVDKGESAPVRKNTRQFYDGEESCYIIDAKLEGNLGRYLNHSCSPNLFVQNVFVDTHDLRFPWVAFFASKRIRAGTELTWDYNYEVGSVEGKELLCCCGAIECRGRLL

SEQ ID NO: 900335 - protein, 1164 aa, Homo sapiens
MSSLPGCIGLDAATATVESEEIAELQQAVVEELGISMEELRHFIDEELEKMDCVQQRKKQLAELETWVIQKESEVAHVDQLFDDASRAVTNCESLVKDFYSKLGLQYRDSSSEDESSRPTEIIEIPDEDDDVLSIDSGDAGSRTPKDQKLREAMAALRKSAQDVQKFMDAVNKKSSSQDLHKGTLSQMSGELSKDGDLIVSMRILGKKRTKTWHKGTLIAIQTVGPGKKYKVKFDNKGKSLLSGNHIAYDYHPPADKLYVGSRVVAKYKDGNQVWLYAGIVAETPNVKNKLRFLIFFDDGYASYVTQSELYPICRPLKKTWEDIEDISCRDFIEEYVTAYPNRPMVLLKSGQLIKTEWEGTWWKSRVEEVDGSLVRILFLDDKRCEWIYRGSTRLEPMFSMKTSSASALEKKQGQLRTRPNMGAVRSKGPVVQYTQDLTGTGTQFKPVEPPQPTAPPAPPFPPAPPLSPQAGDSDLESQLAQSRKQVAKKSTSFRPGSVGSGHSSPTSPALSENVSGGKPGINQTYRSPLGSTASAPAPSALPAPPAPPVFHGMLERAPAEPSYRAPMEKLFYLPHVCSYTCLSRVRPMRNEQYRGKNPLLVPLLYDFRRMTARRRVNRKMGFHVIYKTPCGLCLRTMQEIERYLFETGCDFLFLEMFCLDPYVLVDRKFQPYKPFYYILDITYGKEDVPLSCVNEIDTTPPPQVAYSKERIPGKGVFINTGPEFLVGCDCKDGCRDKSKCACHQLTIQATACTPGGQINPNSGYQYKRLEECLPTGVYECNKRCKCDPNMCTNRLVQHGLQVRLQLFKTQNKGWGIRCLDDIAKGSFVCIYAGKILTDDFADKEGLEMGDEYFANLDHIESVENFKEGYESDAPCSSDSSGVDLKDQEDGNSGTEDPEESNDDSSDDNFCKDEDFSTSSVWRSYATRRQTRGQKENGLSETTSKDSHPPDLGPPHIPVPPSIPVGGCNPPSSEETPKNKVASWLSCNSVSEGGFADSDSHSSFKTNEGGEGRAGGSRMEAEKASTSGLGIKDEGDIKQAKKEDTDDRNKMSVVTESSRNYGYNPSPVKPEGLRRPPSKTSMHQSRRLMASAQSNPDVSHLKLIQSLIKENGHCHLIKSFTIITVRSSPTSSSLDCAALFSFIQHLIFLLPPPFPAKPWVTART

SEQ ID NO: 900336 - protein, 1291 aa, Homo sapiens; identical to SEQ ID NO: 900333

SEQ ID NO: 900337 - protein, 822 aa, Homo sapiens
LFITGGVLCLVAAPGLNVAKKSTSFRPGSVGSGHSSPTSPALSENVSGGKPGINQTYRSPLGSTASAPAPSALPAPPAPPVFHGMLERAPAEPSYRAPMEKLFYLPHVCSYTCLSRVRPMRNEQYRGKNPLLVPLLYDFRRMTARRRVNRKMGFHVIYKTPCGLCLRTMQEIERYLFETGCDFLFLEMFCLDPYVLVDRKFQPYKPFYYILDITYGKEDVPLSCVNEIDTTPPPQVAYSKERIPGKGVFINTGPEFLVGCDCKDGCRDKSKCACHQLTIQATACTPGGQINPNSGYQYKRLEECLPTGVYECNKRCKCDPNMCTNRLVQHGLQVRLQLFKTQNKGWGIRCLDDIAKGSFVCIYAGKILTDDFADKEGLEMGDEYFANLDHIESVENFKEGYESDAPCSSDSSGVDLKDQEDGNSGTEDPEESNDDSSDDNFCKDEDFSTSSVWRSYATRRQTRGQKENGLSETTSKDSHPPDLGPPHIPVPPSIPVGGCNPPSSEETPKNKVASWLSCNSVSEGGFADSDSHSSFKTNEGGEGRAGGSRMEAEKASTSGLGIKDEGDIKQAKKEDTDDRNKMSVVTESSRNYGYNPSPVKPEGLRRPPSKTSMHQSRRLMASAQSNPDDVLTLSSSTESEGESGTSRKPTAGQTSATAVDSDDIQTISSGSEGDDFEDKKNMTGPMKRQVAVKSTRGFALKSTHGIAIKSTNMASVDKGESAPVRKNTRQFYDGEESCYIIDAKLEGNLGRYLNHSCSPNLFVQNVFVDTHDLRFPWVAFFASKRIRAGTELTWDYNYEVGSVEGKELLCCCGAIECRGRLL

SEQ ID NO: 900338 - protein, 1164 aa, Homo sapiens; identical to SEQ ID NO: 900335

SEQ ID NO: 900339 - protein, 1050 aa, Homo sapiens
MSSLPGCIGLDAATATVESEEIAELQQAVVEELGISMEELRHFIDEELEKMDCVQQRKKQLAELETWVIQKESEVAHVDQLFDDASRAVTNCESLVKDFYSKLGLQYRDSSSEDESSRPTEIIEIPDEDDDVLSIDSGDAGSRTPKDQKLREAMAALRKSAQDVQKFMDAVNKKSSSQDLHKGTLSQMSGELSKDGDLIVSMRILGKKRTKTWHKGTLIAIQTVGPGKKYKVKFDNKGKSLLSGNHIAYDYHPPADKLYVGSRVVAKYKDGNQVWLYAGIVAETPNVKNKLRFLIFFDDGYASYVTQSELYPICRPLKKTWEDIEDISCRDFIEEYVTAYPNRPMVLLKSGQLIKTEWEGTWWKSRVEEVDGSLVRILFLDDKRCEWIYRGSTRLEPMFSMKTSSASALEKKQGQLRTRPNMGAVRSKGPVVQYTQDLTGTGTQFKPVEPPQPTAPPAPPFPPAPPLSPQAGDSDLESQLAQSRKQVAKKSTSFRPGSVGSGHSSPTSPALSENVSGGKPGINQTYRSPLGSTASAPAPSALPAPPAPPVFHGMLERAPAEPSYRAPMEKLFYLPHVCSYTCLSRVRPMRNEQYRGKNPLLVPLLYDFRRMTARRRVNRKMGFHVIYKTPCGLCLRTMQEIERYLFETGCDFLFLEMFCLDPYVLVDRKFQPYKPFYYILDITYGKEDVPLSCVNEIDTTPPPQVAYSKERIPGKGVFINTGPEFLVGCDCKDGCRDKSKCACHQLTIQATACTPGGQINPNSGYQYKRLEECLPTGVYECNKRCKCDPNMCTNRLVQHGLQVRLQLFKTQNKGWGIRCLDDIAKGSFVCIYAGKILTDDFADKEGLEMGDEYFANLDHIESVENFKEGYESDAPCSSDSSGVDLKDQEDGNSGTEDPEESNDDSSDDNFCKDEDFSTSSVWRSYATRRQTRGQKENGLSETTSKDSHPPDLGPPHIPVPPSIPVGGCNPPSSEETPKNKVASWLSCNSVSEGGFADSDSHSSFKTNEGGEGRAGGSRMEAEKASTSGLGIKDEGDIKQAKKEVSSGRTL

SEQ ID NO: 900340 - protein, 1050 aa, Homo sapiens; identical to SEQ ID NO: 900339

SEQ ID NO: 900341 - protein, 80 aa, Homo sapiens
PGSYLILSLNLQHSCSPNLFVQNVFVDTHDLRFPWVAFFASKRIRAGTELTWDYNYEVGSVEGKELLCCCGAIECRGRLL

SEQ ID NO: 900342 - protein, 1291 aa, Homo sapiens; identical to SEQ ID NO: 900333

SEQ ID NO: 900343 - protein, 1291 aa, Homo sapiens; identical to SEQ ID NO: 900333

SEQ ID NO: 900344 - protein, 1376 aa, Homo sapiens
MSSLPGCIGLDAATATVESEEIAELQQAVVEELGISMEELRHFIDEELEKMDCVQQRKKQLAELETWVIQKESEVAHVDQLFDDASRAVTNCESLVKDFYSKLGLQYRDSSSEDESSRPTEIIEIPDEDDDVLSIDSGDAGSRTPKDQKLREAMAALRKSAQDVQKFMDAVNKKSSSQDLHKGTLSQMSGELSKDGDLIVSMRILGKKRTKTWHKGTLIAIQTVGPGKKYKVKFDNKGKSLLSGNHIAYDYHPPADKLYVGSRVVAKYKDGNQVWLYAGIVAETPNVKNKLRFLIFFDDGYASYVTQSELYPICRPLKKTWEDIEDISCRDFIEEYVTAYPNRPMVLLKSGQLIKTEWEGTWWKSRVEEVDGSLVRILFLDDKRCEWIYRGSTRLEPMFSMKTSSASALEKKQGQLRTRPNMGAVRSKGPVVQYTQDLTGTGTQFKPVEPPQPTAPPAPPFPPAPPLSPQAGDSDLESQLAQSRKQVAKKSTSFRPGSVGSGHSSPTSPALSENVSGGKPGINQTYRSPLGSTASAPAPSALPAPPAPPVFHGMLERAPAEPSYRAPMEKLFYLPHVCSYTCLSRVRPMRNEQYRGKNPLLVPLLYDFRRMTARRRVNRKMGFHVIYKTPCGLCLRTMQEIERYLFETGCDFLFLEMFCLDPYVLVDRKFQPYKPFYYILDITYGKEDVPLSCVNEIDTTPPPQVAYSKERIPGKGVFINTGPEFLVGCDCKDGCRDKSKCACHQLTIQATACTPGGQINPNSGYQYKRLEECLPTGVYECNKRCKCDPNMCTNRLVQHGLQVRLQLFKTQNKGWGIRCLDDIAKGSFVCIYAGKILTDDFADKEGLEMGDEYFANLDHIESVENFKEGYESDAPCSSDSSGVDLKDQEDGNSGTEDPEESNDDSSDDNFCKDEDFSTSSVWRSYATRRQTRGQKENGLSETTSKDSHPPDLGPPHIPVPPSIPVGGCNPPSSEETPKNKVASWLSCNSVSEGGFADSDSHSSFKTNEGGEGRAGGSRMEAEKASTSGLGIKDEGDIKQAKKEDTDDRNKMSVVTESSRNYGYNPSPVKPEGLRRPPSKTSMHQSRRLMASAQSNPDVSHLKLIQSLIKENGHCHLIKSFTIITVRSSPTSSSLDCAALFSFIQHLIFLLPPPFPAKPWVTARTERSPSHLLLLLLTLLLPQDVLTLSSSTESEGESGTSRKPTAGQTSATAVDSDDIQTISSGSEGDDFEDKKNMTGPMKRQVAVKSTRGFALKSTHGIAIKSTNMASVDKGESAPVRKNTRQFYDGEESCYIIDAKLEGNLGRYLNHSCSPNLFVQNVFVDTHDLRFPWVAFFASKRIRAGTELTWDYNYEVGSVEGKELLCCCGAIECRGRLL

SEQ ID NO: 900345 - protein, 971 aa, Homo sapiens
MPYLPSQFYFFLETEYVTAYPNRPMVLLKSGQLIKTEWEGTWWKSRVEEVDGSLVRILFLDDKRCEWIYRGSTRLEPMFSMKTSSASALEKKQGQLRTRPNMGAVRSKGPVVQYTQDLTGTGTQFKPVEPPQPTAPPAPPFPPAPPLSPQAGDSDLESQLAQSRKQVAKKSTSFRPGSVGSGHSSPTSPALSENVSGGKPGINQTYRSPLGSTASAPAPSALPAPPAPPVFHGMLERAPAEPSYRAPMEKLFYLPHVCSYTCLSRVRPMRNEQYRGKNPLLVPLLYDFRRMTARRRVNRKMGFHVIYKTPCGLCLRTMQEIERYLFETGCDFLFLEMFCLDPYVLVDRKFQPYKPFYYILDITYGKEDVPLSCVNEIDTTPPPQVAYSKERIPGKGVFINTGPEFLVGCDCKDGCRDKSKCACHQLTIQATACTPGGQINPNSGYQYKRLEECLPTGVYECNKRCKCDPNMCTNRLVQHGLQVRLQLFKTQNKGWGIRCLDDIAKGSFVCIYAGKILTDDFADKEGLEMGDEYFANLDHIESVENFKEGYESDAPCSSDSSGVDLKDQEDGNSGTEDPEESNDDSSDDNFCKDEDFSTSSVWRSYATRRQTRGQKENGLSETTSKDSHPPDLGPPHIPVPPSIPVGGCNPPSSEETPKNKVASWLSCNSVSEGGFADSDSHSSFKTNEGGEGRAGGSRMEAEKASTSGLGIKDEGDIKQAKKEDTDDRNKMSVVTESSRNYGYNPSPVKPEGLRRPPSKTSMHQSRRLMASAQSNPDDVLTLSSSTESEGESGTSRKPTAGQTSATAVDSDDIQTISSGSEGDDFEDKKNMTGPMKRQVAVKSTRGFALKSTHGIAIKSTNMASVDKGESAPVRKNTRQFYDGEESCYIIDAKLEGNLGRYLNHSCSPNLFVQNVFVDTHDLRFPWVAFFASKRIRAGTELTWDYNYEVGSVEGKELLCCCGAIECRGRLL

SEQ ID NO: 900346 - protein, 443 aa, Homo sapiens
MGDEYFANLDHIESVENFKEGYESDAPCSSDSSGVDLKDQEDGNSGTEDPEESNDDSSDDNFCKDEDFSTSSVWRSYATRRQTRGQKENGLSETTSKDSHPPDLGPPHIPVPPSIPVGGCNPPSSEETPKNKVASWLSCNSVSEGGFADSDSHSSFKTNEGGEGRAGGSRMEAEKASTSGLGIKDEGDIKQAKKEDTDDRNKMSVVTESSRNYGYNPSPVKPEGLRRPPSKTSMHQSRRLMASAQSNPDDVLTLSSSTESEGESGTSRKPTAGQTSATAVDSDDIQTISSGSEGDDFEDKKNMTGPMKRQVAVKSTRGFALKSTHGIAIKSTNMASVDKGESAPVRKNTRQFYDGEESCYIIDAKLEGNLGRYLNHSCSPNLFVQNVFVDTHDLRFPWVAFFASKRIRAGTELTWDYNYEVGSVEGKELLCCCGAIECRGRLL

SEQ ID NO: 900347 - protein, 188 aa, Homo sapiens
MEGPDSSYSCLLIHICWKVDSEARMEPPIHTEYLRSGGADDLEDKKDMTGPMKRQVAVKSTRGFALKSTHGIAIKSTNMASVDKGESAPVRKNTRQFYDGEESCYIIDAKLEGNLGRYLNHSCSPNLFVQNVFVDTHDLRFPWVAFFASKRIRAGTELTWDYNYEVGSVEGKELLCCCGAIECRGRLL

SEQ ID NO: 900348 - protein, 397 aa, Homo sapiens; identical to SEQ ID NO: 900332

SEQ ID NO: 900349 - protein, 183 aa, Homo sapiens
MSSLPGCIGLDAATATVESEEIAELQQAVVEELGISMEELRHFIDEELEKMDCVQQRKKQLAELETWVIQKESEVAHVDQLFDDASRAVTNCESLVKDFYSKLGLQYRDSSSEDESSRPTEIIEIPDEDDDVLSIDSGDAGSRTPKDQKLREAMAALRKSAQDVQKFMDAVNKKSSSQDLHKG

SEQ ID NO: 900350 - protein, 255 aa, Homo sapiens
QESGRGDVIAARRQEVRSWPVQLGFPSFCLRHLRDLLSPPILSVMDDAHESPSDKGGETGESDETAAVPGDPGATDTDGIPEETDGDADVDLKEAAAEEGELESQDVSDLTTVEREDSSLLNPAAKKLKIDTKEKKEKKQKVDEDEIQKMQILVSSFSEEQLNRYEMYRRSAFPKAAIKRLIQSITGTSVSQNVVIAMSGISKVFVGEVVEEALDVCEKWGEMPPLQPKHMREAVRRLKSKGQIPNSKHKKIIFF

SEQ ID NO: 900351 - protein, 244 aa, Homo sapiens
ARYEAGVNRQRLGFPSFCLRHLRDLLSPPILSVMDDAHESPSDKGGETGESDETAAVPGDPGATDTDGIPEETDGDADVDLKEAAAEEGELESQDVSDLTTVEREDSSLLNPAAKKLKIDTKEKKEKKQKVDEDEIQKMQILVSSFSEEQLNRYEMYRRSAFPKAAIKRLIQSITGTSVSQNVVIAMSGISKVFVGEVVEEALDVCEKWGEMPPLQPKHMREAVRRLKSKGQIPNSKHKKIIFF

SEQ ID NO: 900352 - protein, 198 aa, Homo sapiens
QESGRGDVIAARRQEVRSWPVQLGFPSFCLRHLRDLLSPPILSVMDDAHESPSDKGGETGESDETAAVPGDPGATDTDGIPEETDGDADVDLKEAAAEEGELESQDVSDLTTVEREDSSLLNPAAKKLKIDTKEKKEKKQKVDEDEIQKMQILVSSFSEEQLNRYEMYRRSAFPKAAIKRHWMCVRSGEKCHHYNPNI

SEQ ID NO: 900353 - protein, 115 aa, Homo sapiens
ARYEAGVNRQRLGFPSFCLRHLRDLLSPPILSVMDDAHESPSDKGGETGESDETAAVPGDPGATDTDGIPEETDGDADVDLKEAAAEEGEAGRDVLMRLKEYPEIVLLAARRASG

SEQ ID NO: 900354 - protein, 255 aa, Homo sapiens; identical to SEQ ID NO: 900350

SEQ ID NO: 900355 - protein, 214 aa, Homo sapiens
QESGRGDVIAARRQEVRSWPVQLGFPSFCLRHLRDLLSPPILSVMDDAHESPSDKGGETGESDETAAVPGDPGATDTDGIPEETDGDADVDLKEAAAEEGELESQDVSDLTTVEREDSSLLNPAAKKLKIDTKEKKEKKQKVDEDEIQKMQILVSSFSEEQLNRYEMYRRSAFPKAAIKRLIQSITGTSVSQNVVIAMSGISKVFVGEVVEEGE

SEQ ID NO: 900356 - protein, 187 aa, Homo sapiens
QESGRGDVIAARRQEVRSWPVQLGFPSFCLRHLRDLLSPPILSVMDDAHESPSDKGGETGESDETAAVPGDPGATDTDGIPEETDGDADVDLKEAAAEEGELESQDVSDLTTVEREDSSLLNPAAKKLKIDTKEKKEKKQKVDEDEIQKMQILVSSFSEEQLNRYEMYRRSAFPKAAIKRTFSLPSV

SEQ ID NO: 900357 - protein, 1452 aa, Homo sapiens
MRTLGTCLATLAGLLLTAAGETFSGGCLFDEPYSTCGYSQSEGDDFNWEQVNTLTKPTSDPWMPSGSFMLVNASGRPEGQRAHLLLPQLKENDTHCIDFHYFVSSKSNSPPGLLNVYVKVNNGPLGNPIWNISGDPTRTWNRAELAISTFWPNFYQVIFEVITSGHQGYLAIDEVKVLGHPCTRTPHFLRIQNVEVNAGQFATFQCSAIGRTVAGDRLWLQGIDVRDAPLKEIKVTSSRRFIASFNVVNTTKRDAGKYRCMIRTEGGVGISNYAELVVKEPPVPIAPPQLASVGATYLWIQLNANSINGDGPIVAREVEYCTASGSWNDRQPVDSTSYKIGHLDPDTEYEISVLLTRPGEGGTGSPGPALRTRTKCADPMRGPRKLEVVEVKSRQITIRWEPFGYNVTRCHSYNLTVHYCYQVGGQEQVREEVSWDTENSHPQHTITNLSPYTNVSVKLILMNPEGRKESQELIVQTDEDLPGAVPTESIQGSTFEEKIFLQWREPTQTYGVITLYEITYKAVSSFDPEIDLSNQSGRVSKLGNETHFLFFGLYPGTTYSFTIRASTAKGFGPPATNQFTTKISAPSMPAYELETPLNQTDNTVTVMLKPAHSRGAPVSVYQIVVEEERPRRTKKTTEILKCYPVPIHFQNASLLNSQYYFAAEFPADSLQAAQPFTIGDNKTYNGYWNTPLLPYKSYRIYFQAASRANGETKIDCVQVATKGAATPKPVPEPEKQTDHTVKIAGVIAGILLFVIIFLGVVLVMKKRKLAKKRKETMSSTRQEMTVMVNSMDKSYAEQGTNCDEAFSFMDTHNLNGRSVSSPSSFTMKTNTLSTSVPNSYYPDETHTMASDTSSLVQSHTYKKREPADVPYQTGQLHPAIRVADLLQHITQMKCAEGYGFKEEYESFFEGQSAPWDSAKKDENRMKNRYGNIIAYDHSRVRLQTIEGDTNSDYINGNYIDGYHRPNHYIATQGPMQETIYDFWRMVWHENTASIIMVTNLVEVGRVKCCKYWPDDTEIYKDIKVTLIETELLAEYVIRTFAVEKRGVHEIREIRQFHFTGWPDHGVPYHATGLLGFVRQVKSKSPPSAGPLVVHCSAGAGRTGCFIVIDIMLDMAEREGVVDIYNCVRELRSRRVNMVQTEEQYVFIHDAILEACLCGDTSVPASQVRSLYYDMNKLDPQTNSSQIKEEFRTLNMVTPTLRVEDCSIALLPRNHEKNRCMDILPPDRCLPFLITIDGESSNYINAALMDSYKQPSAFIVTQHPLPNTVKDFWRLVLDYHCTSVVMLNDVDPAQLCPQYWPENGVHRHGPIQVEFVSADLEEDIISRIFRIYNAARPQDGYRMVQQFQFLGWPMYRDTPVSKRSFLKLIRQVDKWQEEYNGGEGRTVVHCLNGGGRSGTFCAISIVCEMLRHQRTVDVFHAVKTLRNNKPNMVDLLDQYKFCYEVALEYLNSG

SEQ ID NO: 900358 - protein, 1535 aa, Homo sapiens
RVLWPNPVRVSSSGLLPEHASLILPFITDPSVKTLFCLNLPGTLCNTWDQEFEDSNQTNQTTSSSGETRSPTGRGRIIIKNTDKTRDCLKNMIPDELERIQSRLYGPGGCLFDEPYSTCGYSQSEGDDFNWEQVNTLTKPTSDPWMPSGSFMLVNASGRPEGQRAHLLLPQLKENDTHCIDFHYFVSSKSNSPPGLLNVYVKVNNGPLGNPIWNISGDPTRTWNRAELAISTFWPNFYQVIFEVITSGHQGYLAIDEVKVLGHPCTRTPHFLRIQNVEVNAGQFATFQCSAIGRTVAGDRLWLQGIDVRDAPLKEIKVTSSRRFIASFNVVNTTKRDAGKYRCMIRTEGGVGISNYAELVVKEPPVPIAPPQLASVGATYLWIQLNANSINGDGPIVAREVEYCTASGSWNDRQPVDSTSYKIGHLDPDTEYEISVLLTRPGEGGTGSPGPALRTRTKCADPMRGPRKLEVVEVKSRQITIRWEPFGYNVTRCHSYNLTVHYCYQVGGQEQVREEVSWDTENSHPQHTITNLSPYTNVSVKLILMNPEGRKESQELIVQTDEDLPGAVPTESIQGSTFEEKIFLQWREPTQTYGVITLYEITYKAVSSFDPEIDLSNQSGRVSKLGNETHFLFFGLYPGTTYSFTIRASTAKGFGPPATNQFTTKISAPSMPAYELETPLNQTDNTVTVMLKPAHSRGAPVSVYQIVVEEERPRRTKKTTEILKCYPVPIHFQNASLLNSQYYFAAEFPADSLQAAQPFTIGDNKTYNGYWNTPLLPYKSYRIYFQAASRANGETKIDCVQVATKGAATPKPVPEPEKQTDHTVKIAGVIAGILLFVIIFLGVVLVMKKRKLAKKRKETMSSTRQEMTVMVNSMDKSYAEQGTNCDEAFSFMDTHNLNGRSVSSPSSFTMKTNTLSTSVPNSYYPDETHTMASDTSSLVQSHTYKKREPADVPYQTGQLHPAIRVADLLQHITQMKCAEGYGFKEEYESFFEGQSAPWDSAKKDENRMKNRYGNIIAYDHSRVRLQTIEGDTNSDYINGNYIDGYHRPNHYIATQGPMQETIYDFWRMVWHENTASIIMVTNLVEVGRVKCCKYWPDDTEIYKDIKVTLIETELLAEYVIRTFAVEKRGVHEIREIRQFHFTGWPDHGVPYHATGLLGFVRQVKSKSPPSAGPLVVHCSAGAGRTGCFIVIDIMLDMAEREGVVDIYNCVRELRSRRVNMVQTEEQYVFIHDAILEACLCGDTSVPASQVRSLYYDMNKLDPQTNSSQIKEEFRTLNMVTPTLRVEDCSIALLPRNHEKNRCMDILPPDRCLPFLITIDGESSNYINAALMDSYKQPSAFIVTQHPLPNTVKDFWRLVLDYHCTSVVMLNDVDPAQLCPQYWPENGVHRHGPIQVEFVSADLEEDIISRIFRIYNAARPQDGYRMVQQFQFLGWPMYRDTPVSKRSFLKLIRQVDKWQEEYNGGEGRTVVHCLNGGGRSGTFCAISIVCEMLRHQRTVDVFHAVKTLRNNKPNMVDLLDQYKFCYEVALEYLNSG

SEQ ID NO: 900359 - protein, 1552 aa, Homo sapiens
RVLWPNPVRVSSSGLLPEHASLILPFITDPSVKTLFCLNLPGTLCNTWDQEFEDSNQTNQTTSSSGETRSPTGRGRIIIKNTDKTRDCLKNMIPDELERIQSRLYGPGGCLFDEPYSTCGYSQSEGDDFNWEQVNTLTKPTSDPWMPSGSFMLVNASGRPEGQRAHLLLPQLKENDTHCIDFHYFVSSKSNSPPGLLNVYVKVNNGPLGNPIWNISGDPTRTWNRAELAISTFWPNFYQVIFEVITSGHQGYLAIDEVKVLGHPCTRTPHFLRIQNVEVNAGQFATFQCSAIGRTVAGDRLWLQGIDVRDAPLKEIKVTSSRRFIASFNVVNTTKRDAGKYRCMIRTEGGVGISNYAELVVKEPPVPIAPPQLASVGATYLWIQLNANSINGDGPIVAREVEYCTASGSWNDRQPVDSTSYKIGHLDPDTEYEISVLLTRPGEGGTGSPGPALRTRTKCADPMRGPRKLEVVEVKSRQITIRWEPFGYNVTRCHSYNLTVHYCYQVGGQEQVREEVSWDTENSHPQHTITNLSPYTNVSVKLILMNPEGRKESQELIVQTDEDLPGAVPTESIQGSTFEEKIFLQWREPTQTYGVITLYEITYKAVSSFDPEIDLSNQSGRVSKLGNETHFLFFGLYPGTTYSFTIRASTAKGFGPPATNQFTTKISAPSMPAYELETPLNQTDNTVTVMLKPAHSRGAPVSVYQIVVEEERPRRTKKTTEILKCYPVPIHFQNASLLNSQYYFAAEFPADSLQAAQPFTIGDNKTYNGYWNTPLLPYKSYRIYFQAASRANGETKIDCVQVATKGAATPKPVPEPEKQTDHTVKIAGVIAGILLFVIIFLGVVLVMKKRKLAKKRKETMSSTRQEMTVMVNSMDKSYAEQGTNCDEAFSFMDTHNLNGRSVSSPSSFTMKTNTLSTSVPNSYYPDETHTMASDTSSLVQSHTYKKREPADVPYQTGQLHPAIRVADLLQHITQMKCAEGYGFKEEYESFFEGQSAPWDSAKKDENRMKNRYGNIIAYDHSRVRLQTIEGDTNSDYINGNYIDGYHRPNHYIATQGPMQETIYDFWRMVWHENTASIIMVTNLVEVGRVKCCKYWPDDTEIYKDIKVTLIETELLAEYVIRTFAVEKGGAGGEANCSPSREVSQRGVHEIREIRQFHFTGWPDHGVPYHATGLLGFVRQVKSKSPPSAGPLVVHCSAGAGRTGCFIVIDIMLDMAEREGVVDIYNCVRELRSRRVNMVQTEEQYVFIHDAILEACLCGDTSVPASQVRSLYYDMNKLDPQTNSSQIKEEFRTLNMVTPTLRVEDCSIALLPRNHEKNRCMDILPPDRCLPFLITIDGESSNYINAALMDSYKQPSAFIVTQHPLPNTVKDFWRLVLDYHCTSVVMLNDVDPAQLCPQYWPENGVHRHGPIQVEFVSADLEEDIISRIFRIYNAARPQDGYRMVQQFQFLGWPMYRDTPVSKRSFLKLIRQVDKWQEEYNGGEGRTVVHCLNGGGRSGTFCAISIVCEMLRHQRTVDVFHAVKTLRNNKPNMVDLLDQYKFCYEVALEYLNSG

SEQ ID NO: 900360 - protein, 765 aa, Homo sapiens
MLTWKSSFALAAIIVTQLTTPYIRIAPAAGDGQLTGAATPKPVPEPEKQTDHTVKIAGVIAGILLFVIIFLGVVLVMKKRKLAKKRKETMSSTRQEMTVMVNSMDKSYAEQGTNCDEAFSFMDTHNLNGRSVSSPSSFTMKTNTLSTSVPNSYYPDETHTMASDTSSLVQSHTYKKREPADVPYQTGQLHPAIRVADLLQHITQMKCAEGYGFKEEYESFFEGQSAPWDSAKKDENRMKNRYGNIIAYDHSRVRLQTIEGDTNSDYINGNYIDGYHRPNHYIATQGPMQETIYDFWRMVWHENTASIIMVTNLVEVGRVKCCKYWPDDTEIYKDIKVTLIETELLAEYVIRTFAVEKRGVHEIREIRQFHFTGWPDHGVPYHATGLLGFVRQVKSKSPPSAGPLVVHCSAGAGRTGCFIVIDIMLDMAEREGVVDIYNCVRELRSRRVNMVQTEEQYVFIHDAILEACLCGDTSVPASQVRSLYYDMNKLDPQTNSSQIKEEFRTLNMVTPTLRVEDCSIALLPRNHEKNRCMDILPPDRCLPFLITIDGESSNYINAALMDSYKQPSAFIVTQHPLPNTVKDFWRLVLDYHCTSVVMLNDVDPAQLCPQYWPENGVHRHGPIQVEFVSADLEEDIISRIFRIYNAARPQDGYRMVQQFQFLGWPMYRDTPVSKRSFLKLIRQVDKWQEEYNGGEGRTVVHCLNGGGRSGTFCAISIVCEMLRHQRTVDVFHAVKTLRNNKPNMVDLLDQYKFCYEVALEYLNSG

SEQ ID NO: 900361 - protein, 449 aa, Homo sapiens
YCPQKHTLRCNNNEGHGPQNITLIETELLAEYVIRTFAVEKRGVHEIREIRQFHFTGWPDHGVPYHATGLLGFVRQVKSKSPPSAGPLVVHCSAGAGRTGCFIVIDIMLDMAEREGVVDIYNCVRELRSRRVNMVQTEEQYVFIHDAILEACLCGDTSVPASQVRSLYYDMNKLDPQTNSSQIKEEFRTLNMVTPTLRVEDCSIALLPRNHEKNRCMDILPPDRCLPFLITIDGESSNYINAALMDSYKQPSAFIVTQHPLPNTVKDFWRLVLDYHCTSVVMLNDVDPAQLCPQYWPENGVHRHGPIQVEFVSADLEEDIISRIFRIYNAARPQDGYRMVQQFQFLGWPMYRDTPVSKRSFLKLIRQVDKWQEEYNGGEGRTVVHCLNGGGRSGTFCAISIVCEMLRHQRTVDVFHAVKTLRNNKPNMVDLLDQYKFCYEVALEYLNSG

SEQ ID NO: 900362 - protein, 1535 aa, Homo sapiens; identical to SEQ ID NO: 900358

SEQ ID NO: 900363 - protein, 279 aa, Homo sapiens
MNKLDPQTNSSQIKEEFRTLNMVTPTLRVEDCSIALLPRNHEKNRCMDILPPDRCLPFLITIDGESSNYINAALMDSYKQPSAFIVTQHPLPNTVKDFWRLVLDYHCTSVVMLNDVDPAQLCPQYWPENGVHRHGPIQVEFVSADLEEDIISRIFRIYNAARPQDGYRMVQQFQFLGWPMYRDTPVSKRSFLKLIRQVDKWQEEYNGGEGRTVVHCLNGGGRSGTFCAISIVCEMLRHQRTVDVFHAVKTLRNNKPNMVDLLDQYKFCYEVALEYLNSG

SEQ ID NO: 900364 - protein, 1452 aa, Homo sapiens; identical to SEQ ID NO: 900357

SEQ ID NO: 900365 - protein, 1239 aa, Homo sapiens
MGTLSLHPGIDVRDAPLKEIKVTSSRRFIASFNVVNTTKRDAGKYRCMIRTEGGVGISNYAELVVKEPPVPIAPPQLASVGATYLWIQLNANSINGDGPIVAREVEYCTASGSWNDRQPVDSTSYKIGHLDPDTEYEISVLLTRPGEGGTGSPGPALRTRTKCADPMRGPRKLEVVEVKSRQITIRWEPFGYNVTRCHSYNLTVHYCYQVGGQEQVREEVSWDTENSHPQHTITNLSPYTNVSVKLILMNPEGRKESQELIVQTDEDLPGAVPTESIQGSTFEEKIFLQWREPTQTYGVITLYEITYKAVSSFDPEIDLSNQSGRVSKLGNETHFLFFGLYPGTTYSFTIRASTAKGFGPPATNQFTTKISAPSMPAYELETPLNQTDNTVTVMLKPAHSRGAPVSVYQIVVEEERPRRTKKTTEILKCYPVPIHFQNASLLNSQYYFAAEFPADSLQAAQPFTIGDNKTYNGYWNTPLLPYKSYRIYFQAASRANGETKIDCVQVATKGAATPKPVPEPEKQTDHTVKIAGVIAGILLFVIIFLGVVLVMKKRKLAKKRKETMSSTRQEMTVMVNSMDKSYAEQGTNCDEAFSFMDTHNLNGRSVSSPSSFTMKTNTLSTSVPNSYYPDETHTMASDTSSLVQSHTYKKREPADVPYQTGQLHPAIRVADLLQHITQMKCAEGYGFKEEYESFFEGQSAPWDSAKKDENRMKNRYGNIIAYDHSRVRLQTIEGDTNSDYINGNYIDGYHRPNHYIATQGPMQETIYDFWRMVWHENTASIIMVTNLVEVGRVKCCKYWPDDTEIYKDIKVTLIETELLAEYVIRTFAVEKRGVHEIREIRQFHFTGWPDHGVPYHATGLLGFVRQVKSKSPPSAGPLVVHCSAGAGRTGCFIVIDIMLDMAEREGVVDIYNCVRELRSRRVNMVQTEEQYVFIHDAILEACLCGDTSVPASQVRSLYYDMNKLDPQTNSSQIKEEFRTLNMVTPTLRVEDCSIALLPRNHEKNRCMDILPPDRCLPFLITIDGESSNYINAALMDSYKQPSAFIVTQHPLPNTVKDFWRLVLDYHCTSVVMLNDVDPAQLCPQYWPENGVHRHGPIQVEFVSADLEEDIISRIFRIYNAARPQDGYRMVQQFQFLGWPMYRDTPVSKRSFLKLIRQVDKWQEEYNGGEGRTVVHCLNGGGRSGTFCAISIVCEMLRHQRTVDVFHAVKTLRNNKPNMVDLLDQYKFCYEVALEYLNSG

SEQ ID NO: 900366 - protein, 524 aa, Homo sapiens
MINQLVPDINLPIESQEATEITAHINGIYSPAFIIDPNITLCTQGPMQETIYDFWRMVWHENTASIIMVTNLVEVGRVKCCKYWPDDTEIYKDIKVTLIETELLAEYVIRTFAVEKRGVHEIREIRQFHFTGWPDHGVPYHATGLLGFVRQVKSKSPPSAGPLVVHCSAGAGRTGCFIVIDIMLDMAEREGVVDIYNCVRELRSRRVNMVQTEEQYVFIHDAILEACLCGDTSVPASQVRSLYYDMNKLDPQTNSSQIKEEFRTLNMVTPTLRVEDCSIALLPRNHEKNRCMDILPPDRCLPFLITIDGESSNYINAALMDSYKQPSAFIVTQHPLPNTVKDFWRLVLDYHCTSVVMLNDVDPAQLCPQYWPENGVHRHGPIQVEFVSADLEEDIISRIFRIYNAARPQDGYRMVQQFQFLGWPMYRDTPVSKRSFLKLIRQVDKWQEEYNGGEGRTVVHCLNGGGRSGTFCAISIVCEMLRHQRTVDVFHAVKTLRNNKPNMVDLLDQYKFCYEVALEYLNSG

SEQ ID NO: 900367 - protein, 1535 aa, Homo sapiens; identical to SEQ ID NO: 900358

SEQ ID NO: 900368 - protein, 1230 aa, Homo sapiens
RVLWPNPVRVSSSGLLPEHASLILPFITDPSVKTLFCLNLPGTLCNTWDQEFEDSNQTNQTTSSSGETRSPTGRGRIIIKNTDKTRDCLKNMIPDELERIQSRLYGPGGCLFDEPYSTCGYSQSEGDDFNWEQVNTLTKPTSDPWMPSGSFMLVNASGRPEGQRAHLLLPQLKENDTHCIDFHYFVSSKSNSPPGLLNVYVKVNNGPLGNPIWNISGDPTRTWNRAELAISTFWPNFYQVIFEVITSGHQGYLAIDEVKVLGHPCTRTPHFLRIQNVEVNAGQFATFQCSAIGRTVAGDRLWLQGIDVRDAPLKEIKVTSSRRFIASFNVVNTTKRDAGKYRCMIRTEGGVGISNYAELVVKEPPVPIAPPQLASVGATYLWIQLNANSINGDGPIVAREVEYCTASGSWNDRQPVDSTSYKIGHLDPDTEYEISVLLTRPGEGGTGSPGPALRTRTKCADPMRGPRKLEVVEVKSRQITIRWEPFGYNVTRCHSYNLTVHYCYQVGGQEQVREEVSWDTENSHPQHTITNLSPYTNVSVKLILMNPEGRKESQELIVQTDEDLPGAVPTESIQGSTFEEKIFLQWREPTQTYGVITLYEITYKAVSSFDPEIDLSNQSGRVSKLGNETHFLFFGLYPGTTYSFTIRASTAKGFGPPATNQFTTKISAPSMPAYELETPLNQTDNTVTVMLKPAHSRGAPVSVYQIVVEEERPRRTKKTTEILKCYPVPIHFQNASLLNSQYYFAAEFPADSLQAAQPFTIGDNKTYNGYWNTPLLPYKSYRIYFQAASRANGETKIDCVQVATKGAATPKPVPEPEKQTDHTVKIAGVIAGILLFVIIFLGVVLVMKKRKLAKKRKETMSSTRQEMTVMVNSMDKSYAEQGTNCDEAFSFMDTHNLNGRSVSSPSSFTMKTNTLSTSVPNSYYPDETHTMASDTSSLVQSHTYKKREPADVPYQTGQLHPAIRVADLLQHITQMKCAEGYGFKEEYESFFEGQSAPWDSAKKDENRMKNRYGNIIAYDHSRVRLQTIEGDTNSDYINGNYIDGYHRPNHYIATQGPMQETIYDFWRMVWHENTASIIMVTNLVEVGRVKCCKYWPDDTEIYKDIKVTLIETELLAEYVIRTFAVEKRGVHEIREIRQFHFTGWPDHGVPYHATGLLGFVRQVKSKSPPSAGPLVVHCSAGAGRTGCFIVIDIMLDMAEREGVVDIYNCVRELRSRRVNMVQTEVLPLIT

SEQ ID NO: 900369 - protein, 396 aa, Homo sapiens
MERSGQRVTTWDCDQGKHSDSDYREDGMDLGSDAGSSSSSSRASSQSNSTKVTPCSECKSSSSPGGSLDLVSALEDYEEPFPVYQKKVIDEWAPEEDGEEEEEEDERDQRGYRDDRSPAREPGDVSARTRSGGGGGRSATTAMPPPVPNGNLHQHDPQDLRHNGNVVVAGRPSCSRGPRRAIQKPQPAGGRRSGRGPAAGGLCLQPPDGGTCVPEEPPVPPMDWEALEKHLAGLQFREQEVRNQGQARTNSTSAQKNERESIRQKLALGSFFDDGPGIYTSCSKSGKPSLSSRLQSGMNLQICFVNDSGSDKDSDADDSKTETSLDTPLSPMSKQSSSYSDRDTTEEESESLDDMDFLTRQKKLQAEAKMALAMAKPMAKMQVEVEKQNRKKVSRR

SEQ ID NO: 900370 - protein, 383 aa, Homo sapiens
MERSGQRVTTWDCDQGKHSDSDYREDGMDLGSDAGSSSSSSRASSQSNSTKVTPCSECKSSSSPGGSLDLVSALEDYEEPFPVYQKKVIDEWAPEEDGEEEEEEDERDQRGYRDDRSPAREPGDVSARTRSGGGGGRSATTAMPPPVPNGNLHQHDPQDLRHNGNVVVAGRPSCSRGPRRAIQKPQPAGGRRSGRGPAAGGLCLQPPDGGTCVPEEPPVPPMDWEALEKHLAGLQFREQEAQKNERESIRQKLALGSFFDDGPGIYTSCSKSGKPSLSSRLQSGMNLQICFVNDSGSDKDSDADDSKTETSLDTPLSPMSKQSSSYSDRDTTEEESESLDDMDFLTRQKKLQAEAKMALAMAKPMAKMQVEVEKQNRKKVSRR

SEQ ID NO: 900371 - protein, 153 aa, Homo sapiens
MVHQDNCSYQAQKNERESIRQKLALGSFFDDGPGIYTSCSKSGKPSLSSRLQSGMNLQICFVNDSGSDKDSDADDSKTETSLDTPLSPMSKQSSSYSDRDTTEEESESLDDMDFLTRQKKLQAEAKMALAMAKPMAKMQVEVEKQNRKKVSRR

SEQ ID NO: 900372 - protein, 369 aa, Homo sapiens
MDLGSDAGSSSSSSRASSQSNSTKVTPCSECKSSSSPGGSLDLVSALEDYEEPFPVYQKKVIDEWAPEEDGEEEEEEDERDQRGYRDDRSPAREPGDVSARTRSGGGGGRSATTAMPPPVPNGNLHQHDPQDLRHNGNVVVAGRPSCSRGPRRAIQKPQPAGGRRSGRGPAAGGLCLQPPDGGTCVPEEPPVPPMDWEALEKHLAGLQFREQEVRNQGQARTNSTSAQKNERESIRQKLALGSFFDDGPGIYTSCSKSGKPSLSSRLQSGMNLQICFVNDSGSDKDSDADDSKTETSLDTPLSPMSKQSSSYSDRDTTEEESESLDDMDFLTRQKKLQAEAKMALAMAKPMAKMQVEVEKQNRKKVSRR

SEQ ID NO: 900373 - protein, 472 aa, Homo sapiens
MRLEELKRLQNPLEQVNDGKYSFENHQLAMDAENNIEKYPLNLQPLESKVKIIQRAWREYLQRQEPLGKRSPSPPSVSSEKLSSSVSMNTFSDSSTPDYREDGMDLGSDAGSSSSSSRASSQSNSTKVTPCSECKSSSSPGGSLDLVSALEDYEEPFPVYQKKVIDEWAPEEDGEEEEEEDERDQRGYRDDRSPAREPGDVSARTRSGGGGGRSATTAMPPPVPNGNLHQHDPQDLRHNGNVVVAGRPSCSRGPRRAIQKPQPAGGRRSGRGPAAGGLCLQPPDGGTCVPEEPPVPPMDWEALEKHLAGLQFREQEVRNQGQARTNSTSAQKNERESIRQKLALGSFFDDGPGIYTSCSKSGKPSLSSRLQSGMNLQICFVNDSGSDKDSDADDSKTETSLDTPLSPMSKQSSSYSDRDTTEEESESLDDMDFLTRQKKLQAEAKMALAMAKPMAKMQVEVEKQNRKKVSRR

SEQ ID NO: 900374 - protein, 169 aa, Homo sapiens
MNLDSDGMDDIISQESSLDMEGNYKKAQKNERESIRQKLALGSFFDDGPGIYTSCSKSGKPSLSSRLQSGMNLQICFVNDSGSDKDSDADDSKTETSLDTPLSPMSKQSSSYSDRDTTEEESESLDDMDFLTRQKKLQAEAKMALAMAKPMAKMQVEVEKQNRKKVSRR

SEQ ID NO: 900375 - protein, 268 aa, Homo sapiens [sequence omitted]

SEQ ID NO: 900376 - protein, 153 aa, Homo sapiens; identical to SEQ ID NO: 900371

SEQ ID NO: 900377 - protein, 174 aa, Homo sapiens
MDLGSDAGSSSSSSRASSQSNSTKVTPCSECKSSSSPGGSLDLVSALEDYEEPFPVYQKKVIDEWAPEEDGEEEEEEDERDQRGYRDDRSPAREPGDVSARTRSGGGGGRSATTAMPPPVPNGNLHQHDPQDLRHNGNVVVAGRPSCSRGPRRAIQKPQPAGGRRSGRGPAAGG

SEQ ID NO: 900378 - protein, 153 aa, Homo sapiens; identical to SEQ ID NO: 900371

SEQ ID NO: 900379 - protein, 164 aa, Homo sapiens
MERSGQRVTTWDCDQGKHSDSAQKNERESIRQKLALGSFFDDGPGIYTSCSKSGKPSLSSRLQSGMNLQICFVNDSGSDKDSDADDSKTETSLDTPLSPMSKQSSSYSDRDTTEEESESLDDMDFLTRQKKLQAEAKMALAMAKPMAKMQVEVEKQNRKKVSRR

SEQ ID NO: 900380 - protein, 369 aa, Homo sapiens; identical to SEQ ID NO: 900372

SEQ ID NO: 900381 - protein, 386 aa, Homo sapiens
DPVSDALLAVQDYREDGMDLGSDAGSSSSSSRASSQSNSTKVTPCSECKSSSSPGGSLDLVSALEDYEEPFPVYQKKVIDEWAPEEDGEEEEEEDERDQRGYRDDRSPAREPGDVSARTRSGGGGGRSATTAMPPPVPNGNLHQHDPQDLRHNGNVVVAGRPSCSRGPRRAIQKPQPAGGRRSGRGPAAGGLCLQPPDGGTCVPEEPPVPPMDWEALEKHLAGLQFREQEVRNQGQARTNSTSAQKNERESIRQKLALGSFFDDGPGIYTSCSKSGKPSLSSRLQSGMNLQICFVNDSGSDKDSDADDSKTETSLDTPLSPMSKQSSSYSDRDTTEEESESLDDMDFLTRQKKLQAEAKMALAMAKPMAKMQVEVEKQNRKKVSRR

SEQ ID NO: 900382 - protein, 147 aa, Homo sapiens
MVHQDNCSYQAQKNERESIRQKLALGSFFDDGPGIYTSCSKSGKPSLSSRLQSGMNLQICFVNDSGSDKDSDADDSKTETSLDTPLSPMSKQSSSYSDRDTTEEESESLDDMDFLTRQKKLQAEAKMALAMAKPMAKMQVEVEKQNR

SEQ ID NO: 900383 - protein, 106 aa, Homo sapiens
DAWVDPRVRKKSPVADLLPHMPHISECLMKRSLKPTDLRDMTIGQLQVIVNDLHSQIESLNEELVQLLLIRDELHTEQDAMLVDIEDLTRHAESQQKHMAEKMPAK

SEQ ID NO: 900384 - protein, 340 aa, Homo sapiens [sequence omitted]

SEQ ID NO: 900385 - protein, 340 aa, Homo sapiens [sequence omitted]

SEQ ID NO: 900386 - protein, 291 aa, Homo sapiens
MGEMEQLRQEAEQLKKQIADARKACADVTLAELVSGLEVVGRVQMRTRRTLRGHLAKIYAMHWATDSKLLVSASQDGKLIVWDSYTTNKVHAIPLRSSWVMTCAYAPSGNFVACGGLDNMCSIYNLKSREGNVKVSRELSAHTGYLSCCRFLDDNNIVTSSGDTTCALWDIETGQQKTVFVGHTGDCMSLAVSPDFNLFISGACDASAKLWDVREGTCRQTFTGHESDINAICDPIQKRALPFLAISFSSPPLNWNCFPTFVFYVIDVFEEYKPVFCRLSLRLSLSDICSP

SEQ ID NO: 900387 - protein, 258 aa, Homo sapiens
MGEMEQLRQEAEQLKKQIADARKACADVTLAELVSGLEVVGRVQMRTRRTLRGHLAKIYAMHWATDSKLLVSASQDGKLIVWDSYTTNKVHAIPLRSSWVMTCAYAPSGNFVACGGLDNMCSIYNLKSREGNVKVSRELSAHTGYLSCCRFLDDNNIVTSSGDTTCALWDIETGQQKTVFVGHTGDCMSLAVSPDFNLFISGACDASAKLWDVREGTCRQTFTGHESDINAICLLPQWPPTIRWLRRLQLQCLGLHEV

SEQ ID NO: 900388 - protein, 291 aa, Homo sapiens; identical to SEQ ID NO: 900386

SEQ ID NO: 900389 - protein, 454 aa, Homo sapiens
GAGLGSALLGWGAGRAQAGWGWTQRTSNLEGLAGERVQPPSRFPVSWSLVWARRAEAQPGGGFLNTDPMFLAGARVTPRPVSHGGDGATASGSGAAQEADCSNSRALPLGPQKTAGDMRSVAQGEGAGFALEGLEVTRDFLNLVRIFETPKPQSPKTNLPWRPMHLPPPPRPCSPDVCFSLQDARKACADVTLAELVSGLEVVGRVQMRTRRTLRGHLAKIYAMHWATDSKLLVSASQDGKLIVWDSYTTNKVHAIPLRSSWVMTCAYAPSGNFVACGGLDNMCSIYNLKSREGNVKVSRELSAHTGYLSCCRFLDDNNIVTSSGDTTCALWDIETGQQKTVFVGHTGDCMSLAVSPDFNLFISGACDASAKLWDVREGTCRQTFTGHESDINAICDPIQKRALPFLAISFSSPPLNWNCFPTFVFYVIDVFEEYKPVFCRLSLRLSLSDICSP

SEQ ID NO: 900390 - protein, 340 aa, Homo sapiens [sequence omitted]

SEQ ID NO: 900391 - protein, 367 aa, Homo sapiens
MGEMEQLRQEAEQLKKQIADARKACADVTLAELVSGLEVVGRVQMRTRRTLRGHLAKIYAMHWATDSKLLVSASQDGKLIVWDSYTTNKVHAIPLRSSWVMTCAYAPSGNFVACGGLDNMCSIYNLKSREGNVKVSRELSAHTGYLSCCRFLDDNNIVTSSGDTTCALWDIETGQQKTVFVGHTGDCMSLAVSPDFNLFISGACDASAKLWDVREGTCRQTFTGHESDINAICFFPNGEAICTGSDDASCRLFDLRADQELICFSHESIICGITSVAFSLSGRLLFAGYDDFNCNVWDSMKSERVGLSSGPDNRLSGWDPVTVGGPRSGEVPIWPGVGTAVGALPRPPPLPGSLGPPPGRRAPATPG

SEQ ID NO: 900392 - protein, 360 aa, Homo sapiens
MGEMEQLRQEAEQLKKQIADARKACADVTLAELVSGLEVVGRVQMRTRRTLRGHLAKIYAMHWATDSKLLVSASQDGKLIVWDSYTTNKVHAIPLRSSWVMTCAYAPSGNFVACGGLDNMCSIYNLKSREGNVKVSRELSAHTGYLSCCRFLDDNNIVTSSGDTTCALWDIETGQQKTVFVGHTGDCMSLAVSPDFNLFISGACDASAKLWDVREGTCRQTFTGHESDINAICFFPNGEAICTGSDDASCRLFDLRADQELICFSHESIICGITSVAFSLSGRLLFAGYDDFNCNVWDSMKSERVGKGQPWLLLPQLEGPSPALPPHSVPPISSHFGLSYCCPLSLGDSTPGIQYPLVPN

SEQ ID NO: 900393 - protein, 340 aa, Homo sapiens [sequence omitted]

SEQ ID NO: 900394 - protein, 218 aa, Homo sapiens
MGEMEQLRQEAEQLKKQIADARKACADVTLAELVSGLEVVGRVQMRTRRTLRGHLAKIYAMHWATDSKLLVSASQDGKLIVWDSYTTNKVHAIPLRSSWVMTCAYAPSGNFVACGGLDNMCSIYNLKSREGNVKVSRELSAHTGYLSCCRFLDDNNIVTSSGDTTCLWDIETGSRDWIGGPPVNADQVGSKLNLIGADAMQLGIEGRRNLAQGITWFQ

SEQ ID NO: 900395 - protein, 327 aa, Homo sapiens
SVPLRSVSLSGTLQGAGTTTKMAVARLAAVAAWVPCRSWGWAAVPFGPHRGLSVLLARIPQRAPRWLPACRQKTSLSFLNRPDLPNLAYKKLKGKSPGIIFIPGYLSYMNGTKALAIEEFCKSLGHACIRFDYSGVGSSDGNSEESTLGKWRKDVLSIIDDLADGPQILVGSSLGGWLMLHAAIARPEKVVALIGVATAADTLVTKFNQLPVELKKEVEMKGVWSMPSKYSEEGVYNVQYSFIKEAEHHCLLHSPIPVNCPIRLLHGMKDDIVPWHTSMQVADRVLSTDVDVILRKHSDHRMREKADIQLLVYTIDDLIDKLSTIVN

SEQ ID NO: 900396 - protein, 229 aa, Homo sapiens
PRFRCVACPSVGHCRVRGQLRRWRLRAWQLWRPGYLVGAGAGQPSPSVPTVASACCLHGYLSGRHGGSQILVGSSLGGWLMLHAAIARPEKVVALIGVATAADTLVTKFNQLPVELKKEVEMKGVWSMPSKYSEEGVYNVQYSFIKEAEHHCLLHSPIPVNCPIRLLHGMKDDIVPWHTSMQVADRVLSTDVDVILRKHSDHRMREKADIQLLVYTIDDLIDKLSTIVN

SEQ ID NO: 900397 - protein, 327 aa, Homo sapiens; identical to SEQ ID NO: 900395

SEQ ID NO: 900398 - protein, 327 aa, Homo sapiens; identical to SEQ ID NO: 900395

SEQ ID NO: 900399 - protein, 327 aa, Homo sapiens; identical to SEQ ID NO: 900395

SEQ ID NO: 900400 - protein, 347 aa, Homo sapiens
SGGRIAPAQCPRPPQSLCVEAGDRGGLSEDPPPRSRRPEPQPLPQRPRHLSPPPPPPPEPPRALWGMAVNVYSTSVTSENLSRHDMLAWVNDSLHLNYTKIEQLCSGAAYCQFMDMLFPGCVHLRKVKFQAKLEHEYIHNFKVLQAAFKKMGVDKIIPVEKLVKGKFQDNFEFIQWFKKFFDANYDGKDYNPLLARQGQDVAPPPNPGDQIFNKSKKLIGTAVPQRTSPTGPKNMQTSGRLSNVAPPCILRKNPPSARNGGHETDAQILELNQQLVDLKLTVDGLEKERDFYFSKLRDIELICQEHESENSPVISGIIGILYATEEGFAPPEDDEIEEHQQEDQDEY

SEQ ID NO: 900401 - protein, 347 aa, Homo sapiens; identical to SEQ ID NO: 900400

SEQ ID NO: 900402 - protein, 154 aa, Homo sapiens
MAVNVYSTSVTSENLSRHDMLAWVNDSLHLNYTKIEQLCSGAAYCQFMDMLFPGCVHLRKVKFQAKLEHEYIHNFKVLQAAFKKMGVDKVGACALGGPEEQCDPGEEEDPPAQATGAAGVIPVLVPPSTSRLSRGNFPPAQGTMEKPTTLAMPS

SEQ ID NO: 900403 - protein, 281 aa, Homo sapiens
MAVNVYSTSVTSENLSRHDMLAWVNDSLHLNYTKIEQLCSGAAYCQFMDMLFPGCVHLRKVKFQAKLEHEYIHNFKVLQAAFKKMGVDKIIPVEKLVKGKFQDNFEFIQWFKKFFDANYDGKDYNPLLARQGQDVAPPPNPGDQIFNKSKKLIGTAVPQRTSPTGPKNMQTSGRLSNVAPPCILRKNPPSARNGGHETDAQILELNQQLVDLKLTVDGLEKERDFYFSKLRDIELICQEHESENSPVISGIIGILYATEEGFAPPEDDEIEEHQQEDQDEY

SEQ ID NO: 900404 - protein, 156 aa, Homo sapiens [sequence omitted]

SEQ ID NO: 900405 - protein, 234 aa, Homo sapiens
SGGRIAPAQCPRPPQSLCVEAGDRGGLSEDPPPRSRRPEPQPLPQRPRHLSPPPPPPPEPPRALWGMAVNVYSTSVTSENLSRHDMLAWVNDSLHLNYTKIEQLCSGAAYCQFMDMLFPGCVHLRKVKFQAKLEHEYIHNFKVLQAAFKKMGVDKIIPVEKLVKGKFQDNFEFIQWFKKFFDANYDGKDYNPLLARQGQDVAPPPNPVPQRTSPTGPPPLHSPEESSISPKWRP

SEQ ID NO: 900406 - protein, 76 aa, Homo sapiens
TAAAASRLRSALVPRSLCALKPETAAASARTLRPGAAGRSRSLCRSAPATCPLPLRLRRSRLVHSGVWPSMCTPHL

SEQ ID NO: 900407 - protein, 220 aa, Homo sapiens
SGGRIAPAQCPRPPQSLCVEAGDRGGLSEDPPPRSRRPEPQPLPQRPRHLSPPPPPPPEPPRALWGMAVNVYSTSVTSENLSRHDMLAWVNDSLHLNYTKIEQLCSGAAYCQFMDMLFPGCVHLRKVKFQAKLEHEYIHNFKVLQAAFKKMGVDKVGACALGGPEEQCDPGEEEDPPAQATGAAGVIPVLVPPSTSRLSRGNFPPAQGTMEKPTTLAMPS

SEQ ID NO: 900408 - protein, 332 aa, Homo sapiens
SGGRIAPAQCPRPPQSLCVEAGDRGGLSEDPPPRSRRPEPQPLPQRPRHLSPPPPPPPEPPRALWGMAVNVYSTSVTSENLSRHDMLAWVNDSLHLNYTKIEQLCSGAAYCQFMDMLFPGCVHLRKVKFQAKLEHEYIHNFKVLQAAFKKMGVDKIIPVEKLVKGKFQDNFEFIQWFKKFFDANYDGKDYNPLLARQGQDVAPPPNPVPQRTSPTGPKNMQTSGRLSNVAPPCILRKNPPSARNGGHETDAQILELNQQLVDLKLTVDGLEKERDFYFSKLRDIELICQEHESENSPVISGIIGILYATEEGFAPPEDDEIEEHQQEDQDEY

SEQ ID NO: 900409 - protein, 347 aa, Homo sapiens; identical to SEQ ID NO: 900400

SEQ ID NO: 900410 - protein, 76 aa, Homo sapiens; identical to SEQ ID NO: 900406

SEQ ID NO: 900411 - protein, 1574 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIEYPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRDSSTWLTAFVLKVLSLAQEQVGGSPEKLQETSNWLLSQQQADGSFQDLSPVIHRSMQGGLVGNDETVALTAFVTIALHHGLAVFQDEGAEPLKQRVEASISKANSFLGEKASAGLLGAHAAAITAYALTLTKAPVDLLGVAHNNLMAMAQETGDNLYWGSVTGSQSNAVSPTPAPRNPSDPMPQAPALWIETTAYALLHLLLHEGKAEMADQAAAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKVVEEQESRVHYTVCIWRNGKVGLSGMAIADVTLLSGFHALRADLEKLTSLSDRYVSHFETEGPHVLLYFDSVPTSRECVGFEAVQEVPVGLVQAGQRNPVRLLQPRAQMFCVLRGTK

SEQ ID NO: 900412 - protein, 1587 aa, Homo sapiens
TRSAPRAASWLEDPREVRSVCLSATFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIEYPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRDSSTWLTAFVLKVLSLAQEQVGGSPEKLQETSNWLLSQQQADGSFQDLSPVIHRSMQGGLVGNDETVALTAFVTIALHHGLAVFQDEGAEPLKQRVEASISKANSFLGEKASAGLLGAHAAAITAYALTLTKAPADLLGVAHNNLMAMAQETGDNLYWGSVTGSQSNAVSPTPAPRNPSDPMPQAPALWIETTAYALLHLLLHEGKAEMADQAAAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKVVEEQESRVHYTVCIWRNGKVGLSGMAIADVTLLSGFHALRADLEKLTSLSDRYVSHFETEGPHVLLYFDSVPTSRECVGFEAVQEVPVGLVQAGQRNPVRLLQPRAQMFCVLRGTK

SEQ ID NO: 900413 - protein, 1612 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIEYPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVRPHGSLSIQELGEPGPSEGWGGYTGPGLWPSSFSCPQVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRDSSTWLTAFVLKVLSLAQEQVGGSPEKLQETSNWLLSQQQADGSFQDLSPVIHRSMQGGLVGNDETVALTAFVTIALHHGLAVFQDEGAEPLKQRVEASISKANSFLGEKASAGLLGAHAAAITAYALTLTKAPVDLLGVAHNNLMAMAQETGDNLYWGSVTGSQSNAVSPTPAPRNPSDPMPQAPALWIETTAYALLHLLLHEGKAEMADQAAAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKVVEEQESRVHYTVCIWRNGKVGLSGMAIADVTLLSGFHALRADLEKLTSLSDRYVSHFETEGPHVLLYFDSVPTSRECVGFEAVQEVPVGLVQAGQRNPVRLLQPRAQMFCVLRGTK

SEQ ID NO: 900414 - protein, 1375 aa, Homo sapiens
MTLVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIEYPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRDSSTWLTAFVLKVLSLAQEQVGGSPEKLQETSNWLLSQQQADGSFQDLSPVIHRSMQGGLVGNDETVALTAFVTIALHHGLAVFQDEGAEPLKQRVEASISKANSFLGEKASAGLLGAHAAAITAYALTLTKAPVDLLGVAHNNLMAMAQETGDNLYWGSVTGSQSNAVSPTPAPRNPSDPMPQAPALWIETTAYALLHLLLHEGKAEMADQAAAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKVVEEQESRVHYTVCIWRNGKVGLSGMAIADVTLLSGFHALRADLEKLTSLSDRYVSHFETEGPHVLLYFDSVPTSRECVGFEAVQEVPVGLVQAGQRNPVRLLQPRAQMFCVLRGTK

SEQ ID NO: 900415 - protein, 633 aa, Homo sapiens
YPRSPNTRAKAEMAVPVSALLNRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKETSNWLLSQQQADGSFQDLSPVIHRSMQGGLVGNDETVALTAFVTIALHHGLAVFQDEGAEPLKQRVEASISKANSFLGEKASAGLLGAHAAAITAYALTLTKAPVDLLGVAHNNLMAMAQETGDNLYWGSVTGSQSNAVSPTPAPRNPSDPMPQAPALWIETTAYALLHLLLHEGKAEMADQAAAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKVVEEQESRVHYTVCIWRNGKVGLSGMAIADVTLLSGFHALRADLEKLTSLSDRYVSHFETEGPHVLLYFDSVPTSRECVGFEAVQEVPVGLVQAGQRNPVRLLQPRAQMFCVLRGTK

SEQ ID NO: 900416 - protein, 1473 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIEYPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRDSSTWLTAFVLKVLSLAQEQVGGSPEKLQETSNWLLSQQQADGSFQDLSPVIHRSMQGGLVGNDETVALTAFVTIALHHGLAVFQDEGAEPLKQRVEASISKANSFLGEKASAGLLGAHAAAITAYALTLTKAPVDLLGVAHNNLMAMAQETGDNLYWGSVTGSQSNAVSPTPAPRNPSDPMPQAPALWIETTAYALLHLLLHEGKAEMADQAAAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREARGTARWGCLAWPSRTSPS

SEQ ID NO: 900417 - protein, 1117 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIEYPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGAKVVEEQESRVHYTVCIWRNGKVGLSGMAIADVTLLSGFHALRADLEKLTSLSDRYVSHFETEGPHVLLYFDSVPTSRECVGFEAVQEVPVGLVQAGQRNPVRLLQPRAQMFCVLRGTK

SEQ ID NO: 900418 - protein, 1574 aa, Homo sapiens; identical to SEQ ID NO: 900411

SEQ ID NO: 900419 - protein, 136 aa, Homo sapiens
GAALGQGREGRTQAGAGLLEPAQAEPGRQLTRLHRRNGKVGLSGMAIADVTLLSGFHALRADLEKLTSLSDRYVSHFETEGPHVLLYFDSVPTSRECVGFEAVQEVPVGLVQAGQRNPVRLLQPRAQMFCVLRGTK

SEQ ID NO: 900420 - protein, 1574 aa, Homo sapiens; identical to SEQ ID NO: 900411

SEQ ID NO: 900421 - protein, 1574 aa, Homo sapiens; identical to SEQ ID NO: 900411

SEQ ID NO: 900422 - protein, 1574 aa, Homo sapiens; identical to SEQ ID NO: 900411

SEQ ID NO: 900423 - protein, 172 aa, Homo sapiens
MQTSPTLPSGRCTRCSDPGLLLLHHLGRLPPAAVPPTLKQLQGCHGLEEGDLVKSRLLATLCSAEVCQCAEGKCPRQRRALERGLQDEDGYRMKFACYYPRVEYGFQVKVLREDSRAAFRLFETKITQVLHFTKDVKAAANQMRNFLVRASLPPSLGTWERIFDHGSGWGHL

SEQ ID NO: 900424 - protein, 120 aa, Homo sapiens
MASRLRFSEKTAELLSASLRPRSPKSCTSPRMSRPLLIRCATSWFEPPCRLRLEPGKEYLIMGLDGATYDLEGHPQYLLDSNSWIEEMPSERLCRSTRQRAACAQLNDFLQEYGTQGCQV

SEQ ID NO: 900425 - protein, 1334 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIEYPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRDSSTWLTAFVLKVLSLAQEQVGGSPEKLQETSNWLLSQQQADGSFQDLSPVIHRSMQGGLVGNDETVALTAFVTIALHHGLAVFQDEGAEPLKQRVEASISKANSFLGEKASAGLLGAHAAAITAYALTLTKAPVDLLGVAHNNLMAMAQETGDNLYWGSVTGSQSNAVSPTPAPRNPSDPMPQAPALWIETTAYALLHLLLHEGKAEMADQAAAWLTRQGSFQGGFRSTQVGAVPGCPPTSAGRNLNLGTMKLEALLCPLS

SEQ ID NO: 900426 - protein, 360 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIEYPAGDMYKAELTSR

SEQ ID NO: 900427 - protein, 137 aa, Homo sapiens
DSWPPCVLLKSASVLRVRLRAWGGAVEAGWPGPPPHCLMGSPTSGKCPRQRRALERGLQDEDGYRMKFACYYPRVEYGQSSHRGPGLTLPRGPAVLVSLGVACSSYRSCTQPVCSDTNFLPSQPQSNSPFPLLLTPS

SEQ ID NO: 900428 - protein, 75 aa, Homo sapiens
AAGPREWVPHLSSPRLARSPPPGSAWALRLCRKCRWGWCKPASATLYDYYNPERRCSVFYGAPSKEQTLGHLVFC

SEQ ID NO: 900429 - protein, 1506 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYAGEWQSHISLSKAEFQDALEKLNMGITDLQGLRLYVAAAIIEYPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRDSSTWLTAFVLKVLSLAQEQVGGSPEKLQETSNWLLSQQQADGSFQDLSPVIHRSMQGGLVGNDETVALTAFVTIALHHGLAVFQDEGAEPLKQRVEASISKANSFLGEKASAGLLGAHAAAITAYALTLTKAPVDLLGVAHNNLMAMAQETGDNLYWGSVTGSQSNAVSPTPAPRNPSDPMPQAPALWIETTAYALLHLLLHEGKAEMADQAAAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKVVEEQESRVHYTVCIWRNGKVGLSGMAIADVTLLSGFHALRADLEKLTSLSDRYVSHFETEGPHVLLYFDSVPTSRECVGFEAVQEVPVGLVQAGQRNPVRLLQPRAQMFCVLRGTK

SEQ ID NO: 900430 - protein, 1324 aa, Homo sapiens
MSASLRPSSMKCSYYIQARYIYGKPVQGVAYVRFGLLDEDGKKTFFRGLESQTKLVNGQSHISLSKAEFQDALEKLNMGITDLQGLRLYVAAAIIEYPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRDSSTWLTAFVLKVLSLAQEQVGGSPEKLQETSNWLLSQQQADGSFQDLSPVIHRSMQGGLVGNDETVALTAFVTIALHHGLAVFQDEGAEPLKQRVEASISKANSFLGEKASAGLLGAHAAAITAYALTLTKAPVDLLGVAHNNLMAMAQETGDNLYWGSVTGSQSNAVSPTPAPRNPSDPMPQAPALWIETTAYALLHLLLHEGKAEMADQAAAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKVVEEQESRVHYTVCIWRNGKVGLSGMAIADVTLLSGFHALRADLEKLTSLSDRYVSHFETEGPHVLLYFDSVPTSRECVGFEAVQEVPVGLVQAGQRNPVRLLQPRAQMFCVLRGTK

SEQ ID NO: 900431 - protein, 1568 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIEYPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRDSSTWLTAFVLKVLSLAQEQVGGSPEKLQETSNWLLSQQQADGSFQDLSPVIHRSMQGGLVGNDETVALTAFVTIALHHGLAVFQDEGAEPLKQRVEASISKANSFLGEKASAGLLGAHAAAITAYALTLTKAPVDLLGVAHNNLMAMAQETGDNLYWGSVTGSQSNAVSPTPAPRNPSDPMPQAPALWIETTAYALLHLLLHEGKAEMADQAAAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKVVEEQESRVHYTVCIWRNGKVGLSGMAIADVTLLSGFHALRADLEKLSSPRLARSPPPGSAWALRLCRKCRWGWCKPASATLYDYYNPERRCSVFYGAPSKEQTLGHLVFC

SEQ ID NO: 900432 - protein, 1574 aa, Homo sapiens; identical to SEQ ID NO: 900411

SEQ ID NO: 900433 - protein, 1339 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIEYPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRDSSTWLTAFVLKVLSLAQEQVGGSPEKLQETSNWLLSQQQADGSFQDLSPVIHRSMQGGLVGNDETVALTAFVTIALHHGLAVFQDEGAEPLKQRVEASISKANSFLGEKASAGLLGAHAAAITAYALTLTKAPVDLLGVAHNNLMAMAQETGDNLYWGSVTGSQSNAVSPTPAPRNPSDPMPQAPALWIETTAYALLHLLLHEGKAEMADQAAAWLTRQGSFQGGFRSTQDTVIALDALSAYWIASHTTEERGLNVTLSSTGRNGL

SEQ ID NO: 900434 - protein, 1574 aa, Homo sapiens; identical to SEQ ID NO: 900411

SEQ ID NO: 900435 - protein, 1574 aa, Homo sapiens; identical to SEQ ID NO: 900411

SEQ ID NO: 900436 - protein, 156 aa, Homo sapiens
YRYKLNVGTRMCCRPAQPCTTTTTPSADVLCFTGHQVKSRLLATLCSAEVCQCAEGKCPRQRRALERGLQDEDGYRMKFACYYPRVEYGFQVKVLREDSRAAFRLFETKITQVLHFTKDVKAAANQMRNFLVRASLPPSLGTWERIFDHGSGWGHL

SEQ ID NO: 900437 - protein, 118 aa, Homo sapiens
RLCAVCSCVCCVCVCAVGKCPRQRRALERGLQDEDGYRMKFACYYPRVEYGFQVKVLREDSRAAFRLFETKITQVLHFTKDVKAAANQMRNFLVRASLPPSLGTWERIFDHGSGWGHL

SEQ ID NO: 900438 - protein, 1084 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIEYPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGSGCKGKQEGGQERTVTGRWTAQEATEGKKGGP

SEQ ID NO: 900439 - protein, 244 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYGESWKLEG

SEQ ID NO: 900440 - protein, 600 aa, Homo sapiens
CTPVFVRGLSSPSAAMALLSEGLDELPAACLSPCGPPNPTELFSESRRLALEELVAGGPEAFAAFLRRERLARFLNPDEVHAILRAAERPGEEGAAAAAAAEDSFGSSHDCSSGTYFPEQSDLEPPLLELGWPAFYQGAYRGATRVETHFQPRGAGEGGPYGCKDALRQQLRSAREVIAVVMDVFTDIDIFRDLQEICRKQGVAVYILLDQALLSQFLDMCMDLKVHPEQEKLMTVRTITGNIYYARSGTKIIGKVHEKFTLIDGIRVATGSYSFTWTDGKLNSSNLVILSGQVVEHFDLEFRILYAQSKPISPKLLSHFQSSNKFDHLTNRKPQSKELTLGNLLRMRLARLSSTPRKADLDPEMPAEGKAERKPHDCESSTVSEEDYFSSHRDELQSRKAIDAATQTEPGEEMPGLSVSEVGTQTSITTACAGTQTAVITRIASSQTTIWSRSTTTQTDMDENILFPRGTQSTEGSPVSKMSVSRSSSLKSSSSVSSQGSVASSTGSPASIRTTDFHNPGYPKYLGTPHLELYLSDSLRNLNKERQFHFAGIRSRLNHMLAMLSRRTLFTENHLGLHSGNFSRVNLLAVRDVALYPSYQ

SEQ ID NO: 900441 - protein, 584 aa, Homo sapiens
CTPVFVRGLSSPSAAMALLSEGLDELPAACLSPCGPPNPTELFSESRRLALEELVAGGPEAFAAFLRRERLARFLNPDEVHAILRAAERPGEEGAAAAAAAEDSFGSSHDCSSGTYFPEQSDLEPPLLELGWPAFYQGAYRGATRVETHFQPRGAGEGGPYGCKDALRQQLRSAREVIAVVMDVFTDIDIFRDLQEICRKQGVAVYILLDQALLSQFLDMCMDLKVHPEQEKLMTVRTITGNIYYARSGTKIIGKVHEKFTLIDGIRVATGSYSFTWTDGKLNSSNLVILSGQVVEHFDLEFRILYAQSKPISPKLLSHFQSSNKFDHLTNRKPQSKELTLGNLLRMRLARLSSTPRKADLDPEMPAEGKAERKPHDCESSTVSEEDYFSSHRDELQSRKAIDAATQTEPGEEMPGLSVSEVGTQTSITTACAGTQTAVITRIASSQTTIWSRSTTTQTDMDENILFPRGTQSTEGSPVSKMSVSRSSSLKSSSSVSSQGSVASSTGSPASIRTTDFHNPGYPKYLGTPHLELYLSDSLRNLNKERQFHFAGIRSRLNHMLAMLSRRTLFTENHLGRSKGSKKN

SEQ ID NO: 900442 - protein, 217 aa, Homo sapiens
RILRTELELRDELQSRKAIDAATQTEPGEEMPGLSVSEVGTQTSITTACAGTQTAVITRIASSQTTIWSRSTTTQTDMDENILFPRGTQSTEGSPVSKMSVSRSSSLKSSSSVSSQGSVASSTGSPASIRTTDFHNPGYPKYLGTPHLELYLSDSLRNLNKERQFHFAGIRSRLNHMLAMLSRRTLFTENHLGLHSGNFSRVNLLAVRDVALYPSYQ

SEQ ID NO: 900443 - protein, 600 aa, Homo sapiens; identical to SEQ ID NO: 900440

SEQ ID NO: 900444 - protein, 650 aa, Homo sapiens
CTPVFVRGLSSPSAAMALLSEGLDELPAACLSPCGPPNPTELFSESRRLALEELVAGGPEAFAAFLADLLMLPCASGFTGAPPGLMCCTGQYSCCRCAVTDGPVEDGMGGCCACAVLCCAVPDVTICICASSGTDVASICGTVLTPDATSVTLVKHTMRSFGCFVIGPALLTMWLPYLLGCRRCCTMDCDSRMTLSAGTGWADRVVALPGCNGLLLLPGSSARVREVIAVVMDVFTDIDIFRDLQEICRKQGVAVYILLDQALLSQFLDMCMDLKVHPEQEKLMTVRTITGNIYYARSGTKIIGKVHEKFTLIDGIRVATGSYSFTWTDGKLNSSNLVILSGQVVEHFDLEFRILYAQSKPISPKLLSHFQSSNKFDHLTNRKPQSKELTLGNLLRMRLARLSSTPRKADLDPEMPAEGKAERKPHDCESSTVSEEDYFSSHRDELQSRKAIDAATQTEPGEEMPGLSVSEVGTQTSITTACAGTQTAVITRIASSQTTIWSRSTTTQTDMDENILFPRGTQSTEGSPVSKMSVSRSSSLKSSSSVSSQGSVASSTGSPASIRTTDFHNPGYPKYLGTPHLELYLSDSLRNLNKERQFHFAGIRSRLNHMLAMLSRRTLFTENHLGLHSGNFSRVNLLAVRDVALYPSYQ

SEQ ID NO: 900445 - protein, 359 aa, Homo sapiens
MTLESIMACCLSEEAKEARRINDEIERQLRRDKRDARRELKLLLLGTGESGKSTFIKQMRIIHGSGYSDEDKRGFTKLVYQNIFTAMQAMIRAMDTLKIPYKYEHNKAHAQLVREVDVEKVSAFENPYVDAIKSLWNDPGIQECYDRRREYQLSDSTKYYLNDLDRVADPAYLPTQQDVLRVRVPTTGIIEYPFDLQSVIFRMVDVGGQRSERRKWIHCFENVTSIMFLVALSEYDQVLVESDNENRMEESKALFRTIITYPWFQNSSVILFLNKKDLLEEKIMYSHLVDYFPEYDGPQRDAQAAREFILKMFVDLNPDSDKINYSHFTCATDTENIRFVFAAVKDTILQLNLKEYNLV

SEQ ID NO: 900446 - protein, 359 aa, Homo sapiens; identical to SEQ ID NO: 900445

SEQ ID NO: 900447 - protein, 353 aa, Homo sapiens
MACCLSEEAKEARRINDEIERQLRRDKRDARRELKLLLLGTGESGKSTFIKQMRIIHGSGYSDEDKRGFTKLVYQNIFTAMQAMIRAMDTLKIPYKYEHNKAHAQLVREVDVEKVSAFENPYVDAIKSLWNDPGIQECYDRRREYQLSDSTKYYLNDLDRVADPAYLPTQQDVLRVRVPTTGIIEYPFDLQSVIFRMVDVGGQRSERRKWIHCFENVTSIMFLVALSEYDQVLVESDNENRMEESKALFRTIITYPWFQNSSVILFLNKKDLLEEKIMYSHLVDYFPEYDGPQRDAQAAREFILKMFVDLNPDSDKIIYSHFTCATDTENIRFVFAAVKDTILQLNLKEYNLV

SEQ ID NO: 900448 - protein, 353 aa, Homo sapiens; identical to SEQ ID NO: 900447

SEQ ID NO: 900449 - protein, 353 aa, Homo sapiens; identical to SEQ ID NO: 900447

SEQ ID NO: 900450 - protein, 353 aa, Homo sapiens; identical to SEQ ID NO: 900447

SEQ ID NO: 900451 - protein, 122 aa, Homo sapiens
RQSLGSLTSPGGTSLCLTRPSIPEARGSALPDTGMCVCVSGLSSLHCWGFRNTGNVAGLAEVSVVPPLLPCLWSYCMCQGRLHPVTSQSILMHFRKLFPFLARALRILVPHKECHCLKQNIL

SEQ ID NO: 900452 - protein, 432 aa, Homo sapiens
TLLVEIHPVNNVKVLKAVDSYIWVQFLYPHIESHPLPENHLLLISEEKYIEQFRIHVAQEDGNRVVIKNSGHLPRDRIAEDFVWAQWDMSEQRLYYIDLKKSRSILKCIQFYADESYNLMFEVPLDISLSNSGFKLVNFGCDYHQYRDKFSKHLTLCVFTNHTGSLCVCYSPKCASWGQITYSVFYIHKGHSKTFTTSLENVGSHMTKGITFLNLDYYVAVYLPGHFFHLLNVQHPDLICHNLFLTGNNEMIDMLPHCPLQSLSGSLVLDCCSGKLYRALLSQSSLLQLLQNTCLDCEKMAALHCALYCGQGAQFLEAQIIQWISENVSACHSFDLIQEFIIASSYWSVYSETSNMDKLLPHSSVLTWNTEIPGITLVTEDIALPLMKVLSFKGYWEKLNSNLEYVKYAKPHFHYNNSVVRREWHNLISEEV

SEQ ID NO: 900453 - protein, 122 aa, Homo sapiens; identical to SEQ ID NO: 900451

SEQ ID NO: 900454 - protein, 432 aa, Homo sapiens; identical to SEQ ID NO: 900452

SEQ ID NO: 900455 - protein, 411 aa, Homo sapiens
TLLVEIHPVNNVKVLKAVDSYIWVQFLYPHIESHPLPENHLLLISEEKYIEQFRIHVAQEDGNRVVIKNSGHLPRDRIAEDFVWAQWDMSEQRLYYIDLKKSRSILKCIQFYADESYNLMFEVPLDISLSNSGFKLVNFGCDYHQYRDKFSKHLTLCVFTNHTGSLCVCYSPKCASWGQITYSVFYIHKGHSKTFTTSLENVGSHMTKGITFLNLDYYVAVYLPGHFFHLLNVQHPDLICHNLFLTGNNEMIDMLPHCPLQSLSGSLVLDCCSGKLYRALLSQSSLLQLLQNTCLDCEKMAALHCALYCGQGAQFLEAQWRQRADLNTNRVLSDFLKIIQWISENVSACHSFDLIQEFIIASSYWSVYSETSNMDKLLPHSSVLTWNTIVQGGAAIVDTHRVTSGSPRRAI

SEQ ID NO: 900456 - protein, 248 aa, Homo sapiens
MGLMVSELKDHFLRHLQGVEKKKIEQMVLDYISKLLDLICHIVETNWRKHNLHSWVLHFNSRGSAAEFAVFHIMTRILEATNSLFLPLPPGFHTLHTILGVQCLPLHNLLHCIDSGVLLLTETAVIRLMKDLDNTEKNEKLKFSIIVRLPPLIGQKICRLWDHPMSSNIISRNHVTRLLQNYKKQPRNSMINKSSFSVEFLPLNYFIEILTDIESSNQALYPFEGHDNVDAEFVEEAALKHTAMLLGL

SEQ ID NO: 900457 - protein, 245 aa, Homo sapiens [sequence omitted]

SEQ ID NO: 900458 - protein, 248 aa, Homo sapiens; identical to SEQ ID NO: 900456

SEQ ID NO: 900459 - protein, 451 aa, Homo sapiens
TLLVEIHPVNNVKVLKAVDSYIWVQFLYPHIESHPLPENHLLLISEEKYIEQFRIHVAQEDGNRVVIKNSGHLPRDRIAEDFVWAQWDMSEQRLYYIDLKKSRSILKCIQFYADESYNLMFEVPLDISLSNSGFKLVNFGCDYHQYRDKFSKHLTLCVFTNHTGSLCVCYSPKCASWGQITYSVFYIHKGHSKTFTTSLENVGSHMTKGITFLNLDYYVAVYLPGHFFHLLNVQHPDLICHNLFLTGNNEMIDMLPHCPLQSLSGSLVLDCCSGKLYRALLSQSSLLQLLQNTCLDCEKMAALHCALYCGQGAQFLEAQIIQWISENVSACHSFDLIQEFIIASSYWSVYSETSNMDKLLPHSSVLTWNTEIPGITLVTEDIALPLMKVLSFKGYWEKLNSNLEYVKYAKPHFHYNNSVVRREWHNLISEEKTGKRRSAAYVRNILDNAVK

SEQ ID NO: 900460 - protein, 1099 aa, Homo sapiens
MFGYAPPNSQYWLCLSKKQNPLELEEVNISVTSASGRLELPRASGRHKCLLLGDRSPQNLPVSQLGGLVLELSRGPHWPPPGMINRAVWSPNVWKLMELRIPLSRKSSRGVWLGLSPWGPPGRPVFTWSMGATTLLKTCITVEGRNRGPGPFLSEGHGEGWEREERQWPRPILAVAHGTLAVWPWPPVSLKQGFKLTLERVTNPKRSIEVRCHGLIDPCHGITCKTLSCHCSLVLFENLTKKKFQVWNMGVICTSWGIKKKSMVGNYKEVTKEVTSSANKLGNFFFFQFRISLEDIDGITLWHYCIIYHLSVLTLECTLFNVNAVVDISKAALKKYMHLSVFLFLIVFSYGLYTFVSKGDRFLFEIFISVILQKHSEKVREALSLSYLRKTWMSLATEELCFNQVMCISTSTELFIVTVISVVPLTLFLEGFLSLGNSAFNSWYSGLHACLVKPMRFIQLKIQMANDQQIQIYGGLTFRELLYVACFNTDPPRALLPSFRGGFLMAVLQGLPEMQWCLRSTKKAGNLWYEARPPRRASGNRMIRPLNDSNFEAKYYFMKGLHCQSDEYGISNPVLLSCQNHFNGVSLQYAPRGKILQAALEVTMKNVDVFEYKACFVFCCCSNGIHRVFEKCIYIKRSRGLIAGWLPFAVGFCYLVLITVNVPSLLAPELYSIVAALALRVVDVAFSFIVKNMLEAMNVYKSLNYVIFFSSSFFSLYLIILQLGNREPSLFCIEEGFTSASELLFMNEKTVLCMYSSLHWPGSELNRVYALSNIGDKGSKKSPKRRRTSENLLGPPSPSLHKYSAREARMTADRVYGHRVVSEDLAGAENSGRLKIWNKVTELRKHLNLVQTRRQHSLQQLTYLSVFRCGLPFICDLCFISKCLSSKDVALAQWEKLGSDYKSRGVIIIKIKCKSSGQSQHMSSFHLQDLLSEQNCKESLFVIELILKQIVYKCELKLYINSNCTFKAVAVFRLSYHFIVSNVHLLYQRKTGKARNTSHSKEIRESVEILFGSYSVVSFAAQTNVVTHFLRNTILHCQAYEGSNQIFIVIQFGSFRDFFFKLLWDKGHLLEGWEGGRIFKCKTFPSLDQGVGSFQNNQN

SEQ ID NO: 900461 - protein, 65 aa, Homo sapiens
MQLKGTKEKRSEGIAMAQTRTIRTIRIGPNIRSSTVRVEPRTELRVKLNSEKSETGGSKSNRSHR

SEQ ID NO: 900462 - protein, 239 aa, Homo sapiens
MAHAGRTGYDNREIVMKYIHYKLSQRGYEWDAGDVGAAPPGAAPAPGIFSSQPGHTPHPAASRDPVARTSPLQTPAAPGAAAGPALSPVPPVVHLTLRQAGDDFSRRYRRDFAEMSSQLHLTPFTARGRFATVVEELFRDGVNWGRIVAFFEFGGVMCVESVNREMSPLVDNIALWMTEYLNRHLHTWIQDNGGWDAFVELYGPSMRPLFDFSWLSLKTLLSLALVGACITLGAYLGHK

SEQ ID NO: 900463 - protein, 1099 aa, Homo sapiens
MFGYAPPNSQYWLCLSKKQNPLELEEVNISVTSASGRLELPRASGRHKCLLLGDRSPQNLPVSQLGGLVLELSRGPHWPPPGMINRAVWSPNVWKLMELRIPLSRKSSRGVWLGLSPWGPPGRPVFTWSMGATTLLKTCITVEGRNRGPGPFLSEGHGEGWEREERQWPRPILAVAHGTLAVWPWPPVSLKQGFKMTLERVTNPKRSIEVRCHGLLTPVYGITCKTLSCHCSLVLFENLTKKKFQVWNMGVICTSWGIKKKSMVGNYKEVTKEVTSSANKLGNFFFFQFRISLETLMENSVALLHYIPFICINFGMYSVQCLMLWLIFQKAALKKYMHLSVFLFLIVFSYGLYTFVSKGDRFLFEIFISVILQKHSEKVREALSLSYLRKTWMSLATEELCFNQVMCISTSTELFIVTVISVVPLTLFLEGFLSLGNSAFNSWYSGLHACLVKPMRFIQLKIQMANDQQIQIYGGLTFRELLYVACFNTDPPRALLPSFRGGFLMAVLQGLPEMQWCLRSTKKAGNLWYEARPPRRASGNRMIRPLNDSNFEAKYYFMKGLHCQSDEYGISNPVLLSCQNHFNGVSLQYAPRGKILQAALEVTMKNVDVFEYKACFVFCCCSNGIHRVFEKCIYIKRSRGLIAGWLPFAVGFCYLVLITVNVPSLLAPELYSIVAALALRVVDVAFSFIVKNMLEAMNVYKSLNYVIFFSSSFFSLYLIILQLGNREPSLFCIEEGFTSASYLLFMNEKTVLCMYSSLHWPGSELNRVYALSNIGDKGSKKSPKRRRTSENLLGPPSPSLHKYSAREARMTADRVYGHRVVSEDLAGAENSGRLKIWNKVTELRKHLNLVQTRRQHSLQQLTYLSVFRCGLPFICDLCFISKCLSSKDVALAQWEKLGSDYKSRGVIIIKIKCKSSGQSQHMSSFHLQDLLSEQNCKYSLFVIELILKQIVYKCELKLYINSNCTFKAVAVFRLSYHFIVSNVHLLYQRKTGKARNTSHSKEIRESVEILFGSYSVVSFAAQTNVVTHFLRNTILHCQAYEGSNQIFIVIQFGSFRDFFFKLLWDKGHLLEGWEGGRIFKCKTFPSLDQGVGSFQNNQN

SEQ ID NO: 900464 - protein, 205 aa, Homo sapiens
MAHAGRTGYDNREIVMKYIHYKLSQRGYEWDAGDVGAAPPGAAPAPGIFSSQPGHTPHPAASRDPVARTSPLQTPAAPGAAAGPALSPVPPVVHLTLRQAGDDFSRRYRRDFAEMSSQLHLTPFTARGRFATVVEELFRDGVNWGRIVAFFEFGGVMCVESVNREMSPLVDNIALWMTEYLNRHLHTWIQDNGGWVGALGDVSLG

SEQ ID NO: 900465 - protein, 1053 aa, Homo sapiens
EIDEEHVEDDGLSLDIQESEYMCNEETEIKEAQSYQNSPVSSATNQDAGYGSPFSESSDQLAHFKGSSSREEKEDPQCPDSVSYPQDSLAQIKAVYANLFSESCWSSLALDLKKSGSTTSTNDASQKESSAPTPTPPTCPVSTTGPTTSTPSTSCSSSTSHSSTTSTSSSSGYDWHQAALAKTLQQTSSYGLLPEPSLFSTVQLYRQNNKLYGSVFTGASKFRCKDCSAAYDTLVELTVHMNETGHYRDDNRDKDSEKTKRWSKPRKRSLMEMEGKEDAQKVLKCMYCGHSFESLQDLSVHMIKTKHYQKVPLKEPVPAITKLVPSTKKRALQDLAPPCSPEPAGMAAEVALSESAKDQKAANPYVTPNNRYGYQNGASYTWQFEARKAQILKCMECGSSHDTLQQLTAHMMVTGHFLKVTTSASKKGKQLVLDPVVEEKIQSIPLPPTTHTRLPASSIKKQPDSPAGSTTSEEKKEPEKEKPPVAGDAEKIKEESEDSLEKFEPSTLYPYLREEDLDDSPKGGLDILKSLENTVSTAISKAQNGAPSWGGYPSIHAAYQLPGTVKPLPAAVQSVQVQPSYAGGVKSLSSAEHNALLHSPGSLTPPPHKSNVSAMEELVEKVTGKVNIKKEERPPEKEKSSLAKAASPIAKENKDFPKTEEVSGKPQKKGPEAETGKAKKEGPLDVHTPNGTEPLKAKVTNGCNNLGIIMDHSPEPSFINPLSALQSIMNTHLGKVSKPVSPSLDPLAMLYKISNSMLDKPVYPATPVKQADAIDRYYYENSDQPIDLTKSKNKPLVSSVADSVASPLRESALMDISDMVKNLTGRLTPKSSTPSTVSEKSDADGSSFEEALDELSPVHKRKGRQSNWNPQHLLILQAQFASSLRETTEGKYIMSDLGPQERVHISKFTGLSMTTISHWLANVKYQLRRTGGTKFLKNLDTGHPVFFCNDCASQFRTASTYISHLETHLGFSLKDLSKLPLNQIQEQQNVSKVLTNKTLGPLGATEEDLGSTFQCKLCNRTFASKHAVKLHLSKTHGKSPEDHLIYVTELEKQ

SEQ ID NO: 900466 - protein, 1045 aa, Homo sapiens
EIDEEHVEDDGLSLDIQESEYMCNEETEIKEAQSYQNSPVSSATNQDAGYGSPFSESSDQLAHFKGSSSREEKEDPQCPDSVSYPQDSLAQIKAVYANLFSESCWSSLALDLKKSGSTTSTNDASQKESSAPTPTPPTCPVSTTGPTTSTPSTSCSSSTSHSSTTSTSSSSGYDWHQAALAKTLQQTSSYGLLPEPSLFSTVQLYRQNNKLYGSVFTGASKFRCKDCSAAYDTLVELTVHMNETGHYRDDNRDKDSEKTKRWSKPRKRSLMEMEGKEDAQKVLKCMYCGHSFESLQDLSVHMIKTKHYQKVPLKEPVPAITKLVPSTKKRALQDLAPPCSPEPAGMAAEVALSESAKDQKAANPYVTPNNRYGYQNGASYTWQFEARKAQILKCMECGSSHDTLQQLTAHMMVTGHFLKVTTSASKKGKQLVLDPVVEEKIQSIPLPPTTHTRLPASSIKKQPDSPAGSTTSEEKKEPEKEKPPVAGDAEKIKEESEDSLEKFEPSTLYPYLREEELDILKSLENTVSTAISKAQNGAPSWGGYPSIHAAYQLPGTVKPLPAAVQSVQVQPSYAGGVKSLSSAEHNALLHSPGSLTPPPHKSNVSAMEELVEKVTGKVNIKKEERPPEKEKSSLAKAASPIAKENKDFPKTEEVSGKPQKKGPEAETGKAKKEGPLDVHTPNGTEPLKAKVTNGCNNLGIIMDHSPEPSFINPLSALQSIMNTHLGKVSKPVSPSLDPLAMLYKISNSMLDKPVYPATPVKQADAIDRYYYENSDQPIDLTKSKNKPLVSSVADSVASPLRESALMDISDMVKNLTGRLTPKSSTPSTVSEKSDADGSSFEEALDELSPVHKRKGRQSNWNPQHLLILQAQFASSLRETTEGKYIMSDLGPQERVHISKFTGLSMTTISHWLANVKYQLRRTGGTKFLKNLDTGHPVFFCNDCASQFRTASTYISHLETHLGFSLKDLSKLPLNQIQEQQNVSKVLTNKTLGPLGATEEDLGSTFQCKLCNRTFASKHAVKLHLSKTHGKSPEDHLIYVTELEKQ

SEQ ID NO: 900467 - protein, 921 aa, Homo sapiens
NGASYTWQFEARKAQILKCMECGSSSTSHSSTTSTSSSSGYDWHQAALAKTLQQTSSYGLLPEPSLFSTVQLYRQNNKLYGSVFTGASKFRCKDCSAAYDTLVELTVHMNETGHYRDDNRDKDSEKTKRWSKPRKRSLMEMEGKEDAQKVLKCMYCGHSFESLQDLSVHMIKTKHYQKVPLKEPVPAITKLVPSTKKRALQDLAPPCSPEPAGMAAEVALSESAKDQKAANPYVTPNNRYGYQNGASYTWQFEARKAQILKCMECGSSHDTLQQLTAHMMVTGHFLKVTTSASKKGKQLVLDPVVEEKIQSIPLPPTTHTRLPASSIKKQPDSPAGSTTSEEKKEPEKEKPPVAGDAEKIKEESEDSLEKFEPSTLYPYLREEDLDDSPKGGLDILKSLENTVSTAISKAQNGAPSWGGYPSIHAAYQLPGTVKPLPAAVQSVQVQPSYAGGVKSLSSAEHNALLHSPGSLTPPPHKSNVSAMEELVEKVTGKVNIKKEERPPEKEKSSLAKAASPIAKENKDFPKTEEVSGKPQKKGPEAETGKAKKEGPLDVHTPNGTEPLKAKVTNGCNNLGIIMDHSPEPSFINPLSALQSIMNTHLGKVSKPVSPSLDPLAMLYKISNSMLDKPVYPATPVKQADAIDRYYYENSDQPIDLTKSKNKPLVSSVADSVASPLRESALMDISDMVKNLTGRLTPKSSTPSTVSEKSDADGSSFEEALDELSPVHKRKGRQSNWNPQHLLILQAQFASSLRETTEGKYIMSDLGPQERVHISKFTGLSMTTISHWLANVKYQLRRTGGTKFLKNLDTGHPVFFCNDCASQFRTASTYISHLETHLGFSLKDLSKLPLNQIQEQQNVSKVLTNKTLGPLGATEEDLGSTFQCKLCNRTFASKHAVKLHLSKTHGKSPEDHLIYVTELEKQ

SEQ ID NO: 900468 - protein, 632 aa, Homo sapiens
RLSCSKIQSFVTVTNREGPGGPECPMRTPQLALLQVFFLVFPDGVRPQPSSSPSGAVPTSLELQRGTDGGTLQSPSEATATRPAVPGLPTVVPTLVTPSAPGNRTVDLFPVLPICVCDLTPGACDINCCCDRDCYLLHPRTVFSFCLPGSVRSSSWVCVDNSVIFRSNSPFPSRVFMDSNGIRQFCVHVNNSNLNYFQKLQKVNATNFQALAAEFGGESFTSTFQTQSPPSFYRAGDPILTYFPKWSVISLLRQPAGVGAGGLCAESNPAGFLESKSTTCTRFFKNLASSCTLDSALNAASYYNFTVLKVPRSMTDPQNMEFQVPVILTSQANAPLLAGNTCQNVVSQVTYEIETNGTFGIQKVSVSLGQTNLTVEPGASLQQHFILRFRAFQQSTAASLTSPRSGNPGYIVGKPLLALTDDISYSMTLLQSQGNGSCSVKRHEVQFGVNAISGCKLRLKKADCSHLQQEIYQTLHGRPRPEYVAIFGNADPAQKGGWTRILNRHCSISAINCTSCCLIPVSLEIQVLWAYVGLLSNPQAHVSGVRFLYQCQSIQDSQQVTEVSLTTLVNFVDITQKPQPPRGQPKMDWKWPFDFFPFKVAFSRGVFSQKCSVSPILILCLLLLGVLNLETM

SEQ ID NO: 900469 - protein, 625 aa, Homo sapiens
MRLETAEAYVGPGGPECPMRTPQLALLQVFFLVFPDGVRPQPSSSPSGAVPTSLELQRGTDGGTLQSPSEATATRPAVPGLPTVVPTLVTPSAPGNRTVDLFPVLPICVCDLTPGACDINCCCDRDCYLLHPRTVFSFCLPGSVRSSSWVCVDNSVIFRSNSPFPSRVFMDSNGIRQFCVHVNNSNLNYFQKLQKVNATNFQALAAEFGGESFTSTFQTQSPPSFYRAGDPILTYFPKWSVISLLRQPAGVGAGGLCAESNPAGFLESKSTTCTRFFKNLASSCTLDSALNAASYYNFTVLKVPRSMTDPQNMEFQVPVILTSQANAPLLAGNTCQNVVSQVTYEIETNGTFGIQKVSVSLGQTNLTVEPGASLQQHFILRFRAFQQSTAASLTSPRSGNPGYIVGKPLLALTDDISYSMTLLQSQGNGSCSVKRHEVQFGVNAISGCKLRLKKADCSHLQQEIYQTLHGRPRPEYVAIFGNADPAQKGGWTRILNRHCSISAINCTSCCLIPVSLEIQVLWAYVGLLSNPQAHVSGVRFLYQCQSIQDSQQVTEVSLTTLVNFVDITQKPQPPRGQPKMDWKWPFDFFPFKVAFSRGVFSQKCSVSPILILCLLLLGVLNLETM

SEQ ID NO: 900470 - protein, 625 aa, Homo sapiens; identical to SEQ ID NO: 900469

SEQ ID NO: 900471 - protein, 598 aa, Homo sapiens
MRLETAEAYVGPGGPECPMRTPQLALLQVFFLVFPDGVRPQPSSSPSGAVPTSLELQRGTDGGTLQSPSEATATRPAVPGLPTVVPTLVTPSAPGNRTVDLFPVLPICVCDLTPGACDINCCCDRDCYLLHPRTVFSFCLPGSVRSSSWVCVDNSVIFRSNSPFPSRVFMDSNGIRQFCVHVNNSNLNYFQKLQKVNATNFQALAAEFGGESFTSTFQTQSPPSFYRAGDPILTYFPKWSVISLLRQPAGVGAGGLCAESNPAGFLESKSTTCTRFFKNLASSCTLDSALNAASYYNFTVLKVPRSMTDPQNMEVTYEIETNGTFGIQKVSVSLGQTNLTVEPGASLQQHFILRFRAFQQSTAASLTSPRSGNPGYIVGKPLLALTDDISYSMTLLQSQGNGSCSVKRHEVQFGVNAISGCKLRLKKADCSHLQQEIYQTLHGRPRPEYVAIFGNADPAQKGGWTRILNRHCSISAINCTSCCLIPVSLEIQVLWAYVGLLSNPQAHVSGVRFLYQCQSIQDSQQVTEVSLTTLVNFVDITQKPQPPRGQPKMDWKWPFDFFPFKVAFSRGVFSQKCSVSPILILCLLLLGVLNLETM

SEQ ID NO: 900472 - protein, 456 aa, Homo sapiens [sequence omitted]

SEQ ID NO: 900473 - protein, 522 aa, Homo sapiens
MRLETAEAYVGPGGPECPMRTPQLALLQVFFLVFPDGVRPQPSSSPSGAVPTSLELQRGTDGGTLQSPSEATATRPAVPGLPTVVPTLVTPSAPGNRTVDLFPVLPICVCDLTPGACDINCCCDRDCYLLHPRTVFSFCLPGSVRSSSWVCVDNSVIFRSNSPFPSRVFMDSNGIRQFCVHVNNSNLNYFQKLQKVNATNFQALAAEFGGESFTSTFQTQSPPSFYRAGDPILTYFPKWSVISLLRQPAGVGAGGLCAESNPAGFLESKSTTCTRFFKNLASSCTLDSALNAASYYNFTVLKVPRSMTDPQNMEFQVPVILTSQANAPLLAGNTCQNVVSQVTYEIETNGTFGIQKVSVSLGQTNLTVEPGASLQQHFILRFRAFQQSTAASLTSPRSGNPGYIVGKPLLALTDDISYSMTLLQSQGNGSCSVKRHEVQFGVNAISGCKLRLKKADCSHLQQEIYQTLHGRPRPEYVAIFGNADPAQKGGWTRILNRHCSISVRREIYFLMKTHFYPFVNLG

SEQ ID NO: 900474 - protein, 391 aa, Homo sapiens
MRLETAEAYVGPGGPECPMRTPQLALLQVFFLVFPDGVRPQPSSSPSGAVPTSLELQRGTDGGTLQSPSEATATRPAVPGLPTVVPTLVTPSAPGNRTVDLFPVLPICVCDLTPGACDINCCCDRDCYLLHPRTVFSFCLPGSVRSSSWVCVDNSVIFRSNSPFPSRVFMDSNGIRQFCVHVNNSNLNYFQKLQKVNATNFQALAAEFGGESFTSTFQTQSPPSFYRAGDPILTYFPKWSVISLLRQPAGVGAGGLCAESNPAGFLESKSTTCTRFFKNLASSCTLDSALNAASYYNFTVLKVPRSMTDPQNMEDSQQVTEVSLTTLVNFVDITQKPQPPRGQPKMDWKWPFDFFPFKVAFSRGVFSQKCSVSPILILCLLLLGVLNLETM

SEQ ID NO: 900475 - protein, 461 aa, Homo sapiens
MRLETAEAYVGPGGPECPMRTPQLALLQVFFLVFPDGVRPQPSSSPSGAVPTSLELQRGTDGGTLQSPSEATATRPAVPGLPTVVPTLVTPSAPGNRTVDLFPVLPICVCDLTPGACDINCCCDRDCYLLHPRTVFSFCLPGSVRSSSWVCVDNSVIFRSNSPFPSRVFMDSNGIRQFCVHVNNSNLNYFQKLQKVNATNFQALAAEFGGESFTSTFQTQSPPSFYRAGDPILTYFPKWSVISLLRQPAGVGAGGLCAESNPAGFLESKSTTCTRFFKNLASSCTLDSALNAASYYNFTVLKVPRSMTDPQNMEFQVPVILTSQANAPLLAGNTCQNVVSQVTYEIETNGTFGIQKVSVSLGQTNLTVEPGASLQQHFILRFRAFQQSTAASLTSPRSGNPGYIVGKPLLALTDDISYSVSFLELGGLLQPNEKSCKGFQTYVRLAKGEEFFVHYNEVLIY

SEQ ID NO: 900476 - protein, 433 aa, Homo sapiens
MDSNGIRQFCVHVNNSNLNYFQKLQKVNATNFQALAAEFGGESFTSTFQTQSPPSFYRAGDPILTYFPKWSVISLLRQPAGVGAGGLCAESNPADSALNAASYYNFTVLKVPRSMTDPQNMEFQVPVILTSQANAPLLAGNTCQNVVSQVTYEIETNGTFGIQKVSVSLGQTNLTVEPGASLQQHFILRFRAFQQSTAASLTSPRSGNPGYIVGKPLLALTDDISYSMTLLQSQGNGSCSVKRHEVQFGVNAISGCKLRLKKADCSHLQQEIYQTLHGRPRPEYVAIFGNADPAQKGGWTRILNRHCSISAINCTSCCLIPVSLEIQVLWAYVGLLSNPQAHVSGVRFLYQCQSIQDSQQVTEVSLTTLVNFVDITQKPQPPRGQPKMDWKWPFDFFPFKVAFSRGVFSQKCSVSPILILCLLLLGVLNLETM

SEQ ID NO: 900477 - protein, 160 aa, Homo sapiens
MTLLQSQGNGSCSVKRHEVQFGVNAISGCKLRLKKADCSHLQQEIYQTLHGRPRPEYVAIFGNADPAQKGGWTRILNRHCSISDSQQVTEVSLTTLVNFVDITQKPQPPRGQPKMDWKWPFDFFPFKVAFSRGVFSQKCSVSPILILCLLLLGVLNLETM

SEQ ID NO: 900478 - protein, 186 aa, Homo sapiens
MRLETAEAYVGPGGPECPMRTPQLALLQVFFLVFPDGVRPQPSSSPSGAVPTSLELQRGTDGGTLQSPSEATATRPAVPGLPTVVPTLVTPSAPGNRTVDLFPVLPICVCDLTPGACDINCCCDRDCYLLHPRTVFSFCLPGSVRSSSWVCVDNSVIFRSNSPFPSRVFMDSNGIRQFCVHVNNCE

SEQ ID NO: 900479 - protein, 625 aa, Homo sapiens; identical to SEQ ID NO: 900469

SEQ ID NO: 900480 - protein, 625 aa, Homo sapiens; identical to SEQ ID NO: 900469

SEQ ID NO: 900481 - protein, 579 aa, Homo sapiens
MRLETAEAYVGPGGPECPMRTPQLALLQVFFLVFPDGVRPQPSSSPSGAVPTSLELQRGTDGGTLQSPSEATATRPAVPGLPTVVPTLVTPSAPGNRTVDLFPVLPICVCDLTPGACDINCCCDRDCYLLHPRTVFSFCLPGSVRSSSWVCVDNSVIFRSNSPFPSRVFMDSNGIRQFCVHVNNSNLNYFQKLQKVNATNFQALAAEFGGESFTSTFQTQSPPSFYRAGDPILTYFPKWSVISLLRQPAGVGAGGLCAESNPAGFLESKSTTCTRFFKNLASSCTLDSALNAASYYNFTVLKVPRSMTDPQNMEFQVPVILTSQANAPLLAGNTCQNVVSQVTYEIETNGTFGIQKVSVSLGQTNLTVEPGASLQQHFILRFRAFQQSTAASLTSPRSGNPGYIVGKPLLALTDDISYSMTLLQSQGNGSCSVKRHEVQFGVNAISGCKLRLKKADCSHLQQEIYQTLHGRPRPEYVAIFGNADPAQKGGWTRILNRHCSISDSQQVTEVSLTTLVNFVDITQKPQPPRGQPKMDWKWPFDFFPFKVAFSRGVFSQKCSVSPILILCLLLLGVLNLETM

SEQ ID NO: 900482 - protein, 662 aa, Homo sapiens
MRLETAEAYVGPGGPECPMRTPQLALLQVFFLVFPDGVRPQPSSSPSGAVPTSLELQRGTDGGTLQSPSEATATRPAVPGLPTVVPTLVTPSAPGNRTVDLFPVLPICVCDLTPGACDINCCCDRDCYLLHPRTVFSFCLPGSVRSSSWVCVDNSVIFRSNSPFPSRVFMDSNGIRQFCVHVNNSNLNYFQKLQKVNATNFQALAAEFGGESFTSTFQTQSPPSFYRAGDPILTYFPKWSVISLLRQPAGVGAGGLCAESNPAGFLESKSTTCTRFFKNLASSCTLDSALNAASYYNFTVLKVPRSMTDPQNMEFQVPVILTSQANAPLLAGNTCQNVVSQVTYEIETNGTFGIQKVSVSLGQTNLTVEPGASLQQHFILRFRAFQQSTAASLTSPRSGNPGYIVGKPLLALTDDISYSMTLLQSQGNGSCSVKRHEVQFGVNAISGCKLRLKKADCSHLQQEIYQTLHGRPRPEYVAIFGNADPAQKGGWTRILNRHCSISAINCTSCCLIPVSLEIQVLWAYVGLLSNPQAHVSGVRFLYQCQSIQVGYFPPTPPLLCQCICIRLLNQYSMFHHDVYVNMHAADSQQVTEVSLTTLVNFVDITQKPQPPRGQPKMDWKWPFDFFPFKVAFSRGVFSQKCSVSPILILCLLLLGVLNLETM

SEQ ID NO: 900483 - protein, 408 aa, Homo sapiens
MRLETAEAYVGPGGPECPMRTPQLALLQVFFLVFPDGVRPQPSSSPSGAVPTSLELQRGTDGGTLQSPSEATATRPAVPGLPTVVPTLVTPSAPGNRTVDLFPVLPICVCDLTPGACDINCCCDRDCYLLHPRTVFSFCLPGSVRSSSWVCVDNSVIFRSNSPFPSRVFMDSNGIRQFCVHVNNSNLNYFQKLQKVNATNFQALAAEFGGESFTSTFQTQSPPSFYRAGDPILTYFPKWSVISLLRQPAGVGAGGLCAESNPAGFLESKSTTCTRFFKNLASSCTLDSALNAASYYNFTVLKVPRSMTDPQNMEFQVPVILTSQANGFSASYRSIFDNSCELCGHYPEATASKGPTQNGLEMAIRLLSLQSGIQQRSILSKMLSLSHPYPVPLTTWSSQPRDYVKKRK

SEQ ID NO: 900484 - protein, 389 aa, Homo sapiens
MRLETAEAYVGPGGPECPMRTPQLALLQVFFLVFPDGVRPQPSSSPSGAVPTSLELQRGTDGGTLQSPSEATATRPAVPGLPTVVPTLVTPSAPGNRTVDLFPVLPICVCDLTPGACDINCCCDRDCYLLHPRTVFSFCLPGSVRSSSWVCVDNSVIFRSNSPFPSRVFMDSNGIRQFCVHVNNSNLNYFQKLQKVNATNFQALAAEFGGESFTSTFQTQSPPSFYRAGDPILTYFPKWSVISLLRQPAGVGAGGLCAESNPAGFLESKSTTCTRFFKNLASSCTLDSALNAASYYNFTVLKVPRSMTDPQNMEFQVPVILTSQANAPLLAGNTCQNVVSQVTYEIETNGTFGIQKVSVSLGQTNLTVEPGASLQQHFILRFRVRALLL

SEQ ID NO: 900485 - protein, 319 aa, Homo sapiens [sequence omitted]

SEQ ID NO: 900486 - protein, 332 aa, Homo sapiens
MRLETAEAYVGPGGPECPMRTPQLALLQVFFLVFPDGVRPQPSSSPSGAVPTSLELQRGTDGGTLQSPSEATATRPAVPGLPTVVPTLVTPSAPGNRTVDLFPVLPICVCDLTPGACDINCCCDRDCYLLHPRTVFSFCLPGSVRSSSWVCVDNSVIFRSNSPFPSRVFMDSNGIRQFCVHVNNSNLNYFQKLQKVNATNFQALAAEFGGESFTSTFQTQSPPSFYRAGDPILTYFPKWSVISLLRQPAGVGAGGLCAESNPAGFLESKSTTCTRFFKNLASSCTLDSALNAASYYNFTVLKVPRSMTDPQNMEFQVPVILTSHGHSIPGTE

SEQ ID NO: 900487 - protein, 289 aa, Homo sapiens
MRLETAEAYVGPGGPECPMRTPQLALLQVFFLVFPDGVRPQPSSSPSGAVPTSLELQRGTDGGTLQSPSEATATRPAVPGLPTVVPTLVTPSAPGNRTVDLFPVLPICVCDLTPGACDINCCCDRDCYLLHPRTVFSFCLPGSVRSSSWVCVDNSVIFRSNSPFPSRVFMDSNGIRQFCVHVNNSNLNYFQKLQKVNATNFQALAAEFGGESFTSTFQTQSPPSFYRAGDPILTYFPKWSVISLLRQPAGVGAGGELLCLKSQILARVFPKKKSSQTFGTFGFFFKKNP

SEQ ID NO: 900488 - protein, 319 aa, Homo sapiens
MLGRSLREVSAALKQGQITPTELCQKCLSLIKKTKFLNAYITVSEEVALKQAEESEKRYKNGQSLGDLDGIPIAVKDNFSTSGIETTCASNMLKGYIPPYNATVVQKLLDQGALLMGKTNLDEFAMGSGSTDGVFGPVKNPWSYSKQYREKRKQNPHSENEDSDWLITGGSSGGSAAAVSAFTCYAALGSDTGGSTRNPAAHCGLVGFKPSYGLVSRHGLIPLVNSMDVPGILTRCVDDAAIVLGALAGPDPRDSTTVHEPINKPFMLPSLADVSKLCIGIPKVTFSFHYFTEILSSPIESTDLGGGLGGFESLLCHFY

SEQ ID NO: 900489 - protein, 528 aa, Homo sapiens
MLGRSLREVSAALKQGQITPTELCQKCLSLIKKTKFLNAYITVSEEVALKQAEESEKRYKNGQSLGDLDGIPIAVKDNFSTSGIETTCASNMLKGYIPPYNATVVQKLLDQGALLMGKTNLDEFAMGSGSTDGVFGPVKNPWSYSKQYREKRKQNPHSENEDSDWLITGGSSGGSAAAVSAFTCYAALGSDTGGSTRNPAAHCGLVGFKPSYGLVSRHGLIPLVNSMDVPGILTRCVDDAAIVLGALAGPDPRDSTTVHEPINKPFMLPSLADVSKLCIGIPKEYLVPELSSEVQSLWSKAADLFESEGAKVIEVSLPHTSYSIVCYHVLCTSEVASNMARFDGLQYGHRCDIDVSTEAMYAATRREGFNDVVRGRILSGNFFLLKENYENYFVKAQKVRRLIANDFVNAFNSGVDVLLTPTTLSEAVPYLEFIKEDNRTRSAQDDIFTQAVNMAGLPAVSIPVALSNQGLPIGLQFIGRAFCDQQLLTVAKWFEKQVQFPVIQLQELMDDCSAVLENEKLASVSLKQ

SEQ ID NO: 900490 - protein, 528 aa, Homo sapiens; identical to SEQ ID NO: 900489

SEQ ID NO: 900491 - protein, 444 aa, Homo sapiens
LSSTLECNGAISARCSLRLPASSDSPDSASQVAGTTGMPHHSQSGSTDGVFGPVKNPWSYSKQYREKRKQNPHSENEDSDWLITGGSSGGSAAAVSAFTCYAALGSDTGGSTRNPAAHCGLVGFKPSYGLVSRHGLIPLVNSMDVPGILTRCVDDAAIVLGALAGPDPRDSTTVHEPINKPFMLPSLADVSKLCIGIPKEYLVPELSSEVQSLWSKAADLFESEGAKVIEVSLPHTSYSIVCYHVLCTSEVASNMARFDGLQYGHRCDIDVSTEAMYAATRREGFNDVVRGRILSGNFFLLKENYENYFVKAQKVRRLIANDFVNAFNSGVDVLLTPTTLSEAVPYLEFIKEDNRTRSAQDDIFTQAVNMAGLPAVSIPVALSNQGLPIGLQFIGRAFCDQQLLTVAKWFEKQVQFPVIQLQELMDDCSAVLENEKLASVSLKQ

SEQ ID NO: 900492 - protein, 262 aa, Homo sapiens
MLPSLADVSKLCIGIPKEYLVPELSSEVQSLWSKAADLFESEGAKVIEVSLPHTSYSIVCYHVLCTSEVASNMARFDGLQYGHRCDIDVSTEAMYAATRREGFNDVVRGRILSGNFFLLKENYENYFVKAQKVRRLIANDFVNAFNSGVDVLLTPTTLSEAVPYLEFIKEDNRTRSAQDDIFTQAVNMAGLPAVSIPVALSNQGLPIGLQFIGRAFCDQQLLTVAKWFEKQVQFPVIQLQELMDDCSAVLENEKLASVSLKQ

SEQ ID NO: 900493 - protein, 154 aa, Homo sapiens
LVGTDSLNFHRYTNYENYFVKAQKVRRLIANDFVNAFNSGVDVLLTPTTLSEAVPYLEFIKEDNRTRSAQDDIFTQAVNMAGLPAVSIPVALSNQGLPIGLQFIGRAFCDQQLLTVAKWFEKQVQFPVIQLQELMDDCSAVLENEKLASVSLKQ

SEQ ID NO: 900494 - protein, 387 aa, Homo sapiens
MLGRSLREVSAALKQGQITPTELCQKCLSLIKKTKFLNAYITVSEEVALKQAEESEKRYKNGQSLGDLDGIPIAVKDNFSTSGIETTCASNMLKGYIPPYNATVVQKLLDQGALLMGKTNLDEFAMGSGSTDGVFGPVKNPWSYSKQYREKRKQNPHSENEDSDWLITGGSSGGSAAAVSAFTCYAALGSDTGGSTRNPAAHCGLVGFKPSYGLVSRHGLIPLVNSMDVPGILTRCVDDAAIVLGALAGPDPRDSTTVHEPINKPFMLPSLADVSKLCIGIPKEYLVPELSSEVQSLWSKAADLFESEGAKVIEVSLPHTSYSIVCYHVLCTSEVASNMARFDGLQYGHRCDIDVSTEAMYAATRREGFNDVVRGRILSGNFFLLKE

SEQ ID NO: 900495 - protein, 528 aa, Homo sapiens; identical to SEQ ID NO: 900489

SEQ ID NO: 900496 - protein, 154 aa, Homo sapiens; identical to SEQ ID NO: 900493

SEQ ID NO: 900497 - protein, 563 aa, Homo sapiens
MLGRSLREPDFETKSWLRRRMSCPPPVLKLISASPFITTLSVEVSAALKQGQITPTELCQKCLSLIKKTKFLNAYITVSEEVALKQAEESEKRYKNGQSLGDLDGIPIAVKDNFSTSGIETTCASNMLKGYIPPYNATVVQKLLDQGALLMGKTNLDEFAMGSGSTDGVFGPVKNPWSYSKQYREKRKQNPHSENEDSDWLITGGSSGGSAAAVSAFTCYAALGSDTGGSTRNPAAHCGLVGFKPSYGLVSRHGLIPLVNSMDVPGILTRCVDDAAIVLGALAGPDPRDSTTVHEPINKPFMLPSLADVSKLCIGIPKEYLVPELSSEVQSLWSKAADLFESEGAKVIEVSLPHTSYSIVCYHVLCTSEVASNMARFDGLQYGHRCDIDVSTEAMYAATRREGFNDVVRGRILSGNFFLLKENYENYFVKAQKVRRLIANDFVNAFNSGVDVLLTPTTLSEAVPYLEFIKEDNRTRSAQDDIFTQAVNMAGLPAVSIPVALSNQGLPIGLQFIGRAFCDQQLLTVAKWFEKQVQFPVIQLQELMDDCSAVLENEKLASVSLKQ

SEQ ID NO: 900498 - protein, 378 aa, Homo sapiens
TLPHQPTGLASYAHLFNTARGMEVQTACIGRTHDYAALGSDTGGSTRNPAAHCGLVGFKPSYGLVSRHGLIPLVNSMDVPGILTRCVDDAAIVLGALAGPDPRDSTTVHEPINKPFMLPSLADVSKLCIGIPKEYLVPELSSEVQSLWSKAADLFESEGAKVIEVSLPHTSYSIVCYHVLCTSEVASNMARFDGLQYGHRCDIDVSTEAMYAATRREGFNDVVRGRILSGNFFLLKENYENYFVKAQKVRRLIANDFVNAFNSGVDVLLTPTTLSEAVPYLEFIKEDNRTRSAQDDIFTQAVNMAGLPAVSIPVALSNQGLPIGLQFIGRAFCDQQLLTVAKWFEKQVQFPVIQLQELMDDCSAVLENEKLASVSLKQ

SEQ ID NO: 900499 - protein, 190 aa, Homo sapiens
MARFDGLQYGHRCDIDVSTEAMYAATRREGFNDVVRGRILSGNFFLLKENYENYFVKAQKVRRLIANDFVNAFNSGVDVLLTPTTLSEAVPYLEFIKEDNRTRSAQDDIFTQAVNMAGLPAVSIPVALSNQGLPIGLQFIGRAFCDQQLLTVAKWFEKQVQFPVIQLQELMDDCSAVLENEKLASVSLKQ

SEQ ID NO: 900500 - protein, 356 aa, Homo sapiens [sequence omitted]

SEQ ID NO: 900501 - protein, 47 aa, Homo sapiens
MGDHRRYSHTEYSQLHYLNHHHRDPITQYSQLHFFDYHHRDPLKQYS

SEQ ID NO: 900502 - protein, 238 aa, Homo sapiens
MLCFLRGMAFVPFLLVTWSSAAFIISYVVAVLSGHVNPFLPYISDTGTTPPESGIFGFMINFSAFLGAATMYTRYKIVQKQNQTCYFSTPVFNLVSLVLGLVGCFGMGIVANFQELAVPVVHDGGALLAFVCGVVYTLLQSIISYKSCPQWNSLSTCHIRMVISAVSCAAVIPMIVCASLISITKLEWNPREKDYVYHVVSAICEWTVAFGFIFYFLTFIQDFQSVTLRISTEINGDI

SEQ ID NO: 900503 - protein, 238 aa, Homo sapiens; identical to SEQ ID NO: 900502

SEQ ID NO: 900504 - protein, 185 aa, Homo sapiens
MLCFLRGMAFVPFLLVTWSSAAFIISYVVAVLSGHVNPFLPYISDTGTTPPESGIFGFMINFSAFLGAATMYTRYKIVQKQNQTCYFSTPVFNLVSLVLGLVGCFGMGIVANFQELAVPVVHDGGALLAFVCGVVYTLLQSIISYKSCPQWNSLSTCHIRMVISAVSCAAVIPSILFHICALLKE

SEQ ID NO: 900505 - protein, 209 aa, Homo sapiens
MLCFLRGMAFVPFLLVTWSSAAFIISYVVAVLSGHVNPFLPYISDTGTTPPESGIFGFMINFSAFLGAATMYTRYKIVQKQNQTCYFSTPVFNLVSLVLGLVGCFGMGIVANFQELAVPVVHDGGALLAFVCGVVYTLLQSIISYKSCPQWNSLSTCHIRMVISAVSCAAVIPMIVCASLISITKLEWNPREKVIQELMATMVTHYEPH

SEQ ID NO: 900506 - protein, 238 aa, Homo sapiens; identical to SEQ ID NO: 900502

SEQ ID NO: 900507 - protein, 238 aa, Homo sapiens; identical to SEQ ID NO: 900502

SEQ ID NO: 900508 - protein, 195 aa, Homo sapiens
GKARAGVPASDPTPPVRAQPGLRRVSKPKAKGTRPRVPSGGSVVASAWSSPGASDPAGPLCDFTRFATSPGSPRPTHSGPAASPPAASLRSSRFPSLRGWACPGRRGASPPTVRECTRPAAASRQPGATRRPAPLGAALRRRRRRRDAVLPEGNGFRPLPLGDLVVSRLHYLLRGRRALRARQPLPPVYQTLSQK

SEQ ID NO: 900509 - protein, 115 aa, Homo sapiens
MLCFLRGMAFVPFLLVTWSSAAFIISYVVAVLSGHVNPFLPYISDTGTTPPESGIFGFMINFSAFLGAATMYTRYKIVQKQNQTCYFSTPVFNLVSLVLGLVGCFGMGIVANFQV

SEQ ID NO: 900510 - protein, 149 aa, Homo sapiens
WGNYFWISRGPAPQAFLRGAPGLRVRDEADGPEAVPLPQNTVLQPLTLGFTSFCWNRLFWSQRKITKAREWFHRTVKIDSDLGDAWAFFYKFELQHGTEEQQEEVRKRCESAEPRHGELWCAVSKDIANWQKKIGDILRLVAGRIKNTF

SEQ ID NO: 900511 - protein, 98 aa, Homo sapiens
GNQKWAGRVRTERSASGARVTRRRRHFATECIGRRSLESLRLSLFRCLIPFLPSLGRRRHHEQEEETVPRDARAPRLRAGAGPGRHWLHHAVRHWARP

SEQ ID NO: 900512 - protein, 114 aa, Homo sapiens
SNRARTPAARWRLGVAGWYWGVLCQTRSRHRCEWALRDLGMPTVALDGFRPGVRLGVNTSEALFSVCTPDCISLLVANDTPTRGGQEVSWLLSLLVEMIHLREEDRKSHGFFLC

SEQ ID NO: 900513 - protein, 79 aa, Homo sapiens
PEGLGHPLQMRSWAWLCPVLHRHHLSCSLTCWLQLKKCPHSTPLWLLLSRLEEKIGQLTRARAILEKSRLKNPKNPGLW

SEQ ID NO: 900514 - protein, 941 aa, Homo sapiens
MNKKKKPFLGMPAPLGYVPGLGRGATGFTTRSDIGPARDANDPVDDRHAPPGKRTVGDQMKKNQAADDDDEDLNDTNYDEFNGYAGSLFSSGPYEKDDEEADAIYAALDKRMDERRKERREQREKEEIEKYRMERPKIQQQFSDLKRKLAEVTEEEWLSIPEVGDARNKRQRNPRYEKLTPVPDSFFAKHLQTGENHTSVDPRQTQFGGLNTPYPGGLNTPYPGGMTPGLMTPGTGELDMRKIGQARNTLMDMRLSQVSDSVSGQTVVDPKGYLTDLNSMIPTHGGDINDIKKARLLLKSVRETNPHHPPAWIASARLEEVTGKLQVARNLIMKGTEMCPKSEDVWLEAARLQPGDTAKAVVAQAVRHLPQSVRIYIRAAELETDIRAKKRVLRKALEHVPNSVRLWKAAVELEEPEDARIMLSRAVECCPTSVELWLALARLETYENARKVLNKARENIPTDRHIWITAAKLEEANGNTQMVEKIIDRAITSLRANGVEINREQWIQDAEECDRAGSVATCQAVMRAVIGIGIEEEDRKHTWMEDADSCVAHNALECARAIYAYALQVFPSKKSVWLRAAYFEKNHGTRESLEALLQRAVAHCPKAEVLWLMGAKSKWLAGDVPAARSILALAFQANPNSEEIWLAAVKLESENDEYERARRLLAKARSSAPTARVFMKSVKLEWVQDNIRAAQDLCEEALRHYEDFPKLWMMKGQIEEQKEMMEKAREAYNQGLKKCPHSTPLWLLLSRLEEKIGQLTRARAILEKSRLKNPKNPGLWLESVRLEYRAGLKNIANTLMAKALQECPNSGILWSEAIFLEARPQRRTKSVDALKKCEHDPHVLLAVAKLFWSQRKITKAREWFHRTVKIDSDLGDAWAFFYKFELQHGTEEQQEEVRKRCESAEPRHGELWCAVSKDIANWQKKIGDILRLVAGRIKNTF

SEQ ID NO: 900515 - protein, 941 aa, Homo sapiens; identical to SEQ ID NO: 900514

SEQ ID NO: 900516 - protein, 882 aa, Homo sapiens
MKKNQAADDDDEDLNDTNYDEFNGYAGSLFSSGPYEKDDEEADAIYAALDKRMDERRKERREQREKEEIEKYRMERPKIQQQFSDLKRKLAEVTEEEWLSIPEVGDARNKRQRNPRYEKLTPVPDSFFAKHLQTGENHTSVDPRQTQFGGLNTPYPGGLNTPYPGGMTPGLMTPGTGELDMRKIGQARNTLMDMRLSQVSDSVSGQTVVDPKGYLTDLNSMIPTHGGDINDIKKARLLLKSVRETNPHHPPAWIASARLEEVTGKLQVARNLIMKGTEMCPKSEDVWLEAARLQPGDTAKAVVAQAVRHLPQSVRIYIRAAELETDIRAKKRVLRKALEHVPNSVRLWKAAVELEEPEDARIMLSRAVECCPTSVELWLALARLETYENARKVLNKARENIPTDRHIWITAAKLEEANGNTQMVEKIIDRAITSLRANGVEINREQWIQDAEECDRAGSVATCQAVMRAVIGIGIEEEDRKHTWMEDADSCVAHNALECARAIYAYALQVFPSKKSVWLRAAYFEKNHGTRESLEALLQRAVAHCPKAEVLWLMGAKSKWLAGDVPAARSILALAFQANPNSEEIWLAAVKLESENDEYERARRLLAKARSSAPTARVFMKSVKLEWVQDNIRAAQDLCEEALRHYEDFPKLWMMKGQIEEQKEMMEKAREAYNQGLKKCPHSTPLWLLLSRLEEKIGQLTRARAILEKSRLKNPKNPGLWLESVRLEYRAGLKNIANTLMAKALQECPNSGILWSEAIFLEARPQRRTKSVDALKKCEHDPHVLLAVAKLFWSQRKITKAREWFHRTVKIDSDLGDAWAFFYKFELQHGTEEQQEEVRKRCESAEPRHGELWCAVSKDIANWQKKIGDILRLVAGRIKNTF

SEQ ID NO: 900517 - protein, 898 aa, Homo sapiens
MNKKKKPFLGMPAPLGYVPGLGRGATGFTTRSDIGPARDANDPVDDRHAPPGKRTVGDQMKKNQAADDDDEDLNDTNYDEFNGYAGSLFSSGPYEKDDEEADAIYAALDKRMDERRKERREQREKEEIEKYRMERPKIQQQFSDLKRKLAEVTEEEWLSIPEVGDARNKRQRNPRYEKLTPVPDSFFAKHLQTGENHTSVDPRQTQFGGLNTPYPGGLNTPYPGGMTPGLMTPGTGELDMRKIGQARNTLMDMRLSQVSDSVSGQTVVDPKGYLTDLNSMIPTHGGDINDIKKARLLLKSVRETNPHHPPAWIASARLEEVTGKLQVARNLIMKGTEMCPKSEDVWLEAARLQPGDTAKAVVAQAVRHLPQSVRIYIRAAELETDIRAKKRVLRKALEHVPNSVRLWKAAVELEEPEDARIMLSRAVECCPTSVELWLALARLETYENARKVLNKARENIPTDRHIWITAAKLEEANGNTQMVEKIIDRAITSLRANGVEINREQWIQDAEECDRAGSVATCQAVMRAVIGIGIEEEDRKHTWMEDADSCVAHNALECARAIYAYALQVFPSKKSVWLRAAYFEKNHGTRESLEALLQRAVAHCPKAEVLWLMGAKSKWLAGDVPAARSILALAFQANPNSEEIWLAAVKLESENDEYERARRLLAKARSSAPTARVFMKSVKLEWVQDNIRAAQDLCEEALRHYEDFPKLWMMKGQIEEQKEMMEKAREAYNQGLKKCPHSTPLWLLLSRLEEKIGQLTRARAILEKSRLKNPKNPGLWLESVRLEYRAGLKNIANTLMAKALQECPNSGILWSEAIFLEARPQRRTKSVDALKKCEHDPHVLLAVAKLFWSQRKITKAREWFHRTVKIDSDLGDAWAFFYKFELQHGTEEEDRGHP

SEQ ID NO: 900518 - protein, 779 aa, Homo sapiens
MNKKKKPFLGMPAPLGYVPGLGRGATGFTTRSDIGPARDANDPVDDRHAPPGKRTVGDQMKKNQAADDDDEDLNDTNYDEFNGYAGSLFSSGPYEKDDEEADAIYAALDKRMDERRKERREQREKEEIEKYRMERPKIQQQFSDLKRKLAEVTEEEWLSIPEVGDARNKRQRNPRYEKLTPVPDSFFAKHLQTGENHTSVDPRQTQFGGLNTPYPGGLNTPYPGGMTPGLMTPGTGELDMRKIGQARNTLMDMRLSQVSDSVSGQTVVDPKGYLTDLNSMIPTHGGDINDIKKARLLLKSVRETNPHHPPAWIASARLEEVTGKLQVARNLIMKGTEMCPKSEDVWLEAARLQPGDTAKAVVAQAVRHLPQSVRIYIRAAELETDIRAKKRVLRKALEHVPNSVRLWKAAVELEEPEDARIMLSRAVECCPTSVELWLALARLETYENARKVLNKARENIPTDRHIWITAAKLEEANGNTQMVEKIIDRAITSLRANGVEINREQWIQDAEECDRAGSVATCQAVMRAVIGIGIEEEDRKHTWMEDADSCVAHNALECARAIYAYALQVFPSKKSVWLRAAYFEKNHGTRESLEALLQRAVAHCPKAEVLWLMGAKSKWLAGDVPAARSILALAFQANPNSEEIWLAAVKLESENDEYERARRLLAKARSSAPTARVFMKSVKLEWVQDNIRAAQDLCEEALRHYEDFPKLWMMKGQIEEQKEMMEKAREAYNQGLKKCPHSTPLWLLLSRLEEKIGQLTRARAILEKSRLKNPKNPGL

SEQ ID NO: 900519 - protein, 569 aa, Homo sapiens
YHKMLRLSLFVSAPDLKEATERAALEHVPNSVRLWKAAVELEEPEDARIMLSRAVECCPTSVELWLALARLETYENARKVLNKARENIPTDRHIWITAAKLEEANGNTQMVEKIIDRAITSLRANGVEINREQWIQDAEECDRAGSVATCQAVMRAVIGIGIEEEDRKHTWMEDADSCVAHNALECARAIYAYALQVFPSKKSVWLRAAYFEKNHGTRESLEALLQRAVAHCPKAEVLWLMGAKSKWLAGDVPAARSILALAFQANPNSEEIWLAAVKLESENDEYERARRLLAKARSSAPTARVFMKSVKLEWVQDNIRAAQDLCEEALRHYEDFPKLWMMKGQIEEQKEMMEKAREAYNQGLKKCPHSTPLWLLLSRLEEKIGQLTRARAILEKSRLKNPKNPGLWLESVRLEYRAGLKNIANTLMAKALQECPNSGILWSEAIFLEARPQRRTKSVDALKKCEHDPHVLLAVAKLFWSQRKITKAREWFHRTVKIDSDLGDAWAFFYKFELQHGTEEQQEEVRKRCESAEPRHGELWCAVSKDIANWQKKIGDILRLVAGRIKNTF

SEQ ID NO: 900520 - protein, 213 aa, Homo sapiens
MNKKKKPFLGMPAPLGYVPGLGRGATGFTTRSDIGPARDANDPVDDRHAPPGKRTVGDQMKKNQAADDDDEDLNDTNYDEFNGYAGSLFSSGPYEKDDEEADAIYAALDKRMDERRKERREQREKEEIEKYRMERPKIQQQFSDLKRKLAEVTEEEWLSIPEVGDARNKRQRNPRYEKLTPVPDSFFAKHLQTGENHTSVDPRQTVSFQKRAH

SEQ ID NO: 900521 - protein, 69 aa, Homo sapiens
VSGEVGGVGLVRAGSVCLQEQQEEVRKRCESAEPRHGELWCAVSKDIANWQKKIGDILRLVAGRIKNTF

SEQ ID NO: 900522 - protein, 91 aa, Homo sapiens
KKNRLGEPVFNPTECIGRRSLESLRLSLFRCLIPFLPSLGRRRHHEQEEETVPRDARAPRLRAGAGPGEATGFGVRTYLCVHPACRLDVTH

SEQ ID NO: 900523 - protein, 901 aa, Homo sapiens
MNKKKKPFLGMPAPLGYVPGLGRGATGFTTRSDIGPARDANDPVDDRHAPPGKRTVGDQMKKNQAADDDDEDLNDTNYDEFNGYAGSLFSSGPYEKDDEEADAIYAALDKRMDERRKERREQREKEEIEKYRMERPKIQQQFSDLKRKLAEVTEEEWLSIPEVGDARNKRQRNPRYEKLTPVPDSFFAKHLQTGENHTSVDPRQTQFGGLNTPYPGGLNTPYPGGMTPGLMTPGTGELDMRKIGQARNTLMDMRLSQVSDSVSGQTVVDPKGYLTDLNSMIPTHGGDINDIKKARLLLKSVRETNPHHPPAWIASARLEEVTGKLQVARNLIMKGTEMCPKSEDVWLEAARLQPGDTAKAVVAQAVRHLPQSVRIYIRAAELETDIRAKKRVLRKALEHVPNSVRLWKAAVELEEPEDARIMLSRAVECCPTSVELWLALARLETYENARKVLNKARENIPTDRHIWITAAKLEEANGNTQMVEKIIDRAITSLRANGVEINREQWIQDAEECDRAGSVATCQAVMRAVIGIGIEEEDRKHTWMEDADSCVAHNALECARAIYAYALQVFPSKKSVWLRAAYFEKNHGTRESLEALLQRAVAHCPKAEVLWLMGAKSKWLAGDVPAARSILALAFQVFMKSVKLEWVQDNIRAAQDLCEEALRHYEDFPKLWMMKGQIEEQKEMMEKAREAYNQGLKKCPHSTPLWLLLSRLEEKIGQLTRARAILEKSRLKNPKNPGLWLESVRLEYRAGLKNIANTLMAKALQECPNSGILWSEAIFLEARPQRRTKSVDALKKCEHDPHVLLAVAKLFWSQRKITKAREWFHRTVKIDSDLGDAWAFFYKFELQHGTEEQQEEVRKRCESAEPRHGELWCAVSKDIANWQKKIGDILRLVAGRIKNTF

SEQ ID NO: 900524 - protein, 74 aa, Homo sapiens
DARIMLSRAVECCPTSVELWLALARLETYEKPRRRHHEQEEETVPRDARAPRLRAGAGPGRHWLHHAVRHWARP

SEQ ID NO: 900525 - protein, 941 aa, Homo sapiens; identical to SEQ ID NO: 900514

SEQ ID NO: 900526 - protein, 941 aa, Homo sapiens; identical to SEQ ID NO: 900514

SEQ ID NO: 900527 - protein, 935 aa, Homo sapiens
MNKKKKPFLGMPAPLGYVPGLGRGATGFTTRSDIGPARDANDPVDDRHAPPGKRTVGDQMKKNQAADDDDEDLNDTNYDEFNGYAGSLFSSGPYEKDDEEADAIYAALDKRMDERRKERREQREKEEIEKYRMERPKIQQQFSDLKRKLAEVTEEEWLSIPEVGDARNKRQRNPRYEKLTPVPDSFFAKHLQTGENHTSVDPRQTQFGGLNTPYPGGLNTPYPGGMTPGLMTPGTGELDMRKIGQARNTLMDMRLSQVSDSVSGQTVVDPKGYLTDLNSMIPTHGGDINDIKKARLLLKSVRETNPHHPPAWIASARLEEVTGKLQVARNLIMKGTEMCPKSEDVWLEAARLQPGDTAKAVVAQAVRHLPQSVRIYIRAAELETDIRAKKRVLRKALEHVPNSVRLWKAAVELEEPEDARIMLSRAVECCPTSVELWLALARLETYENARKVLNKARENIPTDRHIWITAAKLEEANGNTQMVEKIIDRAITSLRANGVEINREQWIQDAEECDRAGSVATCQAVMRAVIGIGIEEEDRKHTWMEDADSCVAHNALECARAIYAYALQVFPSKKSVWLRAAYFEKNHGTRESLEALLQRAVAHCPKAEVLWLMGAKSKWLAGDVPAARSILALAFQANPNSEEIWLAAVKLESENDEYERARRLLAKARSSAPTARVFMKSVKLEWVQDNIRAAQDLCEEALRHYEDFPKLWMMKGQIEEQKEMMEKAREAYNQGLKKCPHSTPLWLLLSRLEEKIGQLTRARAILEKSRLKNPKNPGLWLESVRLEYRAGLKNIANTLMAKALQECPNSGILWSEAIFLEARPQRRTKSVDALKKCEHDPHVLLAVAKLFWSQRKITKAREWFHRTVKIDSDLGDAWAFFYKFELQHGTEEQQEEVRKRCESAEPRHGELWCAVSKDIANWHIFEGSSRTPQRW

SEQ ID NO: 900528 - protein, 845 aa, Homo sapiens
MNKKKKPFLGMPAPLGYVPGLGRGEQREKEEIEKYRMERPKIQQQFSDLKRKLAEVTEEEWLSIPEVGDARNKRQRNPRYEKLTPVPDSFFAKHLQTGENHTSVDPRQTQFGGLNTPYPGGLNTPYPGGMTPGLMTPGTGELDMRKIGQARNTLMDMRLSQVSDSVSGQTVVDPKGYLTDLNSMIPTHGGDINDIKKARLLLKSVRETNPHHPPAWIASARLEEVTGKLQVARNLIMKGTEMCPKSEDVWLEAARLQPGDTAKAVVAQAVRHLPQSVRIYIRAAELETDIRAKKRVLRKALEHVPNSVRLWKAAVELEEPEDARIMLSRAVECCPTSVELWLALARLETYENARKVLNKARENIPTDRHIWITAAKLEEANGNTQMVEKIIDRAITSLRANGVEINREQWIQDAEECDRAGSVATCQAVMRAVIGIGIEEEDRKHTWMEDADSCVAHNALECARAIYAYALQVFPSKKSVWLRAAYFEKNHGTRESLEALLQRAVAHCPKAEVLWLMGAKSKWLAGDVPAARSILALAFQANPNSEEIWLAAVKLESENDEYERARRLLAKARSSAPTARVFMKSVKLEWVQDNIRAAQDLCEEALRHYEDFPKLWMMKGQIEEQKEMMEKAREAYNQGLKKCPHSTPLWLLLSRLEEKIGQLTRARAILEKSRLKNPKNPGLWLESVRLEYRAGLKNIANTLMAKALQECPNSGILWSEAIFLEARPQRRTKSVDALKKCEHDPHVLLAVAKLFWSQRKITKAREWFHRTVKIDSDLGDAWAFFYKFELQHGTEEQQEEVRKRCESAEPRHGELWCAVSKDIANWQKKIGDILRLVAGRIKNTF

SEQ ID NO: 900529 - protein, 815 aa, Homo sapiens
MNKKKKPFLGMPAPLGYVPGLGRGATGFTTRSDIGPARDANDPVDDRHAPPGKRTVGDQMKKNQAADDDDEDLNDTNYDEFNGYAGSLFSSGPYEKDDEEADAIYAALDKRMDERRKERREQREKEEIEKYRMERPKIQQQFSDLKRKLAEVTEEEWLSIPEVGDARNKRQRNPRYEKLTPVPDSFFAKHLQTGENHTSVDPRQTQFGGLNTPYPGGLNTPYPGGMTPGLMTPGTGELDMRKIGQARNTLMDMRLSQVSDSVSGQTVVDPKGYLTDLNSMIPTHGGDINDIKKARLLLKSVRETNPHHPPAWIASARLEEVTGKLQVARNLIMKGTEMCPKSEDVWLEAARLQPGDTAKAVVAQAVRHLPQSVRIYIRAAELETDIRAKKRVLRKALEHVPNSVRLWKAAVELEEPEDARIMLSRAVECCPTSVELWLALARLETYENARKVLNKARENIPTDRHIWITAAKLEEANGNTQMVEKIIDRAITSLRANGVEINREQWIQDAEECDRAGSVATCQAVMRAVIGIGIEEEDRKHTWMEDADSCVAHNALECARAIYAYALQVFPSKKSVWLRAAYFEKNHGTRESLEALLQRAVAHCPKAEVLWLMGAKSKWLAGDVPAARSILALAFQANPNSEEIWLAAVKLESENDEYERARRLLAKARSSAPTARVFMKSVKLEWVQDNIRAAQDLCEEALRHYEDFPKLWMMKGQIEEQKEMMEKAREAYNQGLKKCPHSTPLWLLLSRLEEKIGQLTRARAILEKSRLKNPKNPGLWLESVRLEYRAGLKNIANTLMAKALQECPNSGILWS

SEQ ID NO: 900530 - protein, 635 aa, Homo sapiens
DFFQGGLMQSRLEEVTGKLQVARNLIMKGTEMCPKSEDVWLEAARLQPGDTAKAVVAQAVRHLPQSVRIYIRAAELETDIRAKKRVLRKALEHVPNSVRLWKAAVELEEPEDARIMLSRAVECCPTSVELWLALARLETYENARKVLNKARENIPTDRHIWITAAKLEEANGNTQMVEKIIDRAITSLRANGVEINREQWIQDAEECDRAGSVATCQAVMRAVIGIGIEEEDRKHTWMEDADSCVAHNALECARAIYAYALQVFPSKKSVWLRAAYFEKNHGTRESLEALLQRAVAHCPKAEVLWLMGAKSKWLAGDVPAARSILALAFQANPNSEEIWLAAVKLESENDEYERARRLLAKARSSAPTARVFMKSVKLEWVQDNIRAAQDLCEEALRHYEDFPKLWMMKGQIEEQKEMMEKAREAYNQGLKKCPHSTPLWLLLSRLEEKIGQLTRARAILEKSRLKNPKNPGLWLESVRLEYRAGLKNIANTLMAKALQECPNSGILWSEAIFLEARPQRRTKSVDALKKCEHDPHVLLAVAKLFWSQRKITKAREWFHRTVKIDSDLGDAWAFFYKFELQHGTEEQQEEVRKRCESAEPRHGELWCAVSKDIANWQKKIGDILRLVAGRIKNTF

SEQ ID NO: 900531 - protein, 381 aa, Homo sapiens
MNKKKKPFLGMPAPLGYVPGLGRGATGFTTRSDIGPARDANDPVDDRHAPPGKRTVGDQMKKNQAADDDDEDLNDTNYDEFNGYAGSLFSSGPYEKDDEEADAIYAALDKRMDERRKERREQREKEEIEKYRMERPKIQQQFSDLKRKLAEVTEEEWLSIPEVGDARNKRQRNPRYEKLTPVPDSFFAKHLQTGENHTSVDPRQTQFGGLNTPYPGGLNTPYPGGMTPGLMTPGTGELDMRKIGQARNTLMDMRLSQVSDSVSGQTVVDPKGYLTDLNSMIPTHGGDINDIKKARLLLKSVRETNPHHPPAWIASARLEEVTGKLQVARNLIMKGTEMCPKSEDVWLEAARLQPGDTAKAVVAQAVRHLPQSVRIYIKNTF

SEQ ID NO: 900532 - protein, 91 aa, Homo sapiens; identical to SEQ ID NO: 900522

SEQ ID NO: 900533 - protein, 95 aa, Homo sapiens
RSGEEHRNRVIQTPGVLGVSCSATGFTTRSDIGPARDANDPVDDRHAPPGKRTVGDQMKKNQAADDDDEDLNDTNYDEVRCVRLSWLLQPVSGSS

SEQ ID NO: 900534 - protein, 93 aa, Homo sapiens
SGLLLKFNPPFQGEPQMAQPSTWGSHKELTFAGQACGVLQLMENQIGAVERGAFDDMKELERLRLNRNQLHMLPELLFQNNQALSRLIYGSER

SEQ ID NO: 900535 - protein, 1616 aa, Homo sapiens
GRRRRRNGRGAEPPPPKAPSLRPRTGAVAWRSKVPPSPQGRRAQARGLFGGSAPGLHLEAAPDGDGQRLLPSGSRAGRCEGTMALTPGWGSSAGPVRPELWLLLWAAAWRLGASACPALCTCTGTTVDCHGTGLQAIPKNIPRNTERLELNGNNITRIHKNDFAGLKQLRVLQLMENQIGAVERGAFDDMKELERLRLNRNQLHMLPELLFQNNQALSRLDLSENAIQAIPRKAFRGATDLKNLRLDKNQISCIEEGAFRALRGLEVLTLNNNNITTIPVSSFNHMPKLRTFRLHSNHLFCDCHLAWLSQWLRQRPTIGLFTQCSGPASLRGLNVAEVQKSEFSCSGQGEAGRVPTCTLSSGSCPAMCTCSNGIVDCRGKGLTAIPANLPETMTEIRLELNGIKSIPPGAFSPYRKLRRIDLSNNQIAEIAPDAFQGLRSLNSLVLYGNKITDLPRGVFGGLYTLQLLLLNANKINCIRPDAFQDLQNLSLLSLYDNKIQSLAKGTFTSLRAIQTLHLAQNPFICDCNLKWLADFLRTNPIETSGARCASPRRLANKRIGQIKSKKFRCSAKEQYFIPGTEDYQLNSECNSDVVCPHKCRCEANVVECSSLKLTKIPERIPQSTAELRLNNNEISILEATGMFKKLTHLKKINLSNNKVSEIEDGAFEGAASVSELHLTANQLESIRSGMFRGLDGLRTLMLRNNRISCIHNDSFTGLRNVRLLSLYDNQITTVSPGAFDTLQSLSTLNLLANPFNCNCQLAWLGGWLRKRKIVTGNPRCQNPDFLRQIPLQDVAFPDFRCEEGQEEGGCLPRPQCPQECACLDTVVRCSNKHLRALPKGIPKNVTELYLDGNQFTLVPGQLSTFKYLQLVDLSNNKISSLSNSSFTNMSQLTTLILSYNALQCIPPLAFQGLRSLRLLSLHGNDISTLQEGIFADVTSLSHLAIGANPLYCDCHLRWLSSWVKTGYKEPGIARCAGPQDMEGKLLLTTPAKKFECQGPPTLAVQAKCDLCLSSPCQNQGTCHNDPLEVYRCACPSGYKGRDCEVSLDSCSSGPCENGGTCHAQEGEDAPFTCSCPTGFEGPTCGVNTDDCVDHACANGGVCVDGVGNYTCQCPLQYEGKACEQLVDLCSPDLNPCQHEAQCVGTPDGPRCECMPGYAGDNCSENQDDCRDHRCQNGAQCMDEVNSYSCLCAEGYSGQLCEIPPHLPAPKSPCEGTECQNGANCVDQGNRPVCQCLPGFGGPECEKLLSVNFVDRDTYLQFTDLQNWPRANITLQVSTAEDNGILLYNGDNDHIAVELYQGHVRVSYDPGSYPSSAIYSAETINDGQFHTVELVAFDQMVNLSIDGGSPMTMDNFGKHYTLNSEAPLYVGGMPVDVNSAAFRLWQILNGTGFHGCIRNLYINNELQDFTKTQMKPGVVPGCEPCRKLYCLHGICQPNATPGPMCHCEAGWVGLHCDQPADGPCHGHKCVHGQCVPLDALSYSCQCQDGYSGALCNQAGALAEPCRGLQCLHGHCQASGTKGAHCVCDPGFSGELCEQESECRGDPVRDFHQVQRGYAICQTTRPLSWVECRGSCPGQGCCQGLRLKRRKFTFECSDGTSFAEEVEKPTKCGCALCA

SEQ ID NO: 900536 - protein, 1616 aa, Homo sapiens; identical to SEQ ID NO: 900535

SEQ ID NO: 900537 - protein, 353 aa, Homo sapiens
MSFPLSGQLCEIPPHLPAPKSPCEGTECQNGANCVDQGNRPVCQCLPGFGGPECEKLLSVNFVDRDTYLQFTDLQNWPRANITLQVSTAEDNGILLYNGDNDHIAVELYQGHVRVSYDPGSYPSSAIYSAETINDGQFHTVELVAFDQMVNLSIDGGSPMTMDNFGKHYTLNSEAPLYVGGMPVDVNSAAFRLWQILNGTGFHGCIRNLYINNELQDFTKTQMKPGVVPGCEPCRKLYCLHGICQPNATPGPMCHCEAGWVGLHCDQPADGPCHGHKCVHGQCVPLDALSYSCQCQDGYSGALCNQAGALAEPCRGLQCLHGHCQASGTKGAHCVCDPGFSGELCEQGQGPPS

SEQ ID NO: 900538 - protein, 226 aa, Homo sapiens
GRRRRRNGRGAEPPPPKAPSLRPRTGAVAWRSKVPPSPQGRRAQARGLFGGSAPGLHLEAAPDGDGQRLLPSGSRAGRCEGTMALTPGWGSSAGPVRPELWLLLWAAAWRLGASACPALCTCTGTTVDCHGTGLQAIPKNIPRNTERLELNGNNITRIHKNDFAGLKQLRVLQLMENQIGAVERGAFDDMKELERLRLNRNQLHMLPELLFQNNQALSRLIYGSER

SEQ ID NO: 900539 - protein, 1616 aa, Homo sapiens; identical to SEQ ID NO: 900535

SEQ ID NO: 900540 - protein, 1543 aa, Homo sapiens
GRRRRRNGRGAEPPPPKAPSLRPRTGAVAWRSKVPPSPQGRRAQARGLFGGSAPGLHLEAAPDGDGQRLLPSGSRAGRCEGTMALTPGWGSSAGPVRPELWLLLWAAAWRLGASACPALCTCTGTTVDCHGTGLQAIPKNIPRNTERLELNGNNITRIHKNDFAGLKQLRVLQLMENQIGAVERGAFDDMKELERLRLNRNQLHMLPELLFQNNQALSRLDLSENAIQAIPRKAFRGATDLKNLRLDKNQISCIEEGAFRALRGLEVLTLNNNNITTIPVSSFNHMPKLRTFRLHSNHLFCDCHLAWLSQWLRQRPTIGLFTQCSGPASLRGLNVAEVQKSEFSCSGQGEAGRVPTCTLSSGSCPAMCTCSNGIVDCRGKGLTAIPANLPETMTEIRLELNGIKSIPPGAFSPYRKLRRIDLSNNQIAEIAPDAFQGLRSLNSLVLYGNKITDLPRGVFGGLYTLQLLLLNANKINCIRPDAFQDLQNLSLLSLYDNKIQSLAKGTFTSLRAIQTLHLAQNPFICDCNLKWLADFLRTNPIETSGARCASPRRLANKRIGQIKSKKFRCSAKEQYFIPGTEDYQLNSECNSDVVCPHKCRCEANVVECSSLKLTKIPERIPQSTAELRLNNNEISILEATGMFKKLTHLKKINLSNNKVSEIEDGAFEGAASVSELHLTANQLESIRSGMFRGLDGLRTLMLRNNRISCIHNDSFTGLRNVRLLSLYDNQITTVSPGAFDTLQSLSTLNLLANPFNCNCQLAWLGGWLRKRKIVTGNPRCQNPDFLRQIPLQDVAFPDFRCEEGQEEGGCLPRPQCPQECACLDTVVRCSNKHLRALPKGIPKNVTELYLDGNQFTLVPGQLSTFKYLQLVDLSNNKISSLSNSSFTNMSQLTTLILSYNALQCIPPLAFQGLRSLRLLSLHGNDISTLQEGIFADVTSLSHLAIGANPLYCDCHLRWLSSWVKTGYKEPGIARCAGPQDMEGKLLLTTPAKKFECQGPPTLAVQAKCDLCLSSPCQNQGTCHNDPLEVYRCACPSGYKGRDCEVSLDSCSSGPCENGGTCHAQEGEDAPFTCSCPTGFEGPTCGVNTDDCVDHACANGGVCVDGVGNYTCQCPLQYEGKACEQLVDLCSPDLNPCQHEAQCVGTPDGPRCECMPGYAGDNCSENQDDCRDHRCQNGAQCMDEVNSYSCLCAEGYSGQLCEIPPHLPAPKSPCEGTECQNGANCVDQGNRPVCQCLPGFGGPECEKLLSVNFVDRDTYLQFTDLQNWPRANITLQVSTAEDNGILLYNGDNDHIAVELYQGHVRVSYDPGSYPSSAIYSAETINDGQFHTVELVAFDQMVNLSIDGGSPMTMDNFGKHYTLNSEAPLYVGGMPVDVNSAAFRLWQILNGTGFHGCIRNLYINNELQDFTKTQMKPGVVPGCEPCRKLYCLHGICQPNATPGPMCHCEAGWVGLHCDQPADGPCHGHKCVHGQCVPLDALSYSCQCQDGYSGALCNQAGALAEPCRGLQCLHGHCQASGTKGAHCVCDPGFSGELCEQGQGPPS

SEQ ID NO: 900541 - protein, 1273 aa, Homo sapiens
GRRRRRNGRGAEPPPPKAPSLRPRTGAVAWRSKVPPSPQGRRAQARGLFGGSAPGLHLEAAPDGDGQRLLPSGSRAGRCEGTMALTPGWGSSAGPVRPELWLLLWAAAWRLGASACPALCTCTGTTVDCHGTGLQAIPKNIPRNTERLELNGNNITRIHKNDFAGLKQLRVLQLMENQIGAVERGAFDDMKELERLRLNRNQLHMLPELLFQNNQALSRLDLSENAIQAIPRKAFRGATDLKNLRLDKNQISCIEEGAFRALRGLEVLTLNNNNITTIPVSSFNHMPKLRTFRLHSNHLFCDCHLAWLSQWLRQRPTIGLFTQCSGPASLRGLNVAEVQKSEFSCSGQGEAGRVPTCTLSSGSCPAMCTCSNGIVDCRGKGLTAIPANLPETMTEIRLELNGIKSIPPGAFSPYRKLRRIDLSNNQIAEIAPDAFQGLRSLNSLVLYGNKITDLPRGVFGGLYTLQLLLLNANKINCIRPDAFQDLQNLSLLSLYDNKIQSLAKGTFTSLRAIQTLHLAQNPFICDCNLKWLADFLRTNPIETSGARCASPRRLANKRIGQIKSKKFRCSAKEQYFIPGTEDYQLNSECNSDVVCPHKCRCEANVVECSSLKLTKIPERIPQSTAELRLNNNEISILEATGMFKKLTHLKKINLSNNKVSEIEDGAFEGAASVSELHLTANQLESIRSGMFRGLDGLRTLMLRNNRISCIHNDSFTGLRNVRLLSLYDNQITTVSPGAFDTLQSLSTLNLLANPFNCNCQLAWLGGWLRKRKIVTGNPRCQNPDFLRQIPLQDVAFPDFRCEEGQEEGGCLPRPQCPQECACLDTVVRCSNKHLRALPKGIPKNVTELYLDGNQFTLVPGQLSTFKYLQLVDLSNNKISSLSNSSFTNMSQLTTLILSYNALQCIPPLAFQGLRSLRLLSLHGNDISTLQEGIFADVTSLSHLAIGANPLYCDCHLRWLSSWVKTGYKEPGIARCAGPQDMEGKLLLTTPAKKFECQGPPTLAVQAKCDLCLSSPCQNQGTCHNDPLEVYRCACPSGYKGRDCEVSLDSCSSGPCENGGTCHAQEGEDAPFTCSCPTGFEGPTCGVNTDDCVDHACANGGVCVDGVGNYTCQCPLQYEGKACEQLVDLCSPDLNPCQHEAQCVGTPDGPRCECMPGYAGDNCSENQDDCRDHRCQNGAQCMDEVNSYSCLCAEGYSGQLCEIPPHLPAPKSPGVSACQVMQVTTAVRTRMTAGTTAARMGPSVWMKSTATPASVLRATVDSSVRSLPICLPPE

SEQ ID NO: 900542 - protein, 456 aa, Homo sapiens
MASALSLGNKCDPFLRCVLCRGGGALQGPRGRGPDDFESQLSPPGSARRLVRSKRACGNPPDAFGLSRASVHPPLPRVSIGCSSGPGRAKRERVGGAAWRQRKMAASAAVFSRLRSGLRLGSRGLCTRLATPPRRAPDQAAEIGSRGSTKAQGPQQQPGSEGPSYAKKVALWLAGLLGAGGTVSVVYIFGNNPVDENGAKIPDEFDNDPILVQQLRRTYKYFKDYRQMIIEPTSPCLLPDPLQEPYYQPPYTLVLELTGVLLHPEWSLATGWRFKKRPGIETLFQQLAPLYEIVIFTSETGMTAFPLIDSVDPHGFISYRLFRDATRYMDGHHVKDISCLNRDPARVVVVDCKKEAFRLQPYNGVALRPWDGNSDDRVLLDLSAFLKTIALNGVEDVRTVLEHYALEDDPLAAFKQRQSRLEQEEQQRLAELSKSNKQNLFLGSLTSRLWPRSKQP

SEQ ID NO: 900543 - protein, 456 aa, Homo sapiens; identical to SEQ ID NO: 900542

SEQ ID NO: 900544 - protein, 456 aa, Homo sapiens; identical to SEQ ID NO: 900542

SEQ ID NO: 900545 - protein, 456 aa, Homo sapiens; identical to SEQ ID NO: 900542

SEQ ID NO: 900546 - protein, 456 aa, Homo sapiens; identical to SEQ ID NO: 900542

SEQ ID NO: 900547 - protein, 364 aa, Homo sapiens
NYRLGTRPGFKSAEAAAVFSRLRSGLRLGSRGLCTRLATPPRRAPDQAAEIGSRGSTKAQGPQQQPGSEGPSYAKKVALWLAGLLGAGGTVSVVYIFGNNPVDENGAKIPDEFDNDPILVQQLRRTYKYFKDYRQMIIEPTSPCLLPDPLQEPYYQPPYTLVLELTGVLLHPEWSLATGWRFKKRPGIETLFQQLAPLYEIVIFTSETGMTAFPLIDSVDPHGFISYRLFRDATRYMDGHHVKDISCLNRDPARVVVVDCKKEAFRLQPYNGVALRPWDGNSDDRVLLDLSAFLKTIALNGVEDVRTVLEHYALEDDPLAAFKQRQSRLEQEEQQRLAELSKSNKQNLFLGSLTSRLWPRSKQP

SEQ ID NO: 900548 - protein, 298 aa, Homo sapiens
MRAEMPNGLRPLLWLAGLLGAGGTVSVVYIFGNNPVDENGAKIPDEFDNDPILVQQLRRTYKYFKDYRQMIIEPTSPCLLPDPLQEPYYQPPYTLVLELTGVLLHPEWSLATGWRFKKRPGIETLFQQLAPLYEIVIFTSETGMTAFPLIDSVDPHGFISYRLFRDATRYMDGHHVKDISCLNRDPARVVVVDCKKEAFRLQPYNGVALRPWDGNSDDRVLLDLSAFLKTIALNGVEDVRTVLEHYALEDDPLAAFKQRQSRLEQEEQQRLAELSKSNKQNLFLGSLTSRLWPRSKQP

SEQ ID NO: 900549 - protein, 240 aa, Homo sapiens
MVPRFLMSSTMMIIEPTSPCLLPDPLQEPYYQPPYTLVLELTGVLLHPEWSLATGWRFKKRPGIETLFQQLAPLYEIVIFTSETGMTAFPLIDSVDPHGFISYRLFRDATRYMDGHHVKDISCLNRDPARVVVVDCKKEAFRLQPYNGVALRPWDGNSDDRVLLDLSAFLKTIALNGVEDVRTVLEHYALEDDPLAAFKQRQSRLEQEEQQRLAELSKSNKQNLFLGSLTSRLWPRSKQP

SEQ ID NO: 900550 - protein, 229 aa, Homo sapiens
MIIEPTSPCLLPDPLQEPYYQPPYTLVLELTGVLLHPEWSLATGWRFKKRPGIETLFQQLAPLYEIVIFTSETGMTAFPLIDSVDPHGFISYRLFRDATRYMDGHHVKDISCLNRDPARVVVVDCKKEAFRLQPYNGVALRPWDGNSDDRVLLDLSAFLKTIALNGVEDVRTVLEHYALEDDPLAAFKQRQSRLEQEEQQRLAELSKSNKQNLFLGSLTSRLWPRSKQP

SEQ ID NO: 900551 - protein, 229 aa, Homo sapiens; identical to SEQ ID NO: 900550

SEQ ID NO: 900552 - protein, 244 aa, Homo sapiens
GRVGRPTRSRSETGMMIIEPTSPCLLPDPLQEPYYQPPYTLVLELTGVLLHPEWSLATGWRFKKRPGIETLFQQLAPLYEIVIFTSETGMTAFPLIDSVDPHGFISYRLFRDATRYMDGHHVKDISCLNRDPARVVVVDCKKEAFRLQPYNGVALRPWDGNSDDRVLLDLSAFLKTIALNGVEDVRTVLEHYALEDDPLAAFKQRQSRLEQEEQQRLAELSKSNKQNLFLGSLTSRLWPRSKQP

SEQ ID NO: 900553 - protein, 449 aa, Homo sapiens
MASALSLGNKCDPFLRCVLCRGGGALQGPRGRGPDDFESQLSPPGSARRLVRSKRACGNPPDAFGLSRASVHPPLPRVSIGCSSGPGRAKRERVGGAAWRQRKMAASAAVFSRLRSGLRLGSRGLCTRLATPPRRAPDQAAEIGSRGSTKAQGPQQQPGSEGPSYAKKVALWLAGLLGAGGTVSVVYIFGNNPVDENGAKIPDEFDNDPILVQQLRRTYKYFKDYRQMIIEPTSPCLLPDPLQEPYYQPPYTLVLELTGVLLHPEWSLATGWRFKKRPGIETLFQQLAPLYEIVIFTSETGMTAFPLIDSVDPHGFISYRLFRDATRYMDGHHVKDISCLNRDPARVVVVDCKKEAFRLQPYNGVALRPWDGNSDDRVLLDLSAFLKTNCTGNGVEASPPVGGFAGRNPRAGFKTSAQKPGIKARKEASKGRSLSKDPKKNSLAKKTRL

SEQ ID NO: 900554 - protein, 228 aa, Homo sapiens
MSLKACKTQLRKSFNKSNNINKNSDNYWWLPNWANAPWSLATGWRFKKRPGIETLFQQLAPLYEIVIFTSETGMTAFPLIDSVDPHGFISYRLFRDATRYMDGHHVKDISCLNRDPARVVVVDCKKEAFRLQPYNGVALRPWDGNSDDRVLLDLSAFLKTIALNGVEDVRTVLEHYALEDDPLAAFKQRQSRLEQEEQQRLAELSKSNKQNLFLGSLTSRLWPRSKQP

SEQ ID NO: 900555 - protein, 169 aa, Homo sapiens
GRVGRPTRSRSETGMTAFPLIDSVDPHGFISYRLFRDATRYMDGHHVKDISCLNRDPARVVVVDCKKEAFRLQPYNGVALRPWDGNSDDRVLLDLSAFLKTIALNGVEDVRTVLEHYALEDDPLAAFKQRQSRLEQEEQQRLAELSKSNKQNLFLGSLTSRLWPRSKQP

SEQ ID NO: 900556 - protein, 139 aa, Homo sapiens
MGGELGTDVDLICHSLPEDISCLNRDPARVVVVDCKKEAFRLQPYNGVALRPWDGNSDDRVLLDLSAFLKTIALNGVEDVRTVLEHYALEDDPLAAFKQRQSRLEQEEQQRLAELSKSNKQNLFLGSLTSRLWPRSKQP

SEQ ID NO: 900557 - protein, 383 aa, Homo sapiens
MASALSLGNKCDPFLRCVLCRGGGALQGPRGRGPDDFESQLSPPGSARRLVRSKRACGNPPDAFGLSRASVHPPLPRVSIGCSSGPGRAKRERVGGAAWRQRKMAASAAVFSRLRSGLRLGSRGLCTRLATPPRRAPDQAAEIGSRGSTKAQGPQQQPGSEGPSYAKKVALWLAGLLGAGGTVSVVYIFGNNPVDENGAKIPDEFDNDPILVQQLRRTYKYFKDYRQMIIEPTSPCLLPDPLQEPYYQPPYTLVLELTGVLLHPEWSLATGWRFKKRPGIETLFQQLAPLYEIVIFTSETGMTAFPLIDSVDPHGFISYRLFRDATRYMDGHHVKVPWVHGWASGIWRSWHHLREGGPSSDPSLTWLMVLPRFDSCWQAHACL

SEQ ID NO: 900558 - protein, 456 aa, Homo sapiens; identical to SEQ ID NO: 900542

SEQ ID NO: 900559 - protein, 456 aa, Homo sapiens; identical to SEQ ID NO: 900542

SEQ ID NO: 900560 - protein, 456 aa, Homo sapiens; identical to SEQ ID NO: 900542

SEQ ID NO: 900561 - protein, 456 aa, Homo sapiens; identical to SEQ ID NO: 900542

SEQ ID NO: 900562 - protein, 347 aa, Homo sapiens
QVILEQEGPGTLESQSGRGSYFLCGVGGGEAAEIGSRGSTKAQGPQQQPGSEGPSYAKKVALWLAGLLGAGGTVSVVYIFGNNPVDENGAKIPDEFDNDPILVQQLRRTYKYFKDYRQMIIEPTSPCLLPDPLQEPYYQPPYTLVLELTGVLLHPEWSLATGWRFKKRPGIETLFQQLAPLYEIVIFTSETGMTAFPLIDSVDPHGFISYRLFRDATRYMDGHHVKDISCLNRDPARVVVVDCKKEAFRLQPYNGVALRPWDGNSDDRVLLDLSAFLKTIALNGVEDVRTVLEHYALEDDPLAAFKQRQSRLEQEEQQRLAELSKSNKQNLFLGSLTSRLWPRSKQP

SEQ ID NO: 900563 - protein, 472 aa, Homo sapiens
MASALSLGNKCDPFLRCVLCRGGGALQGPRGRGPDDFESQLSPPGSARRLVRSKRACGNPPDAFGLSRASVHPPLPRVSIGCSSGPGRAKRERVGGAAWRQRKMAASAAVFSRLRSGLRLGSRGLCTRLATPPRRAPDQAAEIGSRGSTKAQGPQQQPGSEGPSYAKKVALWLAGLLGAGGTVSVVYIFGNNPVDENGAKVRGKETEALPGVLVCWIPDEFDNDPILVQQLRRTYKYFKDYRQMIIEPTSPCLLPDPLQEPYYQPPYTLVLELTGVLLHPEWSLATGWRFKKRPGIETLFQQLAPLYEIVIFTSETGMTAFPLIDSVDPHGFISYRLFRDATRYMDGHHVKDISCLNRDPARVVVVDCKKEAFRLQPYNGVALRPWDGNSDDRVLLDLSAFLKTIALNGVEDVRTVLEHYALEDDPLAAFKQRQSRLEQEEQQRLAELSKSNKQNLFLGSLTSRLWPRSKQP

SEQ ID NO: 900564 - protein, 229 aa, Homo sapiens; identical to SEQ ID NO: 900550

SEQ ID NO: 900565 - protein, 429 aa, Homo sapiens
MASALSLGNKCDPFLRCVLCRGGGALQGPRGRGPDDFESQLSPPGSARRLVRSKRACGNPPDAFGLSRASVHPPLPRVSIGCSSGPGRAKRERVGGAAWRQRKMAASAAVFSRLRSGLRLGSRGLCTRLATPPRRAPDQAAEIGSRGSTKAQGPQQQPGSEGPSYAKKVALWLAGLLGAGGTVSVVYIFGNNPVDENGAKMIIEPTSPCLLPDPLQEPYYQPPYTLVLELTGVLLHPEWSLATGWRFKKRPGIETLFQQLAPLYEIVIFTSETGMTAFPLIDSVDPHGFISYRLFRDATRYMDGHHVKDISCLNRDPARVVVVDCKKEAFRLQPYNGVALRPWDGNSDDRVLLDLSAFLKTIALNGVEDVRTVLEHYALEDDPLAAFKQRQSRLEQEEQQRLAELSKSNKQNLFLGSLTSRLWPRSKQP

SEQ ID NO: 900566 - protein, 239 aa, Homo sapiens
MHAMIDRMAPMIIEPTSPCLLPDPLQEPYYQPPYTLVLELTGVLLHPEWSLATGWRFKKRPGIETLFQQLAPLYEIVIFTSETGMTAFPLIDSVDPHGFISYRLFRDATRYMDGHHVKDISCLNRDPARVVVVDCKKEAFRLQPYNGVALRPWDGNSDDRVLLDLSAFLKTIALNGVEDVRTVLEHYALEDDPLAAFKQRQSRLEQEEQQRLAELSKSNKQNLFLGSLTSRLWPRSKQP

SEQ ID NO: 900567 - protein, 155 aa, Homo sapiens [sequence omitted]

SEQ ID NO: 900568 - protein, 260 aa, Homo sapiens
MASALSLGNKCDPFLRCVLCRGGGALQGPRGRGPDDFESQLSPPGSARRLVRSKRACGNPPDAFGLSRASVHPPLPRVSIGCSSGPGRAKRERVGGAAWRQRKMAASAAVFSRLRSGLRLGSRGLCTRLATPPRRAPDQDISCLNRDPARVVVVDCKKEAFRLQPYNGVALRPWDGNSDDRVLLDLSAFLKTIALNGVEDVRTVLEHYALEDDPLAAFKQRQSRLEQEEQQRLAELSKSNKQNLFLGSLTSRLWPRSKQP

SEQ ID NO: 900569 - protein, 242 aa, Homo sapiens
MVFTITFPLTAPVGMLVPVTECFNGSCQYGCTAPRRDCGLRLRWGLQQAVAGSGAVAGVGAGQLVALLAAGCPLPVVVAAVAVAAAGVVGAAAGAGVAGPRPAAVPSADQPEPFSLLQIRSDISCLNRDPARVVVVDCKKEAFRLQPYNGVALRPWDGNSDDRVLLDLSAFLKTIALNGVEDVRTVLEHYALEDDPLAAFKQRQSRLEQEEQQRLAELSKSNKQNLFLGSLTSRLWPRSKQP

SEQ ID NO: 900570 - protein, 141 aa, Homo sapiens
MAELDPFGAPAGAPGGPALGNGVAGAGEEDPAAAFLAQQESEIAGIENDEAFAILDGGAPGPQPHGEPPGGPDAVDGVMNGEYYQESNGPTDSYAAISQVDRLQSEPESIRKWREEQMERLEALDANSRKQEAEWTHEHRQ

SEQ ID NO: 900571 - protein, 194 aa, Homo sapiens
WLVRGLVLNRPSLPPGACPPLPVGTTAVAAGRGVGGSVGFCLTVGVRAVQLPAMAELDPFGAPAGAPGGPALGNGVAGAGEEDPAAAFLAQQESEIAGIENDEAFAILDGGAPGPQPHGEPPGGPDAVDGVMNGEYYQESNGPTDSYAAISQVDRLQSEPESIRKWREEQMERLEALDANSRKQEAEWTHEHRQ

SEQ ID NO: 900572 - protein, 197 aa, Homo sapiens
GQEKRNRLGTRLGVGLPPGACPPLPVGTTAVAAGRGVGGSVGFCLTVGVRAVQLPAMAELDPFGAPAGAPGGPALGNGVAGAGEEDPAAAFLAQQESEIAGIENDEAFAILDGGAPGPQPHGEPPGGPDAVDGVMNGEYYQESNGPTDSYAAISQVDRLQSEPESIRKWREEQMERLEALDANSRKQEAEWTHEHRQ

SEQ ID NO: 900573 - protein, 183 aa, Homo sapiens
GQEKRNRLGTRLGVAAVAAGRGVGGSVGFCLTVGVRAVQLPAMAELDPFGAPAGAPGGPALGNGVAGAGEEDPAAAFLAQQESEIAGIENDEAFAILDGGAPGPQPHGEPPGGPDAVDGVMNGEYYQESNGPTDSYAAISQVDRLQSEPESIRKWREEQMERLEALDANSRKQEAEWTHEHRQ

SEQ ID NO: 900574 - protein, 141 aa, Homo sapiens; identical to SEQ ID NO: 900570

SEQ ID NO: 900575 - protein, 197 aa, Homo sapiens; identical to SEQ ID NO: 900572

SEQ ID NO: 900576 - protein, 141 aa, Homo sapiens; identical to SEQ ID NO: 900570

SEQ ID NO: 900577 - protein, 141 aa, Homo sapiens; identical to SEQ ID NO: 900570

SEQ ID NO: 900578 - protein, 180 aa, Homo sapiens
WLVRGLVLNRPTAVAAGRGVGGSVGFCLTVGVRAVQLPAMAELDPFGAPAGAPGGPALGNGVAGAGEEDPAAAFLAQQESEIAGIENDEAFAILDGGAPGPQPHGEPPGGPDAVDGVMNGEYYQESNGPTDSYAAISQVDRLQSEPESIRKWREEQMERLEALDANSRKQEAEWTHEHRQ

SEQ ID NO: 900579 - protein, 141 aa, Homo sapiens; identical to SEQ ID NO: 900570

SEQ ID NO: 900580 - protein, 141 aa, Homo sapiens; identical to SEQ ID NO: 900570

SEQ ID NO: 900581 - protein, 141 aa, Homo sapiens; identical to SEQ ID NO: 900570

SEQ ID NO: 900582 - protein, 195 aa, Homo sapiens
AGCSLFGSATPPRPTGYTGRASALPVSLLALVLLSQSAPQRWLPGVVSVGRLVFVSPLVSVPFSCPPWLSWIRSAPLPAPLAVPRWGTEWPAPAKKTRLRPSWRSKRARLRASRTTRPSPSWTAAPPGPSRTASRRGVRESNGPTDSYAAISQVDRLQSEPESIRKWREEQMERLEALDANSRKQEAEWTHEHRQ

SEQ ID NO: 900583 - protein, 141 aa, Homo sapiens; identical to SEQ ID NO: 900570

SEQ ID NO: 900584 - protein, 141 aa, Homo sapiens; identical to SEQ ID NO: 900570

SEQ ID NO: 900585 - protein, 141 aa, Homo sapiens; identical to SEQ ID NO: 900570

SEQ ID NO: 900586 - protein, 141 aa, Homo sapiens; identical to SEQ ID NO: 900570

SEQ ID NO: 900587 - protein, 141 aa, Homo sapiens; identical to SEQ ID NO: 900570

SEQ ID NO: 900588 - protein, 181 aa, Homo sapiens
AGCSLFGSATPPRPTGYTGRASALPVSLLALVLLSQSAPQRWLPGVVSVGRLVFVSPLVSVPFSCPPWLSWIRSAPLPAPLAVPRWGTEWPAPAKKTRLRPSWRSKRARLRASRTTRPSPSWTAAPPGPSRTASRRGVRMPILGSKKQSGHTNTGNKGARRMVCKTGRAATENKSKQQGGR

SEQ ID NO: 900589 - protein, 195 aa, Homo sapiens; identical to SEQ ID NO: 900582

SEQ ID NO: 900590 - protein, 141 aa, Homo sapiens; identical to SEQ ID NO: 900570

SEQ ID NO: 900591 - protein, 113 aa, Homo sapiens
MAELDPFGAPAGAPGGPALGNGVAGAGEEDPAAAFLAQQESEIAGIENDEAFAILDGGAPGPQPHGEPPGGPDAVDGVMNGEYYQESNGPTDSYAAISQVDRLQSEPSNSLNQ

SEQ ID NO: 900592 - protein, 189 aa, Homo sapiens
RCLSPRLSPRRLVRSGLPGLAAVAAGRGVGGSVGFCLTVGVRAVQLPAMAELDPFGAPAGAPGGPALGNGVAGAGEEDPAAAFLAQQESEIAGIENDEAFAILDGGAPGPQPHGEPPGGPDAVDGVMNGEYYQESNGPTDSYAAISQVDRLQSEPESIRKWREEQMERLEALDANSRKQEAEWTHEHRQ

SEQ ID NO: 900593 - protein, 197 aa, Homo sapiens; identical to SEQ ID NO: 900572

SEQ ID NO: 900594 - protein, 197 aa, Homo sapiens; identical to SEQ ID NO: 900572

SEQ ID NO: 900595 - protein, 194 aa, Homo sapiens; identical to SEQ ID NO: 900571

SEQ ID NO: 900596 - protein, 141 aa, Homo sapiens; identical to SEQ ID NO: 900570

SEQ ID NO: 900597 - protein, 179 aa, Homo sapiens
GCEPGVIGRGTAVAAGRGVGGSVGFCLTVGVRAVQLPAMAELDPFGAPAGAPGGPALGNGVAGAGEEDPAAAFLAQQESEIAGIENDEAFAILDGGAPGPQPHGEPPGGPDAVDGVMNGEYYQESNGPTDSYAAISQVDRLQSEPESIRKWREEQMERLEALDANSRKQEAEWTHEHRQ

SEQ ID NO: 900598 - protein, 183 aa, Homo sapiens; identical to SEQ ID NO: 900573

SEQ ID NO: 900599 - protein, 141 aa, Homo sapiens; identical to SEQ ID NO: 900570

SEQ ID NO: 900600 - protein, 141 aa, Homo sapiens; identical to SEQ ID NO: 900570

SEQ ID NO: 900601 - protein, 158 aa, Homo sapiens
MAELDPFGAPAGAPGGPALGNGVAGAGEEDPAAAFLAQQESEIAGIENDEAFAIPGDRAGGRATPPGWHPPKGPGQTGGPERPAPGGVRDAVDGVMKGEYYQESNGPTDSYAAISQVDRLQSEPESIRKWREEQMERLEALDANSRKQEAEWTHEHRQ

SEQ ID NO: 900602 - protein, 181 aa, Homo sapiens; identical to SEQ ID NO: 900588

SEQ ID NO: 900603 - protein, 186 aa, Homo sapiens
AGCSLFGSATPPRPTGYTGRASALPVSLLALVLLSQSAPQRWLPGVVSVGRLVFVSPLVSVPFSCPPWLSWIRSAPLPAPLAVPRWGTEWPAPAKKTRLRPSWRSKRARLRASRTTRPSPSWTAAPPGPSRTASRRGVRMPILGSKKQSGHTNTGNKGARRMVCKTGRAATENKSKQQGSRRSLCK

SEQ ID NO: 900604 - protein, 141 aa, Homo sapiens; identical to SEQ ID NO: 900570

SEQ ID NO: 900605 - protein, 141 aa, Homo sapiens; identical to SEQ ID NO: 900570

SEQ ID NO: 900606 - protein, 141 aa, Homo sapiens; identical to SEQ ID NO: 900570

SEQ ID NO: 900607 - protein, 119 aa, Homo sapiens
MAELDPFGAPAGAPGGPALGNGVAGAGEEDPAAAFLAQQESEIAGIENDEAFAILDGGAPGPQPHGEPPGGPDAVDGVMNGEYYQESNGPTDSYAAISQVDRLQSEPESIRKWREASQE

SEQ ID NO: 900608 - protein, 91 aa, Homo sapiens
AGCSLFGSATPPRPTGYTGRASALPVSLLALVLLSQSAPQRWLPGVVSVGRLVFVSPLVSVPFSCPPWLSWIRSAPLPAPLCCVPAAVCEL

SEQ ID NO: 900609 - protein, 318 aa, Homo sapiens
MGHESDVVWGGSDRAQWAMEFPFDVDALFPERITVLDQHLRPPARRPGTTTPARVDLQQQIMTIIDELGKASAKAQNLSAPITSASRMQSNRHVVYILKDSSARPAGKGAIIGFIKVGYKKLFVLDDREAHNEVEPLCILDFYIHESVQRHGHGRELFQYMLQKERVEPHQLAIDRPSQKLLKFLNKHYNLETTVPQVNNFVIFEGFFAHQHPPARKLPPKRAEGDIKPYSSSDREFLKVAVEPPWPLNRAPRRATPPAHPPPRSSSLGNSPERGPLRPFVPEQELLRSLRLCPPHPTARLLLAADPGGSPAQRRRTR

SEQ ID NO: 900610 - protein, 210 aa, Homo sapiens
MSPPLPAPARKLPPKRAEGDIKPYSSSDREFLKVAVEPPWPLNRAPRRATPPAHPPPRSSSLGNSPERGPLRPFVPEQELLRSLRLCPPHPTARLLLAADPGGSPAQRRRTRGTPPGLVAQSCCYSRHGGVNSSSPNTGNQDSKQGEQETKNRSASEEQALSQDGSGEKPMHTAPPQAPAPPAQSWTVGGDILNARFIRNLQERRSTRPW

SEQ ID NO: 900611 - protein, 351 aa, Homo sapiens
MGHESDVVWGGSDRAQWAMEFPFDVDALFPERITVLDQHLRPPARRPGTTTPARVDLQQQIMTIIDELGKASAKAQNLSAPITSASRMQSNRHVVYILKDSSARPAGKGAIIGFIKVGYKKLFVLDDREAHNEVEPLCILDFYIHESVQRHGHGRELFQYMLQKERVEPHQLAIDRPSQKLLKFLNKHYNLETTVPQVNNFVIFEGFFAHQHRPPAPSLRATRHSRAAAVDPTPAAPARKLPPKRAEGDIKPYSSSDREFLKVAVEPPWPLNRAPRRATPPAHPPPRSSSLGNSPERGPLRPFVPEQELLRSLRLCPPHPTARLLLAADPGGSPAQRRRTSSLPRSEESRY

SEQ ID NO: 900612 - protein, 328 aa, Homo sapiens
MGHESDVVWGGSDRAQWAMEFPFDVDALFPERITVLDQHLRPPARRPGTTTPARVDLQQQIMTIIDELGKASAKAQNLSAPITSASRMQSNRHVVYILKDSSARPAGKGAIIGFIKVGYKKLFVLDDREAHNEVEPLCILDFYIHESVQRHGHGRELFQYMLQKERVEPHQLAIDRPSQKLLKFLNKHYNLETTVPQVNNFVIFEGFFAHQHPPARKLPPKRAEGDIKPYSSSDREFLKVAVEPPWPLNRAPRRATPPAHPPPRSSSLGNSPERGPLRPFVPEQELLRSLRLCPPHPTARLLLAADPGGSPAQRRRTSSLPRSEESRY

SEQ ID NO: 900613 - protein, 122 aa, Homo sapiens
MSPPLPAPARKLPPKRAEGDIKPYSSSDREFLKVAVEPPWPLNRAPRRATPPAHPPPRSSSLGNSPERGPLRPFVPEQELLRSLRLCPPHPTARLLLAADPGGSPAQRRRTSSLPRSEESRY

SEQ ID NO: 900614 - protein, 439 aa, Homo sapiens
MGHESDVVWGGSDRAQWAMEFPFDVDALFPERITVLDQHLRPPARRPGTTTPARVDLQQQIMTIIDELGKASAKAQNLSAPITSASRMQSNRHVVYILKDSSARPAGKGAIIGFIKVGYKKLFVLDDREAHNEVEPLCILDFYIHESVQRHGHGRELFQYMLQKERVEPHQLAIDRPSQKLLKFLNKHYNLETTVPQVNNFVIFEGFFAHQHRPPAPSLRATRHSRAAAVDPTPAAPARKLPPKRAEGDIKPYSSSDREFLKVAVEPPWPLNRAPRRATPPAHPPPRSSSLGNSPERGPLRPFVPEQELLRSLRLCPPHPTARLLLAADPGGSPAQRRRTRGTPPGLVAQSCCYSRHGGVNSSSPNTGNQDSKQGEQETKNRSASEEQALSQDGSGEKPMHTAPPQAPAPPAQSWTVGGDILNARFIRNLQERRSTRPW

SEQ ID NO: 900615 - protein, 273 aa, Homo sapiens
MGHESDVVWGGSDRAQWAMEFPFDVDALFPERITVLDQHLRPPARRPGTTTPARVDLQQQIMTIIDELGKASAKAQNLSAPITSASRMQSNRHVVYILKDSSARPAGKGAIIGFIKVGYKKLFVLDDREAHNEVEPLCILDFYIHESVQRHGHGRELFQYMLQKERVEPHQLAIDRPSQKLLKFLNKHYNLETTVPQVNNFVIFEGFFAHQHRPPAPSLRATRHSRAAAVDPTPAAPARKLPPKRAEGDIKPYSSSDRECKRGKGGVSGPGVP

SEQ ID NO: 900616 - protein, 341 aa, Homo sapiens
MGHESDVVWGGSDRAQWAMEFPFDVDALFPERITVLDQHLRPPARRPGTTTPARVDLQQQIMTIIDELGKASAKAQNLSAPITSASRMQSNRHVVYILKDSSARPAGKGAIIGFIKVGYKKLFVLDDREAHNEVEPLCILDFYIHESVQRHGHGRELFQYMLQKERVEPHQLAIDRPSQKLLKFLNKHYNLETTVPQVNNFVIFEGFFAHQHRPPAPSLRATRHSRAAAVDPTPAAPARKLPPKRAEGDIKPYSSSDREFLKVAVEPPWPLNRAPRRATPPAHPPPRSSSLGNSPERGPLRPFVPEQELLRSLRLCPPHPTARLLLAADPGGSPAQRRRTR

SEQ ID NO: 900617 - protein, 245 aa, Homo sapiens
MGHESDVVWGGSDRAQWAMEFPFDVDALFPERITVLDQHLRPPARRPGTTTPARVDLQQQIMTIIDELGKASAKAQNLSAPITSASRMQSNRHVVYILKDSSARPAGKGAIIGFIKVGYKKLFVLDDREAHNEVEPLCILDFYIHESVQRHGHGRELFQYMLQKERVEPHQLAIDRPSQKLLKFLNKHYNLETTVPQVNNFVIFEGFFAHQHRPPAPSLRATRHSRAAAVDPTPAGQACIEGVEL

SEQ ID NO: 900618 - protein, 93 aa, Homo sapiens
KSSRPHSLSTPAFPHMPDISTGNQDSKQGEQETKNRSASEEQALSQDGSGEKPMHTAPPQAPAPPAQSWTVGGDILNARFIRNLQERRSTRPW

SEQ ID NO: 900619 - protein, 298 aa, Homo sapiens
MWLTWPFCFLTITLREEGVCHLESVDLQQQIMTIIDELGKASAKAQNLSAPITSASRMQSNRHVVYILKDSSARPAGKGAIIGFIKVGYKKLFVLDDREAHNEVEPLCILDFYIHESVQRHGHGRELFQYMLQKERVEPHQLAIDRPSQKLLKFLNKHYNLETTVPQVNNFVIFEGFFAHQHPPARKLPPKRAEGDIKPYSSSDREFLKVAVEPPWPLNRAPRRATPPAHPPPRSSSLGNSPERGPLRPFVPEQELLRSLRLCPPHPTARLLLAADPGGSPAQRRRTSSLPRSEESRY

SEQ ID NO: 900620 - protein, 382 aa, Homo sapiens
MGHESDVVWGGSDRAQWAMEFPFDVDALFPERITVLDQHLRPPARRPGTTTPARVDLQQQIMTIIDELGKASAKAQNLSAPITSASRMQSNRHVVYILKDSSARPAGKGAIIGFIKVGYKKLFVLDDREAHNEVEPLCILDFYIHESVQRHGHGRELFQYMLQKERVEPHQLAIDRPSQKLLKFLNKHYNLETTVPQVNNFVIFEGFFAHQHRPPAPSLRATRHSRAAAVDPTPAAPARKLPPKRAEGDIKPYSSSDREFLKVAVEPPWPLNRAPRRATPPAHPPPRSSSLGNSPERGPLRPFVPEQELLRSLRLCPPHPTARLLLAADPGGSPAQRRRTRGTPPGLVAQSCCYSRHGGVNSSSPNTGNQDSKQGEQETKNR

SEQ ID NO: 900621 - protein, 243 aa, Homo sapiens
MGHESDVVWGGSDRAQWAMEFPFDVDALFPERITVLDQHLRPPARRPGTTTPARVDLQQQIMTIIDELGKASAKAQNLSAPITSASRMQSNRHVVYILKDSSARPAGKGAIIGFIKVGYKKLFVLDDREAHNEVEPLCILDFYIHESVQRHGHGRELFQYMLQKERVEPHQLAIDRPSQKLLKFLNKHYNLETTVPQVNNFVIFEGFFAHQHPPARKLPPKRAEGDIKPYSSSDREWGLPQVW

SEQ ID NO: 900622 - protein, 234 aa, Homo sapiens
MAAGIVASRRLRDLLTRRLTGSNYPGLSISLRLTGSSAQEAASGVALGEAPDHSYESLRVTSAQKHVLHVQLNRPNKRNAMNKVFWREMVECFNKISRDADCRAVVISGAGKMFTAGIDLMDMASDILQPKGDDVARISWYLRDIITRYQETFNVIERCPKPVIAAVHGGCIGGGVDLVTACDIRYCAQDAFFQVNGGGRGFGCRCRNTAAPAQGHREPEPGQRAGLHRPQDDG

SEQ ID NO: 900623 - protein, 139 aa, Homo sapiens
LRLGTRLGGLNRPRAFFQVKEVDVGLAADVGTLQRLPKVIGNQSLVNELAFTARKMMADEALGSGLVSRVFPDKEVMLDAALALAAEISSKSPVAVQSTKVNLLYSRDHSVAESLNYVGVLEHEHAADPRPREVGPGHD

SEQ ID NO: 900624 - protein, 86 aa, Homo sapiens
MMADEALGSGLVSRVFPDKEVMLDAALALAAEISSKSPVAVQSTKVNLLYSRDHSVAESLNYVASWNMSMLQTQKSKDPKRGIFYI

SEQ ID NO: 900625 - protein, 134 aa, Homo sapiens
YSRCRTGRAIRGHEGPESPKFRGLTGSNYPGLSISLRLTGSSAQEAASGVALGEAPDHSYESLRVTSAQKHVLHVQLNRPNKRNAMNKVFWREMVECFNKISRDADCRAVVISGAGKMFTAEVPDALHTPCQPS

SEQ ID NO: 900626 - protein, 234 aa, Homo sapiens; identical to SEQ ID NO: 900622

SEQ ID NO: 900627 - protein, 154 aa, Homo sapiens
MNKVFWREMVECFNKISRDADCRAVVISGAGKMFTAGIDLMDMASDILQPKGDDVARISWYLRDIITRYQETFNVIERCPKPVIAAVHGGCIGGGVDLVTACDIRYCAQDAFFQVNGGGRGFGCRCRNTAAPAQGHREPEPGQRAGLHRPQDDG

SEQ ID NO: 900628 - protein, 234 aa, Homo sapiens; identical to SEQ ID NO: 900622

SEQ ID NO: 900629 - protein, 146 aa, Homo sapiens
MVECFNKISRDADCRAVVISGAGKMFTAGIDLMDMASDILQPKGDDVARISWYLRDIITRYQETFNVIERCPKPVIAAVHGGCIGGGVDLVTACDIRYCAQDAFFQVNGGGRGFGCRCRNTAAPAQGHREPEPGQRAGLHRPQDDG

SEQ ID NO: 900630 - protein, 120 aa, Homo sapiens
MAAGIVASRRLRDLLTRRLTGSNYPGLSISLRLTGSSAQEAASGVALGEAPDHSYESLRVTSAQKHVLHVQLNRPNKRNAMNKVFWREMVECFNKISRDADCRAVVISGAGKMFTAAQRR

SEQ ID NO: 900631 - protein, 325 aa, Homo sapiens
MAAGIVASRRLRDLLTRRLTGSNYPGLSISLRLTGSSAQEAASGVALGEAPDHSYESLRVTSAQKHVLHVQLNRPNKRNAMNKVFWREMVECFNKISRDADCRAVVISGAGKMFTAGIDLMDMASDILQPKGDDVARISWYLRDIITRYQETFNVIERVTLGVWRGSFSIRASPGPALTPLFLFPPQCPKPVIAAVHGGCIGGGESAAILLLGCSPGGAAAPMPRPLASSLSSVMGQTVSQEAAPPPGSQGWFWWSFSIPGLYLLGVDLVTACDIRYCAQDAFFQVNGGGRGFGCRCRNTAAPAQGHREPEPGQRAGLHRPQDDG

SEQ ID NO: 900632 - protein, 234 aa, Homo sapiens; identical to SEQ ID NO: 900622

SEQ ID NO: 900633 - protein, 243 aa, Homo sapiens
MAAGIVASRRLRDLLTRRLTGSNYPGLSISLRLTGSSAQEAASGVALGEAPDHSYESLRVTSAQKHVLHVQLNRPNKRNAMNKVFWREMVECFNKISRDADCRAVVISGAGKMFTAGIDLMDMASDILQPKGDDVARISWYLRDIITRYQETFNVIERCPKPVIAAVHGGCIGGGVDLVTACDIRYCAQDAFFQVNGGGRGFGCRCRNTAAPAQGHREPEPAQLAGLYRPYTYRSLAFCHLYP

SEQ ID NO: 900634 - protein, 188 aa, Homo sapiens
MAAGIVASRRLRDLLTRRLTGSNYPGLSISLRLTGSSAQEAASGVALGEAPDHSYESLRVTSAQKHVLHVQLNRPNKRNAMNKVFWREMVECFNKISRDADCRAVVISGAGKMFTAGIDLMDMASDILQPKGDDVARISWYLRDIITRYQETFNVIERCPKPVIAAVHGGCIGGGPCPASSTEREDGR

SEQ ID NO: 900635 - protein, 108 aa, Homo sapiens
MNKVFWREMVECFNKISRDADCRAVVISGAGKMFTAGIDLMDMASDILQPKGDDVARISWYLRDIITRYQETFNVIERCPKPVIAAVHGGCIGGGPCPASSTEREDGR

SEQ ID NO: 900636 - protein, 91 aa, Homo sapiens
KASRGWVNRTRVIERCPKPVIAAVHGGCIGGGVDLVTACDIRYCAQDAFFQVNGGGRGFGCRCRNTAAPAQGHREPEPGQRAGLHRPQDDG

SEQ ID NO: 900637 - protein, 163 aa, Homo sapiens
MAAGIVASRRLRDLLTRRLTGSNYPGLSISLRLTGSSAQEAASGVALGEAPDHSYESLRVTSAQKHVLHVQLNRPNKRNAMNKVFWREMVECFNKISRDADCRAVVISGAGKMFTAGIDLMDMASDILQASWNMSMLQTQDLVKSVQATTENKELKTVTFSKL

SEQ ID NO: 900638 - protein, 234 aa, Homo sapiens; identical to SEQ ID NO: 900622

SEQ ID NO: 900639 - protein, 154 aa, Homo sapiens; identical to SEQ ID NO: 900627

SEQ ID NO: 900640 - protein, 146 aa, Homo sapiens; identical to SEQ ID NO: 900629

SEQ ID NO: 900641 - protein, 234 aa, Homo sapiens; identical to SEQ ID NO: 900622

SEQ ID NO: 900642 - protein, 154 aa, Homo sapiens
MAAGIVASRRLRDLLTRRLTGSNYPGLSISLRLTGSSAQEAASGVALGEAPDHSYESLRVTSAQKHVLHVQLNRPNKRCPKPVIAAVHGGCIGGGVDLVTACDIRYCAQDAFFQVNGGGRGFGCRCRNTAAPAQGHREPEPGQRAGLHRPQDDG

SEQ ID NO: 900643 - protein, 78 aa, Homo sapiens
KLSRYQQAWAQIKNVMLDAALALAAEISSKSPVAVQSTKVNLLYSRDHSVAESLNYVGVLEHEHAADPRPREVGPGHD

SEQ ID NO: 900644 - protein, 129 aa, Homo sapiens
MAAGIVASRRLRDLLTRRLTGSNYPGLSISLRLTGSSAQEAASGVALGEAPDHSYESLRVTSAQKHVLHVQLNRPNKRNAMNKVFWREMVECFNKISRDADCRAVVISGAGKMFTAEVPDALHTPCQPS

SEQ ID NO: 900645 - protein, 346 aa, Homo sapiens
GARVGKMALRLLRRAARGAAAAALLRLKASLAADIPRLGYSSSSHHKYIPRRAVLYVPGNDEKKIKKIPSLNVDCAVLDCEDGVAANKKNEARLRIVKTLEDIDLGPTEKCVRVNSVSSGLAEEDLETLLQSRVLPSSLMLPKVESPEEIQWFADKFSFHLKGRKLEQPMNLIPFVETAMGLLNFKAVCEETLKVGPQVGLFLDAVVFGGEDFRASIGATSSKETLDILYARQKIVVIAKAFGLQAVDLVYIDFRDGAGLLRQSREGAAMGFTGKQVIHPNQIAVVQEQFSPSPEKIKWAEELIAAFKEHQQLGKGAFTFQGSMIDMPLLKQAQNTVTLATSIKEK

SEQ ID NO: 900646 - protein, 346 aa, Homo sapiens; identical to SEQ ID NO: 900645

SEQ ID NO: 900647 - protein, 357 aa, Homo sapiens
GARVGKMALRLLRRAARGAAAAALLRLKASLAADIPRLGYSSSSHHKYIPRRAVLYVPGNDEKKIKKIPSLNVDCAVLDCEDGVAANKKNEARLRIVKTLEDIDLGPTEKCVRVNSVSSGLAEEDLETLLQSRVLPSSLMLPKVESPEEIQWFADKFSFHLKGRKLEQPMNLIPFVETAMGLLNFKAVCEETLKVGPQVGLFLDAVVFGGEDFRASIGVKDISLSLFLCATSSKETLDILYARQKIVVIAKAFGLQAVDLVYIDFRDGAGLLRQSREGAAMGFTGKQVIHPNQIAVVQEQFSPSPEKIKWAEELIAAFKEHQQLGKGAFTFQGSMIDMPLLKQAQNTVTLATSIKEK

SEQ ID NO: 900648 - protein, 346 aa, Homo sapiens; identical to SEQ ID NO: 900645

SEQ ID NO: 900649 - protein, 270 aa, Homo sapiens
GARVGKMALRLLRRAARGAAAAALLRLKASLAADIPRLGYSSSSHHKYIPRRAVLYVPGNDEKKIKKIPSLNVDCAVLDCEDGVAANKKNEARLRIVKTLEDIDLGPTEKCVRVNSVSSGLAEEDLETLLQSRVLPSSLMLPKVESPEEIQWFADKFSFHLKGRKLEQPMNLIPFVETAMGLLNFKAVCEETLKVGPQVGLFLDAVVFGGEDFRASIGVKDISLSLFLCVCVYMCVYIFSLPLKDGHLHNNVYLPTMTMVFHDNGMDTTS

SEQ ID NO: 900650 - protein, 346 aa, Homo sapiens; identical to SEQ ID NO: 900645

SEQ ID NO: 900651 - protein, 389 aa, Homo sapiens
GARVGKMALRLLRRAARGAAAAALLRLKASLAADIPRLGYSSSSHHKYIPRRAVLYVPGNDEKKIKKIPSLNVDCAVLDCEDGVAANKKNEARLRIVKTLEDIDLGPTEKCVRVNSVSSGLAEEDLETLLQSRVLPSSLMLPKVESPEEIQWFADKFSFHLKGRKLEQPMNLIPFVETAMGLLNFKAVCEETLKVGPQVGLFLDAVVFGGEDFRASIGATSSKETLDILYARQKIVVIAKAFGLQAVDLVYIDFRDGAGLLRQSREGAAMGFTGKQVIHPNQIAVVQEQFSPSPEKIKWAEELIAAFKEHQQLGKVGRYCCSWLCIQPFPSSPGQRSQSISRVPGRYWVLGARSWESKGAFTFQGSMIDMPLLKQAQNTVTLATSIKEK

SEQ ID NO: 900652 - protein, 312 aa, Homo sapiens
GARVGKMALRLLRRAARGAAAAALLRLKASLAADIPRLGYSSSSHHKYIPRRAVLYVPGNDEKKIKKIPSLNVDCAVLDCEDGVAANKKNEARLRIVKTLEDIDLGPTEKCVRVNSVSSGLAEEDLETLLQSRVLPSSLMLPKVESPEEIQWAVCEETLKVGPQVGLFLDAVVFGGEDFRASIGATSSKETLDILYARQKIVVIAKAFGLQAVDLVYIDFRDGAGLLRQSREGAAMGFTGKQVIHPNQIAVVQEQFSPSPEKIKWAEELIAAFKEHQQLGKGAFTFQGSMIDMPLLKQAQNTVTLATSIKEK

SEQ ID NO: 900653 - protein, 357 aa, Homo sapiens
GARVGKMALRLLRRAARGAAAAALLRLKASLAADIPRLGYSSSSHHKYIPRRAVLYVPGNDEKKIKKIPSLNVDCAVLDCEDGVAANKKNEARLRIVKTLEDIDLGPTEKCVRVNSVSSGLAEEDLETLLQSRVLPSSLMLPKVESPEEIQWFADKFSFHLKGRKLEQPMNLIPFVETAMGLLNFKAVCEETLKVGPQVGLFLDAVVFGGEDFRASIGATSSKETLDILYARQKIVVIAKAFGLQAVDLVYIDFRDGAGLLRQSREGAAMGFTGKQVIHPNQIAVVQEQFSPSPEKIKWAEELIAAFKEHQQLGKEVCILCFPGGLYFPREYDRHAITEAGPEHCYACHLHQGKMIC

SEQ ID NO: 900654 - protein, 1341 aa, Homo sapiens
QPLPSAALRRCPPPARVGGRWVSAEKVNEGGSGGGGSQRLTRRARSTARVPAPGTMDAPRASAAKPPTGRKMKARAPPPPGKAATLHVHSDQKPPHDGALGSQQNLVRMKEALRASTMDVTVVLPSGLEKRSVLNGSHAMMDLLVELCLQNHLNPSHHALEIRSSETQQPLSFKPNTLIGTLNVHTVFLKEKVPEEKVKPGPPKVPEKSVRLVVNYLRTQKAVVRVSPEVPLQNILPVICAKCEVSPEHVVLLRDNIAGEELELSKSLNELGIKELYAWDNRRETFRKSSLGNDETDKEKKKFLGFFKVNKRSNSKAEQLVLSGADSDEDTSRAAPGRGLNGCLTTPNSPSMHSRSLTLGPSLSLGSISGVSVKSEMKKRRAPPPPGSGPPVQDKASEKVSLGSQIDLQKKKRRAPAPPPPQPPPPSPLIPNRTEDKEENRKSTMVSLPLGSGSHCSPDGAPQVLSEAEETVSVGSCFASEDTTEDSGVMSSPSDIVSLDSQQDSMKYKDKWATDQEDCSDQDLAGTPDLGPQKSPLWEKNGSENSHLRTEKAVTASNDEEDLLIAGEFRKTLAELDEDLEEMEDSYETDTSSLTSSIHGASNHCPQDAMIPHGDTDAIPVTFIGEVSDDPVDSGLFSNRNNNAGSFDSEGVASRRDSLAPLQAEHSQPHEKAREEVPALHPASHDVGKGIRVALSNISKDGNLMETAPRVTSFASNLHTDNLNAKVKDKVYGCADGERTQATERVNSQPVNEKDSNDKNAALAPTSWHQRGQNPGKSYRLKHGLTTYKIIPPKSEMRCYDRDVSLSTGAIKIDELGNLVSPHATGIRIISLSSSVPEAESQPIGKVREFWRCNSVEKHLGRPSESSARGPPSTPVPTQTQNPESRLQADPKPISPQQKSAHHEGRNPLGEGRNQPPTMGMGHVRVPAAHTTEVTFLKPQRRTSSQYVASAIAKRIGAPKVHADVVRPHGYAEKGYAGKAPVLAAPPVTVKDDRTSSPHSETQGWKDGAQWPCVTPPNNHGEDLAVGAPPRGEVIGPHRKLSTQDRPAAIHRSSCFSLVQSSQRDRVSVGQSCGFSGKQSTSSQEASSASEPRRAPDGTDPPPPHTSDTQACSRELVNGSVRAPGHGEPSHPPGGSGTESHILLEREEKPSVFSTDGNETDSIWPPSIFGPKKKFKPVVQRPVPKDTSLHSALMEAIHSAGGKDRLRKTAEHTGEGRPAKLSYTEAEGERSALLAAIRGHSGTCSLRKVASSASEELQSFRDAALSAQGSESPLLEDLGLLSPPAIPPPPPPPSQALSAPRTASRFSTGTLSNTADARQALMDAIRSGTGAARLRKVPLLV

SEQ ID NO: 900655 - protein, 1323 aa, Homo sapiens
QPLPSAALRRCPPPARVGGRWVSAEKVNEGGSGGGGSQRLTRRARSTARVPAPGTMDAPRASAAKPPTGRKMKARAPPPPGKAATLHVHSDQKPPHDGALGSQQNLVRMKEALRASTMDVTVVLPSGLEKRSVLNGSHAMMDLLVELCLQNHLNPSHHALEIRSSETQQPLSFKPNTLIGTLNVHTVFLKEKVPEEKVKPGPPKVPEKSVRLVVNYLRTQKAVVRVSPEVPLQNILPVICAKCEVSPEHVVLLRDNIAGEELELSKSLNELGIKELYAWDNRRETFRKSSLGNDETDKEKKKFLGFFKVNKRSNSKAEQLVLSGADSDEDTSRAAPGRGLNGCLTTPNSPSMHSRSLTLGPSLSLGSISGVSVKSEMKKRRAPPPPGSGPPVQDKASEKVSLGSQIDLQKKKRRAPAPPPPQPPPPSPLIPNRTEDKEENRKSTMVSLPLGSGSHCSPDGAPQVLSEAEETVSVGSCFASEDTTEDSGVMSSPSDIVSLDSQQDSMKYKDKWATDQEDCSDQDLAGTPDLGPQKSPLWEKNGSENSHLRTEKAVTASNDEEDLLIAGEFRKTLAELDEDLEEMEDSYETDTSSLTSSIHGASNHCPQDAMIPHGDTDAIPVTFIGEVSDDPVDSGLFSNRNNNAGSFDSEGVASRRDSLAPLQAEHSQPHEKAREEVPALHPASHDVGKGIRVALSNISKDGNLMETAPRVTSFASNLHTDNLNAKVKDKVYGCADGERTQATERVNSQPVNEKDSNDKNAALAPTSWHQRGQNPGKSYRLKHGLTTYKIIPPKSEMRCYDRDVSLSTGAIKIDELGNLVSPHATGIRIISLSSSVPEAESQPIGKVREFWRCNSVEKHLGRPSESSARGPPSTPVPTQTQNPESRLQADPKPISPQQKSAHHEGRNPLGEGRNQPPTMGMGHVRVPAAHTTEVTFLKPQRRTSSQYVASAIAKRIGAPGKAPVLAAPPVTVKDDRTSSPHSETQGWKDGAQWPCVTPPNNHGEDLAVGAPPRGEVIGPHRKLSTQDRPAAIHRSSCFSLVQSSQRDRVSVGQSCGFSGKQSTSSQEASSASEPRRAPDGTDPPPPHTSDTQACSRELVNGSVRAPGHGEPSHPPGGSGTESHILLEREEKPSVFSTDGNETDSIWPPSIFGPKKKFKPVVQRPVPKDTSLHSALMEAIHSAGGKDRLRKTAEHTGEGRPAKLSYTEAEGERSALLAAIRGHSGTCSLRKVASSASEELQSFRDAALSAQGSESPLLEDLGLLSPPAIPPPPPPPSQALSAPRTASRFSTGTLSNTADARQALMDAIRSGTGAARLRKVPLLV

SEQ ID NO: 900656 - protein, 990 aa, Homo sapiens
MHSRSLTLGPSLSLGSISGVSVKSEMKKRRAPPPPGSGPPVQDKASEKVSLGSQIDLQKKKRRAPAPPPPQPPPPSPLIPNRTEDKEENRKSTMVSLPLGSGSHCSPDGAPQVLSEAEETVSVGSCFASEDTTEDSGVMSSPSDIVSLDSQQDSMKYKDKWATDQEDCSDQDLAGTPDLGPQKSPLWEKNGSENSHLRTEKAVTASNDEEDLLIAGEFRKTLAELDEDLEEMEDSYETDTSSLTSSIHGASNHCPQDAMIPHGDTDAIPVTFIGEVSDDPVDSGLFSNRNNNAGSFDSEGVASRRDSLAPLQAEHSQPHEKAREEVPALHPASHDVGKGIRVALSNISKDGNLMETAPRVTSFASNLHTDNLNAKVKDKVYGCADGERTQATERVNSQPVNEKDSNDKNAALAPTSWHQRGQNPGKSYRLKHGLTTYKIIPPKSEMRCYDRDVSLSTGAIKIDELGNLVSPHATGIRIISLSSSVPEAESQPIGKVREFWRCNSVEKHLGRPSESSARGPPSTPVPTQTQNPESRLQADPKPISPQQKSAHHEGRNPLGEGRNQPPTMGMGHVRVPAAHTTEVTFLKPQRRTSSQYVASAIAKRIGAPKVHADVVRPHGYAEKGYAGKAPVLAAPPVTVKDDRTSSPHSETQGWKDGAQWPCVTPPNNHGEDLAVGAPPRGEVIGPHRKLSTQDRPAAIHRSSCFSLVQSSQRDRVSVGQSCGFSGKQSTSSQEASSASEPRRAPDGTDPPPPHTSDTQACSRELVNGSVRAPGHGEPSHPPGGSGTESHILLEREEKPSVFSTDGNETDSIWPPSIFGPKKKFKPVVQRPVPKDTSLHSALMEAIHSAGGKDRLRKTAEHTGEGRPAKLSYTEAEGERSALLAAIRGHSGTCSLRKVASSASEELQSFRDAALSAQGSESPLLEDLGLLSPPAIPPPPPPPSQALSAPRTASRFSTGTLSNTADARQALMDAIRSGTGAARLRKVPLLV

SEQ ID NO: 900657 - protein, 803 aa, Homo sapiens
MSAPFSLVFPRTEKAVTASNDEEDLLIAGEFRKTLAELDEDLEEMEDSYETDTSSLTSSIHGASNHCPQDAMIPHGDTDAIPVTFIGEVSDDPVDSGLFSNRNNNAGSFDSEGVASRRDSLAPLQAEHSQPHEKAREEVPALHPASHDVGKGIRVALSNISKDGNLMETAPRVTSFASNLHTDNLNAKVKDKVYGCADGERTQATERVNSQPVNEKDSNDKNAALAPTSWHQRGQNPGKSYRLKHGLTTYKIIPPKSEMRCYDRDVSLSTGAIKIDELGNLVSPHATGIRIISLSSSVPEAESQPIGKVREFWRCNSVEKHLGRPSESSARGPPSTPVPTQTQNPESRLQADPKPISPQQKSAHHEGRNPLGEGRNQPPTMGMGHVRVPAAHTTEVTFLKPQRRTSSQYVASAIAKRIGAPKVHADVVRPHGYAEKGYAGKAPVLAAPPVTVKDDRTSSPHSETQGWKDGAQWPCVTPPNNHGEDLAVGAPPRGEVIGPHRKLSTQDRPAAIHRSSCFSLVQSSQRDRVSVGQSCGFSGKQSTSSQEASSASEPRRAPDGTDPPPPHTSDTQACSRELVNGSVRAPGHGEPSHPPGGSGTESHILLEREEKPSVFSTDGNETDSIWPPSIFGPKKKFKPVVQRPVPKDTSLHSALMEAIHSAGGKDRLRKTAEHTGEGRPAKLSYTEAEGERSALLAAIRGHSGTCSLRKVASSASEELQSFRDAALSAQGSESPLLEDLGLLSPPAIPPPPPPPSQALSAPRTASRFSTGTLSNTADARQALMDAIRSGTGAARLRKVPLLV

SEQ ID NO: 900658 - protein, 459 aa, Homo sapiens
QPLPSAALRRCPPPARVGGRWVSAEKVNEGGSGGGGSQRLTRRARSTARVPAPGTMDAPRASAAKPPTGRKMKARAPPPPGKAATLHVHSDQKPPHDGALGSQQNLVRMKEALRASTMDVTVVLPSGLEKRSVLNGSHAMMDLLVELCLQNHLNPSHHALEIRSSETQQPLSFKPNTLIGTLNVHTVFLKEKVPEEKVKPGPPKVPEKSVRLVVNYLRTQKAVVRVSPEVPLQNILPVICAKCEVSPEHVVLLRDNIAGEELELSKSLNELGIKELYAWDNRRETFRKSSLGNDETDKEKKKFLGFFKVNKRSNSKAEQLVLSGADSDEDTSRAAPGRGLNGCLTTPNSPSMHSRSLTLGPSLSLGSISGVSVKSEMKKRRAPPPPGSGPPVQDKASEKVSLGSQIDLQKKKRRAPAPPPPQPPPPSPLIPNRTEDKEENRKSTMVYCCASFPTQAKRF

SEQ ID NO: 900659 - protein, 1316 aa, Homo sapiens
QPLPSAALRRCPPPARVGGRWVSAEKVNEGGSGGGGSQRLTRRARSTARVPAPGTMDAPRASAAKPPTGRKMKARAPPPPGKAATLHVHSDQKPPHDGALGSQQNLVRMKEALRASTMDVTVVLPSGLEKRSVLNGSHAMMDLLVELCLQNHLNPSHHALEIRSSETQQPLSFKPNTLIGTLNVHTVFLKEKVPEEKVKPGPPKVPEKSVRLVVNYLRTQKAVVRVSPEVPLQNILPVICAKCEVSPEHVVLLRDNIAGEELELSKSLNELGIKELYAWDNRRETFRKSSLGNDETDKEKKKFLGFFKVNKRSNSKGCLTTPNSPSMHSRSLTLGPSLSLGSISGVSVKSEMKKRRAPPPPGSGPPVQDKASEKVSLGSQIDLQKKKRRAPAPPPPQPPPPSPLIPNRTEDKEENRKSTMVSLPLGSGSHCSPDGAPQVLSEAEETVSVGSCFASEDTTEDSGVMSSPSDIVSLDSQQDSMKYKDKWATDQEDCSDQDLAGTPDLGPQKSPLWEKNGSENSHLRTEKAVTASNDEEDLLIAGEFRKTLAELDEDLEEMEDSYETDTSSLTSSIHGASNHCPQDAMIPHGDTDAIPVTFIGEVSDDPVDSGLFSNRNNNAGSFDSEGVASRRDSLAPLQAEHSQPHEKAREEVPALHPASHDVGKGIRVALSNISKDGNLMETAPRVTSFASNLHTDNLNAKVKDKVYGCADGERTQATERVNSQPVNEKDSNDKNAALAPTSWHQRGQNPGKSYRLKHGLTTYKIIPPKSEMRCYDRDVSLSTGAIKIDELGNLVSPHATGIRIISLSSSVPEAESQPIGKVREFWRCNSVEKHLGRPSESSARGPPSTPVPTQTQNPESRLQADPKPISPQQKSAHHEGRNPLGEGRNQPPTMGMGHVRVPAAHTTEVTFLKPQRRTSSQYVASAIAKRIGAPKVHADVVRPHGYAEKGYAGKAPVLAAPPVTVKDDRTSSPHSETQGWKDGAQWPCVTPPNNHGEDLAVGAPPRGEVIGPHRKLSTQDRPAAIHRSSCFSLVQSSQRDRVSVGQSCGFSGKQSTSSQEASSASEPRRAPDGTDPPPPHTSDTQACSRELVNGSVRAPGHGEPSHPPGGSGTESHILLEREEKPSVFSTDGNETDSIWPPSIFGPKKKFKPVVQRPVPKDTSLHSALMEAIHSAGGKDRLRKTAEHTGEGRPAKLSYTEAEGERSALLAAIRGHSGTCSLRKVASSASEELQSFRDAALSAQGSESPLLEDLGLLSPPAIPPPPPPPSQALSAPRTASRFSTGTLSNTADARQALMDAIRSGTGAARLRKVPLLV

SEQ ID NO: 900660 - protein, 1294 aa, Homo sapiens
QPLPSAALRRCPPPARVGGRWVSAEKVNEGGSGGGGSQRLTRRARSTARVPAPGTMDAPRASAAKPPTGRKMKARAPPPPGKAATLHVHSDQKPPHDGALGSQQNLVRMKEALRASTMDVTVVLPSGLEKRSVLNGSHAMMDLLVELCLQNHLNPSHHALEIRSSETQQPLSFKPNTLIGTLNVHTVFLKEKVPEEKVKPGPPKVPEKSVRLVVNYLRTQKAVVRVSPEVPLQNILPVICAKCEVSPEHVVLLRDNIAGEELELSKSLNELGIKELYAWDNRRETFRKSSLGNDETDKEKKKFLGFFKVNKRSNSKAEQLVLSGADSDEDTSRAAPGRGLNGCLTTPNSPSMHSRSLTLGPSLSLGSISGVSVKSEMKKRRAPPPPGSGPPVQDKASEKVSLGSQIDLQKKKRRAPAPPPPQPPPPSPLIPNRTEDKEENRKSTMVSLPLGSGSHCSPDGAPQVLSEAEETVSVGSCFASEDTTEDSGVMSSPSDIVSLDSQQDSMKYKDKWATDQEDCSDQDLAGTPDLGPQKSPLWEKNGSENSHLRTEKAVTASNDEEDLLIAGEFRKTLAELDEDLEEMEDSYETDTSSLTSSIHGASNHCPQDAMIPHGDTDAIPVTFIGEVSDDPVDSGLFSNRNNNAGSFDSEGVASRRDSLAPLQAEHSQPHEKAREEVPALHPASHDVGKGIRVALSNISKDGNLMETAPRVTSFASNLHTDNLNAKVKDKVYGCADGERTQATERVNSQPVNEKDSNDKNAALAPTSWHQRGQNPGKSYRLKHGLTTYKIIPPKSEMRCYDRDVSLSTGAIKIDELGNLVSPHATGIRIISLSSSVPEAESQPIGKVREFWRCNSVEKHLGRPSESSARGPPSTPVPTQTQNPESRLQADPKPISPQQKSAHHEGRNPLGEGRNQPPTMGMGHVRVPAAHTTEVTFLKPQRRTSSQYVASAIAKRIGAPKVHADVVRPHGYAEKGYAGKAPVLAAPPVTVKDDRTSSPHSETQGWKDGAQWPCVTPPNNHGEDLAVGAPPRGEVIGPHRKLSTQDRPAAIHRSSCFSLVQSSQRDRVSVGQSCGFSGKQSTSSQEASSASEPRRAPDGTDPPPPHTSDTQACSRELVNGSVRAPGHGEPSHPPGGSGTESHILLEREEKPSVFSTDGNETDSIWPPSIFGPKKKFKPVVQRPVPKDTSLHSALMEAIHSAGGKDRLRKTAEHTGEGRPAKLSYTEAEGERSALLAAIRGHSGTCSLRKALSAPRTASRFSTGTLSNTADARQALMDAIRSGTGAARLRKVPLLV

SEQ ID NO: 900661 - protein, 1253 aa, Homo sapiens
QPLPSAALRRCPPPARVGGRWVSAEKVNEGGSGGGGSQRLTRRARSTARVPAPGTMDAPRASAAKPPTGRKMKARAPPPPGKAATLHVHSDQKPPHDGALGSQQNLVRMKEALRASTMDVTVVLPSGLEKRSVLNGSHAMMDLLVELCLQNHLNPSHHALEIRSSETQQPLSFKPNTLIGTLNVHTVFLKEKVPEEKVKPGPPKVPEKSVRLVVNYLRTQKAVVRVSPEVPLQNILPVICAKCEVSPEHVVLLRDNIAGEELELSKSLNELGIKELYAWDNRRETFRKSSLGNDETDKEKKKFLGFFKVNKRSNSKAEQLVLSGADSDEDTSRAAPGRGLNGCLTTPNSPSMHSRSLTLGPSLSLGSISGVSVKSEMKKRRAPPPPGSGPPVQDKASEKVSLGSQIDLQKKKRRAPAPPPPQPPPPSPLIPNRTEDKEENRKSTMVSLPLGSGSHCSPDGAPQVLSEAEETVSVGSCFASEDTTEDSGVMSSPSDIVSLDSQQDSMKYKDKWATDQEDCSDQDLAGTPDLGPQKSPLWEKNGSENSHLRTEKAVTASNDEEDLLIAGEFRKTLAELDEDLEEMEDSYETDTSSLTSSIHGASNHCPQDAMIPHGDTDAIPVTFIGEVSDDPVDSGLFSNRNNNAGSFDSEGVASRRDSLAPLQAEHSQPHEKAREEVPALHPASHDVGKGIRVALSNISKDGNLMETAPRVTSFASNLHTDNLNAKVKDKVYGCADGERTQATERVNSQPVNEKDSNDKNAALAPTSWHQRGQNPGKSYRLKHGLTTYKIIPPKSEMRCYDRDVSLSTGAIKIDELGNLVSPHATGIRIISLSSSVPEAESQPIGKVREFWRCNSVEKHLGRPSESSARGPPSTPVPTQTQNPESRLQADPKPISPQQKSAHHEGRNPLGEGRNQPPTMGMGHVRVPAAHTTEVTFLKPQRRTSSQYVASAIAKRIGAPKVHADVVRPHGYAEKGYAGKAPVLAAPPVTVKDDRTSSPHSETQGWKDGAQWPCVTPPNNHGEDLAVGAPPRGEVIGPHRKLSTQDRPAAIHRSSCFSLVQSSQRDRVSVGQSCGFSGKQSTSSQEASSASEPRRAPDGTDPPPPHTSDTQACSRELVNGSVRAPGHGEPSHPPGGSGTESHILLEREEKPSVFSTDGNETDSIWPPSIFGPKKKFKPVVQRPVPKDTSLHSALMEAIHSAGGKDRLRKTAEHTGEGRPAKLSYTEAEGERSALLAAIRGHSGTCSLRKVPLLV

SEQ ID NO: 900662 - protein, 72 aa, Homo sapiens
VPLTSGLCILLVVLPWQLLRGSWSVRRSVRTALITASFLQVKGTGKGVPGVLLQEWLCTELSSTRRSASWAY

SEQ ID NO: 900663 - protein, 447 aa, Homo sapiens
QPLPSAALRRCPPPARVGGRWVSAEKVNEGGSGGGGSQRLTRRARSTARVPAPGTMDAPRASAAKPPTGRKMKARAPPPPGKAATLHVHSDQKPPHDGALGSQQNLVRMKEALRASTMDVTVVLPSGLEKRSVLNGSHAMMDLLVELCLQNHLNPSHHALEIRSSETQQPLSFKPNTLIGTLNVHTVFLKEKVPEEKVKPGPPKVPEKSVRLVVNYLRTQKAVVRVSPEVPLQNILPVICAKCEVSPEHVVLLRDNIAGEELELSKSLNELGIKELYAWDNRRETFRKSSLGNDETDKEKKKFLGFFKVNKRSNSKAEQLVLSGADSDEDTSRAAPGRGLNGCLTTPNSPSMHSRSLTLGPSLSLGSISGVSVKSEMKKRRAPPPPGSGPPVQDKASEKVSLGSQIDLQKKKRRAPAPPPPQPPPPSPLIPNRTEDKEENRKSTMGE

SEQ ID NO: 900664 - protein, 455 aa, Homo sapiens [sequence omitted]

SEQ ID NO: 900665 - protein, 807 aa, Homo sapiens
MMDSPFLELWQSKAVSIREQLGLGDRPNDSYCYNSAKNSTVLQGVTFGGIPTVLLIDVSCFLFLILVFSIIRRRFWDYGRIALVSEADSESRFQRLSSTSSSGQQDFENELGCCPWLTAIFRLHDDQILEWCGEDAIHYLSFQRHIIFLLVVVSFLSLCVILPVNLSGDLLDKDPYSFGRTTIANLQTDNDLLWLHTIFAVIYLFFTVGFMRHHTQSIKYKEENLVRRTLFITGLPRDARKETVESHFRDAYPTCEVVDVQLCYNVAKLIYLCKEKKKTEKSLTYYTNLQVKTGQRTLINPKPCGQFCCCEVLGCEWEDAISYYTRMKDRLLERITEEERHVQDQPLGMAFVTFQEKSMATYILKDFNACKCQSLQCKGEPQPSSHSRELYTSKWTVTFAADPEDICWKNLSIQGLRWWLQWLGINFTLFLGLFFLTTPSIILSTMDKFNVTKPIHALNNPIISQFFPTLLLWSFSALLPSIVYYSTLLESHWTKSGENQIMMTKVYIFLIFMVLILPSLGLTSLDFFFRWLFDKTSSEASIRLECVFLPDQGAFFVNYVIASAFIGNGMELLRLPGLILYTFRMIMAKTAADRRNVKQNQAFQYEFGAMYAWMLCVFTVIVAYSITCPIIAPFGLIYILLKHMVDRHNLYFVYLPAKLEKGIHFAAVNQALAAPILCLFWLYFFSFLRLGMKAPATLFTFLVLLLTILVCLAHTCFGCFKHLSPLNYKTEEPASDKGSEAEAHMPPPFTPYVPRILNGLASERTALSPQQQQQQTYGAIHNISGTIPGQCLAQSATGSVAAAPQEA

SEQ ID NO: 900666 - protein, 807 aa, Homo sapiens; identical to SEQ ID NO: 900665

SEQ ID NO: 900667 - protein, 204 aa, Homo sapiens [sequence omitted]

SEQ ID NO: 900668 - protein, 807 aa, Homo sapiens; identical to SEQ ID NO: 900665

SEQ ID NO: 900669 - protein, 107 aa, Homo sapiens [sequence omitted]

SEQ ID NO: 900670 - protein, 414 aa, Homo sapiens
SELAEESQERGEIARLPPPEPASRDRAMWLEILLTSVLGFAIYWFISRDKEETLPLEDGWWGPGTRSAAREDDSIRPFKVETSDEEIHDLHQRIDKFRFTPPLEDSCFHYGFNSNYLKKVISYWRNEFDWKKQVEILNRHPHFKTKIEGLDIHFIHVKPPQLPAGHTPKPLLMVHGWPGSFYEFYKIIPLLTDPKNHGLSDEHVFEVICPSIPGYGFSEASSKKGFNSVATARIFYKLMLRLGFQEFYIQGGDWGSLICTNMAQLVPSHVKGLHLNMALVLSNFSTLTLLLGQRFGRFLGLTERDVELLYPVKEKVFYSLMRESGYMHIQCTKPDTVGSALNDSPVGLAAYILEKFSTWTNTEFRYLEDGGLERDVLGEQLRLLKGRKVAPTNHVGIGDELWVLEPHPLFRRVQ

SEQ ID NO: 900671 - protein, 387 aa, Homo sapiens
MWLEILLTSVLGFAIYWFISRDKEETLPLEDGWWGPGTRSAAREDDSIRPFKVETSDEEIHDLHQRIDKFRFTPPLEDSCFHYGFNSNYLKKVISYWRNEFDWKKQVEILNRHPHFKTKIEGLDIHFIHVKPPQLPAGHTPKPLLMVHGWPGSFYEFYKIIPLLTDPKNHGLSDEHVFEVICPSIPGYGFSEASSKKGFNSVATARIFYKLMLRLGFQEFYIQGGDWGSLICTNMAQLVPSHVKGLHLNMALVLSNFSTLTLLLGQRFGRFLGLTERDVELLYPVKEKVFYSLMRESGYMHIQCTKPDTVGSALNDSPVGLAAYILEKFSTWTNTEFRYLEDGGLERDVLGEQLRLLKGRKVAPTNHVGIGDELWVLEPHPLFRRVQ

SEQ ID NO: 900672 - protein, 212 aa, Homo sapiens
MTQKHERMKVYVPTGFEASSKKGFNSVATARIFYKLMLRLGFQEFYIQGGDWGSLICTNMAQLVPSHVKGLHLNMALVLSNFSTLTLLLGQRFGRFLGLTERDVELLYPVKEKVFYSLMRESGYMHIQCTKPDTVGSALNDSPVGLAAYILEKFSTWTNTEFRYLEDGGLERDVLGEQLRLLKGRKVAPTNHVGIGDELWVLEPHPLFRRVQ

SEQ ID NO: 900673 - protein, 107 aa, Homo sapiens [sequence omitted]

SEQ ID NO: 900674 - protein, 107 aa, Homo sapiens [sequence omitted]

SEQ ID NO: 900675 - protein, 482 aa, Homo sapiens
SELAEESQERGEIARLPPPEPASRDRAMWLEILLTSVLGFAIYWFISRDKEETLPLEDGWWGPGTRSAAREDDSIRPFKVETSDEEIHDLHQRIDKFRFTPPLEDSCFHYGFNSNYLKKVISYWRNEFDWKKQVEILNRHPHFKTKIEGLDIHFIHVKPPQLPAGHTPKPLLMVHGWPGSFYEFYKIIPLLTDPKNHGLSDEHVFEVICPSIPGYGFSEASSKKGFNSVATARIFYKLMLRLGFQEFYIQGGDWGSLICTNMAQLVPSHVKGLHLNMALVLSNFSTLTLLLGQRFGRFLGLTERDVELLYPVKEKVFYSLMRESGYMHIQCTKPDTVGSALNDSPVGLAAYILEKFSTWTNTEFRYLEDGGLERKFSLDDLLTNVMLYWTTGTIISSQRFYKENLGQGWMTQKHERMKVYVPTGFSAFPFELLHTPEKWVRFKYPKLISYSYMVRGGHFAAFEEPELLAQDIRKFLSVLERQ

SEQ ID NO: 900676 - protein, 807 aa, Homo sapiens; identical to SEQ ID NO: 900665

SEQ ID NO: 900677 - protein, 715 aa, Homo sapiens
MVLLTHHPWDLSVVFPSPPSATHTHFQPAQPMFVYQAVGVWAAATEWVILADPLELMWPGPTAGLFPAALDPSCWLHVPALPQGRWRHPPFRHLLWATDPSVCGSPPSHKCKAVGKTPGARWGAHCSGELDPGEWLFTVALGMGLRLSCLWSQCHLALGAAQGGSGEGCGKVSSHCPRHCDTRNGLTQDFLPPADTGAGGKGKASEAGVEGLLGSLREVKGGKAVTFEMVRVEVGALRREAWEQAMCNVVYCYTWAWGKSDQNEKLSHWPGSSTDQSSSLTGRVEGDGPMEEQCVALSFLICKMGIVLPLLLVVARIKQNSPHTVLAWHLLHSVTHNTLITTKQRSYATASHSYSVPTCHMCAGNLSSLGLAVATFPCSILKDFNACKCQSLQCKGEPQPSSHSRELYTSKWTVTFAADPEDICWKLLDQGEVGERPGFLVGAAHHLEHRCDLAVNGDLHTSAILWAVMLCCARCGPTGVSAQPFPPVFLPSIQVLPSRNIMPVLHLILNFLIAMLKKEKETVEINFNNVSRPIYPNCYFNMQFLKNVRCFTFSFSHLVFNIWCVFYTSSTSQFTPATFKMLSSRMQLVQPYLGPVSAWGRAGELSCVHGGPGEPPVLLLRVRAPSASPSAAACPALPQLLAQNELEVLPSARFYVLPLTVLLFGSQGFLNSGLLCGSVLWDERPGQVQAMPSLLCPCLPPSCTPATAPLGRMCR

SEQ ID NO: 900678 - protein, 807 aa, Homo sapiens; identical to SEQ ID NO: 900665

SEQ ID NO: 900679 - protein, 807 aa, Homo sapiens; identical to SEQ ID NO: 900665

SEQ ID NO: 900680 - protein, 807 aa, Homo sapiens; identical to SEQ ID NO: 900665

SEQ ID NO: 900681 - protein, 1049 aa, Homo sapiens
MYFAGGQSETLSLNKTKQNKSPLCIKFQNFPLLEDKRQREERSPLAQKPAARSLCHPFPWIRGHVSCLGCFLFQRCLLPPSLPGHRDAYPTCEVVDVQLCYNVAKLIYLCKEKKKTEKSLTYYTNLQVKTGQRTLINPKPCGQFCCCEVLGCEWEDAISYYTRMKDRLLERITEEERHVQDQPLGMAFVTFQEKSMATYECRHIQTPSWLTPCSPPDNSLSLSSGDGTADPPSLGFICGVSFSSLSYPHSLSASPAHVCVTGGGGVGSSQEWVILADPLELMWPGPTAGLFPAALDPSCWLHVPALPQGRWRHPPFRHLLWATDPSVCGSPPSHKCKAVGKTPGARWGAHCSGELDPGEWLFTVALGMGLRLSCLWSQCHLALGAAQGGSGEGCGKVSSHCPRHCDTRNGLTQDFLPPADTGAGGKGKASEAGVEGLLGSLREVKGGKAVTFEMVRVEVGALRREAWEQAMCNVVYCYTWAWGKSDQNEKLSHWPGSSTDQSSSLTGRVEGDGPMEEQCVALSFLICKMGIVLPLLLVVARIKQNSPHTVLAWHLLHSVTHNTLITTKQRSYATASHSYSVPTCHMCAGNLSSLGLAVATFPCSILKDFNACKCQSLQCKGEPQPSSHSRELYTSKWTVTFAADPEDICWKNLSIQGLRWWLQWLGINFTLFLGLFFLTTPSIILSTMDKFNVTKPIHALNNPIISQFFPTLLLWSFSALLPSIVYYSTLLESHWTKSGENQIMMTKVYIFLIFMVLILPSLGLTSLDFFFRWLFDKTSSEASIRLECVFLPDQGAFFVNYVIASAFIGNGMELLRLPGLILYTFRMIMAKTAADRRNVKQNQAFQYEFGAMYAWMLCVFTVIVAYSITCPIIAPFGLIYILLKHMVDRHNLYFVYLPAKLEKGIHFAAVNQALAAPILCLFWLYFFSFLRLGMKAPATLFTFLVLLLTILVCLAHTCFGCFKHLSPLNYKTEEPASDKGSEAEAHMPPPFTPYVPRILNGLASERTALSPQQQQQQTYGAIHNISGTIPGQCLAQSATGSVAAAPQEA

SEQ ID NO: 900682 - protein, 103 aa, Homo sapiens
PDSSSWGTLGSLPSSIGPWGPGEVLCLGPYREPTTSRVSVGEGCSPRPSRSLSHWQRGERLGPQVVLAEEGGVGSHRGALMDGEPVLGVWGEIKAGGSPLGRT

SEQ ID NO: 900683 - protein, 91 aa, Homo sapiens
MVHGWPGSFYEFYKIIPLLTDPKNHGLSDEHVFEVICPSIPGYGFSEASSKKGTGLLRFHNCPVLAKGGPGVPTRLSFRRGEQGVGPRKLG

SEQ ID NO: 900684 - protein, 91 aa, Homo sapiens
LQGLLCFLETDFALVLCPSHPSQLGVLNLLQDLHQRIDKFRFTPPLEDSCFHYGFNSNYLKKVISYWRNEFDWKKQVEILNRHPHFKTKIE

SEQ ID NO: 900685 - protein, 125 aa, Homo sapiens
MGPLCKQSWPAPPCWQRHGRPAGDEATGQGYAAPDQWHRPTPPSAGAAWSRGSTGHRCGGKSASRESLSEKAQISPGPPGQRTGTGRGYRGAKAPGSCARSLDLLFHILPLPTPTASGLYLGAPW

SEQ ID NO: 900686 - protein, 807 aa, Homo sapiens; identical to SEQ ID NO: 900665

SEQ ID NO: 900687 - protein, 727 aa, Homo sapiens
MYFAGGQSETLSLNKTKQNKSPLCIKFQNFPLLEDKRQREERSPLAQKPAARSLCHPFPWIRGHVSCLGCFLFQRCLLPPSLPGHRDAYPTCEVVDVQLCYNVAKLIYLCKEKKKTEKSLTYYTNLQVKTGQRTLINPKPCGQFCCCEVLGCEWEDAISYYTRMKDRLLERITEEERHVQDQPLGMAFVTFQEKSMATYECRHIQTPSWLTPCSPPDNSLSLSSGDGTADPPSLGFICGVSFSSLSYPHSLSASPAHVCVTGGGGVGSSQEWVILADPLELMWPGPTAGLFPAALDPSCWLHVPALPQGRWRHPPFRHLLWATDPSVCGSPPSHKCKAVGKTPGARWGAHCSGELDPGEWLFTVALGMGLRLSCLWSQCHLALGAAQGGSGEGCGKVSSHCPRHCDTRNGLTQDFLPPADTGAGGKGKASEAGVEGLLGSLREVKGGKAVTFEMVRVEVGALRREAWEQAMCNVVYCYTWAWGKSDQNEKLSHWPGSSTDQSSSLTGRVEGDGPMEEQCVALSFLICKMGIVLPLLLVVARIKQNSPHTVLAWHLLHSVTHNTLITTKQRSYATASHSYSVPTCHMCAGNLSSLGLAVATFPCSILKDFNACKCQSLQCKGEPQPSSHSRELYTSKWTVTFAADPEDICWKNLSIQGLRWWLQWLGINFTLFLGLFFLTTPSIILSTMDKFNVTKPIHALNNISGTIPGQCLAQSATGSVAAAPQEA

SEQ ID NO: 900688 - protein, 807 aa, Homo sapiens; identical to SEQ ID NO: 900665

SEQ ID NO: 900689 - protein, 807 aa, Homo sapiens; identical to SEQ ID NO: 900665

SEQ ID NO: 900690 - protein, 807 aa, Homo sapiens; identical to SEQ ID NO: 900665

SEQ ID NO: 900691 - protein, 107 aa, Homo sapiens [sequence omitted]

SEQ ID NO: 900692 - protein, 101 aa, Homo sapiens
PSGIVWWGLTSCSRYPCARSRPDPLPRWSCRSSINPCVLLNVGQGKQIPDEGPAEALGGGEDLPAGMSLLLIWPQCTCFSLWTSHPFQAPFPCIFIAFLFA

SEQ ID NO: 900693 - protein, 482 aa, Homo sapiens; identical to SEQ ID NO: 900675

SEQ ID NO: 900694 - protein, 482 aa, Homo sapiens; identical to SEQ ID NO: 900675

SEQ ID NO: 900695 - protein, 482 aa, Homo sapiens; identical to SEQ ID NO: 900675

SEQ ID NO: 900696 - protein, 372 aa, Homo sapiens
SELAEESQERGEIARLPPPEPASRDRAMWLEILLTSVLGFAIYWFISRDKEETLPLEDGWWGPGTRSAAREDDSIRPFKVETSDEEIHDLHQRIDKFRFTPPLEDSCFHYGFNSNYLKKVISYWRNEFDWKKQVEILNRHPHFKTKIEGLDIHFIHVKPPQLPAGHTPKPLLMVHGWPGSFYEFYKIIPLLTDPKNHGLSDEHVFEVICPSIPGYGFSEASSKKGFNSVATARIFYKLMLRLGFQEFYIQGGDWGSLICTNMAQLVPSHVKGLHLNMALVLSNFSTLTLLLGQRFGRFLGLTERDVELLYPVKEKVFYSLMRESGYMHIQCTKPDTVDPLTPPSSLPNPQLRVVSNMALMINDFTLKAAGTQ

SEQ ID NO: 900697 - protein, 340 aa, Homo sapiens
SELAEESQERGEIARLPPPEPASRDRAMWLEILLTSVLGFAIYWFISRDKEETLPLEDGWWGPGTRSAAREDDSIRPFKVETSDEEIHDLHQRIDKFRFTPPLEDSCFHYGFNSNYLKKVISYWRNEFDWKKQVEILNRHPHFKTKIEGLDIHFIHVKPPQLPAGHTPKPLLMVHGWPGSFYEFYKIIPLLTDPKNHGLSDEHVFEVICPSIPGYGFSEASSKKGFNSVATARIFYKLMLRLGFQEFYIQGGDWGSLICTNMAQLVPSHVKGLHLNMALVLSNFSTLTLLLGQRFGRFLGLTERDVELLYPVKEKVFYSLMRESGYMHIQCTKPDTVALL

SEQ ID NO: 900698 - protein, 101 aa, Homo sapiens; identical to SEQ ID NO: 900692

SEQ ID NO: 900699 - protein, 113 aa, Homo sapiens
CSLGPLVFYEISQARLPPGGGQKSSQRQEGILEPKYRGGISSPGGRCVWGRPLRPLLSQLPRANSLLTPPEGEPGGNTGPTLGEDGAVMEPLAAPYPSWRMPLRSHSQGWKGR

SEQ ID NO: 900700 - protein, 169 aa, Homo sapiens
MLGGSGSHGRRSLAALSQIAYQRNDDDEEEAARERRRRARQERLRQKQEEESLGQVTDQVEVNAQNSVPDEEAKTTTTNTQVEGDDEAAFLERLARREERRQKRLQEALERQKEFDPTITDASLSLPSRRMQNDTAENETTEKEEKSESRQERYEIEERTSQSTEMWRC

SEQ ID NO: 900701 - protein, 395 aa, Homo sapiens [sequence omitted]

SEQ ID NO: 900702 - protein, 317 aa, Homo sapiens
MQETKIKGEKVEQKIEGKWVNEKKAQEDKLQTAVLKKQGEEKGTKVQAKREKLQEDKPTFKKEEIKDEKIKKDKEPKEEVKSFMDRKKGFTEVKSQNGEFMTHKLKHTENTFSRPGGRASVDTKEAEGAPQVEAGKRLEELRRRRGETESEEFEKLKQKQQEAALELEELKKKREERRKVLEEEEQRRKQEEADRKLREEEEKRRLKEEIERRRAEAAEKRQKMPEDGLSDDKKPFKCFTPKGSSLKIEERAEFLNKSVQKSSGVKSTHQAAIVSKIDSRLEQYTSAIEATSRVCGRKGMCFHPPLQQAHQIRKLLA

SEQ ID NO: 900703 - protein, 289 aa, Homo sapiens
MQETKIKGEKVEQKIEGKWVNEKKAQEDKLQTAVLKKQGEEKGTKVQAKREKLQEDKPTFKKEEIKDEKIKKDKEPKEEVKSFMDRKKGFTEVKSQNGEFMTHKLKHTENTFSRPGGRASVDTKEAEGAPQVEAGKRLEELRRRRGETESEEFEKLKQKQQEAALELEELKKKREERRKVLEEEEQRRKQEEADRKLREEEEKRRLKEEIERRRAEAAEKRQKMPEDGLSDDKKPFKCFTPKGSSLKIEERAEFLNKSVQKSSGVKSTHQAAIVSKIDSRLEQYTSAIE

SEQ ID NO: 900704 - protein, 395 aa, Homo sapiens [sequence omitted]

SEQ ID NO: 900705 - protein, 405 aa, Homo sapiens
MQETKIKGEKVEQKIEGKWVNEKKAQEDKLQTAVLKKQGEEKGTKVQAKREKLQEDKPTFKKEEIKDEKIKKDKEPKEEVKSFMDRKKGFTEVKSQNGEFMTHKLKHTENTFSRPGGRASVDTKEAEGAPQVEAGKRLEELRRRRGETESEEFEKLKQKQQEAALELEELKKKREERRKVLEEEEQRRKQEEADRKLREEEEKRRLKEEIERRRAEAAEKRQKMPEDGLSDDKKPFKCFTPKGSSLKIEERAEFLNKSVQKSSGVKSTHQAAIVSKIDSRLEQYTSAIEGTKSAKPTKPAASDLPVPAEGVRNIKSMWEKGNVFSSPTAAGTPNKETAGLKVGVSSRINEWLTKTPDGNKSPAPKPSDLRPGDVSSKRNLWEKQSVDKVTSPTKEPVSKETHAVK

SEQ ID NO: 900706 - protein, 395 aa, Homo sapiens [sequence omitted]

SEQ ID NO: 900707 - protein, 405 aa, Homo sapiens; identical to SEQ ID NO: 900705

SEQ ID NO: 900708 - protein, 395 aa, Homo sapiens [sequence omitted]

SEQ ID NO: 900709 - protein, 395 aa, Homo sapiens [sequence omitted]

SEQ ID NO: 900710 - protein, 395 aa, Homo sapiens [sequence omitted]

SEQ ID NO: 900711 - protein, 395 aa, Homo sapiens [sequence omitted]

SEQ ID NO: 900712 - protein, 395 aa, Homo sapiens [sequence omitted]

SEQ ID NO: 900713 - protein, 374 aa, Homo sapiens
MQETKIKGEKVEQKIEGKWVNEKKAQEDKLQTAVLKKQGEEKGTKVQAKREKLQEDKPTFKKEEIKDEKIKKDKEPKEEVKSFMDRKKGFTEVKSQNGEFMTHKLKHTENTFSRPGGRASVDTKEAEGAPQVEAGKRLEELRRRRGETESEEFEKLKQKQQEAALELEELKKKREERRKVLEEEEQRRKQEEADRKLREEEEKRRLKEEIERRRAEAAEKRQKMPEDGLSDDKKPFKCFTPKGSSLKIEERAEFLNKSVQKSSGVKSTHQAAIVSKIDSRLEQYTSAIEGTKSAKPTKPAASDLPVPAEGVRNIKSMWEKGNVFSSPTAAGTPNKETAGLKVGVSSRINEWLTKTPDGNKSPAPKPSVSTFRFF

SEQ ID NO: 900714 - protein, 400 aa, Homo sapiens
MQETKIKGEKVEQKIEGKWVNEKKAQEDKLQTAVLKKQGEEKGTKVQAKREKLQEDKPTFKKEEIKDEKIKKDKEPKEEVKSFMDRKKGFTEVKSQNGEFMTHKLKHTENTFSRPGGRASVDTKEAEGAPQVEAGKRLEELRRRRGETESEEFEKLKQKQQEAALELEELKKKREERRKVLEEEEQRRKQEEADRKLREEEEKRRLKEEIERRRAEAAEKRQKMPEDGLSDDKKPFKCFTPKGSSLKIEERAEFLNKSVQKSSGVKSTHQAAIVSKIDSRLEQYTSAIEGTKSAKPTKPAASDLPVPAEGVRNIKSMWEKGNVFSSPTAAGTPNKETAGLKVGVSSRINEWLTKTPDGNKSPAPKPSDLRPGDVSSKRNLWEKQSVDKVTSPTKVIYWED

SEQ ID NO: 900715 - protein, 118 aa, Homo sapiens
MESHSVTQVGVQWRHLSSLQPPPPGFKQFSCRSLPSSWDYRHLPPSPGNFCIFSRDGVSPCWPGWSQTPDLDPPASASPSAGITGMSHLAWPINYDSDDRIVFKQENNQNVLAKVETT

SEQ ID NO: 900716 - protein, 481 aa, Homo sapiens
MDDFERRRELRRQKREEMRLEAERIAYQRNDDDEEEAARERRRRARQERLRQKQEEESLGQVTDQVEVNAQNSVPDEEAKTTTTNTQVEGDDEAAFLERLARREERRQKRLQEALERQKEFDPTITDASLSLPSRRMQNDTAENETTEKEEKSESRQERYEIEETETVTKSYQKNDWRDAEENKKEDKEKEEEEEEKPKRGSIGENQIKDEKIKKDKEPKEEVKSFMDRKKGFTEVKSQNGEFMTHKLKHTENTFSRPGGRASVDTKEAEGAPQVEAGKRLEELRRRRGETESEEFEKLKQKQQEAALELEELKKKREERRKVLEEEEQRRKQEEADRKLREEEEKRRLKEEIERRRAEAAEKRQKMPEDGLSDDKKPFKCFTPKGSSLKIEERAEFLNKSVQKSSGVKSTHQAAIVSKIDSRLEQYTSAIEGTKSAKPTKPAASDLPVPAEGVRNIKSMWEKGNVFSSPTAAGTPNKVSI

SEQ ID NO: 900717 - protein, 395 aa, Homo sapiens [sequence omitted]

SEQ ID NO: 900718 - protein, 395 aa, Homo sapiens [sequence omitted]

SEQ ID NO: 900719 - protein, 395 aa, Homo sapiens [sequence omitted]

SEQ ID NO: 900720 - protein, 395 aa, Homo sapiens [sequence omitted]

SEQ ID NO: 900721 - protein, 75 aa, Homo sapiens
SPTTTKFAAASTGVSSRINEWLTKTPDGNKSPAPKPSDLRPGDVSSKRNLWEKQSVDKVTSPTKEPVSKETHAVK

SEQ ID NO: 900722 - protein, 395 aa, Homo sapiens [sequence omitted]

SEQ ID NO: 900723 - protein, 395 aa, Homo sapiens [sequence omitted]

SEQ ID NO: 900724 - protein, 395 aa, Homo sapiens [sequence omitted]

SEQ ID NO: 900725 - protein, 395 aa, Homo sapiens [sequence omitted]

SEQ ID NO: 900726 - protein, 114 aa, Homo sapiens
GRLLLLNSRPRRRAAEERQRIKEEEKRAAEERQRIKEEEKRAAEERQRARAEEEEKAKVEEQKRNKQLEEKKHAMQETKIKGEKVEQKIEGKWVNEKKAQEDKLQTAVLKKQVQ

SEQ ID NO: 900727 - protein, 278 aa, Homo sapiens
MELGRGAYGVVEKMRHVPSGQIMAVKRIRATVNSQEQKRLLMDLDISMRTVDCPFTVTFYGALFREGDVWICMELMDTSLDKFYKQVIDKGQTIPEDILGKIAVSIVKALEHLHSKLSVIHRDVKPSNVLINALGQVKMCDFGISGYLVDSVAKTIDAGCKPYMAPERINPELNQKGYSVKSDIWSLGITMIELAILRFPYDSWGTPFQQLKQVVEEPSPQLPADKFSAEFVDFTSQCLKKNSKERPTYPELMQHPFFTLHESKGTDVASFVKLILGD

SEQ ID NO: 900728 - protein, 126 aa, Homo sapiens
MELGRGAYGVVEKMRHVPSGQIMAVKRIRATVNSQEQKRLLMDLDISMRTVDCPFTVTFYGALFREGDVWICMELMDTSLDKFYKQVIDKGQTIPEDILGKIAVSIVKALEHLHSKLSVIHRGKHP

SEQ ID NO: 900729 - protein, 334 aa, Homo sapiens
MSQSKGKKRNPGLKIPKEAFEQPQTSSTPPRDLDSKACISIGNQNFEVKADDLEPIMELGRGAYGVVEKMRHVPSGQIMAVKRIRATVNSQEQKRLLMDLDISMRTVDCPFTVTFYGALFREGDVWICMELMDTSLDKFYKQVIDKGQTIPEDILGKIAVSIVKALEHLHSKLSVIHRDVKPSNVLINALGQVKMCDFGISGYLVDSVAKTIDAGCKPYMAPERINPELNQKGYSVKSDIWSLGITMIELAILRFPYDSWGTPFQQLKQVVEEPSPQLPADKFSAEFVDFTSQCLKKNSKERPTYPELMQHPFFTLHESKGTDVASFVKLILGD

SEQ ID NO: 900730 - protein, 140 aa, Homo sapiens
MCDFGISGYLVDSVAKTIDAGCKPYMAPERINPELNQKGYSVKSDIWSLGITMIELAILRFPYDSWGTPFQQLKQVVEEPSPQLPADKFSAEFVDFTSQCLKKNSKERPTYPELMQHPFFTLHESKGTDVASFVKLILGD

SEQ ID NO: 900731 - protein, 334 aa, Homo sapiens; identical to SEQ ID NO: 900729

SEQ ID NO: 900732 - protein, 334 aa, Homo sapiens; identical to SEQ ID NO: 900729

SEQ ID NO: 900733 - protein, 278 aa, Homo sapiens; identical to SEQ ID NO: 900727

SEQ ID NO: 900734 - protein, 245 aa, Homo sapiens
MSQSKGKKRNPGLKIPKEAFEQPQTSSTPPRDLDSKACISIGNQNFEVKADDLEPIMELGRGAYGVVEKMRHVPSGQIMAVKRIRATVNSQEQKRLLMDLDISMRTVDCPFTVTFYGALFREGDVWICMELMDTSLDKFYKQVIDKGQTIPEDILGKIAVSIVKALEHLHSKLSVIHRDVKPSNVLINALGQVKMCDFGISGYLVDSVAKTIDAGCKPYMAPERINPELNQTSSLQSLLTLPHSA

SEQ ID NO: 900735 - protein, 290 aa, Homo sapiens
MVEAGVESGFCFFNSVAITAKLLQQKLNVGKVLIVDWDIHHGNGTQQAFYNDPSVLYISLHRYDNGNFFPGSGAPEEVGGGPGVGYNVNVAWTGGVDPPIGDVEYLTAFRTVVMPIAHEFSPDVVLVSAGFDAVEGHLSPLGGYSVTARCFGHLTRQLMTLAGGRVVLALEGGHDLTAICDASEACVSALLSVELQPLDEAVLQQKPNINAVATLEKVIEIQSKHWSCVQKFAAGLGRSLREAQAGETEEAETVSAMALLSVGAEQAQAAAAREHSPRPAEEPMEQEPAL

SEQ ID NO: 900736 - protein, 147 aa, Homo sapiens
DSPTAIQAPKRCKYLIECRPTTKSLNNKSSPNPGVIPRAEFGTSSALLSVELQPLDEAVLQQKPNINAVATLEKVIEIQSKHWSCVQKFAAGLGRSLREAQAGETEEAETVSAMALLSVGAEQAQAAAAREHSPRPAEEPMEQEPAL

SEQ ID NO: 900737 - protein, 1113 aa, Homo sapiens
MSGREPSLEILPRTSLHSIPVTVEVKPVLPRAMPSSMGGGGGGSPSPVELRGALVGSVDPTLREQQLQQELLALKQQQQLQKQLLFAEFQKQHDHLTRQHEVQLQKHLKQQQEMLAAKQQQEMLAAKRQQELEQQRQREQQRQEELEKQRLEQQLLILRNKEKSKESAIASTEVKLRLQEFLLSKSKEPTPGGLNHSLPQHPKCWGAHHASLDQSSPPQSGPPGTPPSYKLPLPGPYDSRDDFPLRKTASEPNLKVRSRLKQKVAERRSSPLLRRKDGTVISTFKKRAVEITGAGPGASSVCNSAPGSGPSSPNSSHSTIAENGFTGSVPNIPTEMLPQHRALPLDSSPNQFSLYTSPSLPNISLGLQATVTVTNSHLTASPKLSTQQEAERQALQSLRQGGTLTGKFMSTSSIPGCLLGVALEGDGSPHGHASLLQHVLLLEQARQQSTLIAVPLHGQSPLVTGERVATSMRTVGKLPRHRPLSRTQSSPLPQSPQALQQLVMQQQHQQFLEKQKQQQLQLGKILTKTGELPRQPTTHPEETEEELTEQQEVLLGEGALTMPREGSTESESTQEDLEEEDEEEDGEEEEDCIQVKDEEGESGAEEGPDLEEPGAGYKKLFSDAQPLQPLQVYQAPLSLATVPHQALGRTQSSPAAPGGMKSPPDQPVKHLFTTGVVYDTFMLKHQCMCGNTHVHPEHAGRIQSIWSRLQETGLLSKCERIRGRKATLDEIQTVHSEYHTLLYGTSPLNRQKLDSKKLLGPISQKMYAVLPCGGIGVDSDTVWNEMHSSSAVRMAVGCLLELAFKVAAGELKNGFAIIRPPGHHAEESTAMGFCFFNSVAITAKLLQQKLNVGKVLIVDWDIHHGNGTQQAFYNDPSVLYISLHRYDNGNFFPGSGAPEEVGGGPGVGYNVNVAWTGGVDPPIGDVEYLTAFRTVVMPIAHEFSPDVVLVSAGFDAVEGHLSPLGGYSVTARCFGHLTRQLMTLAGGRVVLALEGGHDLTAICDASEACVSALLSVELQPLDEAVLQQKPNINAVATLEKVIEIQSKHWSCVQKFAAGLGRSLREAQAGETEEAETVSAMALLSVGAEQAQAAAAREHSPRPAEEPMEQEPAL

SEQ ID NO: 900738 - protein, 1113 aa, Homo sapiens; identical to SEQ ID NO: 900737

SEQ ID NO: 900739 - protein, 1113 aa, Homo sapiens; identical to SEQ ID NO: 900737

SEQ ID NO: 900740 - protein, 708 aa, Homo sapiens
ALGYDAPGTRPRAVGVALEGDGSPHGHASLLQHVLLLEQARQQSTLIAVPLHGQSPLVTGERVATSMRTVGKLPRHRPLSRTQSSPLPQSPQALQQLVMQQQHQQFLEKQKQQQLQLGKILTKTGELPRQPTTHPEETEEELTEQQEVLLGEGALTMPREGSTESESTQEDLEEEDEEEDGEEEEDCIQVKDEEGESGAEEGPDLEEPGAGYKKLFSDAQPLQPLQVYQAPLSLATVPHQALGRTQSSPAAPGGMKSPPDQPVKHLFTTGVVYDTFMLKHQCMCGNTHVHPEHAGRIQSIWSRLQETGLLSKCERIRGRKATLDEIQTVHSEYHTLLYGTSPLNRQKLDSKKLLGPISQKMYAVLPCGGIGVDSDTVWNEMHSSSAVRMAVGCLLELAFKVAAGELKNGFAIIRPPGHHAEESTAMGFCFFNSVAITAKLLQQKLNVGKVLIVDWDIHHGNGTQQAFYNDPSVLYISLHRYDNGNFFPGSGAPEEVGGGPGVGYNVNVAWTGGVDPPIGDVEYLTAFRTVVMPIAHEFSPDVVLVSAGFDAVEGHLSPLGGYSVTARCFGHLTRQLMTLAGGRVVLALEGGHDLTAICDASEACVSALLSVELQPLDEAVLQQKPNINAVATLEKVIEIQSKHWSCVQKFAAGLGRSLREAQAGETEEAETVSAMALLSVGAEQAQAAAAREHSPRPAEEPMEQEPAL

SEQ ID NO: 900741 - protein, 1101 aa, Homo sapiens
MSGREPSLEILPRTSLHSIPVTVEVKPVLPRAMPSSMGGGGGGSPSPVELRGALVGSVDPTLREQQLQQELLALKQQQQLQKQLLFAEFQKQHDHLTRQHEVQLQKHLKQQQEMLAAKQQQEMLAAKRQQELEQQRQREQQRQEELEKQRLEQQLLILRNKEKSKESAIASTEVKLRLQEFLLSKSKEPTPGGLNHSLPQHPKCWGAHHASLDQSSPPQSGPPGTPPSYKLPLPGPYDSRDDFPLRKTASEPNLKVRSRLKQKVAERRSSPLLRRKDGTVISTFKKRAVEITGAGPGASSVCNSAPGSGPSSPNSSHSTIAENGFTGSVPNIPTEMLPQHRALPLDSSPNQFSLYTSPSLPNISLGLQATVTVTNSHLTASPKLSTQQEAERQALQSLRQGGTLTGKFMSTSSIPGCLLGVALEGDGSPHGHASLLQHVLLLEQARQQSTLIAVPLHGQSPLVTGERVATSMRTVGKLPRHRPLSRTQSSPLPQSPQALQQLVMQQQHQQFLEKQKQQQLQLGKILTKTGELPRQPTTHPEETEEELTEQQEVLLGEGALTMPREGSTESESTQEDLEEEDEEEDGEEEEDCIQVKDEEGESGAEEGPDLEEPGAGYKKLFSDAQPLQPLQVYQAPLSLATVPHQALGRTQSSPAAPGGMKSPPDQPVKHLFTTGVVYDTFMLKHQCMCGNTHVHPEHAGRIQSIWSRLQETGLLSKCERIRGRKATLDEIQTVHSEYHTLLYGTSPLNRQKLDSKKLLGPISQKMYAVLPCGGIGVDSDTVWNEMHSSSAVRMAVGCLLELAFKVAAGELKNGFAIIRPPGHHAEESTAMGFCFFNSVAITAKLLQQKLNVGKVLIVDWDIHHGNGTQQAFYNDPSVLYISLHRYDNGNFFPGSGAPEEVGGGPGVGYNVNVAWTGGVDPPIGDVEYLTAFRTVVMPIAHEFSPDVVLVSAGFDAVEGHLSPLGGYSVTARCFGHLTRQLMTLAGGRVVLALEGGHDLTAICDASEACVSALLSVELQPLDEAVLQQKPNINAVATLEKVIEIQSKHWSCVQKFAAGLGRSLREAQAGETEEAETVSAMALLSVGAEQAQAAAAREHSPR

SEQ ID NO: 900742 - protein, 872 aa, Homo sapiens
MSGREPSLEILPRTSLHSIPVTVEVKPVLPRAMPSSMGGGGGGSPSPVELRGALVGSVDPTLREQQLQQELLALKQQQQLQKQLLFAEFQKQHDHLTRQHEVQLQKHLKQQQEMLAAKQQQEMLAAKRQQELEQQRQREQQRQEELEKQRLEQQLLILRNKEKSKESAIASTEVKLRLQEFLLSKSKEPTPGGLNHSLPQHPKCWGAHHASLDQSSPPQSGPPGTPPSYKLPLPGPYDSRDDFPLRKTASEPNLKVRSRLKQKVAERRSSPLLRRKDGTVISTFKKRAVEITGAGPGASSVCNSAPGSGPSSPNSSHSTIAENGFTGSVPNIPTEMLPQHRALPLDSSPNQFSLYTSPSLPNISLGLQATVTVTNSHLTASPKLSTQQEAERQALQSLRQGGTLTGKFMSTSSIPGCLLGVALEGDGSPHGHASLLQHVLLLEQARQQSTLIAVPLHGQSPLVTGERVATSMRTVGKLPRHRPLSRTQSSPLPQSPQALQQLVMQQQHQQFLEKQKQQQLQLGKILTKTGELPRQPTTHPEETEEELTEQQEVLLGEGALTMPREGSTESESTQEDLEEEDEEEDGEEEEDCIQVKDEEGESGAEEGPDLEEPGAGYKKLFSDAQPLQPLQVYQAPLSLATVPHQALGRTQSSPAAPGGMKSPPDQPVKHLFTTGVVYDTFMLKHQCMCGNTHVHPEHAGRIQSIWSRLQETGLLSKCERIRGRKATLDEIQTVHSEYHTLLYGTSPLNRQKLDSKKLLGPISQKMYAVLPCGGIGVDSDTVWNEMHSSSAVRMAVGCLLELAFKVAAGELKNGFAIIRPPGHHAEESTAMGFCFFNSVAITAKLLQQKLNVGKVLIVDWVGSELVGLGRGG

SEQ ID NO: 900743 - protein, 817 aa, Homo sapiens
MSGREPSLEILPRTSLHSIPVTVEVKPVLPRAMPSSMGGGGGGSPSPVELRGALVGSVDPTLREQQLQQELLALKQQQQLQKQLLFAEFQKQHDHLTRQHEVQLQKHLKQQQEMLAAKQQQEMLAAKRQQELEQQRQREQQRQEELEKQRLEQQLLILRNKEKSKESAIASTEVKLRLQEFLLSKSKEPTPGGLNHSLPQHPKCWGAHHASLDQSSPPQSGPPGTPPSYKLPLPGPYDSRDDFPLRKTASEPNLKVRSRLKQKVAERRSSPLLRRKDGTVISTFKKRAVEITGAGPGASSVCNSAPGSGPSSPNSSHSTIAENGFTGSVPNIPTEMLPQHRALPLDSSPNQFSLYTSPSLPNISLGLQATVTVTNSHLTASPKLSTQQEAERQALQSLRQGGTLTGKFMSTSSIPGCLLGVALEGDGSPHGHASLLQHVLLLEQARQQSTLIAVPLHGQSPLVTGERVATSMRTVGKLPRHRPLSRTQSSPLPQSPQALQQLVMQQQHQQFLEKQKQQQLQLGKILTKTGELPRQPTTHPEETEEELTEQQEVLLGEGALTMPREGSTESESTQEDLEEEDEEEDGEEEEDCIQVKDEEGESGAEEGPDLEEPGAGYKKLFSDAQPLQPLQVYQAPLSLATVPHQALGRTQSSPAAPGGMKSPPDQPVKHLFTTGVVYDTFMLKHQCMCGNTHVHPEHAGRIQSIWSRLQETGLLSKCERIRGRKATLDEIQTVHSEYHTLLYGTSPLNRQKLDSKKLLGPISQKMYAVLPCGGIGVDSDTVWNEMHSSSAVRMAVGCLLELAFKVAAGELKVSVCL

SEQ ID NO: 900744 - protein, 175 aa, Homo sapiens
NKSSLQKNLVLEYFFLNLVEGHLSPLGGYSVTARCFGHLTRQLMTLAGGRVVLALEGGHDLTAICDASEACVSALLSVELQPLDEAVLQQKPNINAVATLEKVIEIQSKHWSCVQKFAAGLGRSLREAQAGETEEAETVSAMALLSVGAEQAQAAAAREHSPRPAEEPMEQEPAL

SEQ ID NO: 900745 - protein, 316 aa, Homo sapiens
MSGREPSLEILPRTSLHSIPVTVEVKPVLPRAMPSSMGGGGGGSPSPVELRGALVGSVDPTLREQQLQQELLALKQQQQLQKQLLFAEFQKQHDHLTRQHEVQLQKHLKQQQEMLAAKQQQEMLAAKRQQELEQQRQREQQRQEELEKQRLEQQLLILRNKEKSKESAIASTEVKLRLQEFLLSKSKEPTPGGLNHSLPQHPKCWGAHHASLDQSSPPQSGPPGTPPSYKLPLPGPYDSRDDFPLRKTASEPNLKVRSRLKQKVAERRSSPLLRRKDGTVISTFKKRAVEITGAGPGGKGCSHVPVLRVWESGVGG

SEQ ID NO: 900746 - protein, 90 aa, Homo sapiens
PDEALPYSVGPVGSGLREPVLCGLPDHLPFGLLPASGGPLPGMLLVPKAQGLVEMLQTIYETESCFSAMGCQVGNHPWKSCRGLLCTASL

SEQ ID NO: 900747 - protein, 191 aa, Homo sapiens
MLKHQCMCGNTHVHPEHAGRIQSIWSRLQETGLLSKCERIRGRKATLDEIQTVHSEYHTLLYGTSPLNRQKLDSKKLLGPISQKMYAVLPCGGIGVDSDTVWNEMHSSSAVRMAVGCLLELAFKVAAGELKNGFAIIRPPGHHAEESTAMGFCFFNSVAITAKLLQQKLNVGKVLIVDWVGSELVGLGRGG

SEQ ID NO: 900748 - protein, 1113 aa, Homo sapiens; identical to SEQ ID NO: 900737

SEQ ID NO: 900749 - protein, 1113 aa, Homo sapiens; identical to SEQ ID NO: 900737

SEQ ID NO: 900750 - protein, 872 aa, Homo sapiens; identical to SEQ ID NO: 900742

SEQ ID NO: 900751 - protein, 896 aa, Homo sapiens
MSGREPSLEILPRTSLHSIPVTVEVKPVLPRAMPSSMGGGGGGSPSPVELRGALVGSVDPTLREQQLQQELLALKQQQQLQKQLLFAEFQKQHDHLTRQHEVQLQKHLKQQQEMLAAKQQQEMLAAKRQQELEQQRQREQQRQEELEKQRLEQQLLILRNKEKSKESAIASTEVKLRLQEFLLSKSKEPTPGGLNHSLPQHPKCWGAHHASLDQSSPPQSGPPGTPPSYKLPLPGPYDSRDDFPLRKTASEPNLKVRSRLKQKVAERRSSPLLRRKDGTVISTFKKRAVEITGAGPGASSVCNSAPGSGPSSPNSSHSTIAENGFTGSVPNIPTEVLLGEGALTMPREGSTESESTQEDLEEEDEEEDGEEEEDCIQVKDEEGESGAEEGPDLEEPGAGYKKLFSDAQPLQPLQVYQAPLSLATVPHQALGRTQSSPAAPGGMKSPPDQPVKHLFTTGVVYDTFMLKHQCMCGNTHVHPEHAGRIQSIWSRLQETGLLSKCERIRGRKATLDEIQTVHSEYHTLLYGTSPLNRQKLDSKKLLGPISQKMYAVLPCGGIGVDSDTVWNEMHSSSAVRMAVGCLLELAFKVAAGELKNGFAIIRPPGHHAEESTAMGFCFFNSVAITAKLLQQKLNVGKVLIVDWDIHHGNGTQQAFYNDPSVLYISLHRYDNGNFFPGSGAPEEVGGGPGVGYNVNVAWTGGVDPPIGDVEYLTAFRTVVMPIAHEFSPDVVLVSAGFDAVEGHLSPLGGYSVTARCFGHLTRQLMTLAGGRVVLALEGGHDLTAICDASEACVSALLSVELQPLDEAVLQQKPNINAVATLEKVIEIQSKHWSCVQKFAAGLGRSLREAQAGETEEAETVSAMALLSVGAEQAQAAAAREHSPRPAEEPMEQEPAL

SEQ ID NO: 900752 - protein, 254 aa, Homo sapiens
MDIHHGNGTQQAFYNDPSVLYISLHRYDNGNFFPGSGAPEEVGGGPGVGYNVNVAWTGGVDPPIGDVEYLTAFRTVVMPIAHEFSPDVVLVSAGFDAVEGHLSPLGGYSVTARCFGHLTRQLMTLAGGRVVLALEGGHDLTAICDASEACVSALLSVELQPLDEAVLQQKPNINAVATLEKVIEIQSKHWSCVQKFAAGLGRSLREAQAGETEEAETVSAMALLSVGAEQAQAAAAREHSPRPAEEPMEQEPAL

SEQ ID NO: 900753 - protein, 421 aa, Homo sapiens
MSGREPSLEILPRTSLHSIPVTVEVKPVLPRAMPSSMGGGGGGSPSPVELRGALVGSVDPTLREQQLQQELLALKQQQQLQKQLLFAEFQKQHDHLTRQHEVQLQKHLKQQQEMLAAKQQQEMLAAKRQQELEQQRQREQQRQEELEKQRLEQQLLILRNKEKSKESAIASTEVKLRLQEFLLSKSKEPTPGGLNHSLPQHPKCWGAHHASLDQSSPPQSGPPGTPPSYKLPLPGPYDSRDDFPLRKTASEPNLKVRSRLKQKVAERRSSPLLRRKDGTVISTFKKRAVEITGAGPGASSVCNSAPGSGPSSPNSSHSTIAENGFTGSVPNIPTEMLPQHRALPLDSSPNQFSLYTSPSLPNISLGLQATVTVTNSHLTASPKLSTQQEAERQALQSLRQGGTLTGKFMSTSSIPGCLRRP

SEQ ID NO: 900754 - protein, 132 aa, Homo sapiens [sequence omitted]

SEQ ID NO: 900755 - protein, 414 aa, Homo sapiens
MSEYIRVTEDENDEPIEIPSEDDGTVLLSTVTAQFPGACGLRYRNPVSQCMRGVRLVEGILHAPDAGWGNLVYVVNYPKDNKRKMDETDASSAVKVKRAVQKTSDLIVLGLPWKTTEQDLKEYFSTFGEVLMVQVKKDLKTGHSKGFGFVRFTEYETQVKVMSQRHMIDGRWCDCKLPNSKQSQDEPLRSRKVFVGRCTEDMTEDELREFFSQYGDVMDVFIPKPFRAFAFVTFADDQIAQSLCGEDLIIKGISVHISNAEPKHNSNRQLERSGRFGGNPGGFGNQGGFGNSRGGGAGLGNNQGSNMGGGMNFGAFSINPAMMAAAQAALQSSWGMMGMLASQQNQSGPSGNNQNQGNMQREPNQAFGSGNNSYSGSNSGAAIGWGSASNAGSGSGFNGGFGSSMDSKSSGWGM

SEQ ID NO: 900756 - protein, 414 aa, Homo sapiens; identical to SEQ ID NO: 900755

SEQ ID NO: 900757 - protein, 414 aa, Homo sapiens; identical to SEQ ID NO: 900755

SEQ ID NO: 900758 - protein, 364 aa, Homo sapiens [sequence omitted]

SEQ ID NO: 900759 - protein, 253 aa, Homo sapiens
MSQRHMIDGRWCDCKLPNSKQSQDEPLRSRKVFVGRCTEDMTEDELREFFSQYGDVMDVFIPKPFRAFAFVTFADDQIAQSLCGEDLIIKGISVHISNAEPKHNSNRQLERSGRFGGNPGGFGNQGGFGNSRGGGAGLGNNQGSNMGGGMNFGAFSINPAMMAAAQAALQSSWGMMGMLASQQNQSGPSGNNQNQGNMQREPNQAFGSGNNSYSGSNSGAAIGWGSASNAGSGSGFNGGFGSSMDSKSSGWGM

SEQ ID NO: 900760 - protein, 374 aa, Homo sapiens
MRTMSPLKYHRKTMGRCCSPRLQPNAGWGNLVYVVNYPKDNKRKMDETDASSAVKVKRAVQKTSDLIVLGLPWKTTEQDLKEYFSTFGEVLMVQVKKDLKTGHSKGFGFVRFTEYETQVKVMSQRHMIDGRWCDCKLPNSKQSQDEPLRSRKVFVGRCTEDMTEDELREFFSQYGDVMDVFIPKPFRAFAFVTFADDQIAQSLCGEDLIIKGISVHISNAEPKHNSNRQLERSGRFGGNPGGFGNQGGFGNSRGGGAGLGNNQGSNMGGGMNFGAFSINPAMMAAAQAALQSSWGMMGMLASQQNQSGPSGNNQNQGNMQREPNQAFGSGNNSYSGSNSGAAIGWGSASNAGSGSGFNGGFGSSMDSKSSGWGM

SEQ ID NO: 900761 - protein, 315 aa, Homo sapiens
HGFAGAVQLGLIGRKTTEQDLKEYFSTFGEVLMVQVKKDLKTGHSKGFGFVRFTEYETQVKVMSQRHMIDGRWCDCKLPNSKQSQDEPLRSRKVFVGRCTEDMTEDELREFFSQYGDVMDVFIPKPFRAFAFVTFADDQIAQSLCGEDLIIKGISVHISNAEPKHNSNRQLERSGRFGGNPGGFGNQGGFGNSRGGGAGLGNNQGSNMGGGMNFGAFSINPAMMAAAQAALQSSWGMMGMLASQQNQSGPSGNNQNQGNMQREPNQAFGSGNNSYSGSNSGAAIGWGSASNAGSGSGFNGGFGSSMDSKSSGWGM

SEQ ID NO: 900762 - protein, 108 aa, Homo sapiens
MGGGMNFGAFSINPAMMAAAQAALQSSWGMMGMLASQQNQSGPSGNNQNQGNMQREPNQAFGSGNNSYSGSNSGAAIGWGSASNAGSGSGFNGGFGSSMDSKSSGWGM

SEQ ID NO: 900763 - protein, 102 aa, Homo sapiens [sequence omitted]

SEQ ID NO: 900764 - protein, 414 aa, Homo sapiens; identical to SEQ ID NO: 900755

SEQ ID NO: 900765 - protein, 396 aa, Homo sapiens
MSEYIRVTEDENDEPIEIPSEDDGTVLLSTVTAQFPGACGLRYRNPVSQCMRGVRLVEGILHAPDAGWGNLVYVVNYPKDNKRKMDETDASSAVKVKRAVQKTSDLIVLGLPWKTTEQDLKEYFSTFGEVLMVQVKKDLKTGHSKGFGFVRFTEYETQVKVMSQRHMIDGRWCDCKLPNSKQSQDEPLRSRFFSQYGDVMDVFIPKPFRAFAFVTFADDQIAQSLCGEDLIIKGISVHISNAEPKHNSNRQLERSGRFGGNPGGFGNQGGFGNSRGGGAGLGNNQGSNMGGGMNFGAFSINPAMMAAAQAALQSSWGMMGMLASQQNQSGPSGNNQNQGNMQREPNQAFGSGNNSYSGSNSGAAIGWGSASNAGSGSGFNGGFGSSMDSKSSGWGM

SEQ ID NO: 900766 - protein, 330 aa, Homo sapiens [sequence omitted]

SEQ ID NO: 900767 - protein, 302 aa, Homo sapiens
MSEYIRVTEDENDEPIEIPSEDDGTVLLSTVTAQFPGACGLRYRNPVSQCMRGVRLVEGILHAPDAGWGNLVYVVNYPKDNKRKMDETDASSAVKVKRAVQKTSDLIVLGLPWKTTEQDLKEYFSTFGEVLMVQVKKDLKTGHSKGFGFVRFTEYETQVKVMSQRHMIDGRWCDCKLPNSKQSQDEPLRSRKVFVGRCTEDMTEDELREFFSQYGDVMDVFIPKPFRAFAFVTFADDQIAQSLCGEDLIIKGISVHISNAEPKHNSNRQLERSGRFGGNPGSHFKCLWKKHFIESSAVNILP

SEQ ID NO: 900768 - protein, 277 aa, Homo sapiens
MSEYIRVTEDENDEPIEIPSEDDGTVLLSTVTAQFPGACGLRYRNPVSQCMRGVRLVEGILHAPDAGWGNLVYVVNYPKDNKRKMDETDASSAVKVKRAVQKTSDLIVLGLPWKTTEQDLKEYFSTFGEVLMVQVKKDLKTGHSKGFGFVRFTEYETQVKVMSQRHMIDGRWCDCKLPNSKQSQDEPLRSRKVFVGRCTEDMTEDELREFFSQYGDVMDVFIPKPFRAFAFVTFADDQIAQSLCGEDLIIKGISVHSHFKCLWKKHFIESSAVNILP

SEQ ID NO: 900769 - protein, 197 aa, Homo sapiens
MSEYIRVTEDENDEPIEIPSEDDGTVLLSTVTAQFPGACGLRYRNPVSQCMRGVRLVEGILHAPDAGWGNLVYVVNYPKDNKRKMDETDASSAVKVKRAVQKTSDLIVLGLPWKTTEQDLKEYFSTFGEVLMVQVKKDLKTGHSKGFGFVRFTEYETQVKVMSQRHMIDGRWCDCKLPNSKQSQDEPLRSAWPVRAD

SEQ ID NO: 900770 - protein, 433 aa, Homo sapiens
LKSRCRAGGGGGGSGGGGSSRRGARLGGGIRRAVLAPRSLPRSLPGAVGRRGAKPGWPEGAMAAPVPWACCAVLAAAAAVVYAQRHSPQEAPHVQYERLGSDVTLPCGTANWDAAVTWRVNGTDLAPDLLNGSQLVLHGLELGHSGLYACFHRDSWHLRHQVLLHVGLPPREPVLSCRSNTYPKGFYCSWHLPTPTYIPNTFNVTVLHGSKIMVCEKDPALKNRCHIRYMHLFSTIKYKVSISVSNALGHNATAITFDEFTIVKPDPPENVVARPVPSNPRRLEVTWQTPSTWPDPESFPLKFFLRYRPLILDQWQHVELSDGTAHTITDAYAGKEYIIQVAAKDNEIGTWSDWSVAAHATPWTEEPRHLTTEAQAAETTTSTTSSLAPPPTTKICDPGELGSGGGPSAPFLVSVPITLALAAAAATASSLLI

SEQ ID NO: 900771 - protein, 372 aa, Homo sapiens
MAAPVPWACCAVLAAAAAVVYAQRHSPQEAPHVQYERLGSDVTLPCGTANWDAAVTWRVNGTDLAPDLLNGSQLVLHGLELGHSGLYACFHRDSWHLRHQVLLHVGLPPREPVLSCRSNTYPKGFYCSWHLPTPTYIPNTFNVTVLHGSKIMVCEKDPALKNRCHIRYMHLFSTIKYKVSISVSNALGHNATAITFDEFTIVKPDPPENVVARPVPSNPRRLEVTWQTPSTWPDPESFPLKFFLRYRPLILDQWQHVELSDGTAHTITDAYAGKEYIIQVAAKDNEIGTWSDWSVAAHATPWTEEPRHLTTEAQAAETTTSTTSSLAPPPTTKICDPGELGSGGGPSAPFLVSVPITLALAAAAATASSLLI

SEQ ID NO: 900772 - protein, 372 aa, Homo sapiens; identical to SEQ ID NO: 900771

SEQ ID NO: 900773 - protein, 372 aa, Homo sapiens; identical to SEQ ID NO: 900771

SEQ ID NO: 900774 - protein, 247 aa, Homo sapiens
MAAPVPWACCAVLAAAAAVVYAQRHSPQEAPHVQYERLGSDVTLPCGTANWDAAVTWRVNGTDLAPDLLNGSQLVLHGLELGHSGLYACFHRDSWHLRHQVLLHVGLPPREPVLSCRSNTYPKGFYCSWHLPTPTYIPNTFNVTVLHGSKIMVCEKDPALKNRCHIRYMHLFSTIKYKVSISVSNALGHNATAITFDEFTIVWSEHSRDYRRAIIPTAFGDVAIIMYPMKNHMLFIAITKGDDIGSC

SEQ ID NO: 900775 - protein, 403 aa, Homo sapiens
MFSVFEEITRIVVKEMDAGGDMIAVRSLVDADRFRCFHLVGEKRTFFGCRHYTTGLTLMDILDTDGDKWLDELDSGLQGQKAEFQILDNVDSTGELIVRLPKEITISGSFQGFHHQKIKISENRISQQYLATLENRKLKRELPFSFRSINTRENLYLVTETLETVKEETLKSDRQYKFWSQISQGHLSYKHKGQREVTIPPNRVLSYRVKQLVFPNKETMKKDGASSCLGKSLGSEDSRNMKEKLEDMESVLKDLTEEKRKDVLNSLAKCLGKEDIRQDLEQRVSEVLISGELHMEDPDKPLLSSLFNAAGVLVEARAKAILDFLDALLELSEEQQFVAEALEKGTLPLLKDQVKSVMEQNWDELASSPPDMDYDPEARILCALYVVVSILLELAEGPTSVSS

SEQ ID NO: 900776 - protein, 163 aa, Homo sapiens
MKEKLEDMESVLKDLTEEKRKDVLNSLAKCLGKEDIRQDLEQRVSEVLISGELHMEDPDKPLLSSLFNAAGVLVEARAKAILDFLDALLELSEEQQFVAEALEKGTLPLLKDQVKSVMEQNWDELASSPPDMDYDPEARILCALYVVVSILLELAEGPTSVSS

SEQ ID NO: 900777 - protein, 366 aa, Homo sapiens
MFSVFEEITRIVVKEMDAGGDMIAVRSLVDADRFRCFHLVGEKRTFFGCRHYTTGLTLMDILDTDGDKWLDELDSGLQGQKAEFQILDNVDSTGELIVRLPKEITISGSFQGFHHQKIKISENRISQQYLATLENRKLKRELPFSFRSINTRENLYLVTETLETVKEETLKSDRQYKFWSQISQGHLSYETQGKSLGSEDSRNMKEKLEDMESVLKDLTEEKRKDVLNSLAKCLGKEDIRQDLEQRVSEVLISGELHMEDPDKPLLSSLFNAAGVLVEARAKAILDFLDALLELSEEQQFVAEALEKGTLPLLKDQVKSVMEQNWDELASSPPDMDYDPEARILCALYVVVSILLELAEGPTSVSS

SEQ ID NO: 900778 - protein, 123 aa, Homo sapiens
MKEKLEDMESVLKDLTEEKRKDVLNSLAKCLGKEDIRQDLEQRVSEVLISGELHMEDPDKPLLSSLFNAAGVLVEARAKAILDFLDALLELSEEQQFVAEALEKGTLPLLKDQLAEGPTSVSS

SEQ ID NO: 900779 - protein, 117 aa, Homo sapiens
MKEKLEDMESVLKDLTEEKRKDVLNSLAKCLGKEDIRQDLEQRVSEVLISGELHMEDPDKPLLSSLFNAAGVLVEARAKAILDFLDALLELSEEQQFVAEALEKGTLPLLKDQDSLG

SEQ ID NO: 900780 - protein, 394 aa, Homo sapiens
MFSVFEEITRIVVKEMDAGGDMIAVRSLVDADRFRCFHLVGEKRTFFGCRHYTTGLTLMDILDTDGDKWLDELDSGLQGQKAEFQILDNVDSTGELIVRLPKEITISGSFQGFHHQKIKISENRISQQYLATLENRKLKRELPFSFRSINTRENLYLVTETLETVKEETLKSDRQYKFWSQISQGHLSYKHKGQREVTIPPNRVLSYRVKQLVFPNKETMRKSLGSEDSRNMKEKLEDMESVLKDLTEEKRKDVLNSLAKCLGKEDIRQDLEQRVSEVLISGELHMEDPDKPLLSSLFNAAGVLVEARAKAILDFLDALLELSEEQQFVAEALEKGTLPLLKDQVKSVMEQNWDELASSPPDMDYDPEARILCALYVVVSILLELAEGPTSVSS

SEQ ID NO: 900781 - protein, 163 aa, Homo sapiens; identical to SEQ ID NO: 900776

SEQ ID NO: 900782 - protein, 163 aa, Homo sapiens; identical to SEQ ID NO: 900776

SEQ ID NO: 900783 - protein, 262 aa, Homo sapiens
MFSVFEEITRIVVKEMDAGGDMIAVRSLVDADRFRCFHLVGEKRTFFGCRHYTTGLTLMDILDTDGDKWLDELDSGLQGQKAEFQILDNVDSTGELIVRLPKEITISGSFQGFHHQKIKISENRISQQYLATLENRKLKRELPFSFRSINTRENLYLVTETLETVKEETLKSDRQYKFWSQISQGHLSYKHKGQREVTIPPNRVLSYRVKQLVFPNKETMKKDGASSCLGKGDSQVCSGWLHQPTLSPCGSRLLLRWGQLSG

SEQ ID NO: 900784 - protein, 373 aa, Homo sapiens
MSLRRHIGNPEYLMKRIPQNPRYQHIKSRLDTGNSMTKYTEKLEEIKKNYRYKKDELFKRLKVTTFAQLIIQVASLSDQTLEVTAEEIQRLEDNDSAASDPDAETTARTNGKGNPGEQSPSPEQFINNAGAGDSSRSTLQSVISGVGELDLDKGPVKKAEPHTKDKPYPDCPFLLLDVRDRDSYQQCHIVGAYSYPIATLSRTMNPYSNDILEYKNAHGKIIILYDDDERLASQAATTMCERGFENLFMLSGGLKVLAQKFPEGLITGSLPASCQQALPPGSARKRSSPKGPPLPAENKWRFTPEDLKKIEYYLEEEQGPADHPSRLNQANSSGRESKVPGARSAQNLPGGGPASHSNPRSLSSGHLQGKPWK

SEQ ID NO: 900785 - protein, 373 aa, Homo sapiens; identical to SEQ ID NO: 900784

SEQ ID NO: 900786 - protein, 170 aa, Homo sapiens
MNPYSNDILEYKNAHGKIIILYDDDERLASQAATTMCERGFENLFMLSGGLKVLAQKFPEGLITGSLPASCQQALPPGSARKRSSPKGPPLPAENKWRFTPEDLKKIEYYLEEEQGPADHPSRLNQANSSGRESKVPGARSAQNLPGGGPASHSNPRSLSSGHLQGKPWK

SEQ ID NO: 900787 - protein, 373 aa, Homo sapiens; identical to SEQ ID NO: 900784

SEQ ID NO: 900788 - protein, 329 aa, Homo sapiens
MSLRRHIGNPEYLMKRIPQNPRYQHIKSRLDTGNSMTKYTEKLEEIKKNNDSAASDPDAETTARTNGKGNPGEQSPSPEQFINNAGAGDSSRSTLQSVISGVGELDLDKGPVKKAEPHTKDKPYPDCPFLLLDVRDRDSYQQCHIVGAYSYPIATLSRTMNPYSNDILEYKNAHGKIIILYDDDERLASQAATTMCERGFENLFMLSGGLKVLAQKFPEGLITGSLPASCQQALPPGSARKRSSPKGPPLPAENKWRFTPEDLKKIEYYLEEEQGPADHPSRLNQANSSGRESKVPGARSAQNLPGGGPASHSNPRSLSSGHLQGKPWK

SEQ ID NO: 900789 - protein, 301 aa, Homo sapiens
MSLRRHIGNPEYLMKRIPQNPRYQHIKSRLDTGNSMTKYTEKLEEIKKNYRYKKDELFKRLKVTTFAQLIIQVASLSDQTLEVTAEEIQRLEDNDSAASDPDAETTARTNGKGNPGEQSPSPEQFINNAGAGDSSRSTLQSVISGVGELDLDKGPVKKAEPHTKDKPYPDCPFLLLDVRDRDSYQQCHIVGAYSYPIATLSRTMNPYSNDILEYKNAHGKIIILYDDDERLASQAATTMCERGFENLFMLSGGRLNQANSSGRESKVPGARSAQNLPGGGPASHSNPRSLSSGHLQGKPWK

SEQ ID NO: 900790 - protein, 1365 aa, Homo sapiens
MEFSIKQSPLSVQSVVKCIKMKQAPEILGSANGKTPSCEVNRECSVFLSKAQLSSSLQEGVMQKFNGHDALPFIPADKLKDLTSRVFNGEPGAHDAKLRFESQEMKGIGTPPNTTPIKNGSPEIKLKITKTYMNGKPLFESSICGDSAADVSQSEENGQKPENKARRNRKRSIKYDSLLEQGLVEAALVSKISSPSDKKIPAKKESCPNTGRDKDHLLKYNVGDLVWSKVSGYPWWPCMVSADPLLHSYTKLKGQKKSARQYHVQFFGDAPERAWIFEKSLVAFEGEGQFEKLCQESAKQAPTKAEKIKLLKPISGKLRAQWEMGIVQAEEAASMSVEERKAKFTFLYVGDQLHLNPQVAKEAGIAAESLGEMAESSGVSEEAAENPKSVREECIPMKRRRRAKLCSSAETLESHPDIGKSTPQKTAEADPRRGVGSPPGRKKTTVSMPRSRKGDAASQFLVFCQKHRDEVVAEHPDASGEEIEELLRSQWSLLSEKQRARYNTKFALVAPVQAEEDSGNVNGKKRNHTKRIQDPTEDAEAEDTPRKRLRTDKHSLRKRDTITDKTARTSSYKAMEAASSLKSQAATKNLSDACKPLKKRNRASTAASSALGFSKSSSPSASLTENEVSDSPGDEPSESPYESADETQTEVSVSSKKSERGVTAKKEYVCQLCEKPGSLLLCEGPCCGAFHLACLGLSRRPEGRFTCSECASGIHSCFVCKESKTDVKRCVVTQCGKFYHEACVKKYPLTVFESRGFRCPLHSCVSCHASNPSNPRPSKGKMMRCVRCPVAYHSGDACLAAGCSVIASNSIICTAHFTARKGKRHHAHVNVSWCFVCSKGGSLLCCESCPAAFHPDCLNIEMPDGSWFCNDCRAGKKLHFQDIIWVKLGNYRWWPAEVCHPKNVPPNIQKMKHEIGEFPVFFFGSKDYYWTHQARVFPYMEGDRGSRYQGVRGIGRVFKNALQEAEARFREIKLQREARETQESERKPPPYKHIKVNKPYGKVQIYTADISEIPKCNCKPTDENPCGFDSECLNRMLMFECHPQVCPAGEFCQNQCFTKRQYPETKIIKTDGKGWGLVAKRDIRKGEFVNEYVGELIDEEECMARIKHAHENDITHFYMLTIDKDRIIDAGPKGNYSRFMNHSCQPNCETLKWTVNGDTRVGLFAVCDIPAGTELTFNYNLDCLGNEKTVCRCGASNCSGFLGDRPKTSTTLSSEEKGKKTKKKTRRRRAKGEGKRQSEDECFRCGDGGQLVLCDRKFCTKAYHLSCLGLGKRPFGKWECPWHHCDVCGKPSTSFCHLCPNSFCKEHQDGTAFSCTPDGRSYCCEHDLGAASVRSTKTEKPPPEPGKPKGKRRRRRGWRRVTEGK

SEQ ID NO: 900791 - protein, 1365 aa, Homo sapiens; identical to SEQ ID NO: 900790

SEQ ID NO: 900792 - protein, 647 aa, Homo sapiens
MEFSIKQSPLSVQSVVKCIKMKQAPEILGSANGKTPSCEVNRECSVFLSKAQLSSSLQEGVMQKFNGHDALPFIPADKLKDLTSRVFNGEPGAHDAKLRFESQEMKGIGTPPNTTPIKNGSPEIKLKITKTYMNGKPLFESSICGDSAADVSQSEENGQKPENKARRNRKRSIKYDSLLEQGLVEAALVSKISSPSDKKIPAKKESCPNTGRDKDHLLKYNVGDLVWSKVSGYPWWPCMVSADPLLHSYTKLKGQKKSARQYHVQFFGDAPERAWIFEKSLVAFEGEGQFEKLCQESAKQAPTKAEKIKLLKPISGKLRAQWEMGIVQAEEAASMSVEERKAKFTFLYVGDQLHLNPQVAKEAGIAAESLGEMAESSGVSEEAAENPKSVREECIPMKRRRRAKLCSSAETLESHPDIGKSTPQKTAEADPRRGVGSPPGRKKTTVSMPRSRKGDAASQFLVFCQKHRDEVVAEHPDASGEEIEELLRSQWSLLSEKQRARYNTKFALVAPVQAEEDSGNVNGKKRNHTKRIQDPTEDAEAEDTPRKRLRTDKHSLRKRDTITDKTARTSSYKAMEAASSLKSQAATKNLSDACKPLKKRNRASTAASSALGFSKSSSPSASLTENELLWEPTPVKLDLNPAALYCT

SEQ ID NO: 900793 - protein, 156 aa, Homo sapiens
MNHSCQPNCETLKWTVNGDTRVGLFAVCDIPAGTELTFNYNLDCLGNEKTVCRCGASNCSGFLGDRPKTSTTLSSEEKGKKTKKKTRRRRAKGEGKRQSEDECFRCGDGGQLVLCDRKFCTKAYHLSCLGLGKRPFGSGMLNHVTVGTSIIALANR

SEQ ID NO: 900794 - protein, 185 aa, Homo sapiens
RRSLSILLADKHPRCDRHGGSGHTASFYLLTALGKGWKHGPAPARSHILCSSSCSFSPCFLVFVHFLLTETISSMSVEERKAKFTFLYVGDQLHLNPQVAKEAGIAAESLGEMAESSGVSEEAAENPKSVREECIPMKRRRRAKLCSSAETLESHPDIGKSTPQKTAEADPRRGVVNRRPSEFLI

SEQ ID NO: 900795 - protein, 1365 aa, Homo sapiens; identical to SEQ ID NO: 900790

SEQ ID NO: 900796 - protein, 713 aa, Homo sapiens [sequence omitted]

SEQ ID NO: 900797 - protein, 713 aa, Homo sapiens [sequence omitted]

SEQ ID NO: 900798 - protein, 705 aa, Homo sapiens [sequence omitted]

SEQ ID NO: 900799 - protein, 713 aa, Homo sapiens [sequence omitted]

SEQ ID NO: 900800 - protein, 629 aa, Homo sapiens
MEFSIKQSPLSVQSVVKCIKMKQAPEILGSANGKTPSCEVNRECSVFLSKAQLSSSLQEGVMQKFNGHDALPFIPADKLKDLTSRVFNGEPGAHDAKLRFESQEMKGIGTPPNTTPIKNGSPEIKLKITKTYMNGKPLFESSICGDSAADVSQSEENGQKPENKARRNRKRSIKYDSLLEQGLVEAALVSKISSPSDKKIPAKKESCPNTGRDKDHLLKYNVGDLVWSKVSGYPWWPCMVSADPLLHSYTKLKGQKKSARQYHVQFFGDAPERAWIFEKSLVAFEGEGQFEKLCQESAKQAPTKAEKIKLLKPISGKLRAQWEMGIVQAEEAASMSVEERKAKFTFLYVGDQLHLNPQVAKEAGIAAESLGEMAESSGVSEEAAENPKSVREECIPMKRRRRAKLCSSAETLESHPDIGKSTPQKTAEADPRRGVGSPPGRKKTTVSMPRSRKGDAASQFLVFCQKHRDEVVAEHPDASGEEIEELLRSQWSLLSEKQRARYNTKFALVAPVQAEEDSGNVNGKKRNHTKRIQDPTEDAEAEDTPRKRLRTDKHSLRKRDTITDKTARTSSYKAMEAASSLKSQAATKNLSDACKPLKKRNRASTAASSALGFSKSSSPSASLTENEVK

SEQ ID NO: 900801 - protein, 647 aa, Homo sapiens; identical to SEQ ID NO: 900792

SEQ ID NO: 900802 - protein, 640 aa, Homo sapiens
MEFSIKQSPLSVQSVVKCIKMKQAPEILGSANGKTPSCEVNRECSVFLSKAQLSSSLQEGVMQKFNGHDALPFIPADKLKDLTSRVFNGEPGAHDAKLRFESQEMKGIGTPPNTTPIKNGSPEIKLKITKTYMNGKPLFESSICGDSAADVSQSEENGQKPENKARRNRKRSIKYDSLLEQGLVEAALVSKISSPSDKKIPAKKESCPNTGRDKDHLLKYNVGDLVWSKVSGYPWWPCMVSADPLLHSYTKLKGQKKSARQYHVQFFGDAPERAWIFEKSLVAFEGEGQFEKLCQESAKQAPTKAEKIKLLKPISGKLRAQWEMGIVQAEEAASMSVEERKAKFTFLYVGDQLHLNPQVAKEAGIAAESLGEMAESSGVSEEAAENPKSVREECIPMKRRRRAKLCSSAETLESHPDIGKSTPQKTAEADPRRGVGSPPGRKKTTVSMPRSRKGDAASQFLVFCQKHRDEVVAEHPDASGEEIEELLRSQWSLLSEKQRARYNTKFALVAPVQAEEDSGNVNGKKRNHTKRIQDPTEDAEAEDTPRKRLRTDKHSLRKRDTITDKTARTSSYKAMEAASSLKSQAATKNLSDACKPLKKRNRASTAASSALGFSKSSSPSASLTENEGKIIIITITMALV

SEQ ID NO: 900803 - protein, 713 aa, Homo sapiens [sequence omitted]

SEQ ID NO: 900804 - protein, 226 aa, Homo sapiens
MNHSCQPNCETLKWTVNGDTRVGLFAVCDIPAGTELTFNYNLDCLGNEKTVCRCGASNCSGFLGDRPKTSTTLSSEEKGKKTKKKTRRRRAKGEGKRQSEDECFRCGDGGQLVLCDRKFCTKAYHLSCLGLGKRPFGKWECPWHHCDVCGKPSTSFCHLCPNSFCKEHQDGTAFSCTPDGRSYCCEHDLGAASVRSTKTEKPPPEPGKPKGKRRRRRGWRRVTEGK

SEQ ID NO: 900805 - protein, 640 aa, Homo sapiens; identical to SEQ ID NO: 900802

SEQ ID NO: 900806 - protein, 640 aa, Homo sapiens; identical to SEQ ID NO: 900802

SEQ ID NO: 900807 - protein, 607 aa, Homo sapiens [sequence omitted]

SEQ ID NO: 900808 - protein, 484 aa, Homo sapiens
MEFSIKQSPLSVQSVVKCIKMKQAPEILGSANGKTPSCEVNRECSVFLSKAQLSSSLQEGVMQKFNGHDALPFIPADKLKDLTSRVFNGEPGAHDAKLRFESQEMKGIGTPPNTTPIKNGSPEIKLKITKTYMNGKPLFESSICGDSAADVSQSEENGQKPENKARRNRKRSIKYDSLLEQGLVEAALVSKISSPSDKKIPAKKESCPNTGRDKDHLLKYNVGDLVWSKVSGYPWWPCMVSADPLLHSYTKLKGQKKSARQYHVQFFGDAPERAWIFEKSLVAFEGEGQFEKLCQESAKQAPTKAEKIKLLKPISGKLRAQWEMGIVQAEEAASMSVEERKAKFTFLYVGDQLHLNPQVAKEAGIAAESLGEMAESSGVSEEAAENPKSVREECIPMKRRRRAKLCSSAETLESHPDIGKSTPQKTAEADPRRGVGSPPGRKKTTVSMPRSRKGDAASQFLVFCQKHRDEVSTKLCFMLASFRI

SEQ ID NO: 900809 - protein, 484 aa, Homo sapiens; identical to SEQ ID NO: 900808

SEQ ID NO: 900810 - protein, 1365 aa, Homo sapiens; identical to SEQ ID NO: 900790

SEQ ID NO: 900811 - protein, 584 aa, Homo sapiens
MMRCVRCPVAYHSGDACLAAGCSVIASNSIICTAHFTARKGKRHHAHVNVSWCFVCSKGGSLLCCESCPAAFHPDCLNIEMPDGSWFCNDCRAGKKLHFQDIIWVKLGNYRWWPAEVCHPKNVPPNIQKMKHEIGEFPVFFFGSKDYYWTHQARVFPYMEGDRGSRYQGVRGIGRVFKNALQEAEARFREIKLQREARETQESERKPPPYKHIKVNKPYGKVQIYTADISEIPKCNCKPTDENPCGFDSECLNRMLMFECHPQVCPAGEFCQNQCFTKRQYPETKIIKTDGKGWGLVAKRDIRKGEFVNEYVGELIDEEECMARIKHAHENDITHFYMLTIDKDRIIDAGPKGNYSRFMNHSCQPNCETLKWTVNGDTRVGLFAVCDIPAGTELTFNYNLDCLGNEKTVCRCGASNCSGFLGDRPKTSTTLSSEEKGKKTKKKTRRRRAKGEGKRQSEDECFRCGDGGQLVLCDRKFCTKAYHLSCLGLGKRPFGKWECPWHHCDVCGKPSTSFCHLCPNSFCKEHQDGTAFSCTPDGRSYCCEHDLGAASVRSTKTEKPPPEPGKPKGKRRRRRGWRRVTEGK

SEQ ID NO: 900812 - protein, 103 aa, Homo sapiens
AGPGMCCEASEGDLVSHNEGLASLVLGQQGLKRLQLPGQCLHIVILARLIVGVDEGEFVNEYVGELIDEEECMARIKHAHENDITHFYMLTIDKDRIIDAGPT

SEQ ID NO: 900813 - protein, 705 aa, Homo sapiens [sequence omitted]

SEQ ID NO: 900814 - protein, 584 aa, Homo sapiens; identical to SEQ ID NO: 900811

SEQ ID NO: 900815 - protein, 671 aa, Homo sapiens
EDPEKTTEGRFTACECAQGIHSCFVCKESKTDVKRCVVTQCGKFYHEACVKKYPLTVFESRGFRCPLHSCVSCHASNPSNPRPSKGKMMRCVRCPVAYHSGDACLAAGCSVIASNSIICTAHFTARKGKRHHAHVNVSWCFVCSKGGSLLCCESCPAAFHPDCLNIEMPDGSWFCNDCRAGKKLHFQDIIWVKLGNYRWWPAEVCHPKNVPPNIQKMKHEIGEFPVFFFGSKDYYWTHQARVFPYMEGDRGSRYQGVRGIGRVFKNALQEAEARFREIKLQREARETQESERKPPPYKHIKVNKPYGKVQIYTADISEIPKCNCKPTDENPCGFDSECLNRMLMFECHPQVCPAGEFCQNQCFTKRQYPETKIIKTDGKGWGLVAKRDIRKGEFVNEYVGELIDEEECMARIKHAHENDITHFYMLTIDKDRIIDAGPKGNYSRFMNHSCQPNCETLKWTVNGDTRVGLFAVCDIPAGTELTFNYNLDCLGNEKTVCRCGASNCSGFLGDRPKTSTTLSSEEKGKKTKKKTRRRRAKGEGKRQSEDECFRCGDGGQLVLCDRKFCTKAYHLSCLGLGKRPFGKWECPWHHCDVCGKPSTSFCHLCPNSFCKEHQDGTAFSCTPDGRSYCCEHDLGAASVRSTKTEKPPPEPGKPKGKRRRRRGWRRVTEGK

SEQ ID NO: 900816 - protein, 640 aa, Homo sapiens; identical to SEQ ID NO: 900802

SEQ ID NO: 900817 - protein, 738 aa, Homo sapiens [sequence omitted]

SEQ ID NO: 900818 - protein, 647 aa, Homo sapiens
MEFSIKQSPLSVQSVVKCIKMKQAPEILGSANGKTPSCEVNRECSVFLSKAQLSSSLQEGVMQKFNGHDALPFIPADKLKDLTSRVFNGEPGAHDAKLRFESQEMKGIGTPPNTTPIKNGSPEIKLKITKTYMNGKPLFESSICGDSAADVSQSEENGQKPENKARRNRKRSIKYDSLLEQGLVEAALVSKISSPSDKKIPAKKESCPNTGRDKDHLLKYNVGDLVWSKVSGYPWWPCMVSADPLLHSYTKLKGQKKSARQYHVQFFGDAPERAWIFEKSLVAFEGEGQFEKLCQESAKQAPTKAEKIKLLKPISGKLRAQWEMGIVQAEEAASMSVEERKAKFTFLYVGDQLHLNPQVAKEAGIAAESLGEMAESSGVSEEAAENPKSVREECIPMKRRRRAKLCSSAETLESHPDIGKSTPQKTAEADPRRGVGSPPGRKKTTVSMPRSRKGDAASQFLVFCQKHRDEVVAEHPDASGEEIEELLRSQWSLLSEKQRARYNTKFALVAPVQAEEDSGNVNGKKRNHTKRIQDPTEDAEAEDTPRKRLRTDKHSLRKRDTITDKTARTSSYKAMEAASSLKSQAATKNLSDACKPLKKRNRASTAASSALGFSKSSSPSASLTENEWKMKVFRTSPGETKPPREVP

SEQ ID NO: 900819 - protein, 318 aa, Homo sapiens [sequence omitted]

SEQ ID NO: 900820 - protein, 713 aa, Homo sapiens [sequence omitted]

SEQ ID NO: 900821 - protein, 713 aa, Homo sapiens [sequence omitted]

SEQ ID NO: 900822 - protein, 713 aa, Homo sapiens [sequence omitted]

SEQ ID NO: 900823 - protein, 713 aa, Homo sapiens [sequence omitted]

SEQ ID NO: 900824 - protein, 647 aa, Homo sapiens; identical to SEQ ID NO: 900792

SEQ ID NO: 900825 - protein, 500 aa, Homo sapiens
MPPAVGGPVGYTPPDGGWGWAVVIGAFISIGFSYAFPKSITVFFKEIEGIFHATTSEVSWISSIMLAVMYGGGPISSILVNKYGSRIVMIVGGCLSGCGLIAASFCNTVQQLYVCIGVIGGLGLAFNLNPALTMIGKYFYKRRPLANGLAMAGSPVFLCTLAPLNQVFFGIFGWRGSFLILGGLLLNCCVAGALMRPIGPKPTKAGKDKSKASLEKAGKSGVKKDLHDANTDLIGRHPKQEKRSVFQTINQFLDLTLFTHRGFLLYLSGNVIMFFGLFAPLVFLSSYGKSQHYSSEKSAFLLSILAFVDMVARPSMGLVANTKPIRPRIQYFFAASVVANGVCHMLAPLSTTYVGFCVYAGFFGFAFGWLSSVLFETLMDLVGPQRFSSAVGLVTIVECCPVLLGPPLLGRLNDMYGDYKYTYWACGVVLIISGIYLFIGMGINYRLLAKEQKANEQKKESKEEETSIDVAGKPNEVTKAAESPDQKDTEGGPKEEESPV

SEQ ID NO: 900826 - protein, 500 aa, Homo sapiens; identical to SEQ ID NO: 900825

SEQ ID NO: 900827 - protein, 296 aa, Homo sapiens
MPPAVGGPVGYTPPDGGWGWAVVIGAFISIGFSYAFPKSITVFFKEIEGIFHATTSEVSWISSIMLAVMYGGGPISSILVNKYGSRIVMIVGGCLSGCGLIAASFCNTVQQLYVCIGVIGGLGLAFNLNPALTMIGKYFYKRRPLANGLAMAGSPVFLCTLAPLNQVFFGIFGWRGSFLILGGLLLNCCVAGALMRPIGPKPTKAGKDKSKASLEKAGKSGVKKDLHDANTDLIGRHPKQEKRSVFQTINQFLDLTLFTHRGFLLYLSGNVIMFFGLFAPLVFLIGSVLFCFNLSF

SEQ ID NO: 900828 - protein, 500 aa, Homo sapiens; identical to SEQ ID NO: 900825

SEQ ID NO: 900829 - protein, 412 aa, Homo sapiens [sequence omitted]

SEQ ID NO: 900830 - protein, 500 aa, Homo sapiens; identical to SEQ ID NO: 900825

SEQ ID NO: 900831 - protein, 998 aa, Homo sapiens
MDSLEEPQKKVFKARKTMRVSDRQQLEAVYKVKEELLKTDVKLLNGNHENGDLDPTSPLENMDYIKDKEEVNGIEEICFDPEGSKAEWKETPCILSVNVKNKQDDDLNCEPLSPHNITPEPVSKLPAEPVSGDPAPGDLDAGDPASGVLASGDSTSGDPTSSEPSSSDAASGDATSGDAPSGDVSPGDATSGDATADDLSSGDPTSSDPIPGEPVPVEPISGDCAADDIASSEITSVDLASGAPASTDPASDDLASGDLSSSELASDDLATGELASDELTSESTFDRTFEPKSVPVCEPVPEIDNIEPSSNKDDDFLEKNGADEKLEQIQSKDSLDEKNKADNNIDANEETLETDDTTICSDRPPENEKKVEEDIITELALGEDAISSSMEIDQGEKNEDETSADLVETINENVIEDNKSENILENTDSMETDEIIPILEKLAPSEDELTCFSKTSLLPIDETNPDLEEKMESSFGSPSKQESSESLPKEAFLVLSDEEDISGEKDESEVISQNETCSPAEVESNEKDNKPEEEEQVIHEDDERPSEKNEFSRRKRSKSEDMDNVQSKRRRYMEEEYEAEFQVKITAKGDINQKLQKVIQWLLEEKLCALQCAVFDKTLAELKTRVEKIECNKRHKTVLTELQAKIARLTKRFEAAKEDLKKRHEHPPNPPVSPGKTVNDVNSNNNMSYRNAGTVRQMLESKRNVSESAPPSFQTPVNTVSSTNLVTPPAVVSSQPKLQTPVTSGSLTATSVLPAPNTATVVATTQVPSGNPQPTISLQPLPVILHVPVAVSSQPQLLQSHPGTLVTNQPSGNVEFISVQSPPTVSGLTKNPVSLPSLPNPTKPNNVPSVPSPSIQRNPTASAAPLGTTLAVQAVPTAHSIVQATRTSLPTVGPSGLYSPSTNRGPIQMKIPISAFSTSSAAEQNSNTTPRIENQTNKTIDASVSKKAADSTSQCGKATGSDSSGVIDLTMDDEESGASQGTSIVIVLSNVLIPFFLS

SEQ ID NO: 900832 - protein, 1270 aa, Homo sapiens
MDSLEEPQKKVFKARKTMRVSDRQQLEAVYKVKEELLKTDVKLLNGNHENGDLDPTSPLENMDYIKDKEEVNGIEEICFDPEGSKAEWKETPCILSVNVKNKQDDDLNCEPLSPHNITPEPVSKLPAEPVSGDPAPGDLDAGDPASGVLASGDSTSGDPTSSEPSSSDAASGDATSGDAPSGDVSPGDATSGDATADDLSSGDPTSSDPIPGEPVPVEPISGDCAADDIASSEITSVDLASGAPASTDPASDDLASGDLSSSELASDDLATGELASDELTSESTFDRTFEPKSVPVCEPVPEIDNIEPSSNKDDDFLEKNGADEKLEQIQSKDSLDEKNKADNNIDANEETLETDDTTICSDRPPENEKKVEEDIITELALGEDAISSSMEIDQGEKNEDETSADLVETINENVIEDNKSENILENTDSMETDEIIPILEKLAPSEDELTCFSKTSLLPIDETNPDLEEKMESSFGSPSKQESSESLPKEAFLVLSDEEDISGEKDESEVISQNETCSPAEVESNEKDNKPEEEEQVIHEDDERPSEKNEFSRRKRSKSEDMDNVQSKRRRYMEEEYEAEFQVKITAKGDINQKLQKVIQWLLEEKLCALQCAVFDKTLAELKTRVEKIECNKRHKTVLTELQAKIARLTKRFEAAKEDLKKRHEHPPNPPVSPGKTVNDVNSNNNMSYRNAGTVRQMLESKRNVSESAPPSFQTPVNTVSSTNLVTPPAVVSSQPKLQTPVTSGSLTATSVLPAPNTATVVATTQVPSGNPQPTISLQPLPVILHVPVAVSSQPQLLQSHPGTLVTNQPSGNVEFISVQSPPTVSGLTKNPVSLPSLPNPTKPNNVPSVPSPSIQRNPTASAAPLGTTLAVQAVPTAHSIVQATRTSLPTVGPSGLYSPSTNRGPIQMKIPISAFSTSSAAEQNSNTTPRIENQTNKTIDASVSKKAADSTSQCGKATGSDSSGVIDLTMDDEESGASQDPKKLNHTPVSTMSSSQPVSRPLQPIQPAPPLQPSGVPTSGPSQTTIHLLPTAPTTVNVTHRPVTQVTTRLPVPRAPANHQVVYTTLPAPPAQAPLRGTVMQAPAVRQVNPQNSVTVRVPQTTTYVVNNGLTLGSTGPQLTVHHRPPQVHTEPPRPVHPAPLPEAPQPQRLPPEAASTSLPQKPHLKLARVQSQNGIVLSWSVLEVDRSCATVDSYHLYAYHEEPSATVPSQWKKIGEVKALPLPMACTLTQFVSGSKYYFAVRAKDIYGRFGPFCDPQSTDVISSTQSS

SEQ ID NO: 900833 - protein, 1270 aa, Homo sapiens; identical to SEQ ID NO: 900832

SEQ ID NO: 900834 - protein, 1270 aa, Homo sapiens; identical to SEQ ID NO: 900832

SEQ ID NO: 900835 - protein, 1270 aa, Homo sapiens; identical to SEQ ID NO: 900832

SEQ ID NO: 900836 - protein, 1270 aa, Homo sapiens; identical to SEQ ID NO: 900832

SEQ ID NO: 900837 - protein, 636 aa, Homo sapiens
FTGQSQLQYIHQTNKTIDASVSKKAADSTSQHPPNPPVSPGKTVNDVNSNNNMSYRNAGTVRQMLESKRNVSESAPPSFQTPVNTVSSTNLVTPPAVVSSQPKLQTPVTSGSLTATSVLPAPNTATVVATTQVPSGNPQPTISLQPLPVILHVPVAVSSQPQLLQSHPGTLVTNQPSGNVEFISVQSPPTVSGLTKNPVSLPSLPNPTKPNNVPSVPSPSIQRNPTASAAPLGTTLAVQAVPTAHSIVQATRTSLPTVGPSGLYSPSTNRGPIQMKIPISAFSTSSAAEQNSNTTPRIENQTNKTIDASVSKKAADSTSQCGKATGSDSSGVIDLTMDDEESGASQDPKKLNHTPVSTMSSSQPVSRPLQPIQPAPPLQPSGVPTSGPSQTTIHLLPTAPTTVNVTHRPVTQVTTRLPVPRAPANHQVVYTTLPAPPAQAPLRGTVMQAPAVRQVNPQNSVTVRVPQTTTYVVNNGLTLGSTGPQLTVHHRPPQVHTEPPRPVHPAPLPEAPQPQRLPPEAASTSLPQKPHLKLARVQSQNGIVLSWSVLEVDRSCATVDSYHLYAYHEEPSATVPSQWKKIGEVKALPLPMACTLTQFVSGSKYYFAVRAKDIYGRFGPFCDPQSTDVISSTQSS

SEQ ID NO: 900838 - protein, 600 aa, Homo sapiens
EYDLMFRGVPVVGLQCSYLENAGTVRQMLESKRNVSESAPPSFQTPVNTVSSTNLVTPPAVVSSQPKLQTPVTSGSLTATSVLPAPNTATVVATTQVPSGNPQPTISLQPLPVILHVPVAVSSQPQLLQSHPGTLVTNQPSGNVEFISVQSPPTVSGLTKNPVSLPSLPNPTKPNNVPSVPSPSIQRNPTASAAPLGTTLAVQAVPTAHSIVQATRTSLPTVGPSGLYSPSTNRGPIQMKIPISAFSTSSAAEQNSNTTPRIENQTNKTIDASVSKKAADSTSQCGKATGSDSSGVIDLTMDDEESGASQDPKKLNHTPVSTMSSSQPVSRPLQPIQPAPPLQPSGVPTSGPSQTTIHLLPTAPTTVNVTHRPVTQVTTRLPVPRAPANHQVVYTTLPAPPAQAPLRGTVMQAPAVRQVNPQNSVTVRVPQTTTYVVNNGLTLGSTGPQLTVHHRPPQVHTEPPRPVHPAPLPEAPQPQRLPPEAASTSLPQKPHLKLARVQSQNGIVLSWSVLEVDRSCATVDSYHLYAYHEEPSATVPSQWKKIGEVKALPLPMACTLTQFVSGSKYYFAVRAKDIYGRFGPFCDPQSTDVISSTQSS

SEQ ID NO: 900839 - protein, 1148 aa, Homo sapiens
MDSLEEPQKKVFKARKTMRVSDRQQLEAVYKVKEELLKTDVKLLNGNHENGDLDPTSPLENMDYIKDKEEVNGIEEICFDPEGSKAEWKETPCILSVNVKNKQDDDLNCEPLSPHNITPEPVSKLPAEPVSGDPAPGDLDAGDPASGVLASGDSTSGDPTSSEPSSSDAASGDATSGDAPSGDVSPGDATSGDATADDLSSGDPTSSDPIPGEPVPVEPISGDCAADDIASSEITSVDLASGAPASTDPASDDLASGDLSSSELASDDLATGELASDELTSESTFDRTFEPKSVPVCEPVPEIDNIEPSSNKDDDFLEKNGADEKLEQIQSKDSLDEKNKADNNIDANEETLETDDTTICSDRPPENEKKVEEDIITELALGEDAISSSMEIDQGEKNEDETSADLVETINENVIEDNKSENILENTDSMETDEIIPILEKLAPSEDELTCFSKTSLLPIDETNPDLEEKMESSFGSPSKQESSESLPKEAFLVLSDEEDISGEKDESEVISQNETCSPAEVESNEKDNKPEEEEQVIHEDDERPSEKNEFSRRKRSKSEDMDNVQSKRRRYMEEEYEAEFQVKITAKGDINQKLQKVIQWLLEEKLCALQCAVFDKTLAELKTRVEKIECNKRHKTVLTELQAKIARLTKRFEAAKEDLKKRHEHPPNPPVSPGKTVNDVNSNNNMSYRNAGTVRQMLESKRNVSESAPPSFQTPVNTVSSTNLVTPPAVVSSQPKLQTPVTSGSLTATSVLPAPNTATVVATTQVPSGNPQPTISLQPLPVILHVPVAVSSQPQLLQSHPGTLVTNQPSGNVEFISVQSPPTVSGLTKNPVSLPSLPNPTKPNNVPSVPSPSIQRNPTASAAPLGTTLAVQAVPTAHSIVQATRTSLPTVGPSGLYSPSTNRGPIQMKIPISAFSTSSAAEQNSNTTPRIENQTNKTIDASVSKKAADSTSQCGKATGSDSSGVIDLTMDDEESGASQDPKKLNHTPVSTMSSSQPVSRPLQPIQPAPPLQPSGVPTSGPSQTTIHLLPTAPTTVNVTHRPVTQVTTRLPVPRAPANHQVVYTTLPAPPAQAPLRGTVMQAPAVRQVNPQNSVTVRVPQTTTYVVNNGLTLGSTGPQLTVHHRPPQVHTEPPRPVHPVNILLILKD

SEQ ID NO: 900840 - protein, 520 aa, Homo sapiens
MDSLEEPQKKVFKARKTMRVSDRQQLEAVYKVKEELLKTDVKLLNGNHENGDLDPTSPLENMDYIKDKEEVNGIEEICFDPEGSKAEWKETPCILSVNVKNKQDDDLNCEPLSPHNITPEPVSKLPAEPVSGDPAPGDLDAGDPASGVLASGDSTSGDPTSSEPSSSDAASGDATSGDAPSGDVSPGDATSGDATADDLSSGDPTSSDPIPGEPVPVEPISGDCAADDIASSEITSVDLASGAPASTDPASDDLASGDLSSSELASDDLATGELASDELTSESTFDRTFEPKSVPVCEPVPEIDNIEPSSNKDDDFLEKNGADEKLEQIQSKDSLDEKNKADNNIDANEETLETDDTTICSDRPPENEKKVEEDIITELALGEDAISSSMEIDQGEKNEDETSADLVETINENVIEDNKSENILENTDSMETDEIIPILEKLAPSEDELTCFSKTSLLPIDETNPDLEEKMESSFGSPSKQESSESLPKEAFLVLSDEEDISGEKDESEVISQNETCSPG

SEQ ID NO: 900841 - protein, 602 aa, Homo sapiens
MDSLEEPQKKVFKARKTMRVSDRQQLEAVYKVKEELLKTDVKLLNGNHENGDLDPTSPLENMDYIKDKEEVNGIEEICFDPEGSKAEWKETPCILSVNVKNKQDDDLNCEPLSPHNITPEPVSKLPAEPVSGDPAPGDLDAGDPASGVLASGDSTSGDPTSSEPSSSDAASGDATSGDAPSGDVSPGDATSGDATADDLSSGDPTSSDPIPGEPVPVEPISGDCAADDIASSEITSVDLASGAPASTDPASDDLASGDLSSSELASDDLATGELASDELTSESTFDRTFEPKSVPVCEPVPEIDNIEPSSNKDDDFLEKNGADEKLEQIQSKDSLDEKNKADNNIDANEETLETDDTTICSDRPPENEKKVEEDIITELALGEDAISSSMEIDQGEKNEDETSADLVETINENVIEDNKSENILENTDSMETDEIIPILEKLAPSEDELTCFSKTSLLPIDETNPDLEEKMESSFGSPSKQESSESLPKEAFLVLSDEEDISGEKDESEVISQNETCSPAEVESNEKDNKPEEEEQVIHEDDERPSEKNEFSRRKRSKSEDMDNVQSKRRRYMEEEYEAEFQVKITAKGDINQKLQKVLCQL

SEQ ID NO: 900842 - protein, 1270 aa, Homo sapiens; identical to SEQ ID NO: 900832

SEQ ID NO: 900843 - protein, 1270 aa, Homo sapiens; identical to SEQ ID NO: 900832

SEQ ID NO: 900844 - protein, 1270 aa, Homo sapiens; identical to SEQ ID NO: 900832

SEQ ID NO: 900845 - protein, 1270 aa, Homo sapiens; identical to SEQ ID NO: 900832

SEQ ID NO: 900846 - protein, 757 aa, Homo sapiens
GTLVTNQPSGNVEFISVQSPPTVSGLTKNPVSLPSLPNPTKPNNVPSVPSPSIQRNPTASAAPLGTTLAVQAVPTAHSIVQATRTSLPTVGPSGLYSPSTNRGPIQMKIPISAFSTSSAAEQNSNTTPRIENQTNKTIDASVSKKAADSTSQHPPNPPVSPGKTVNDVNSNNNMSYRNAGTVRQMLESKRNVSESAPPSFQTPVNTVSSTNLVTPPAVVSSQPKLQTPVTSGSLTATSVLPAPNTATVVATTQVPSGNPQPTISLQPLPVILHVPVAVSSQPQLLQSHPGTLVTNQPSGNVEFISVQSPPTVSGLTKNPVSLPSLPNPTKPNNVPSVPSPSIQRNPTASAAPLGTTLAVQAVPTAHSIVQATRTSLPTVGPSGLYSPSTNRGPIQMKIPISAFSTSSAAEQNSNTTPRIENQTNKTIDASVSKKAADSTSQCGKATGSDSSGVIDLTMDDEESGASQDPKKLNHTPVSTMSSSQPVSRPLQPIQPAPPLQPSGVPTSGPSQTTIHLLPTAPTTVNVTHRPVTQVTTRLPVPRAPANHQVVYTTLPAPPAQAPLRGTVMQAPAVRQVNPQNSVTVRVPQTTTYVVNNGLTLGSTGPQLTVHHRPPQVHTEPPRPVHPAPLPEAPQPQRLPPEAASTSLPQKPHLKLARVQSQNGIVLSWSVLEVDRSCATVDSYHLYAYHEEPSATVPSQWKKIGEVKALPLPMACTLTQFVSGSKYYFAVRAKDIYGRFGPFCDPQSTDVISSTQSS

SEQ ID NO: 900847 - protein, 301 aa, Homo sapiens
SLHHSASGCSLSRNMLLQALCCYGTVKAPKVVLQLRVPSNNSHIVVNNWTKPWESTGPQLTVHHRIKKKCIVSNHGAGATQLPVPRAPANHQVVYTTLPAPPAQAPLRGTVMQAPAVRQVNPQNSVTVRVPQTTTYVVNNGLTLGSTGPQLTVHHRPPQVHTEPPRPVHPAPLPEAPQPQRLPPEAASTSLPQKPHLKLARVQSQNGIVLSWSVLEVDRSCATVDSYHLYAYHEEPSATVPSQWKKIGEVKALPLPMACTLTQFVSGSKYYFAVRAKDIYGRFGPFCDPQSTDVISSTQSS

SEQ ID NO: 900848 - protein, 1101 aa, Homo sapiens
MDSLEEPQKKVFKARKTMRVSDRQQLEAVYKVKEELLKTDVKLLNGNHENGDLDPTSPLENMDYIKDKEEVNGIEEICFDPEGSKAEWKETPCILSVNVKNKQDDDLNCEPLSPHNITPEPVSKLPAEPVSGDPAPGDLDAGDPASGVLASGDSTSGDPTSSEPSSSDAASGDATSGDAPSGDVSPGDATSGDATADDLSSGDPTSSDPIPGEPVPVEPISGDCAADDIASSEITSVDLASGAPASTDPASDDLASGDLSSSELASDDLATGELASDELTSESTFDRTFEPKSVPVCEPVPEIDNIEPSSNKDDDFLEKNGADEKLEQIQSKDSLDEKNKADNNIDANEETLETDDTTICSDRPPENEKKVEEDIITELALGEDAISSSMEIDQGEKNEDETSADLVETINENVIEDNKSENILENTDSMETDEIIPILEKLAPSEDELTCFSKTSLLPIDETNPDLEEKMESSFGSPSKQESSESLPKEAFLVLSDEEDISGEKDESEVISQNETCSPAEVESNEKDNKPEEEEQVIHEDDERPSEKNEFSRRKRSKSEDMDNVQSKRRRYMEEEYEAEFQVKITAKGDINQKLQKVIQWLLEEKLCALQCAVFDKTLAELKTRVEKIECNKRHKTVLTELQAKIARLTKRFEAAKEDLKKRHEHPPNPPVSPGKTVNDVNSNNNMSYRNAGTVRQMLESKRNVSESAPPSFQTPVNTVSSTNLVTPPAVVSSQPKLQTPVTSGSLTATSVLPAPNTATVVATTQVPSGNPQPTISLQPLPVILHVPVAVSSQPQLLQSHPGTLVTNQPSGNVEFISVQSPPTVSGLTKNPVSLPSLPNPTKPNNVPSVPSPSIQRNPTASAAPLGTTLAVQAVPTAHSIVQATRTSLPTVGPSGLYSPSTNRGPIQMKIPISAFSTSSAAEQNSNTTPRIENQTNKTIDASVSKKAADSTSQCGKATGSDSSGVIDLTMDDEESGASQDPKKLNHTPVSTMSSSQPVSRPLQPIQPAPPLQPSGVPTSGPSQTTIHLLPTAPTTVNVTHRPVTQVTTRLPVPRAPANHQVVYTTLPAPPAQAPLRGTVMQAPAVRQVNPQNRELNRENC

SEQ ID NO: 900849 - protein, 1073 aa, Homo sapiens
MDSLEEPQKKVFKARKTMRVSDRQQLEAVYKVKEELLKTDVKLLNGNHENGDLDPTSPLENMDYIKDKEEVNGIEEICFDPEGSKAEWKETPCILSVNVKNKQDDDLNCEPLSPHNITPEPVSKLPAEPVSGDPAPGDLDAGDPASGVLASGDSTSGDPTSSEPSSSDAASGDATSGDAPSGDVSPGDATSGDATADDLSSGDPTSSDPIPGEPVPVEPISGDCAADDIASSEITSVDLASGAPASTDPASDDLASGDLSSSELASDDLATGELASDELTSESTFDRTFEPKSVPVCEPVPEIDNIEPSSNKDDDFLEKNGADEKLEQIQSKDSLDEKNKADNNIDANEETLETDDTTICSDRPPENEKKVEEDIITELALGEDAISSSMEIDQGEKNEDETSADLVETINENVIEDNKSENILENTDSMETDEIIPILEKLAPSEDELTCFSKTSLLPIDETNPDLEEKMESSFGSPSKQESSESLPKEAFLVLSDEEDISGEKDESEVISQNETCSPAEVESNEKDNKPEEEEQVIHEDDERPSEKNEFSRRKRSKSEDMDNVQSKRRRYMEEEYEAEFQVKITAKGDINQKLQKVIQWLLEEKLCALQCAVFDKTLAELKTRVEKIECNKRHKTVLTELQAKIARLTKRFEAAKEDLKKRHEHPPNPPVSPGKTVNDVNSNNNMSYRNAGTVRQMLESKRNVSESAPPSFQTPVNTVSSTNLVTPPAVVSSQPKLQTPVTSGSLTATSVLPAPNTATVVATTQVPSGNPQPTISLQPLPVILHVPVAVSSQPQLLQSHPGTLVTNQPSGNVEFISVQSPPTVSGLTKNPVSLPSLPNPTKPNNVPSVPSPSIQRNPTASAAPLGTTLAVQAVPTAHSIVQATRTSLPTVGPSGLYSPSTNRGPIQMKIPISAFSTSSAAEQNSNTTPRIENQTNKTIDASVSKKAADSTSQCGKATGSDSSGVIDLTMDDEESGASQDPKKLNHTPVSTMSSSQPVSRPLQPIQPAPPLQPSGVPTSGPSQTTIHLLPTAPTTVNVTHRPVLLSGAELIQDHRNTKPSISITASPNDIPI

SEQ ID NO: 900850 - protein, 127 aa, Homo sapiens
MIFSMLRKLPKVTCRDVLPEIRAICIEEIGCWMRSYSTSFLTDSYLKYIGWTLHDKHREVRVKCVKALKGLYGNRDLTARLELFTGCFKDWMVSMIMDREYSVAVEAVRLLILILKKHGRGADGRGL

SEQ ID NO: 900851 - protein, 116 aa, Homo sapiens
MIFSMLRKLPKVTCRDVLPEIRAICIEEIGCWMRSYSTSFLTDSYLKYIGWTLHDKHREVRVKCVKALKGLYGNRDLTARLELFTGCFKDWMVSMIMDREYSVAVEAVRLLILILK

SEQ ID NO: 900852 - protein, 116 aa, Homo sapiens; identical to SEQ ID NO: 900851

SEQ ID NO: 900853 - protein, 73 aa, Homo sapiens
RWSPSVVVWRVFRALVSGGFRALVSGGFRALVSWRFPTVGVWRFPTVGVWHAPPSLALVAPCRCTRQEDKKMI

SEQ ID NO: 900854 - protein, 252 aa, Homo sapiens
MAQSKANGSHYALTAIGLGMLVLGVIMAMWNLVPGFSAAEKPTAQGSNKTEVGGGILKSKTFSVAYVLVGAGVMLLLLSICLSIRDKRKQRQGEDLAHVQHPTGAGPHAQEEDSQEEEEEDEEAASRYYVPSYEEVMNTNYSEARGEEQNPRLSISLPSYESLTGLDETTPTSTRADVEASPGNPPDRQNSKLAKRLKPLKVRRIKSEKLHLKDFRINLPDKNVPPPSIEPLTPPPQYDEVQEKAPDTRPPD

SEQ ID NO: 900855 - protein, 252 aa, Homo sapiens; identical to SEQ ID NO: 900854

SEQ ID NO: 900856 - protein, 252 aa, Homo sapiens; identical to SEQ ID NO: 900854

SEQ ID NO: 900857 - protein, 500 aa, Homo sapiens
MAQSKANGSHYALTAIGLGMLVLGVIMAMWNLVPGFSAAEKPTAQGSNKTEVGGGILKSKTFSVAYVLVGAGVMLLLLSICLSIRDKRKQRQGEDLAHVQHPTGAGPHAQEEDSQERRKGGMTRADLNDNNEHPDYAGKECSTPSLLTKHRGDDGRRNTRGLDHPRLPEPNAVAGTGAYDAHYTTPDTISHPTFTRPISNLPNTPYIIHVSPYYTRISNHTIQHLFPNYHYIANTPPMRQSFLNIQLYTAPAIAGACDATIDSSHTSRSRRHHAQSTTHRHRLAGDATAVRERDKSSKARAPPSARTSTRKQAGRQRTPRGGRGEEHRIQHPEDCMRRSRGNEHSRPRGMEVTAPCDSIDTHTSLCTARKSNTTEDKASTTERRRAHTASRWHDSITTTPPNSPLTPLPRSTATRNYHTYHTRHLNTYLNTSHTTPLTSPTPSSLTTLLHNHTPNYTSTPSIQHTTLHKPAPTYDTLHSPPQPHPLNHNSKSTQILHHPP

SEQ ID NO: 900858 - protein, 121 aa, Homo sapiens
ALFYIYIALFYIYIALFYIYIALFYIYIALFYIYIALFYIYIKTVLFQKGNKFCVCCLRWSPELWVENTTWLCRKDTGLFYELSGEAQVAALAEPLMLLFFEGLRPDERRHVMRNSLQWYT

SEQ ID NO: 900859 - protein, 252 aa, Homo sapiens; identical to SEQ ID NO: 900854

SEQ ID NO: 900860 - protein, 252 aa, Homo sapiens; identical to SEQ ID NO: 900854

SEQ ID NO: 900861 - protein, 97 aa, Homo sapiens
EREREREREREREREPTSTRADVEASPGNPPDRQNSKLAKRLKPLKVRRIKSEKLHLKDFRINLPDKNVPPPSIEPLTPPPQYDEVQEKAPDTRPPD

SEQ ID NO: 900862 - protein, 670 aa, Homo sapiens
MGETEKRIETHRIRCLSKLKMFLLAITCAFVSKTLSGSYMNSMLTQIERQFNIPTSLVGFINGSFEIGNLLLIIFVSYFGTKLHRPIMIGIGCVVMGLGCFLKSLPHFLMNQYEYESTVSVSGNLSSNSFLCMENGTQILRPTQDPSECTKEVKSLMWVYVLVGNIVRGMGETPILPLGISYIEDFAKFENSPLYIGLVETGAIIGPLIGLLLASFCANVYVDTGFVNTDDLIITPTDTRWVGAWWFGFLICAGVNVLTAIPFFFLPNTLPKEGLETNADIIKNENEDKQKEEVKKEKYGITKDFLPFMKSLSCNPIYMLFILVSVIQFNAFVNMISFMPKYLEQQYGISSSDAIFLMGIYNLPPICIGYIIGGLIMKKFKITVKQAAHIGCWLSLLEYLLYFLSFLMTCENSSVVGINTSYEGIPQDLYVENDIFADCNVDCNCPSKIWDPVCGNNGLSYLSACLAGCETSIGTGINMVFQNCSCIQTSGNSSAVLGLCDKGPDCSLMLQYFLILSAMSSFIYSLAAIPGYMVLLRCMKSEEKSLGVGLHTFCTRVFAGIPAPIYFGALMDSTCLHWGTLKCGESGACRIYDSTTFRYIYLGLPAALRGSSFVPALIILILLRKCHLPGENASSGTELIETKVKGKENECKDIYQKSTVLKDDELKTKL

SEQ ID NO: 900863 - protein, 670 aa, Homo sapiens; identical to SEQ ID NO: 900862

SEQ ID NO: 900864 - protein, 284 aa, Homo sapiens
MFLLAITCAFVSKTLSGSYMNSMLTQIERQFNIPTSLVGFINGSFEIGNLLLIIFVSYFGTKLHRPIMIGIGCVVMGLGCFLKSLPHFLMNQYEYESTVSVSGNLSSNSFLCMENGTQILRPTQDPSECTKEVKSLMWVYVLVGNIVRGMGETPILPLGISYIEDFAKFENSPLYIGLVETGAIIGPLIGLLLASFCANVYVDTGFVNTDDLIITPTDTRWVGAWWFGFLICAGVNVLTAIPFFFLPNTLPKEGLETNADIIKNENEDKQKEEVKKEKYGITKE

SEQ ID NO: 900865 - protein, 284 aa, Homo sapiens; identical to SEQ ID NO: 900864

SEQ ID NO: 900866 - protein, 579 aa, Homo sapiens
MFLTKNCKQEQERVESAKMFLLAITCAFVSKTLSGSYMNSMLTQIERQFNIPTSLVGFINGSFEIGNLLLIIFVSYFGTKLHRPIMIGIGCVVMGLGCFLKSLPHFLMNQYEYESTVSVSGNLSSNSFLCMENGTQILRPTQDPSECTKEVKSLMWVYVLVGNIVRGMGETPILPLGISYIEDFAKFENSPLYIGLVETGAIIGPLIGLLLASFCANVYVDTGFVNTDDLIITPTDTRWVGAWWFGFLICAGVNVLTAIPFFFLPNTLPKEGLETNADIIKNENEDKQKEEVKKEKYGITKDFLPFMKSLSCNPIYMLFILVSVIQFNAFVNMISFMPKYLEQQYGISSSDAIFLMGIYNLPPICIGYIIGGLIMKKFKITVKQAAHIGCWLSLLEYLLYFLSFLMTCENSSVVGINTSYEGIPQDLYVENDIFADCNVDCNCPSKIWDPVCGNNGLSYLSACLAGCETSIGTGINMVFQNCSCIQTSGNSSAVLGLCDKGPDCSLMLQYFLILSAMSSFIYSLAAIPGYMVLLRCMKSEEKSLGVGLHTFCTRVFGKNSYFFPHPIRTILLLLFFITL

SEQ ID NO: 900867 - protein, 650 aa, Homo sapiens
MFLLAITCAFVSKTLSGSYMNSMLTQIERQFNIPTSLVGFINGSFEIGNLLLIIFVSYFGTKLHRPIMIGIGCVVMGLGCFLKSLPHFLMNQYEYESTVSVSGNLSSNSFLCMENGTQILRPTQDPSECTKEVKSLMWVYVLVGNIVRGMGETPILPLGISYIEDFAKFENSPLYIGLVETGAIIGPLIGLLLASFCANVYVDTGFVNTDDLIITPTDTRWVGAWWFGFLICAGVNVLTAIPFFFLPNTLPKEGLETNADIIKNENEDKQKEEVKKEKYGITKDFLPFMKSLSCNPIYMLFILVSVIQFNAFVNMISFMPKYLEQQYGISSSDAIFLMGIYNLPPICIGYIIGGLIMKKFKITVKQAAHIGCWLSLLEYLLYFLSFLMTCENSSVVGINTSYEGIPQDLYVENDIFADCNVDCNCPSKIWDPVCGNNGLSYLSACLAGCETSIGTGINMVFQNCSCIQTSGNSSAVLGLCDKGPDCSLMLQYFLILSAMSSFIYSLAAIPGYMVLLRCMKSEEKSLGVGLHTFCTRVFAGIPAPIYFGALMDSTCLHWGTLKCGESGACRIYDSTTFRYIYLGLPAALRGSSFVPALIILILLRKCHLPGENASSGTELIETKVKGKENECKDIYQKSTVLKDDELKTKL

SEQ ID NO: 900868 - protein, 305 aa, Homo sapiens
MFLLAITCAFVSKTLSGSYMNSMLTQIERQFNIPTSLVGFINGSFEIGNLLLIIFVSYFGTKLHRPIMIGIGCVVMGLGCFLKSLPHFLMNQYEYESTVSVSGNLSSNSFLCMENGTQILRPTQDPSECTKEVKSLMWVYVLVGNIVRGMGETPILPLGISYIEDFAKFENSPLYIGLVETGAIIGPLIGLLLASFCANVYVDTGFVNTDDLIITPTDTRWVGAWWFGFLICAGVNVLTAIPFFFLPNTLPKEGLETNADIIKNENEDKQKEEVKKEKYGITKGKYTYSKYYEIDLLFHIDMSVF

SEQ ID NO: 900869 - protein, 466 aa, Homo sapiens
WLVEKELMVSVLGPLSIDPNMLNTQRQQVQILLQEFATRKPQYEQLTAAGQGILSRPGEDPSLRGIVKEQLAAVTQKWDSLTGQLSDRCDWIDQAIVKSTQYQSLLRSLSDKLSDLDNKLSSSLAVSTHPDAMNQQLETAQKMKQEIQQEKKQIKVAQALCEDLSALVKEEYLKAELSRQLEGILKSFKDVEQKAENHVQHLQSACASSHQFQQMSRDFQAWLDTKKEEQNKSHPISAKLDVLESLIKDHKDFSKTLTAQSHMYEKTIAEGENLLLKTQGSEKAALQLQLNTIKTNWDTFNKQVKERENKLKESLEKALKYKEQVETLWPWIDKCQNNLEEIKFCLDPAEGENSIAKLKSLQKEMDQHFGMVELLNNTANSLLSVCEIDKEVVTDENKSLIQKVDMVTEQLHSKKFCLENMTQKFKEFQEVSKESKRQLQCAKEQLDIHDSLGSQAYSNKYLTMLQ

SEQ ID NO: 900870 - protein, 346 aa, Homo sapiens
WLVEKELMVSVLGPLSIDPNMLNTQRQQVQILLQEFATRKPQYEQLTAAGQGILSRPGEDPSLRGIVKEQLAAVTQKWDSLTGQLSDRCDWIDQAIVKSTQYQSLLRSLSDKLSDLDNKLSSSLAVSTHPDAMNQQLETAQKMKQEIQQEKKQIKVAQALCEDLSALVKEEYLKAELSRQLEGILKSFKDVEQKAENHVQHLQSACASSHQFQQMSRDFQAWLDTKKEEQNKSHPISAKLDVLESLIKDHKDFSKTLTAQSHMYEKTIAEGENLLLKTQGSEKAALQLQLNTIKTNWDTFNKQVKERENKLKESLEKALGFAYGSEVERLQLASYCEVAGAGYLES

SEQ ID NO: 900871 - protein, 187 aa, Homo sapiens
MQEAQPPEVLKTAGKWRSEGYCTASRVVARRTAPASSSPPPPPASPGGPSSSDQRSPCSNATARWTPPSTASWRTGPVEDTAIVGNKDPPSIWAAVPGKTFLNVTPAEVGVLVGKDWSSFVMNGLTLGGQKYTVVLDSLLQDGELTTDLRMKSIGGAPTFNVIVTMTAKTLGLLMGKEGIHGNFIDK

SEQ ID NO: 900872 - protein, 75 aa, Homo sapiens
GESTERELLELRTKVSKQEQLLQSTTEHLKNANQQKESMEQFIVSQLTRTHDVLKKARTNLEVKSLRALPCTPAL

SEQ ID NO: 900873 - protein, 75 aa, Homo sapiens; identical to SEQ ID NO: 900872

SEQ ID NO: 900874 - protein, 522 aa, Homo sapiens
MEFPDHSRHLLQCLSEQRHQGFLCDCTVLVGDAQFRAHRAVLASCSMYFHLFYKDQLDKRDIVHLNSDIVTAPAFALLLEFMYEGKLQFKDLPIEDVLAAASYLHMYDIVKVCKKKLKEKATTEADSTKKEEDASSCSDKVESLSDGSSHIAGDLPSDEDEGEDEKLNILPSKRDLAAEPGNMWMRLPSDSAGIPQAGGEAEPHATAAGKTVASPCSSTESLSQRSVTSVRDSADVDCVLDLSVKSSLSGVENLNSSYFSSQDVLRSNLVQVKVEKEASCDESDVGTNDYDMEHSTVKESVSTNNRVQYEPAHLAPLREDSVLRELDREDKASDDEMMTPESERVQVEGGMESSLLPYVSNILSPAGQIFMCPLCNKVFPSPHILQIHLSTHFREQDGIRSKPAADVNVPTCSLCGKTFSCMYTLKRHERTHSGEKPYTCTQCGKSFQYSHNLSRHAVVHTREKPHACKWCERRFTQSGDLYRHIRKFHCELVNSLSVKSEALSLPTVRDWTLEDSSQELWK

SEQ ID NO: 900875 - protein, 485 aa, Homo sapiens
MEFPDHSRHLLQCLSEQRHQGFLCDCTVLVGDAQFRAHRAVLASCSMYFHLFYKDQLDKRDIVHLNSDIVTAPAFALLLEFMYEGKLQFKDLPIEDVLAAASYLHMYDIVKVCKKKLKEKATTEADSTKKEEDASSCSDKVESLSDGSSHIAGDLPSDEDEGEDEKLNILPSKRDLAAEPGNMWMRLPSDSAGIPQAGGEAEPHATAAGKTVASPCSSTESLSQRTLLRSNLVQVKVEKEASCDESDVGTNDYDMEHSTVKESVSTNNRVQYEPAHLAPLREDSVLRELDREDKASDDEMMTPESERVQVEGGMESSLLPYVSNILSPAGQIFMCPLCNKVFPSPHILQIHLSTHFREQDGIRSKPAADVNVPTCSLCGKTFSCMYTLKRHERTHSGEKPYTCTQCGKSFQYSHNLSRHAVVHTREKPHACKWCERRFTQSGDLYRHIRKFHCELVNSLSVKSEALSLPTVRDWTLEDSSQELWK

SEQ ID NO: 900876 - protein, 522 aa, Homo sapiens; identical to SEQ ID NO: 900874

SEQ ID NO: 900877 - protein, 494 aa, Homo sapiens
MCPKGYEDSMEFPDHSRHLLQCLSEQRHQGFLCDCTVLVGDAQFRAHRAVLASCSMYFHLFYKDQLDKRDIVHLNSDIVTAPAFALLLEFMYEGKLQFKDLPIEDVLAAASYLHMYDIVKVCKKKLKEKATTEADSTKKEEDASSCSDKVESLSDGSSHIAGDLPSDEDEGEDEKLNILPSKRDLAAEPGNMWMRLPSDSAGIPQAGGEAEPHATAAGKTVASPCSSTESLSQRTLLRSNLVQVKVEKEASCDESDVGTNDYDMEHSTVKESVSTNNRVQYEPAHLAPLREDSVLRELDREDKASDDEMMTPESERVQVEGGMESSLLPYVSNILSPAGQIFMCPLCNKVFPSPHILQIHLSTHFREQDGIRSKPAADVNVPTCSLCGKTFSCMYTLKRHERTHSGEKPYTCTQCGKSFQYSHNLSRHAVVHTREKPHACKWCERRFTQSGDLYRHIRKFHCELVNSLSVKSEALSLPTVRDWTLEDSSQELWK

SEQ ID NO: 900878 - protein, 494 aa, Homo sapiens; identical to SEQ ID NO: 900877

SEQ ID NO: 900879 - protein, 429 aa, Homo sapiens
MTAALAVVTTSGLEDGVPRSRGEGTGEVVLERGPGAAYHMFVVMEDLVEKLKLLRYEEEFLRKSNLKAPSRHYFALPTNPGEQFYMFCTLAAWLINKAGRPFEQPQEYDDPNATISNILSELRSFGRTADFPPSKLKSGYGEHVCYVLDCFAEEALKYIGFTWKRPIYPVEELEEESVAEDDAELTLNKVDEEFVEEETDNEENFIDLNVLKAQTYHLDMNETAKQEDILESTTDAAEWSLEVERVLPQLKVTIRTDNKDWRIHVDQMHQHRSGIESALKETKGFLDKLHNEITRTLEKISSREKYINNQLENLVQEYRAAQAQLSEAKERYQQGNGGVTERTRLLSEVMEELEKVKQEMEEKGSSMTDGAPLVKIKQSLTKLKQETVEMDIRIGIVEHTLLQSKLKEKSNMTRNMHATVIPEPATGFY

SEQ ID NO: 900880 - protein, 411 aa, Homo sapiens
MTAALAVVTTSGLEDGVPRSRGEGTGEVVLERGPGAAYHMFVVMEDLVEKLKLLRYEEEFLRKSNLKAPSRHYFALPTNPGEQFYMFCTLAAWLINKAGRPFEQPQEYDDPNATISNILSELRSFGRTADFPPSKLKSGYGEHVCYVLDCFAEEALKYIGFTWKRPIYPVEELEEESVAEDDAELTLNKVDEEFVEEETDNEENFIDLNVLKAQTYHLDMNETAKQEDILESTTDAAEWSLEVERVLPQLKVTIRTDNKDWRIHVDQMHQHRSGIESALKETKGFLDKLHNEITRTLEKISSREKYINNQLENLVQEYRAAQAQLSEAKERYQQGNGGVTERTRLLSEVMEELEKVKQEMEEKGSSMTDGAPLVKIKQSLTKLKQETVEMDIRIGIVEHTLLQSKLKEKSM

SEQ ID NO: 900881 - protein, 466 aa, Homo sapiens
MTAALAVVTTSGLEDGVPRSRGEGTGEVVLERGPGAAYHMFVVMEDLVEKLKLLRYEEEFLRKSNLKAPSRHYFALPTNPGEQFYMFCTLAAWLINKAGRPFEQPQEYDDPNATISNILSELRSFGRTADFPPSKLKSGYGEHVCYVLDCFAEEALKYIGFTWKRVSPCCPGWSQTPGLRQSTCLGLPKCWDYRCEPSHPARPIYPVEELEEESVAEDDAELTLNKVDEEFVEEETDNEENFIDLNVLKAQTYHLDMNETAKQEDILESTTDAAEWSLEVERVLPQLKVTIRTDNKDWRIHVDQMHQHRSGIESALKETKGFLDKLHNEITRTLEKISSREKYINNQLENLVQEYRAAQAQLSEAKERYQQGNGGVTERTRLLSEVMEELEKVKQEMEEKGSSMTDGAPLVKIKQSLTKLKQETVEMDIRIGIVEHTLLQSKLKEKSNMTRNMHATVIPEPATGFY

SEQ ID NO: 900882 - protein, 270 aa, Homo sapiens
MTAALAVVTTSGLEDGVPRSRGEGTGEVVLERGPGAAYHMFVVMEDLVEKLKLLRYEEEFLRKSNLKAPSRHYFALPTNPGEQFYMFCTLAAWLINKAGRPFEQPQEYDDPNATISNILSELRSFGRTADFPPSKLKSGYGEHVCYVLDCFAEEALKYIGFTWKRPIYPVEELEEESVAEDDAELTLNKVDEEFVEEETDNEENFIDLNVLKAQTYHLDMNETAKQEDILESTTDAAEWSLEVERVLPQLKVTIRTDNKVSKWEHIFLKK

SEQ ID NO: 900883 - protein, 429 aa, Homo sapiens; identical to SEQ ID NO: 900879

SEQ ID NO: 900884 - protein, 387 aa, Homo sapiens
MTAALAVVTTSGLEDGVPRSRGEGTGEVVLERGPGAAYHMFVVMEDLVEKLKLLRYEEEFLRKSNLKAPSRHYFALPTNPGEQFYMFCTLAAWLINKAGRPFEQPQEYDDPNATISNILSELRSFGRTADFPPSKLKSGYGEHVCYVLDCFAEEALKYIGFTWKRPIYPVEELEEESVAEDDAELTLNKVDEEFVEEETDNEENFIDLNVLKAQTYHLDMNETAKQEDILESTTDAAEWSLEVERVLPQLKVTIRTDNKDWRIHVDQMHQHRSGIESALKETKGFLDKLHNEITRTLEKISSREKYINNQLENLVQEYRAAQAQLSEAKERYQQGNGGVTERTRLLSEVMEELEKVKQEMEEKGSSMTDGAPLVKIKQSLTKGAPAA

SEQ ID NO: 900885 - protein, 165 aa, Homo sapiens
MTAALAVVTTSGLEDGVPRSRGEGTGEVVLERGPGAAYHMFVVMEDLVEKLKLLRYEEEFLRKSNLKAPSRHYFALPTNPGEQFYMFCTLAAWLINKAGRPFEQPQEYDDPNATISNILSELRSFGRTADFPPSKLKSGYGEHVCYVLDCFAEEALKYIGFTWKR

SEQ ID NO: 900886 - protein, 287 aa, Homo sapiens [sequence omitted]

SEQ ID NO: 900887 - protein, 1369 aa, Homo sapiens
MGRLPSTYRKCYMLDFGLARQYTNTTGDVRPPRNVAGFRGTVRYASVNAHKNREMGRHDDLWSLFYMLVEFAVGQLPWRKIKDKEQVGMIKEKYEHRMLLKHMPSEFHLFLDHIASLDYFTKPDYQLIMSVFENSMKERGIAENEAFDWEKAGTDALLSTSTSTPPQQNTRQTAAMFGVVNVTPVPGDLLRENTEDVLQGEHLSDQENAPPILPGRPSEGLGPSPHLVPHPGGPEAEVWEETDVNRNKLRINIGKSPCVEEEQSRGMGVPSSPVRAPPDSPTTPVRSLRYRRVNSPESERLSTADGRVELPERRSRMDLPGSPSRQACSSQPAQMLSVDTGHADRQASGRMDVSASVEQEALSNAFRSVPLAEEEDFDSKEWVIIDKETELKDFPPGAEPSTSGTTDEEPEELRPLPEEGEERRRLGAEPTVRPRGRSMQALAEEDLQHLPPQPLPPQLSQGDGRSETSQPPTPGSPSHSPLHSGPRPRRRESDPTGPQRQVFSVAPPFEVNGLPRAVPLSLPYQDFKRDLSDYRERARLLNRVRRVGFSHMLLTTPQVPLAPVQPQANGKEEEEEEEEDEEEEEEDEEEEEEEEEEEEEEEEEEEEEEEAAAAVALGEVLGPRSGSSSEGSERSTDRSQEGAPSTLLADDQKESRGRASMADGDLEPEEGSKTLVLVSPGDMKKSPVTAELAPDPDLGTLAALTPQHERPQPTGSQLDVSEPGTLSSVLKSEPKPPGPGAGLGAGTVTTGVGGVAVTSSPFTKVERTFVHIAEKTHLNVMSSGGQALRSEEFSAGGELGLELASDGGAVEEGARAPLENGLALSGLNGAEIEGSALSGAPRETPSEMATNSLPNGPALADGPAPVSPLEPSPEKVATISPRRHAMPGSRPRSRIPVLLSEEDTGSEPSGSLSAKERWSKRARPQQDLARLVMEKRQGRLLLRLASGASSSSSEEQRRASETLSGTGSEEDTPASEPAAALPRKSGRAAATRSRIPRPIGLRMPMPVAAQQPASRSHGAAPALDTAITSRLQLQTPPGSATAADLRPKQPPGRGLGPGRAQAGARPPAPRSPRLPASTSAARNASASPRSQSLSRRESPSPSHQARPGVPPPRGVPPARAQPDGTPSPGGSKKGPRGKLQAQRATTKGRAGGAEGLGWGQIMTPAALRGPPPSPRPPTRSRPHWSSSQHSLTRPTRATRGPSFPPAPARTRASTRGAPPGLRARGGRGPAPRGGSASPSSPCVLSSSRRPSGRPASHQSLRPGEGSATFHRGLHFWGRLVRSPTRPRLRSMLPQQSLPTPPAAPCPPPTPFQPKSPHPFREAASNSRSGGSSLPARVQPHSLLGAIVARDGLWTARLGWGPREHRSTQV

SEQ ID NO: 900888 - protein, 1369 aa, Homo sapiens; identical to SEQ ID NO: 900887

SEQ ID NO: 900889 - protein, 1515 aa, Homo sapiens
GGGEQADILPANYVVKDRWKVLKKIGGGGFGEIYEAMDLLTRENVALKVESAQQPKQVLKMEVAVLKKLQGKDHVCRFIGCGRNEKFNYVVMQLQGRNLADLRRSQPRGTFTLSTTLRLGKQILESIEAIHSVGFLHRDIKPSNFAMGRLPSTYRKCYMLDFGLARQYTNTTGDVRPPRNVAGFRGTVRYASVNAHKNREMGRHDDLWSLFYMLVEFAVGQLPWRKIKDKEQVGMIKEKYEHRMLLKHMPSEFHLFLDHIASLDYFTKPDYQLIMSVFENSMKERGIAENEAFDWEKAGTDALLSTSTSTPPQQNTRQTAAMFGVVNVTPVPGDLLRENTEDVLQGEHLSDQENAPPILPGRPSEGLGPSPHLVPHPGGPEAEVWEETDVNRNKLRINIGKSPCVEEEQSRGMGVPSSPVRAPPDSPTTPVRSLRYRRVNSPESERLSTADGRVELPERRSRMDLPGSPSRQACSSQPAQMLSVDTGHADRQASGRMDVSASVEQEALSNAFRSVPLAEEEDFDSKEWVIIDKETELKDFPPGAEPSTSGTTDEEPEELRPLPEEGEERRRLGAEPTVRPRGRSMQALAEEDLQHLPPQPLPPQLSQGDGRSETSQPPTPGSPSHSPLHSGPRPRRRESDPTGPQRQVFSVAPPFEVNGLPRAVPLSLPYQDFKRDLSDYRERARLLNRVRRVGFSHMLLTTPQVPLAPVQPQANGKEEEEEEEEDEEEEEEDEEEEEEEEEEEEEEEEEEEEEEEAAAAVALGEVLGPRSGSSSEGSERSTDRSQEGAPSTLLADDQKESRGRASMADGDLEPEEGSKTLVLVSPGDMKKSPVTAELAPDPDLGTLAALTPQHERPQPTGSQLDVSEPGTLSSVLKSEPKPPGPGAGLGAGTVTTGVGGVAVTSSPFTKVERTFVHIAEKTHLNVMSSGGQALRSEEFSAGGELGLELASDGGAVEEGARAPLENGLALSGLNGAEIEGSALSGAPRETPSEMATNSLPNGPALADGPAPVSPLEPSPEKVATISPRRHAMPGSRPRSRIPVLLSEEDTGSEPSGSLSAKERWSKRARPQQDLARLVMEKRQGRLLLRLASGASSSSSEEQRRASETLSGTGSEEDTPASEPAAALPRKSGRAAATRSRIPRPIGLRMPMPVAAQQPASRSHGAAPALDTAITSRLQLQTPPGSATAADLRPKQPPGRGLGPGRAQAGARPPAPRSPRLPASTSAARNASASPRSQSLSRRESPSPSHQARPGVPPPRGVPPARAQPDGTPSPGGSKKGPRGKLQAQRATTKGRAGGAEGLGWGQIMTPAALRGPPPSPRPPTRSRPHWSSSQHSLTRPTRATRGPSFPPAPARTRASTRGAPPGLRARGGRGPAPRGGSASPSSPCVLSSSRRPSGRPASHQSLRPGEGSATFHRGLHFWGRLVRSPTRPRLRSMLPQQSLPTPPAAPCPPPTPFQPKSPHPFREAASNSRSGGSSLPARVQPHSLLGAIVARDGLWTARLGWGPREHRSTQV

SEQ ID NO: 900890 - protein, 625 aa, Homo sapiens
MLARMVSISRPRDPPASASQIERTFVHIAEKTHLNVMSSGGQALRSEEFSAGGELGLELASDGGAVEEGARAPLENGLALSGLNGAEIEGSALSGAPRETPSEMATNSLPNGPALADGPAPVSPLEPSPEKVATISPRRHAMPGSRPRSRIPVLLSEEDTGSEPSGSLSAKERWSKRARPQQDLARLVMEKRQGRLLLRLASGASSSSSEEQRRASETLSGTGSEEDTPASEPAAALPRKSGRAAATRSRIPRPIGLRMPMPVAAQQPASRSHGAAPALDTAITSRLQLQTPPGSATAADLRPKQPPGRGLGPGRAQAGARPPAPRSPRLPASTSAARNASASPRSQSLSRRESPSPSHQARPGVPPPRGVPPARAQPDGTPSPGGSKKGPRGKLQAQRATTKGRAGGAEGLGWGQIMTPAALRGPPPSPRPPTRSRPHWSSSQHSLTRPTRATRGPSFPPAPARTRASTRGAPPGLRARGGRGPAPRGGSASPSSPCVLSSSRRPSGRPASHQSLRPGEGSATFHRGLHFWGRLVRSPTRPRLRSMLPQQSLPTPPAAPCPPPTPFQPKSPHPFREAASNSRSGGSSLPARVQPHSLLGAIVARDGLWTARLGWGPREHRSTQV

SEQ ID NO: 900891 - protein, 486 aa, Homo sapiens
MGRLPSTYRKCYMLDFGLARQYTNTTGDVRPPRNVAGFRGTVRYASVNAHKNREMGRHDDLWSLFYMLVEFAVGQLPWRKIKDKEQVGMIKEKYEHRMLLKHMPSEFHLFLDHIASLDYFTKPDYQLIMSVFENSMKERGIAENEAFDWEKAGTDALLSTSTSTPPQQNTRQTAAMFGVVNVTPVPGDLLRENTEDVLQGEHLSDQENAPPILPGRPSEGLGPSPHLVPHPGGPEAEVWEETDVNRNKLRINIGKSPCVEEEQSRGMGVPSSPVRAPPDSPTTPVRSLRYRRVNSPESERLSTADGRVELPERRSRMDLPGSPSRQACSSQPAQMLSVDTGHADRQASGRMDVSASVEQEALSNAFRSVPLAEEEDFDSKEWVIIDKETELKDFPPGAEPSTSGTTDEEPEELRPLPEEGEERRRLGAEPTVRPRGRSMQALAEEDLQHLPPQPLPPQLSQGDGRSETSQPSLGKPPKNVYMPNRM

SEQ ID NO: 900892 - protein, 246 aa, Homo sapiens
MESIDQYIERKKKHFEEHNSMNELKQQPINKGGVRTPVPPRGRLSVASTPISQRRSQGRSCGPASQSTLGLKGSLKRSAISAAKTGVRFSAATKDNEHKRSLTKTPARKSAHVTVSGGTPKGEAVLGTHKLKTITGNSAAVITPFKLTTEATQTPVSNKKPVFDLKASLSRPLNYEPHKGKLKPWGQSKENNYLNQHVNRINFYKKTYKQPHLQTKEEQRKKREQERKEKKAKVLGMRRGLILAED

SEQ ID NO: 900893 - protein, 246 aa, Homo sapiens; identical to SEQ ID NO: 900892

SEQ ID NO: 900894 - protein, 246 aa, Homo sapiens; identical to SEQ ID NO: 900892

SEQ ID NO: 900895 - protein, 207 aa, Homo sapiens
MESIDQYIERKKKHFEEHNSMNELKQQPINKGGVRTPVPPRGRLSVASTPISQRRSQGRSCGPASQSTLGLKGSLKRSAISAAKTGVRFSAATKDNEHKRSLTKTPARKSAHVTVSGGTPKGEAVLGTHKLKTITGNSAAGKLKPWGQSKENNYLNQHVNRINFYKKTYKQPHLQTKEEQRKKREQERKEKKAKVLGMRRGLILAED

SEQ ID NO: 900896 - protein, 246 aa, Homo sapiens; identical to SEQ ID NO: 900892

SEQ ID NO: 900897 - protein, 288 aa, Homo sapiens
MESIDQYIERKKKHFEEHNSMNELKQQPINKGGVRTPVPPRGRLSVASTPISQRRSQGRSCGPASQSTLGLKGSLKRSAISAAKTGVRFSAATKDNEHKRSLTKTPARKSAHVTVSGGTPKGEAVLGTHKLKTITGNSAAVITPFKLTTEATQTPVSNKKPVFDLKASLSRPLNYEPHKGKLKPWGQSKENNYLNQHVNRINFYKKTYKQPHLQTKEEPRKKREQNEGEQGQRWEMGTGSYGCKYISLTLLVFGIHTFLLRNPMRRSPFREISERQMCSARSQRTLKS

SEQ ID NO: 900898 - protein, 246 aa, Homo sapiens; identical to SEQ ID NO: 900892

SEQ ID NO: 900899 - protein, 246 aa, Homo sapiens; identical to SEQ ID NO: 900892

SEQ ID NO: 900900 - protein, 246 aa, Homo sapiens; identical to SEQ ID NO: 900892

SEQ ID NO: 900901 - protein, 246 aa, Homo sapiens; identical to SEQ ID NO: 900892

SEQ ID NO: 900902 - protein, 308 aa, Homo sapiens
MRTFLKSFIISVSLDLGNRDSKVPSEGKKSLYTDESSKPGKNKRTAITTPNFKKLHEAHFKEMESIDQYIERKKKHFEEHNSMNELKQQPINKGGVRTPVPPRGRLSVASTPISQRRSQGRSCGPASQSTLGLKGSLKRSAISAAKTGVRFSAATKDNEHKRSLTKTPARKSAHVTVSGGTPKGEAVLGTHKLKTITGNSAAVITPFKLTTEATQTPVSNKKPVFDLKASLSRPLNYEPHKGKLKPWGQSKENNYLNQHVNRINFYKKTYKQPHLQTKEEQRKKREQERKEKKAKVLGMRRGLILAED

SEQ ID NO: 900903 - protein, 231 aa, Homo sapiens
MESIDQYIERQQPINKGGVRTPVPPRGRLSVASTPISQRRSQGRSCGPASQSTLGLKGSLKRSAISAAKTGVRFSAATKDNEHKRSLTKTPARKSAHVTVSGGTPKGEAVLGTHKLKTITGNSAAVITPFKLTTEATQTPVSNKKPVFDLKASLSRPLNYEPHKGKLKPWGQSKENNYLNQHVNRINFYKKTYKQPHLQTKEEQRKKREQERKEKKAKVLGMRRGLILAED

SEQ ID NO: 900904 - protein, 383 aa, Homo sapiens
MEEKPSGPIPDMLATAEPSSSETDKEVLSPAVPAAAPSSSMSEEPGPEQAATPPVWERGGAGGMQQGSSPAPDSCQPGPGPSPGLTSIVSGTSEDLRPPRRRPPPGKQIPCSSPGCCLSFPSVRDLAQHLRTHCPPTQSLEGKLFRCSALSCTETFPSMQELVAHSKLHYKPNRYFKCENCLLRFRTHRSLFKHLHVCAEHAQSPAPPPPPALDREPPAPERPPEVDPASAPGLPFPLLEPFTTPAPAPTGPFLPYLNPAPFGLSPPRLRPFLAAAPGPPASSAAVWKKSQGAGSSPRRPQGGSDAPSGHAAPSRIVWEHTRGRYSCMQCAFSTASRPAMTLHLEDHRPGAPAAPAAGPPRPDAPAGKAEECAGGEGGGGPRR

SEQ ID NO: 900905 - protein, 390 aa, Homo sapiens
MEEKPSGPIPDMLATAEPSSSETDKEVLSPAVPAAAPSSSMSEEPGPEQAATPPVWERGGAGGMQQGSSPAPDSCQPGPGPSPGLTSIVSGTSEDLRPPRRRPPPGKQIPCSSPGCCLSFPSVRDLAQHLRTHCPPTQSLEGKLFRCSALSCTETFPSMQELVAHSKLHYKPNRYFKCENCLLRFRTHRSLFKHLHVCAEHAQSPAPPPPPALDREPPAPERPPEVDPASAPGLPFPLLEPFTTPAPAPTGPFLPYLNPAPFGLSPPRLRPFLAAAPGPPASSAAVWKKSQGAGSSPRRPQGGSDAPSGHAAPSRIVWEHTRGRYSCMQCAFSTASRPAMTLHLEDHRPGAPAAPAAGPPRPDAPADPAPLAPKVSPLLSEGELPVFSQL

SEQ ID NO: 900906 - protein, 312 aa, Homo sapiens
MEEKPSGPIPDMLATAEPSSSETDKEVLSPAVPAAAPSSSMSEEPGPEQAATPPVWERGGAGGMQQGSSPAPDSCQPGPGPSPGLTSIVSGTSEDLRPPRRRPPPGKQIPCSSPGCCLSFPSVRDLAQHLRTHCPPTQSLEGKLFRCSALSCTETFPSMQELVAHSKLHYKPNRYFKCENCLLRFRTHRSLFKHLHVCAEHAQSPAPPPPPALDREPPAPERPPEVDPASAPGLPFPLLEPFTTPAPAPTGPFLPYLNPAPFGLSPPRLRPFLAAAPGPPASSAAVWKKSQGAGSSPRRPQGGSDAPSGACR

SEQ ID NO: 900907 - protein, 335 aa, Homo sapiens
NLYGARVKRGPRAGWLESRPRENGADVSANSHCPEGGRRLSCSRRSRRNKRPSRVEDGKQIPCSSPGCCLSFPSVRDLAQHLRTHCPPTQSLEGKLFRCSALSCTETFPSMQELVAHSKLHYKPNRYFKCENCLLRFRTHRSLFKHLHVCAEHAQSPAPPPPPALDREPPAPERPPEVDPASAPGLPFPLLEPFTTPAPAPTGPFLPYLNPAPFGLSPPRLRPFLAAAPGPPASSAAVWKKSQGAGSSPRRPQGGSDAPSGHAAPSRIVWEHTRGRYSCMQCAFSTASRPAMTLHLEDHRPGAPAAPAAGPPRPDAPAGKAEECAGGEGGGGPRR

SEQ ID NO: 900908 - protein, 475 aa, Homo sapiens
MGADWVDPEPRRVLSASSFHQEEKPSGPIPDMLATAEPSSSETDKEVLSPAVPAAAPSSSMSEEPGPEQAATPPVWERGGAGGMQQGSSPAPDSCQPGPGPSPGLTSIVSGTSEDLRPPRRRPPPGKQIPCSSPGCCLSFPSVRDLAQHLRTHCPPTQSLEGKLFRCSALSCTETFPSMQELVAHSKLHYKPNRYFKGDPDLLSPPSTPWMGRGIRGRGPTQPGFTSQVENRPPNLKLRLLSGFPRVSPGSHPKWSGRVAATVVQELGRCENCLLRFRTHRSLFKHLHVCAEHAQSPAPPPPPALDREPPAPERPPEVDPASAPGLPFPLLEPFTTPAPAPTGPFLPYLNPAPFGLSPPRLRPFLAAAPGPPASSAAVWKKSQGAGSSPRRPQGGSDAPSGHAAPSRIVWEHTRGRYSCMQCAFSTASRPAMTLHLEDHRPGAPAAPAAGPPRPDAPAGKAEECAGGEGGGGPRR

SEQ ID NO: 900909 - protein, 358 aa, Homo sapiens
MEEKPSGPIPDMLATAEPSSSETDKEVLSPAVPAAAPSSSMSEEPGPEQAATPPVWERGGAGGMQQGSSPAPDSCQPGPGPSPGLTSIVSGTSEDLRPPRRRPPPGKQIPCSSPGCCLSFPSVRDLAQHLRTHCPPTQSLEGKLFRCSALSCTETFPSMQELVAHSKLHYKPNRYFKCENCLLRFRTHRSLFKHLHVCAEHAQSPAPPPPPALDREPPAPERPPEVDPASAPGLPFPLLEPFTTRPFLAAAPGPPASSAAVWKKSQGAGSSPRRPQGGSDAPSGHAAPSRIVWEHTRGRYSCMQCAFSTASRPAMTLHLEDHRPGAPAAPAAGPPRPDAPAGKAEECAGGEGGGGPRR

SEQ ID NO: 900910 - protein, 410 aa, Homo sapiens
MEEKPSGPIPDMLATAEPSSSETDKEVLSPAVPAAAPSSSMSEEPGPEQAATPPVWERGGAGGMQQGSSPAPDSCQPGPGPSPGLTSIVSGTSEDLRPPRRRPPPGKQIPCSSPGCCLSFPSVRDLAQHLRTHCPPTQSLEGKLFRCSALSCTETFPSMQELVAHSKLHYKPNRYFKCENCLLRFRTHRSLFKHLHVCAEHAQSPAPPPPPALDREPPAPERPPEVDPASAPGLPFPLLEPFTTPAPAPTGPFLPYLNPAPFGLSPPRLRPFLAAAPGPPASSAAVWKKSQGECGVGGLQEGGLGSALTLNLTRPFTAGAGSSPRRPQGGSDAPSGHAAPSRIVWEHTRGRYSCMQCAFSTASRPAMTLHLEDHRPGAPAAPAAGPPRPDAPAGKAEECAGGEGGGGPRR

SEQ ID NO: 900911 - protein, 393 aa, Homo sapiens
MGADWVDPEPRRVLSASSFHQEEKPSGPIPDMLATAEPSSSETDKEVLSPAVPAAAPSSSMSEEPGPEQAATPPVWERGGAGGMQQGSSPAPDSCQPGPGPSPGLTSIVSGTSEDLRPPRRRPPPGKQIPCSSPGCCLSFPSVRDLAQHLRTHCPPTQSLEGKLFRCSALSCTETFPSMQELVAHSKLHYKPNRYFKGDPDLLSPPSTPWMGRGIRGRGPTQPGFTSQVENRPPNLKLRLLSGFPRVSPGSHPKWSGRVAAVPAAGTLHDPRPCPHRTVPALLEPCALWPKPPAPAPLPGRCTRAAGFQRRRLEKEPRCWQQPPKTPGRLRRALRARGPEPHRVGAHTRPLLVHAVRLLHGLAARHDPAPGGPPPRRPRGPRGRAAAPRRPRG

SEQ ID NO: 900912 - protein, 403 aa, Homo sapiens
MGADWVDPEPRRVLSASSFHQEEKPSGPIPDMLATAEPSSSETDKEVLSPAVPAAAPSSSMSEEPGPEQAATPPVWERGGAGGMQQGSSPAPDSCQPGPGPSPGLTSIVSGTSEDLRPPRRRPPPGKQIPCSSPGCCLSFPSVRDLAQHLRTHCPPTQSLEGKLFRCSALSCTETFPSMQELVAHSKLHYKPNRYFKCENCLLRFRTHRSLFKHLHVCAEHAQSPAPPPPPALDREPPAPERPPEVDPASAPGLPFPLLEPFTTPAPAPTGPFLPYLNPAPFGLSPPRLRPFLAAAPGPPASSAAVWKKSQGAGSSPRRPQGGSDAPSGHAAPSRIVWEHTRGRYSCMQCAFSTASRPAMTLHLEDHRPGAPAAPAAGPPRPDAPAGKAEECAGGEGGGGPRR

SEQ ID NO: 900913 - protein, 500 aa, Homo sapiens
NLYGARVKRGPRAGWLESRPRENGADVSANSHCPEGGRRLSCSRRSRRNKRPSRVEDGERGTGVAGAAELRGLAGSGPVRAYSLRPTPPPHPGTRPPLAVTRRAPYFRARPGMDHARQEEKPSGPIPDMLATAEPSSSETDKEVLSPAVPAAAPSSSMSEEPGPEQAATPPVWERGGAGGMQQGSSPAPDSCQPGPGPSPGLTSIVSGTSEDLRPPRRRPPPGKQIPCSSPGCCLSFPSVRDLAQHLRTHCPPTQSLEGKLFRCSALSCTETFPSMQELVAHSKLHYKPNRYFKCENCLLRFRTHRSLFKHLHVCAEHAQSPAPPPPPALDREPPAPERPPEVDPASAPGLPFPLLEPFTTPAPAPTGPFLPYLNPAPFGLSPPRLRPFLAAAPGPPASSAAVWKKSQGAGSSPRRPQGGSDAPSGHAAPSRIVWEHTRGRYSCMQCAFSTASRPAMTLHLEDHRPGAPAAPAAGPPRPDAPAGKAEECAGGEGGGGPRR

SEQ ID NO: 900914 - protein, 312 aa, Homo sapiens; identical to SEQ ID NO: 900906

SEQ ID NO: 900915 - protein, 367 aa, Homo sapiens
MEEKPSGPIPDMLATAEPSSSETDKEVLSPAVPAAAPSSSMSEEPGPEQAATPPVWERGGAGGMQQGSSPAPDSCQPGPGPSPGLTSIVSGTSEDLRPPRRRPPPGKQIPCSSPGCCLSFPSVRDLAQHLRTHCPPTQSLEGKLFRCSALSCTETFPSMQELVAHSKLHYKPNRYFKCENCLLRFRTHRSLFKHLHVCAEHAQSPAPPPPPALDREPPAPERPPEVDPASAPGLPFPLLEPFTTPAPAPTGPFRPFLAAAPGPPASSAAVWKKSQGAGSSPRRPQGGSDAPSGHAAPSRIVWEHTRGRYSCMQCAFSTASRPAMTLHLEDHRPGAPAAPAAGPPRPDAPAGKAEECAGGEGGGGPRR

SEQ ID NO: 900916 - protein, 222 aa, Homo sapiens
GPPGGPAQPRPLPTSRCENCLLRFRTHRSLFKHLHVCAEHAQSPAPPPPPALDREPPAPERPPEVDPASAPGLPFPLLEPFTTPAPAPTGPFLPYLNPAPFGLSPPRLRPFLAAAPGPPASSAAVWKKSQGAGSSPRRPQGGSDAPSGHAAPSRIVWEHTRGRYSCMQCAFSTASRPAMTLHLEDHRPGAPAAPAAGPPRPDAPAGKAEECAGGEGGGGPRR

SEQ ID NO: 900917 - protein, 241 aa, Homo sapiens
MFLTRSEYDRGVNTFSPEGRLFQVEYAIEAIKLGSTAIGIQTSEGVCLAVEKRITSPLMEPSSIEKIVEIDAHIGCAMSGLIADAKTLIDKARVETQNHWFTYNETMTVESVTQAVSNLALQFGEEDADPGAMSRPFGVALLFGGVDEKGPQLFHMDPSGTFVQCDARAIGSASEGAQSSLQEVYHKSMTLKEAIKSSLIILKQVMEEKLNATNIELATVQPGQNFHMFTKEELEEVIKDI

SEQ ID NO: 900918 - protein, 208 aa, Homo sapiens
MFLTRSEYDRGVNTFSPEGRLFQVEYAIEAIKLGSTAIGIQTSEGVCLAVEKRITSPLMEPSSIEKIVEIDAHIGCAMSGLIADAKTLIDKARVETQNHWFTYNETMTVESVTQAVSNLALQFGEEDADPGAMSRPFGVALLFGGVDEKGPQLFHMDPSGTFVQCDARAIGSASEGAQSSLQEVYHKALILKKASRVSLLFLNSKGGG

SEQ ID NO: 900919 - protein, 126 aa, Homo sapiens
MFLTRSEYDRGVNTFSPEGRLFQVEYAIEAIKLGSTAIGIQTSEGVCLAVEKRITSPLMEPSSIEKIVEIDAHIGCAMSGLIADAKTLIDKARVETQVKLALSPLLEGCTMLCSSSRTTGSPTMRQ

SEQ ID NO: 900920 - protein, 241 aa, Homo sapiens; identical to SEQ ID NO: 900917

SEQ ID NO: 900921 - protein, 241 aa, Homo sapiens; identical to SEQ ID NO: 900917

SEQ ID NO: 900922 - protein, 183 aa, Homo sapiens
MEPSSIEKIVEIDAHIGCAMSGLIADAKTLIDKARVETQNHWFTYNETMTVESVTQAVSNLALQFGEEDADPGAMSRPFGVALLFGGVDEKGPQLFHMDPSGTFVQCDARAIGSASEGAQSSLQEVYHKSMTLKEAIKSSLIILKQVMEEKLNATNIELATVQPGQNFHMFTKEELEEVIKDI

SEQ ID NO: 900923 - protein, 223 aa, Homo sapiens
MFLTRSEYDRGVNTFSPEGRLFQVEYAIEAIKLGSTAIGIQTSEGVCLAVEKRITSPLMEPSSIEDAKTLIDKARVETQNHWFTYNETMTVESVTQAVSNLALQFGEEDADPGAMSRPFGVALLFGGVDEKGPQLFHMDPSGTFVQCDARAIGSASEGAQSSLQEVYHKSMTLKEAIKSSLIILKQVMEEKLNATNIELATVQPGQNFHMFTKEELEEVIKDI

SEQ ID NO: 900924 - protein, 135 aa, Homo sapiens
MTVESVTQAVSNLALQFGEEDADPGAMSRPFGVALLFGGVDEKGPQLFHMDPSGTFVQCDARAIGSASEGAQSSLQEVYHKSMTLKEAIKSSLIILKQVMEEKLNATNIELATVQPGQNFHMFTKEELEEVIKDI

SEQ ID NO: 900925 - protein, 106 aa, Homo sapiens
MFLTRSEYDRGVNTFSPEGRLFQVEYAIEAIKLGSTAIGIQTSEGVCLAVEKRITSPLMEPSSIEKIVEIDAHIDYLCIPCCLCPLFWSLIPLPWLLTSLYNSITG

SEQ ID NO: 900926 - protein, 241 aa, Homo sapiens; identical to SEQ ID NO: 900917

SEQ ID NO: 900927 - protein, 218 aa, Homo sapiens
MFLTRSEYDRGVNTFSPEGRLFQVEYAIEAIKLGSTAIGIQTSEGVCLAVEKRITSPLMEPSSIEKIVEIDAHIGCAMSGLIADAKTLIDKARVETQNHWFTYNETMTVESVTQAVSNLALQFGEEDADPGAMSRPFGVALLFGGVDEKGPQLVYKCPFGPLYRGVVEHWALFKGGQRSCRKLPKSMLLRRLSFYLILNSIGGVVRLVCPGGRPISCS

SEQ ID NO: 900928 - protein, 241 aa, Homo sapiens; identical to SEQ ID NO: 900917

SEQ ID NO: 900929 - protein, 241 aa, Homo sapiens; identical to SEQ ID NO: 900917

SEQ ID NO: 900930 - protein, 183 aa, Homo sapiens; identical to SEQ ID NO: 900922

SEQ ID NO: 900931 - protein, 241 aa, Homo sapiens
MFLTRSEYDRGVNTFSPEGRLFQVEYAIEAIKLGSTAIGIQTSEGVCLAVEKRITSPLMEPSSIEKIVEIDAHIGCAMSGLIADAKTLIDKARVETQNHWFTYNETMTVESVTQAVSNLALQFGEEDADPGAMSRPFGVALLFGGVDEKGPQLFHMDPSGTFVQCDARAIGSASEGAQSSLQEVYHKSMTLKEAIKSSLIILKQVMEEKLNATNIERWGLAVLPRLVLNSWAQGNSPASAY

SEQ ID NO: 900932 - protein, 147 aa, Homo sapiens
AQEGGLKRSRSHAQLVLSTAAVWVSWLPVSWVPVESCWSSESPRSRCLLLPSPCFLPGLSTTGPCSWGTSGGNYGWAGPGPGRAAWVLPCHGAPQEPETGRTWGCYALLRRPPSFPKLDHIGGTCPTAESPLGPNSVRKREAPAGAW

SEQ ID NO: 900933 - protein, 511 aa, Homo sapiens
EKGERRGRVRRSAAPEVLVMNRIRIHVLPTNRGRITPVPRSQEPLSCAFTHRPCSHPRLEGQEFCIKHILEDKNAPFKQCSYISTKNGKRCPNAAPKPEKKDGVSFCAEHVRRNALALHAQMKKTNPGPVGETLLCQLSSYAKTELGSQTPESSRSEASRILDEDSWSDGEQEPITVDQTWRGDPDSEADSIDSDQEDPLKHAGVYTAEEVALIMREKLIRLQSLYIDQFKRLQHLLKEKKRRYLHNRKVEHEALGSSLLTGPEGLLAKERENLKRLKCLRRYRQRYGVEALLHRQLKERRMLATDGAAQQAHTTRSSQRCLAFVDDVRCSNQSLPMTRHCLTHICQDTNQVLFKCCQGSEEVPCNKPVPVSLSEDPCCPLHFQLPPQMYKPEQVLSVPDDLEAGPMDLYLSAAELQPTESLPLEFSDDLDVVGDGMQCPPSPLLFDPSLTLEDHLVKEIAEDTVDILGQMQMAGDGCRSQGSRNSEKASAPLSQSGLATANGKPEPTSIS

SEQ ID NO: 900934 - protein, 511 aa, Homo sapiens; identical to SEQ ID NO: 900933

SEQ ID NO: 900935 - protein, 537 aa, Homo sapiens
KQCQSQSRFLRLPGARISGDWSRRTKWRSHRLPRPGPVVRSEVLVMNRIRIHVLPTNRGRITPVPRSQEPLSCAFTHRPCSHPRLEGQEFCIKHILEDKNAPFKQCSYISTKNGKRCPNAAPKPEKKDGVSFCAEHVRRNALALHAQMKKTNPGPVGETLLCQLSSYAKTELGSQTPESSRSEASRILDEDSWSDGEQEPITVDQTWRGDPDSEADSIDSDQEDPLKHAGVYTAEEVALIMREKLIRLQSLYIDQFKRLQHLLKEKKRRYLHNRKVEHEALGSSLLTGPEGLLAKERENLKRLKCLRRYRQRYGVEALLHRQLKERRMLATDGAAQQAHTTRSSQRCLAFVDDVRCSNQSLPMTRHCLTHICQDTNQVLFKCCQGSEEVPCNKPVPVSLSEDPCCPLHFQLPPQMYKPEQVLSVPDDLEAGPMDLYLSAAELQPTESLPLEFSDDLDVVGDGMQCPPSPLLFDPSLTLEDHLVKEIAEDTVDILGQMQMAGDGCRSQGSRNSEKASAPLSQSGLATANGKPEPTSIS

SEQ ID NO: 900936 - protein, 477 aa, Homo sapiens
EKGERRGRVRRSAAPEVLVMNRIRIHVLPTNRGRITPVPRSQEPLSCAFTHRPCSHPRLEGQEFCIKHILEDKNAPFKQCSYISTKNGKRCPNAAPKPEKKDGVSFCAEHVRRNALALHAQMKKTNPGPVGETLLCQLSSYAKTELGSQTPESSRSEASRILDEDSWSDGEQEPITVDQTWRGDPDSEADSIDSDQEDPLKHAGVYTAEEVALIMREKLIRLQSLYIDQFKRLQHLLKEKKRRYLHNRKVEHEALGSSLLTGPEGLLAKERENLKRLKCLRRYRQRYGVEALLHRQLKERRMLATDGAAQQAHTTRSSQRCLAFVDDVRCSNQSLPMTRHCLTHICQDTNQVLFKCCQGSEEVPCNKPVPVSLSEDPCCPLHFQLPPQMYKPEQDLDVVGDGMQCPPSPLLFDPSLTLEDHLVKEIAEDTVDILGQMQMAGDGCRSQGSRNSEKASAPLSQSGLATANGKPEPTSIS

SEQ ID NO: 900937 - protein, 448 aa, Homo sapiens
EKGERRGRVRRSAAPEVLVMNRIRIHVLPTNRGRITPVPRVSFCAEHVRRNALALHAQMKKTNPGPVGETLLCQLSSYAKTELGSQTPESSRSEASRILDEDSWSDGEQEPITVDQTWRGDPDSEADSIDSDQEDPLKHAGVYTAEEVALIMREKLIRLQSLYIDQFKRLQHLLKEKKRRYLHNRKVEHEALGSSLLTGPEGLLAKERENLKRLKCLRRYRQRYGVEALLHRQLKERRMLATDGAAQQAHTTRSSQRCLAFVDDVRCSNQSLPMTRHCLTHICQDTNQVLFKCCQGSEEVPCNKPVPVSLSEDPCCPLHFQLPPQMYKPEQVLSVPDDLEAGPMDLYLSAAELQPTESLPLEFSDDLDVVGDGMQCPPSPLLFDPSLTLEDHLVKEIAEDTVDILGQMQMAGDGCRSQGSRNSEKASAPLSQSGLATANGKPEPTSIS

SEQ ID NO: 900938 - protein, 225 aa, Homo sapiens
QGKTNRLGGRVNRTRECWHRWCCQQAHTTRSSQRCLAFVDDVRCSNQSLPMTRHCLTHICQDTNQVLFKCCQGSEEVPCNKPVPVSLSEDPCCPLHFQLPPQMYKPEQVLSVPDDLEAGPMDLYLSAAELQPTESLPLEFSDDLDVVGDGMQCPPSPLLFDPSLTLEDHLVKEIAEDTVDILGQMQMAGDGCRSQGSRNSEKASAPLSQSGLATANGKPEPTSIS

SEQ ID NO: 900939 - protein, 152 aa, Homo sapiens
MREKLIRLQSLYIDQFKRLQHLLKEKKRRYLHNRKVEHEALGSSLLTGPEGLLAKERENLKRLKCLRRYRQRYGVEALLHRQLKERRMLATDGAAQQAHTTRSSQRCLAFVDDVRCSNQSLPMTRHCLTQKDATAIGDLLTLYCGLMETALD

SEQ ID NO: 900940 - protein, 575 aa, Homo sapiens
KQCQSQSRFLRLPGARISGDWSRRTKWRSHRLPRPGPVVRSEAGRDKGGVRGGGVAAAWGWCCRFPSCCSCASPEDTFSVVLVMNRIRIHVLPTNRGRITPVPRSQEPLSCAFTHRPCSHPRLEGQEFCIKHILEDKNAPFKQCSYISTKNGKRCPNAAPKPEKKDGVSFCAEHVRRNALALHAQMKKTNPGPVGETLLCQLSSYAKTELGSQTPESSRSEASRILDEDSWSDGEQEPITVDQTWRGDPDSEADSIDSDQEDPLKHAGVYTAEEVALIMREKLIRLQSLYIDQFKRLQHLLKEKKRRYLHNRKVEHEALGSSLLTGPEGLLAKERENLKRLKCLRRYRQRYGVEALLHRQLKERRMLATDGAAQQAHTTRSSQRCLAFVDDVRCSNQSLPMTRHCLTHICQDTNQVLFKCCQGSEEVPCNKPVPVSLSEDPCCPLHFQLPPQMYKPEQVLSVPDDLEAGPMDLYLSAAELQPTESLPLEFSDDLDVVGDGMQCPPSPLLFDPSLTLEDHLVKEIAEDTVDILGQMQMAGDGCRSQGSRNSEKASAPLSQSGLATANGKPEPTSIS

SEQ ID NO: 900941 - protein, 366 aa, Homo sapiens
EKGERRGRVRRSAAPEVLVMNRIRIHVLPTNRGRITPVPRSQEPLSCAFTHRPCSHPRLEGQEFCIKHILEDKNAPFKQCSYISTKNGKRCPNAAPKPEKKDGVSFCAEHVRRNALALHAQMKKTNPGPVGETLLCQLSSYAKTELGSQTPESSRSEASRILDEDSWSDGEQEPITVDQTWRGDPDSEADSIDSDQEDPLKHAGVYTAEEVALIMREKLIRLQSLYIDQFKRLQHLLKEKKRRYLHNRKVEHEALGSSLLTGPEGLLAKERENLKRLKCLRRYRQRYGVEALLHRQLKERRMLATDGAAQQAHTTRSSQRCLAFVDDVRCSNQSLPMTRHCLTQKDATAIGDLLTLYCGLMETALD

SEQ ID NO: 900942 - protein, 297 aa, Homo sapiens [sequence omitted]

SEQ ID NO: 900943 - protein, 552 aa, Homo sapiens
MKHWPFRVVSEGGKPKVQVEYKGETKTFFPEEISSMVLTKMKEIAEAYLGGKVHSAVITVPAYFNDSQRQATKDAGTITGLNVLRIINEPTAAAIAYGLDKKGCAGGEKNVLIFDLGGGTFDVSILTIEDGIFEVKSTAGDTHLGGEDFDNRMVSHLAEEFKRKHKKDIGPNKRAVRRLRTACERAKRTLSSSTQASIEIDSLYEGVDFYTSITRARFEELNADLFRGTLEPVEKALRDAKLDKGQIQEIVLVGGSTRIPKIQKLLQDFFNGKELNKSINPDEAVAYGAAVQAAILIGDKSENVQDLLLLDVTPLSLGIETAGGVMTPLIKRNTTIPTKQTQTFTTYSDNQSSVLVQVYEGERAMTKDNNLLGKFDLTGIPPAPRGVPQIEVTFDIDANGILNVTAADKSTGKENKITITNDKGRLSKDDIDRMVQEAERYKSEDEANRDRVAAKNALESYTYNIKQTVEDEKLRGKISEQDKNKILDKCQEVINWLDRNQMAEKDEYEHKQKELERVCNPIISKLYQGGPGGGSGGGGSGASGGPTIEEVD

SEQ ID NO: 900944 - protein, 552 aa, Homo sapiens; identical to SEQ ID NO: 900943

SEQ ID NO: 900945 - protein, 613 aa, Homo sapiens
MSARGPAIGIDLGTTYSCVGVFQHGKVEIIANDQGNRTTPSYVAFTDTERLIGDAAKNQVAMNPDQHHLRRQEADWTEIRGCHSAVGYETLAVPGGERGRQAQSASRVQGGDQDLLPRGDILHGPHEDEGDRGSLPGGQGAQRGHNGPGLFQRLAAPGHQGRRHHHGAQCAAHHQRAHGGTFDVSILTIEDGIFEVKSTAGDTHLGGEDFDNRMVSHLAEEFKRKHKKDIGPNKRAVRRLRTACERAKRTLSSSTQASIEIDSLYEGVDFYTSITRARFEELNADLFRGTLEPVEKALRDAKLDKGQIQEIVLVGGSTRIPKIQKLLQDFFNGKELNKSINPDEAVAYGAAVQAAILIGDKSENVQDLLLLDVTPLSLGIETAGGVMTPLIKRNTTIPTKQTQTFTTYSDNQSSVLVQVYEGERAMTKDNNLLGKFDLTGIPPAPRGVPQIEVTFDIDANGILNVTAADKSTGKENKITITNDKGRLSKDDIDRMVQEAERYKSEDEANRDRVAAKNALESYTYNIKQTVEDEKLRGKISEQDKNKILDKCQEVINWLDRNQMAEKDEYEHKQKELERVCNPIISKLYQGGPGGGSGGGGSGASGGPTIEEVD

SEQ ID NO: 900946 - protein, 118 aa, Homo sapiens
YGGFQNPGEGLGRRVLLEVETKSLETWNIPDLSPHQRPADLFPEDFCLKEDEEEVGDSQAWEEPTNWSTETWNLATSWEVGRGLRRRCSQAVAKGPSHSLGWEGGTTAEGRLKQSLFS

SEQ ID NO: 900947 - protein, 552 aa, Homo sapiens; identical to SEQ ID NO: 900943

SEQ ID NO: 900948 - protein, 150 aa, Homo sapiens
MSKGLLLLLLLSMGGTWASKEPLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQASSSSKAPPPSLPSPS

SEQ ID NO: 900949 - protein, 118 aa, Homo sapiens
MEMFQGLLLLLLLSMGGDMGIQGAASATVPPHQCHPGCGEGGLPRVHHRQHHHLCRLLPHHDPRAAGGPAGPASGGVQLPRCALRVHPAPWLPARREPRGLLRRGSQLSMCTLPPQHH

SEQ ID NO: 900950 - protein, 113 aa, Homo sapiens
MTRVLQGVLPALPQVVCNYRDVRFESIRLPGCPRGVNPVVSYAVALSCQCALCRRSTTDCGGPKDHPLTCDDPRFQDSSSSKAPPPSLPSPSRLPGLETRTQIRFHRKKKTEE

SEQ ID NO: 900951 - protein, 170 aa, Homo sapiens
ILKKATRVELLEHSRNIGIVVTAIETFKSSFQSSQPGDTLGLLVRGLKREDLRRGLVMVKPGSIKPHQKVEAQVYILSKEEGGRHKPFVSHFMPVMFSLTWDMACRIILPPEKELAMPGEDLKFNLILRQPMILEKGQRFTLRDGNRTIGTGLVTNTLAMTEEEKNIKWG

SEQ ID NO: 900952 - protein, 170 aa, Homo sapiens; identical to SEQ ID NO: 900951

SEQ ID NO: 900953 - protein, 306 aa, Homo sapiens
GCLLVVAANDSPMPQTREHLLLAKQIGVEHVVVYVNKADAVQDSEMVELVELEIQELFTEFGYKGEETPVIVGSLSALEGRDPELGLKSVQKLLDAVDTYIPVPARDLEKPFLLPVEAVYSMSGHGTMVTGMLEHDILKKGDKRELLGHNKNICTVLTGIEMFHKSLERAEAGDNLGALVRGLKREDLRRGLVMVKPGSIKPHQKVEAQVYILSKEEGGRHKPFVSHFMPVMFSLTWDMACRIILPPEKELAMPGEDLKFNLILRQPMILEKGQRFTLRDGNRTIGTGLVTNTLAMTEEEKNIKWG

SEQ ID NO: 900954 - protein, 516 aa, Homo sapiens
RVPGLGAALRRMSPWSWFLLQTLCLLPTGAASRRGAPGTANCELKPQQSELNSFLWTIKRDPPSYFFGTIHVPYTRVWDFIPDNSKEAFLQSSIVYFELDLTDPYTISALTSCQMLPQGENLQDVLPRDIYCRLKRHLEYVKLMMPLWMTPDQRGKGLYADYLFNAIAGNWERKRPVWVMLMVNSLTEVDIKSRGVPVLDLFLAQEAERLRKQTGAVEKVEEQCHPLNGLNFSQVIFALNQTLLQQESLRAGSLQIPYTTEDLIKHYNCGDLSSVILSHDSSQVPNFINATLPPQERITAQEIDSYLRRELIYKRNERIGKRVKALLEEFPDKGFFFAFGAGHFMGNNTVLDVLRREGYEVEHAPAGRPIHKGKSKKTSTRPTLSTIFAPKVPTLEVPAPEAVSSGHSTLPPLVSRPGSADTPSEAEQRFRKKRRRSQRRPRLRQFSDLWVRLEESDIVPQLQVPVLDRHISTELRLPRRGHSHHSQMVASSACLSLWTPVFWVLVLAFQTETPLL

SEQ ID NO: 900955 - protein, 409 aa, Homo sapiens
RVPGLGAALRRMSPWSWFLLQTLCLLPTGAASRRGAPGTANCELKPQQSELNSFLWTIKRDPPSYFFGTIHVPYTRVWDFIPDNSKEAFLQSSIVYFELDLTDPYTISALTSCQMLPQGENLQDVLPRDIYCRLKRHLEYVKLMMPLWMTPDQRGKGLYADYLFNAIAGNWERKRPVWVMLMVNSLTEVDIKSRGVPVLDLFLAQEAERLRKQTVGSGKGGRAVPSIEWVELFTGHFMGNNTVLDVLRREGYEVEHAPAGRPIHKGKSKKTSTRPTLSTIFAPKVPTLEVPAPEAVSSGHSTLPPLVSRPGSADTPSEAEQRFRKKRRRSQRRPRLRQFSDLWVRLEESDIVPQLQVPVLDRHISTELRLPRRGHSHHSQMVASSACLSLWTPVFWVLVLAFQTETPLL

SEQ ID NO: 900956 - protein, 344 aa, Homo sapiens
RVPGLGAALRRMSPWSWFLLQTLCLLPTGAASRRGAPGTANCELKPQQSELNSFLWTIKRDPPSYFFGTIHVPYTRVWDFIPDNSKEAFLQSSIVYFELDLTDPYTISALTSCQMLPQGENLQDVLPRDIYCRLKRHLEYVKLMMPLWMTPDQRGKGLYADYLFNAIAGNWERKRPVWVMLMVNSLTEVDIKSRGVPVLDLFLAQEAERLRKQTGAVEKVEEQCHPLNGLNFSQVIFALNQTLLQQESLRAGSLQIPYTTEDLIKHYNCGDLSSVILSHDSSQVPNFINATLPPQERITAQEIDSYLRRELIYKRNERIGKRVKALLEEFPDKGFFFAFGAASQ

SEQ ID NO: 900957 - protein, 111 aa, Homo sapiens
MVIFALNQTLLQQESLRAGSLQIPYTTEDLIKHYNCGDLSSVILSHDSSQVPNFINATLPPQERITAQEIDSYLRRELIYKRNERIGKRVKALLEEFPDKGFFFAFGAASQ

SEQ ID NO: 900958 - protein, 172 aa, Homo sapiens
MGNNTVLDVLRREGYEVEHAPAGRPIHKGKSKKTSTRPTLSTIFAPKVPTLEVPAPEAVSSGHSTLPPLVSRPGSADTPSEAEQRFRKKRRRSQRRPRLRQFSDLWVRLEESDIVPQLQVPVLDRHISTELRLPRRGHSHHSQMVASSACLSLWTPVFWVLVLAFQTETPLL

SEQ ID NO: 900959 - protein, 260 aa, Homo sapiens
RVPGLGAALRRMSPWSWFLLQTLCLLPTGAASRRGAPGTANCELKPQQSELNSFLWTIKRDPPSYFFGTIHVPYTRVWDFIPDNSKEAFLQSSIVYFELDLTDPYTISALTSCQMLPQGENLQDVLPRDIYCRLKRHLEYVKLMMPLWMTPDQRGKGLYADYLFNAIAGNWERKRPVWVMLMVNSLTEVDIKSRGVPVLDLFLAQEAERLRKQTGAVEKVEEQCHPLNGLNFSQHLCFEPRPSCRRTTPPSSLQNTFGYL

SEQ ID NO: 900960 - protein, 435 aa, Homo sapiens
SVSRSGGGPGCGGGSGGRCRGGRRRSMWRSRWDASVLKAEALALLPCGLGMAFSQSHVMAARRHQHSRLIIEVDEYSSNPTQAFTFYNINQGRFQPPHVQMVDPVPHDAPKPPGYTRFVCVSDTHSRTDPIQMPYGDVLIHAGDFTELGLPSEVKKFNEWLGSLPYEYKIVIAGNHELTFDQEFMADLIKQDFYYFPSVSKLKPENYENVQSLLTNCIYLQDSEVTVRGFRIYGSPWQPWFYGWGFNLPRGQALLEKWNLIPEGVDILITHGPPLGFLDWVPKKMQRVGCVELLNTVQRRVQPRLHVFGHIHEGYGVMADGTTTYVNASVCTVNYQPVNPPIVIDLPTPRKLLTAPHCPCPARPCQLHRPGPATVPSMLSCLDDPSGCGDWPSRQVRALERLFSLLSPGVGTLRIPIRGSVLIYFFCVYILRVPR

SEQ ID NO: 900961 - protein, 305 aa, Homo sapiens
SVSRSGGGPGCGGGSGGRCRGGRRRSMWRSRWDASVLKAEALALLPCGLGMAFSQSHVMAARRHQHSRLIIEVDEYSSNPTQAFTFYNINQGRFQPPHVQMVDPVPHDAPKPPGYTRFVCVSDTHSRTDPIQMPYGDVLIHAGDFTELGLPSEVKKFNEWLGSLPYEYKIVIAGNHELTFDQEFMADLIKQDFYYFPSVSKLKPENYENVQSLLTNCIYLQDSEVTVRGFRIYGSPWQQHCIGLAEAERRGVQGSRNPVVAEGVPVARDVYEVSLMPQAQDMCAGGEKQALSVPAPLNFYVDQER

SEQ ID NO: 900962 - protein, 730 aa, Homo sapiens
MLFNSVLRQPQLGVLRNGWSSQYPLQSLLTGYQCSGNDEHTSYGETGVPVPPFGCTFSSAPNMEHVLAVANEEGFVRLYNTESQSFRKKCFKEWMAHWNAVFDLAWVPGELKLVTAAGDQTAKFWDVKAGELIGTCKGHQCSLKSVAFSKFEKAVFCTGGRDGNIMVWDTRCNKKDGFYRQVNQISGAHNTSDKQTPSKPKKKQNSKGLAPSVDFQQSVTVVLFQDENTLVSAGAVDGIIKVWDLRKNYTAYRQEPIASKSFLYPGSSTRKLGYSSLILDSTGSTLFANCTDDNIYMFNMTGLKTSPVAIFNGHQNSTFYVKSSLSPDDQFLVSGSSDEAAYIWKVSTPWQPPTVLLGHSQEVTSVCWCPSDFTKIATCSDDNTLKIWRLNRGLEEKPGGDKLSTVGWASQKKKESRPGLVTVTSSQSTPAKAPRVKCNPSNSSPSSAACAPSCAGDLPLPSNTPTFSIKTSPAKARSPINRRGSVSSVSPKPPSSFKMSIRNWVTRTPSSSPPITPPASETKIMSPRKALIPVSQKSSQAEACSESRNRVKRRLDSSCLESVKQKCVKSCNCVTELDGQVENLHLDLCCLAGNQEDLSKDSLGPTKSSKIEGAGTSISEPPSPISPYASESCGTLPLPLRPCGEGSEMVGKENSSPENKNWLLAMAAKRKAENPSPRSPSSQTPNSRRQSGKTLPSPVTITPSSMRKICTYFHRKSQEDFCGPEHSTEL

SEQ ID NO: 900963 - protein, 730 aa, Homo sapiens; identical to SEQ ID NO: 900962

SEQ ID NO: 900964 - protein, 730 aa, Homo sapiens; identical to SEQ ID NO: 900962

SEQ ID NO: 900965 - protein, 496 aa, Homo sapiens
MVIRIIKVWDLRKNYTAYRQEPIASKSFLYPGSSTRKLGYSSLILDSTGSTLFANCTDDNIYMFNMTGLKTSPVAIFNGHQNSTFYVKSSLSPDDQFLVSGSSDEAAYIWKVSTPWQPPTVLLGHSQEVTSVCWCPSDFTKIATCSDDNTLKIWRLNRGLEEKPGGDKLSTVGWASQKKKESRPGLVTVTSSQSTPAKAPRVKCNPSNSSPSSAACAPSCAGDLPLPSNTPTFSIKTSPAKARSPINRRGSVSSVSPKPPSSFKMSIRNWVTRTPSSSPPITPPASETKIMSPRKALIPVSQKSSQAEACSESRNRVKRRLDSSCLESVKQKCVKSCNCVTELDGQVENLHLDLCCLAGNQEDLSKDSLGPTKSSKIEGAGTSISEPPSPISPYASESCGTLPLPLRPCGEGSEMVGKENSSPENKNWLLAMAAKRKAENPSPRSPSSQTPNSRRQSGKTLPSPVTITPSSMRKICTYFHRKSQEDFCGPEHSTEL

SEQ ID NO: 900966 - protein, 730 aa, Homo sapiens; identical to SEQ ID NO: 900962

SEQ ID NO: 900967 - protein, 232 aa, Homo sapiens
MSIRNWVTRTPSSSPPITPPASETKIMSPRKALIPVSQKSSQAEACSESRNRVKRRLDSSCLESVKQKCVKSCNCVTELDGQVENLHLDLCCLAGNQEDLSKDSLGPTKSSKIEGAGTSISEPPSPISPYASESCGTLPLPLRPCGEGSEMVGKENSSPENKNWLLAMAAKRKAENPSPRSPSSQTPNSRRQSGKTLPSPVTITPSSMRKICTYFHRKSQEDFCGPEHSTEL

SEQ ID NO: 900968 - protein, 72 aa, Homo sapiens
PRFVRASATPCAGAQGALGLQVPAAGRKGGGDPKGEMTLRRPDVARKPIRERDVSLARSLAAGAYSGGSWRR

SEQ ID NO: 900969 - protein, 730 aa, Homo sapiens; identical to SEQ ID NO: 900962

SEQ ID NO: 900970 - protein, 653 aa, Homo sapiens
MLFNSVLRQPQLGVLRNAPNMEHVLAVANEEGFVRLYNTESQSFRKKCFKEWMAHWNAVFDLAWVPGELKLVTAAGDQTAKFWDVKAGELIGTCKGHQCSLKSVAFSKFEKAVFCTGGRDGNIMVWDTRCNKKDGFYRQVNQISGAHNTSDKQTPSKPKKKQNSKGLAPSVDFQQSVTVVLFQDENTLVSAGAVDGIFKSDFGFHWLYLFANCTDDNIYMFNMTGLKTSPVAIFNGHQNSTFYVKSSLSPDDQFLVSGSSDEAAYIWKVSTPWQPPTVLLGHSQEVTSVCWCPSDFTKIATCSDDNTLKIWRLNRGLEEKPGGDKLSTVGWASQKKKESRPGLVTVTSSQSTPAKAPRVKCNPSNSSPSSAACAPSCAGDLPLPSNTPTFSIKTSPAKARSPINRRGSVSSVSPKPPSSFKMSIRNWVTRTPSSSPPITPPASETKIMSPRKALIPVSQKSSQAEACSESRNRVKRRLDSSCLESVKQKCVKSCNCVTELDGQVENLHLDLCCLAGNQEDLSKDSLGPTKSSKIEGAGTSISEPPSPISPYASESCGTLPLPLRPCGEGSEMVGKENSSPENKNWLLAMAAKRKAENPSPRSPSSQTPNSRRQSGKTLPSPVTITPSSMRKICTYFHRKSQEDFCGPEHSTEL

SEQ ID NO: 900971 - protein, 232 aa, Homo sapiens; identical to SEQ ID NO: 900967

SEQ ID NO: 900972 - protein, 713 aa, Homo sapiens
MLFNSVLRQPQLGVLRNGWSSQYPLQSLLTGYQCSGNDEHTSYGETGVPVPPFGCTFSSAPNMEHVLAVANEEGFVRLYNTESQSFRKKCFKEWMAHWNAVFDLAWVPGELKLVTAAGDQTAKFWDVKAGELIGTCKGHQCSLKSVAFSKFEKAVFCTGGRDGNIMVWDTRCNKKDGFYRQVNQISGAHNTSDKQTPSKPKKKQNSKGLAPSVDFQQSVTVVLFQDENTLVSAGAVDGIIKVWDLRKNYTAYRQEPIASKSFLYPGSSTRKLGYSSLILDSTGSTLFANCTDDNIYMFNMTGLKTSPVAIFNGHQNSTFYVKSSLSPDDQFLVSGSSDEAAYIWKVSTPWQPPTVLLGHSQEVTSVCWCPSDFTKIATCSDDNTLKIWRLNRGLEEKPGGDKLSTVGWASQKKKESRPGLVTVTSSQSTPAKAPRVKCNPSNSSPSSAACAPSCAGDLPLPSNTPTFSIKTSPAKARSPINRRGSVSSVSPKPPSSFKMSIRNWVTRTPSSSPPITPPASETKIMSPRKALIPVSQKSSQAEACSESRNRVKRRLDSSCLESVKQKCVKSCNCVTELDGQVENLHLDLCCLAGNQEDLSKDSLGPTKSSKIEGAGTSISEPPSPISPYASESCGTLPLPLRPCGEGSEMVGKENSSPENKNWLLAMAAKRKAENPSPRSPSSQTPNSRRQSGKTLPSPLQSAKVFTNQNQLVI

SEQ ID NO: 900973 - protein, 761 aa, Homo sapiens [sequence omitted]

SEQ ID NO: 900974 - protein, 348 aa, Homo sapiens
MGSAVSFLLLSKAVCLYECFKWSFFYPYCYRGFTGQKTEEVKQDKDDIINIFSVASGHLYERFLRIMMLSVLKNTKTPVKFWFLKNYLSPTFKEFIPYMANEYNFQYELVQYKWPRWLHQQTEKQRIIWGYKILFLDVLFPLVVDKFLFVDADQIVRTDLKELRDFNLDGAPYGYTPFCDSRREMDGYRFWKSGYWASHLAGRKYHISALYVVDLKKFRKIAAGDRLRGQYQGLSQDPNSLSNLDQDLPNNMIHQVPIKSLPQEWLWCETWCDDASKKRAKTIDLCNNPMTKEPKLEAAVRIVPEWQDYDQEIKQLQIRFQKEKETGALYKEKTKEPSREGPQKREEL

SEQ ID NO: 900975 - protein, 608 aa, Homo sapiens
MINNPAKEISYENTQISRAIWAALQTQTSNAAKNFITKMAKEGAAEALAAGADIAEFSVGGMDFSLFKEVFESSKMDFILSHAVYCRDVLKLKKGQRAVISNGRIIGPLEDSELFNQDDFHLLENIILKTSGQKIKSHIQQLRVEEDVASDLVMKVDALLSAQPKGDPRIEYQFFEDRHSAIKLRPKEGETYFDVVAVVDPVTREAQRLAPLLLVLAQLINMNLRVFMNCQSKLSDMPLKSFYRYVLEPEISFTSDNSFAKGPIAKFLDMPQSPLFTLNLNTPESWMVESVRTPYDLDNIYLEEVDSVVAAEYELEYLLLEGHCYDITTGQPPRGLQFTLGTSANPVIVDTIVMANLGYFQLKANPGAWILRLRKGRSEDIYRIYSHDGTDSPPDADEVVIVLNNFKSKIIKVKVQKKADMVNEDLLSDGTSENESGFWDSFKWGFTGQKTEEVKQDKDDIINIFSVASGHLYERFLRIMMLSVLKNTKTPVKFWFLKNYLSPTFKDLPNNMIHQVPIKSLPQEWLWCETWCDDASKKRAKTIDLCNNPMTKEPKLEAAVRIVPEWQDYDQEIKQLQIRFQKEKETGALYKEKTKEPSREGPQKREEL

SEQ ID NO: 900976 - protein, 761 aa, Homo sapiens [sequence omitted]

SEQ ID NO: 900977 - protein, 761 aa, Homo sapiens [sequence omitted]

SEQ ID NO: 900978 - protein, 761 aa, Homo sapiens [sequence omitted]

SEQ ID NO: 900979 - protein, 761 aa, Homo sapiens [sequence omitted]

SEQ ID NO: 900980 - protein, 92 aa, Homo sapiens
HFSCLPLATHTFFVDVNTALHEPTTILLLCNNPMTKEPKLEAAVRIVPEWQDYDQEIKQLQIRFQKEKETGALYKEKTKEPSREGPQKREEL

SEQ ID NO: 900981 - protein, 761 aa, Homo sapiens [sequence omitted]

SEQ ID NO: 900982 - protein, 764 aa, Homo sapiens
MINNPAKEISYENTQISRAIWAALQTQTSNAAKNFITKMAKEGAAEALAAGADIAEFSVGGMDFSLFKEVFESSKMDFILSHAVYCRDVLKLKKGQRAVISNGRIIGPLEDSELFNQDDFHLLENIILKTSGQKIKSHIQQLRVEEDVASDLVMKVDALLSAQPKGDPRIEYQFFEDRHSAIKLRPKEGETYFDVVAVVDPVTREAQRLAPLLLVLAQLINMNLRVFMNCQSKLSDMPLKSFYRYVLEPEISFTSDNSFAKGPIAKFLDMPQSPLFTLNLNTPESWMVESVRTPYDLDNIYLEEVDSVVAAEYELEYLLLEGHCYDITTGQPPRGLQFTLGTSANPVIVDTIVMANLGYFQLKANPGAWILRLRKGRSEDIYRIYSHDGTDSPPDADEVVIVLNNFKSKIIKVKVQKKADMVNEDLLSDGTSENESGFWDSFKWGFTGQKTEEVKQDKDDIINIFSVASGHLYERFLRIMMLSVLKNTKTPVKFWFLKNYLSPTFKEFIPYMANEYNFQYELVQYKWPRWLHQQTEKQRIIWGYKILFLDVLFPLVVDKFLFVDADQIVRTDLKELRDFNLDGAPYGYTPFCDSRREMDGYRFWKSGYWASHLAGRKYHISALYVVDLKKFRKIAAGDRLRGQYQGLSQDPNSLSNLDQDLPNNMIHQVPIKSLPQEWLWCETWCDDASKKRAKTIDLCNNPMTKEPKLEAAVRIVPEWQDYDQEIKQLQIRFQKEKETGALYKEKTKEPSREGPQTPSKGINR

SEQ ID NO: 900983 - protein, 622 aa, Homo sapiens
MINNPAKEISYENTQISRAIWAALQTQTSNAAKNFITKMAKEGAAEALAAGADIAEFSVGGMDFSLFKEVFESSKMDFILSHAVYCRDVLKLKKGQRAVISNGRIIGPLEDSELFNQDDFHLLENIILKTSGQKIKSHIQQLRVEEDVASDLVMKVDALLSAQPKGDPRIEYQFFEDRHSAIKLRPKEGETYFDVVAVVDPVTREAQRLAPLLLVLAQLINMNLRVFMNCQSKLSDMPLKSFYRYVLEPEISFTSDNSFAKGPIAKFLDMPQSPLFTLNLNTPESWMVESVRTPYDLDNIYLEEVDSVVAAEYELEYLLLEGHCYDITTGQPPRGLQFTLGTSANPVIVDTIVMANLGYFQLKANPGAWILRLRKGRSEDIYRIYSHDGTDSPPDADEVVIVLNNFKSKIIKVKVQKKADMVNEDLLSDGTSENESGFWDSFKWGFTGQKTEEVKQDKDDIINIFSVASGHLYERFLRIMMLSVLKNTKTPVKFWFLKNYLSPTFKEFIPYMANEYNFQYELVQYKWPRWLHQQTEKQRIIWGYKILFLDVLFPLVVDKFLFVDADQIVRTDLKELRDFNLDGAPYGYTPFCDSRREMDGYRFWKSGYWASHLAGRKYHIRY

SEQ ID NO: 900984 - protein, 1567 aa, Homo sapiens
SLALWRTDHGPGMGCKGDASGACAAGALPVTGVCYKMGVLVVLTVLWLFSSVKADSKAITTSLTTKWFSTPLLLEASEFLAEDSQEKFWNFVEASQNIGSSDHDGTDYSYYHAILEAAFQFLSPLQQNLFKFCLSLRSYSATIQAFQQIAADEPPPEGCNSFFSVHGKKTCESDTLEALLLTASERPKPLLFKGDHRYPSSNPESPVVIFYSEIGSEEFSNFHRQLISKSNAGKINYVFRHYIFNPRKEPVYLSGYGVELAIKSTEYKAKDDTQVKGTEVNTTVIGENDPIDEVQGFLFGKLRDLHPDLEGQLKELRKHLVESTNEMAPLKVWQLQDLSFQTAARILASPVELALVVMKDLSQNFPTKARAITKTAVSSELRTEVEENQKYFKGTLGLQPGDSALFINGLHMDLDTQDIFSLFDVLRNEARVMEGLHRLGIEGLSLHNVLKLNIQPSEADYAVDIRSPAISWVNNLEVDSRYNSWPSSLQELLRPTFPGVIRQIRKNLHNMVFIVDPAHETTAELMNTAEMFLSNHIPLRIGFIFVVNDSEDVDGMQDAGVAVLRAYNYVAQEVDDYHAFQTLTHIYNKVRTGEKVKVEHVVSVLEKKYPYVEVNSILGIDSAYDRNRKEARGYYEQTGVGPLPVVLFNGMPFEREQLDPDELETITMHKILETTTFFQRAVYLGELPHDQDVVEYIMNQPNVVPRINSRILTAERDYLDLTASNNFFVDDYARFTILDSQGKTAAVANSMNYLTKKGMSSKEIYDDSFIRPVTFWIVGDFDSPSGRQLLYDAIKHQKSSNNVRISMINNPAKEISYENTQISRAIWAALQTQTSNAAKNFITKMAKEGAAEALAAGADIAEFSVGGMDFSLFKEVFESSKMDFILSHAVYCRDVLKLKKGQRAVISNGRIIGPLEDSELFNQDDFHLLENIILKTSGQKIKSHIQQLRVEEDVASDLVMKVDALLSAQPKGDPRIEYQFFEDRHSAIKLRPKEGETYFDVVAVVDPVTREAQRLAPLLLVLAQLINMNLRVFMNCQSKLSDMPLKSFYRYVLEPEISFTSDNSFAKGPIAKFLDMPQSPLFTLNLNTPESWMVESVRTPYDLDNIYLEEVDSVVAAEYELEYLLLEGHCYDITTGQPPRGLQFTLGTSANPVIVDTIVMANLGYFQLKANPGAWILRLRKGRSEDIYRIYSHDGTDSPPDADEVVIVLNNFKSKIIKVKVQKKADMVNEDLLSDGTSENESGFWDSFKWGFTGQKTEEVKQDKDDIINIFSVASGHLYERFLRIMMLSVLKNTKTPVKFWFLKNYLSPTFKEFIPYMANEYNFQYELVQYKWPRWLHQQTEKQRIIWGYKILFLDVLFPLVVDKFLFVDADQIVRTDLKELRDFNLDGAPYGYTPFCDSRREMDGYRFWKSGYWASHLAGRKYHISALYVVDLKKFRKIAAGDRLRGQYQGLSQDPNSLSNLDQDLPNNMIHQVPIKSLPQEWLWCETWCDDASKKRAKTIDLCNNPMTKEPKLEAAVRIVPEWQDYDQEIKQLQIRFQKEKETGALYKEKTKEPSREGPQKREEL

SEQ ID NO: 900985 - protein, 626 aa, Homo sapiens
MINNPAKEISYENTQISRAIWAALQTQTSNAAKNFITKMAKEGAAEALAAGADIAEFSVGGMDFSLFKEVFESSKMDFILSHAVYCRDVLKLKKGQRAVISNGRIIGPLEDSELFNQDDFHLLENIILKTSGQKIKSHIQQLRVEEDVASDLVMKVDALLSAQPKGDPRIEYQFFEDRHSAIKLRPKEGETYFDVVAVVDPVTREAQRLAPLLLVLAQLINMNLRVFMNCQSKLSDMPLKSFYRYVLEPEISFTSDNSFAKGPIAKFLDMPQSPLFTLNLNTPESWMVESVRTPYDLDNIYLEEVDSVVAAEYELEYLLLEGHCYDITTGQPPRGLQFTLGTSANPVIVDTIVMANLGYFQLKANPGAWILRLRKGRSEDIYRIYSHDGTDSPPDADEVVIVLNNFKSKIIKVKVQKKADMVNEDLLSDGTSENESGFWDSFKWGFTGQKTEEVKQDKDDIINIFSVASGHLYERFLRIMMLSVLKNTKTPVKFWFLKNYLSPTFKEFIPYMANEYNFQYELVQYKWPRWLHQQTEKQRIIWGYKILFLDVLFPLVVDKFLFVDADQIVRTDLKELRDFNLDGAPYGYTPFCDSRREMDGYRFWKSGYWASHLAGRKYHIRICPIT

SEQ ID NO: 900986 - protein, 761 aa, Homo sapiens [sequence omitted]

SEQ ID NO: 900987 - protein, 761 aa, Homo sapiens [sequence omitted]

SEQ ID NO: 900988 - protein, 761 aa, Homo sapiens [sequence omitted]

SEQ ID NO: 900989 - protein, 761 aa, Homo sapiens [sequence omitted]

SEQ ID NO: 900990 - protein, 761 aa, Homo sapiens [sequence omitted]

SEQ ID NO: 900991 - protein, 698 aa, Homo sapiens
MINNPAKEISYENTQISRAIWAALQTQTSNAAKNFITKMAKEGAAEALAAGADIAEFSVGGMDFSLFKEVFESSKMDFILSHAVYCRDVLKLKKGQRAVISNGRIIGPLEDSELFNQDDFHLLENIILKTSGQKIKSHIQQLRVEEDVASDLVMKVDALLSAQPKGDPRIEYQFFEDRHSAIKLRPKEGETYFDVVAVVDPVTREAQRLAPLLLVLAQLINMNLRVFMNCQSKLSDMPLKSFYRYVLEPEISFTSDNSFAKGPIAKFLDMPQSPLFTLNLNTPESWMVESVRTPYDLDNIYLEEVDSVVAAEYELEYLLLEGHCYDITTGQPPRGLQFTLGTSANPVIVDTIVMANLGYFQLKANPGAWILRLRKGRSEDIYRIYSHDGTDSPPDADEVVIVLNNFKSKIIKVKVQKKADMVNEDLLSDGTSENESGFWDSFKWGFTGQKTEEVKQDKDDIINIFSVASGHLYERFLRIMMLSVLKNTKTPVKFWFLKNYLSPTFKEFIPYMANEYNFQYELVQYKWPRWLHQQTEKQRIIWGYKILFLDVLFPLVVDKFLFVDADQIVRTDLKELRDFNLDGAPYGYTPFCDSRREMDGYRFWKSGYWASHLAGRKYHISALYVVDLKKFRKIAAGDRLRGQYQGLSQDPNSLSNLDQDLPNNMIHQVPIKSLPQEWLWCETWCDDASKKRAKTIDL

SEQ ID NO: 900992 - protein, 626 aa, Homo sapiens; identical to SEQ ID NO: 900985

SEQ ID NO: 900993 - protein, 928 aa, Homo sapiens
MPPKTPRKTAATAAAAAAEPPAPPPPPPPEEDPEQDSGPEDLPLVRLEFEETEEPDFTALCQKLKIPDHVRERAWLTWEKVSSVDGVLGGYIQKKKELWGICIFIAAVDLDEMSFTFTELQKNIEISVHKFFNLLKEIDTSTKVDNAMSRLLKKYDVLFALFSKLERTCELIYLTQPSSSISTEINSALVLKVSWITFLLAKGEVLQMEDDLVISFQLMLCVLDYFIKLSPPMLLKEPYKTAVIPINGSPRTPRRGQNRSARIAKQLENDTRIIEVLCKEHECNIDEVKNVYFKNFIPFMNSLGLVTSNGLPEVENLSKRYEEIYLKNKDLDARLFLDHDKTLQTDSIDSFETQRTPRKSNLDEEVNVIPPHTPVRTVMNTIQQLMMILNSASDQPSENLISYFNNCTVNPKESILKRVKDIGYIFKEKFAKAVGQGCVEIGSQRYKLGVRLYYRVMESMLKSEEERLSIQNFSKLLNDNIFHMSLLACALEVVMATYSRSTSQNLDSGTDLSFPWILNVLNLKAFDFYKVIESFIKAEGNLTREMIKHLERCEHRIMESLAWLSDSPLFDLIKQSKDREGPTDHLESACPLNLPLQNNHTAADMYLSPVRSPKKKGSTTRVNSTANAETQATSAFQTQKPLKSTSLSLFYKKVYRLAYLRLNTLCERLLSEHPELEHIIWTLFQHTLQNEYELMRDRHLDQIMMCSMYGICKVKNIDLKFKIIVTAYKDLPHAVQETFKRVLIKEEEYDSIIVFYNSVFMQRLKTNILQYASTRPPTLSPIPHIPRSPYKFPSSPLRIPGGNIYISPLKSPYKISEGLPTPTKMTPRSRILVSIGESFGTSEKFQKINQMVCNSDRVLKRSAEGSNPPKPLKKLRFDIEGSDEADGSKHLPGESKFQQKLAEMTSTRTRMQKQKMNDSMDTSNKEEK

SEQ ID NO: 900994 - protein, 103 aa, Homo sapiens
MPPKTPRKTAATAAAAAAEPPAPPPPPPPEEDPEQDSGPEDLPLVRLEFEETEEPDFTALCQKLKIPDHVRERAWLTWEKVSSVDGVLVLRSPVFKPWLTMGN

SEQ ID NO: 900995 - protein, 864 aa, Homo sapiens
SSISTEINSALVLKVSWITFLLAKGGYIQKKKELWGICIFIAAVDLDEMSFTFTELQKNIEISVHKFFNLLKEIDTSTKVDNAMSRLLKKYDVLFALFSKLERTCELIYLTQPSSSISTEINSALVLKVSWITFLLAKGEVLQMEDDLVISFQLMLCVLDYFIKLSPPMLLKEPYKTAVIPINGSPRTPRRGQNRSARIAKQLENDTRIIEVLCKEHECNIDEVKNVYFKNFIPFMNSLGLVTSNGLPEVENLSKRYEEIYLKNKDLDARLFLDHDKTLQTDSIDSFETQRTPRKSNLDEEVNVIPPHTPVRTVMNTIQQLMMILNSASDQPSENLISYFNNCTVNPKESILKRVKDIGYIFKEKFAKAVGQGCVEIGSQRYKLGVRLYYRVMESMLKSEEERLSIQNFSKLLNDNIFHMSLLACALEVVMATYSRSTSQNLDSGTDLSFPWILNVLNLKAFDFYKVIESFIKAEGNLTREMIKHLERCEHRIMESLAWLSDSPLFDLIKQSKDREGPTDHLESACPLNLPLQNNHTAADMYLSPVRSPKKKGSTTRVNSTANAETQATSAFQTQKPLKSTSLSLFYKKVYRLAYLRLNTLCERLLSEHPELEHIIWTLFQHTLQNEYELMRDRHLDQIMMCSMYGICKVKNIDLKFKIIVTAYKDLPHAVQETFKRVLIKEEEYDSIIVFYNSVFMQRLKTNILQYASTRPPTLSPIPHIPRSPYKFPSSPLRIPGGNIYISPLKSPYKISEGLPTPTKMTPRSRILVSIGESFGTSEKFQKINQMVCNSDRVLKRSAEGSNPPKPLKKLRFDIEGSDEADGSKHLPGESKFQQKLAEMTSTRTRMQKQKMNDSMDTSNKEEK

SEQ ID NO: 900996 - protein, 928 aa, Homo sapiens; identical to SEQ ID NO: 900993

SEQ ID NO: 900997 - protein, 913 aa, Homo sapiens
MPPKTPRKTAATAAAAAAEPPAPPPPPPPEEDPEQDSGPEDLPLVRLEFEETEEPDFTALCQKLKIPDHVRERAWLTWEKVSSVDGVLGGYIQKKKELWGICIFIAAVDLDEMSFTFTELQKNIEISVHKFFNLLKEIDTSTKVDNAMSRLLKKYDVLFALFSKLERTCELIYLTQPSSSISTEINSALVLKVSWITFLLAKGEVLQMEDDLVISFQLMLCVLDYFIKLSPPMLLKEPYKTAVIPINGSPRTPRRGQNRSARIAKQLENDTRIIEVLCKEHECNIDEVKNVYFKNFIPFMNSLGLVTSNGLPEVENLSKRYEEIYLKNKDLDARLFLDHDKTLQTDSIDSFETQRTPRKSNLDEEVNVIPPHTPVRTVMNTIQQLMMILNSASDQPSENLISYFNNCTVNPKESILKRVKDIGYIFKEKFAKAVGQGCVEIGSQRYKLGVRLYYRVMESMLKSEEERLSIQNFSKLLNDNIFHMSLLACALEVVMATYSRSTSQNLDSGTDLSFPWILNVLNLKAFDFYKVIESFIKAEGNLTREMIKHLERCEHRIMESLAWLSDSPLFDLIKQSKDREGPTDHLESACPLNLPLQNNHTAADMYLSPVRSPKKKGSTTRVNSTANAETQATSAFQTQKPLKSTSLSLFYKKVYRLAYLRLNTLCERLLSEHPELEHIIWTLFQHTLQNEYELMRDRHLDQIMMCSMYGICKVKNIDLKFKIIVTAYKDLPHAVQETFKRVLIKEEEYDSIIVFYNSVFMQRLKTNILQYASTRPPTLSPIPHIPRSPYKFPSSPLRIPGGNIYISPLKSPYKISEGLPTPTKMTPRSRILVSIGESFGTSEKFQKINQMVCNSDRVLKRSAEGSNPPKPLNKHLPGESKFQQKLAEMTSTRTRMQKQKMNDSMDTSNKEEK

SEQ ID NO: 900998 - protein, 323 aa, Homo sapiens
SVIKSSGIHRFSQAVMLVLLVLSDDATTACHEPDPDGNLPLFHCFIKKVYRLAYLRLNTLCERLLSEHPELEHIIWTLFQHTLQNEYELMRDRHLDQIMMCSMYGICKVKNIDLKFKIIVTAYKDLPHAVQETFKRVLIKEEEYDSIIVFYNSVFMQRLKTNILQYASTRPPTLSPIPHIPRSPYKFPSSPLRIPGGNIYISPLKSPYKISEGLPTPTKMTPRSRILVSIGESFGTSEKFQKINQMVCNSDRVLKRSAEGSNPPKPLKKLRFDIEGSDEADGSKHLPGESKFQQKLAEMTSTRTRMQKQKMNDSMDTSNKEEK

SEQ ID NO: 900999 - protein, 835 aa, Homo sapiens
MPPKTPRKTAATAAAAAAEPPAPPPPPPPEEDPEQDSGPEDLPLVRLEFEETEEPDFTALCQKLKIPDHVRERAWLTWEKVSSVDGVLGGYIQKKKELWGICIFIAAVDLDEMSFTFTELQKNIEISVHKFFNLLKEIDTSTKVDNAMSRLLKKYDVLFALFSKLERTCELIYLTQPSSSISTEINSALVLKVSWITFLLAKGEVLQMEDDLVISFQLMLCVLDYFIKLSPPMLLKEPYKTAVIPINGSPRTPRRGQNRSARIAKQLENDTRIIEVLCKEHECNIDEVKNVYFKNFIPFMNSLGLVTSNGLPEVENLSKRYEEIYLKNKDLDARLFLDHDKTLQTDSIDSFETQRTPRKSNLDEEVNVIPPHTPVRTVMNTIQQLMMILNSASDQPSENLISYFNNCTVNPKESILKRVKDIGYIFKEKFAKAVGQGCVEIGSQRYKLGVRLYYRVMESMLKSEEERLSIQNFSKLLNDNIFHMSLLACALEVVMATYSRSTSQNLDSGTDLSFPWILNVLNLKAFDFYKVIESFIKAEGNLTREMIKHLERCEHRIMESLAWLSDSPLFDLIKQSKDREGPTDHLESACPLNLPLQNNHTAADMYLSPVRSPKKKGSTTRVNSTANAETQATSAFQTQKPLKSTSLSLFYKKVYRLAYLRLNTLCERLLSEHPELEHIIWTLFQHTLQNEYELMRDRHLDQIMMCSMYGICKVKNIDLKFKIIVTAYKDLPHAVQETFKRVLIKEEEYDSIIVFYNSVFMQRLKTNILQYASTRPPTLSPIPHIPRSPYKFPSSPLRIPGGNIYISPLKSPYKISEGLPTPTKMTPRSRCVFSL

SEQ ID NO: 901000 - protein, 610 aa, Homo sapiens
MPPKTPRKTAATAAAAAAEPPAPPPPPPPEEDPEQDSGPEDLPLVRLEFEETEEPDFTALCQKLKIPDHVRERAWLTWEKVSSVDGVLGGYIQKKKELWGICIFIAAVDLDEMSFTFTELQKNIEISVHKFFNLLKEIDTSTKVDNAMSRLLKKYDVLFALFSKLERTCELIYLTQPSSSISTEINSALVLKVSWITFLLAKGEVLQMEDDLVISFQLMLCVLDYFIKLSPPMLLKEPYKTAVIPINGSPRTPRRGQNRSARIAKQLENDTRIIEVLCKEHECNIDEVKNVYFKNFIPFMNSLGLVTSNGLPEVENLSKRYEEIYLKNKDLDARLFLDHDKTLQTDSIDSFETQRTPRKSNLDEEVNVIPPHTPVRTVMNTIQQLMMILNSASDQPSENLISYFNNCTVNPKESILKRVKDIGYIFKEKFAKAVGQGCVEIGSQRYKLGVRLYYRVMESMLKSEEERLSIQNFSKLLNDNIFHMSLLACALEVVMATYSRSTSQNLDSGTDLSFPWILNVLNLKAFDFYKVIESFIKAEGNLTREMIKHLERCEHRIMESLAWLSVILPYPGERNVMQEAKKKLNKQAMMDSHLSLLPLGHVLFVQSHFY

SEQ ID NO: 901001 - protein, 113 aa, Homo sapiens [sequence omitted]

SEQ ID NO: 901002 - protein, 928 aa, Homo sapiens; identical to SEQ ID NO: 900993

SEQ ID NO: 901003 - protein, 721 aa, Homo sapiens
MEDDLVISFQLMLCVLDYFIKLSPPMLLKEPYKTAVIPINGSPRTPRRGQNRSARIAKQLENDTRIIEVLCKEHECNIDEVKNVYFKNFIPFMNSLGLVTSNGLPEVENLSKRYEEIYLKNKDLDARLFLDHDKTLQTDSIDSFETQRTPRKSNLDEEVNVIPPHTPVRTVMNTIQQLMMILNSASDQPSENLISYFNNCTVNPKESILKRVKDIGYIFKEKFAKAVGQGCVEIGSQRYKLGVRLYYRVMESMLKSEEERLSIQNFSKLLNDNIFHMSLLACALEVVMATYSRSTSQNLDSGTDLSFPWILNVLNLKAFDFYKVIESFIKAEGNLTREMIKHLERCEHRIMESLAWLSDSPLFDLIKQSKDREGPTDHLESACPLNLPLQNNHTAADMYLSPVRSPKKKGSTTRVNSTANAETQATSAFQTQKPLKSTSLSLFYKKVYRLAYLRLNTLCERLLSEHPELEHIIWTLFQHTLQNEYELMRDRHLDQIMMCSMYGICKVKNIDLKFKIIVTAYKDLPHAVQETFKRVLIKEEEYDSIIVFYNSVFMQRLKTNILQYASTRPPTLSPIPHIPRSPYKFPSSPLRIPGGNIYISPLKSPYKISEGLPTPTKMTPRSRILVSIGESFGTSEKFQKINQMVCNSDRVLKRSAEGSNPPKPLKKLRFDIEGSDEADGSKHLPGESKFQQKLAEMTSTRTRMQKQKMNDSMDTSNKEEK

SEQ ID NO: 901004 - protein, 928 aa, Homo sapiens; identical to SEQ ID NO: 900993

SEQ ID NO: 901005 - protein, 378 aa, Homo sapiens
MVDPITWNTFLKATQDSPLFDLIKQSKDREGPTDHLESACPLNLPLQNNHTAADMYLSPVRSPKKKGSTTRVNSTANAETQATSAFQTQKPLKSTSLSLFYKKVYRLAYLRLNTLCERLLSEHPELEHIIWTLFQHTLQNEYELMRDRHLDQIMMCSMYGICKVKNIDLKFKIIVTAYKDLPHAVQETFKRVLIKEEEYDSIIVFYNSVFMQRLKTNILQYASTRPPTLSPIPHIPRSPYKFPSSPLRIPGGNIYISPLKSPYKISEGLPTPTKMTPRSRILVSIGESFGTSEKFQKINQMVCNSDRVLKRSAEGSNPPKPLKKLRFDIEGSDEADGSKHLPGESKFQQKLAEMTSTRTRMQKQKMNDSMDTSNKEEK

SEQ ID NO: 901006 - protein, 928 aa, Homo sapiens; identical to SEQ ID NO: 900993

SEQ ID NO: 901007 - protein, 483 aa, Homo sapiens
MPPKTPRKTAATAAAAAAEPPAPPPPPPPEEDPEQDSGPEDLPLVRLEFEETEEPDFTALCQKLKIPDHVRERAWLTWEKVSSVDGVLGGYIQKKKELWGICIFIAAVDLDEMSFTFTELQKNIEISVHKFFNLLKEIDTSTKVDNAMSRLLKKYDVLFALFSKLERTCELIYLTQPSSSISTEINSALVLKVSWITFLLAKGEVLQMEDDLVISFQLMLCVLDYFIKLSPPMLLKEPYKTAVIPINGSPRTPRRGQNRSARIAKQLENDTRIIEVLCKEHECNIDEVKNVYFKNFIPFMNSLGLVTSNGLPEVENLSKRYEEIYLKNKDLDARLFLDHDKTLQTDSIDSFETQRTPRKSNLDEEVNVIPPHTPVRTVMNTIQQLMMILNSASDQPSENLISYFNNCTVNPKESILKRVKDIGYIFKEKFAKAVGQGCVEIGSQRYKLGVRLYYRVMESMLKSEEERLSIQILANFCITIRFR

SEQ ID NO: 901008 - protein, 652 aa, Homo sapiens
MINAQELLTLEDVTVEFTWEEWQLLGPFQKDLYRDVMLEIYSNLLSMGYQVSKPDALSKLERGEEPWTMEDERHSRICPENNEVDDHLQDHLENQRMLKSVEQYHEHNAFGNTASQTKSLCLFRENHDTFELYIKTLKSNLSLVNQNKSCEINNSTKFSGDGKSFLHGNYEELYSAAKFSVSTKANSTKSQVSKHQRTHEIEKNHVCSECGKAFVKKSQLTDHERVHTGEKPYGCTLCAKVFSRKSRLNEHQRIHKREKSFICSECGKVFTMKSRLIEHQRTHTGEKPYICNECGKGFPGKRNLIVHQRNHTGEKSYICSECGKGFTGKSMLIIHQRTHTGEKPYICSECGKGFTTKHYVIIHQRNHTGEKPYICNECGKGFTMKSRMIEHQRTHTGEKPYICSECGKGFPRKSNLIVHQRNHTVEKSYLCSECGKGFTVKSMLIIHQRTHTGEKPYTCSECGKGFPLKSRLIVHQRTHTGEKPYRCSECGKGFIVNSGLMLHQRTHTGEKPYICNECGKGFAFKSNLVVHQRTHTGEKPFMCSECGKGFTMKRYLIVHQQIHTEEKSCICSECGRGFAKETELALHKQVHTGEKPYGCNECGKGFTMKSRLIVHQRTHTGEKPFVCSECRKAFSSKRNLIVHQRTHNGNKP

SEQ ID NO: 901009 - protein, 652 aa, Homo sapiens; identical to SEQ ID NO: 901008

SEQ ID NO: 901010 - protein, 652 aa, Homo sapiens; identical to SEQ ID NO: 901008

SEQ ID NO: 901011 - protein, 652 aa, Homo sapiens; identical to SEQ ID NO: 901008

SEQ ID NO: 901012 - protein, 100 aa, Homo sapiens
STELTRRRSLRTLNSTPQHTHQASARGRVTSSTPNAVAPATHGFGAGLRGDVEVRGAARGVSLGWQTCTPYSVLRSRSGAVFGSLVIHRHPGPHVLPDHS

SEQ ID NO: 901013 - protein, 100 aa, Homo sapiens; identical to SEQ ID NO: 901012

SEQ ID NO: 901014 - protein, 132 aa, Homo sapiens
MNPTSRASTCYRLHLVNSELAILQIDPNNLDSAEQSYAYGITSCNPYLLESISNDEGLRPRCWIRTSRWYQQVKGILSVCCAPGSVQILFYYTLKAKVLEKLRMKPRVVVRVGVETVKRNNREESCPERLME

SEQ ID NO: 901015 - protein, 100 aa, Homo sapiens; identical to SEQ ID NO: 901012

SEQ ID NO: 901016 - protein, 100 aa, Homo sapiens; identical to SEQ ID NO: 901012

SEQ ID NO: 901017 - protein, 100 aa, Homo sapiens; identical to SEQ ID NO: 901012

SEQ ID NO: 901018 - protein, 124 aa, Homo sapiens
MSMTLGYWDIRGLAHAIRLLLEYTDSSYEEKKYTMGDAPDYDRSQWLNEKFKLGLDFPNLPYLIDGAHKITQSNAILCYIARKHNLCGEIRRGEDSCGHFGEPGYGQSPMQLAMSLLQTQTLRN

SEQ ID NO: 901019 - protein, 150 aa, Homo sapiens
DSCFLPQEKLKPEYLQALPEMLKLYSQFLGKQPWFLGDKITFVDFIAYDVLERNQVFEPSCLDAFPNLKDFISRFEGLEKISAYMKSSRFLPRPVFTKMAVWGGSGWTSCRQRSSPSQILDCSRSCPAAYGCPWSGSPKCPHEASPLLSP

SEQ ID NO: 901020 - protein, 124 aa, Homo sapiens; identical to SEQ ID NO: 901018

SEQ ID NO: 901021 - protein, 124 aa, Homo sapiens; identical to SEQ ID NO: 901018

SEQ ID NO: 901022 - protein, 266 aa, Homo sapiens
MSMTLGYWDIRGLAHAIRLLLEYTDSSYEEKKYTMGDGNDTLVSGLCPLTLSGTKQPMVATCGYLCRPPLLELQAVPSLSPGEGVLWPCKAECWGGMLGPLFNWVGCPSELPYTLEALAVWGPEPSAGFFVPEPWDVGLSGQILDPPVSGILPLVPWEGPREGGLGSGEVCFHFFFPTAAPDYDRSQWLNEKFKLGLDFPNLPYLIDGAHKITQSNAILCYIARKHNLCGEIRRGEDSCGHFGEPGYGQSPMQLAMSLLQTQTLRN

SEQ ID NO: 901023 - protein, 218 aa, Homo sapiens
MPMTLGYWNIRGLAHAIRLLLEYTDSSYEEKKYTMGDAPDYDRSQWLNEKFKLGLDFPNLPYLIDGAHKITQSNAILCYIARKHNLCGETEEEKIRVDILENQTMDNHMQLGMICYNPEFEKLKPKYLEELPEKLKLYSEFLGKRPWFAGNKITFVDFLVYDVLDLHRIFEPKCLDAFPNLKDFISRFEGLEKISAYMKSSRFLPRPVFSKMAVWGNK

SEQ ID NO: 901024 - protein, 124 aa, Homo sapiens; identical to SEQ ID NO: 901018

SEQ ID NO: 901025 - protein, 218 aa, Homo sapiens
MPMTLGYWNIRGLAHSIRLLLEYTDSSYEEKKYTMGDAPDYDRSQWLNEKFKLGLDFPNLPYLIDGTHKITQSNAILRYIARKHNLCGESEKEQIREDILENQFMDSRMQLAKLCYDPDFEKLKPKYLEELPEKLKLYSEFLGKRPWFAGNKITFVDFLVYDVLDLHRIFEPKCLDAFPNLKDFISRFEGLEKISAYMKSSRFLPRPVFSKMAVWGNK

SEQ ID NO: 901026 - protein, 103 aa, Homo sapiens
AILCYIARKHNLCGETEEEKIRVDILATSIMSMTLGYWDIRGLAHAIRLLLEYTDSSYEEKKYTMGDAPDYDRSQWLNDHKITQICYSPDFEKLKPEVLGGTP

SEQ ID NO: 901027 - protein, 361 aa, Homo sapiens
MPMILGYWDIRGLAHAIRLLLEYTDSSYEEKKYTMGDGNGTLVFGLCPLTLSWHQATHGGHLWLPLQASPAGAAGCLFPEPLVREPSGLARQNAGVGCWAPCLIGTGVPQGLPETLEALAVWGPEPSAGFFVPEPWDVGLSGQILDPPVSGILPLAPWEGPREGGLGSGEVCFHFFFPTTAPDYDRSQWLNEKFKLGLDFPNLPYLIDGAHKITQSNAILCYIARKHNLCGETEEEKIRVDILENQTMDNHMQLGMICYNPEFEKLKPKYLEELPEKLKLYSEFLGKRPWFAGNKITFVDFLVYDVLDLHRIFEPKCLDAFPNLKDFISRFEGLEKISAYMKSSRFLPRPVFSKMAVWGNK

SEQ ID NO: 901028 - protein, 200 aa, Homo sapiens
MPMILGYWDIRGLAHAIRLLLEYTDSSYEEKKYTMGDAPDYDRSQWLNDHKITQSNAILCYIARKHNLCGETEEEKIRVDILENQTMDNHMQLGMICYNPEFEKLKPKYLEELPEKLKLYSEFLGKRPWFAGNKITFVDFLVYDVLDLHRIFEPKCLDAFPNLKDFISRFEGLEKISAYMKSSRFLPRPVFSKMAVWGNK

SEQ ID NO: 901029 - protein, 218 aa, Homo sapiens; identical to SEQ ID NO: 901023

SEQ ID NO: 901030 - protein, 218 aa, Homo sapiens
MPMTLGYWNIRGLAHSIRLLLEYTDSSYEEKKYTMGDAPDYDRSQWLNEKFKLGLDFPNLPYLIDGTHKITQSNAILRYIARKHNLCGESEKEQIREDILENQFMDSRMQLAKLCYDPDFEKLKPEYLQALPEMLKLYSQFLGKQPWFLGDKITFVDFIAYDVLERNQVFEPSCLDAFPNLKDFISRFEGLEKISAYMKSSRFLPRPVFTKMAVWGNK

SEQ ID NO: 901031 - protein, 323 aa, Homo sapiens
MSMTLGYWDIRGLAHAIRLLLEYTDSSYEEKKYTMGDGNDTLVSGLCPLTLSGTKQPMVATCGYLCRPPLLELQAVPSLSPGEGVLWPCKAECWGGMLGPLFNWVGCPSELPYTLEALAVWGPEPSAGFFVPEPWDVGLSGQILDPPVSGILPLVPWEGPREGGLGSGEVCFHFFFPTAAPDYDRSQWLNEKFKLGLDFPNLPYLIDGAHKITQSNAILCYIARKHNLCGETEEEKIRVDILENQTMDNHMQLGMICYNPEFEKLKPKYLEELPEKLKLYSEFLGKRPWFAGNKGLEKISAYMKSSRFLPRPVFSKMAVWGNK

SEQ ID NO: 901032 - protein, 124 aa, Homo sapiens; identical to SEQ ID NO: 901018

SEQ ID NO: 901033 - protein, 291 aa, Homo sapiens
MSMTLGYWDIRGLAHAIRLLLEYTDSSYEEKKYTMGDGNDTLVSGLCPLTLSGTKQPMVATCGYLCRPPLLELQAVPSLSPGEGVLWPCKAECWGGMLGPLFNWVGCPSELPYTLEALAVWGPEPSAGFFVPEPWDVGLSGQILDPPVSGILPLVPWEGPREGGLGSGEVCFHFFFPTAAPDYDRSQWLNEKFKLGLDFPNLPYLIDGAHKITQSNAILCYIARKHNLCGETEEEKIRVDILENQTMDNHMQLGMICYNPEFGLEKISAYMKSSRFLPRPVFSKMAVWGNK

SEQ ID NO: 901034 - protein, 209 aa, Homo sapiens
MPMTLGYWNIRGLAHSIRLLLEYTDSSYEEKKYTMGDAPDYDRSQWLNEKFKLGLDFPNLPYLIDGTHKITQSNAILRYIARKHNLCGESEKEQIREDILENQFMDSRMQLAKLCYDPDFALPEMLKLYSQFLGKQPWFLGDKITFVDFIAYDVLERNQVFEPSCLDAFPNLKDFISRFEGLEKISAYMKSSRFLPRPVFTKMAVWGNK

SEQ ID NO: 901035 - protein, 151 aa, Homo sapiens
MPMTLGYWNIRGLAHSIRLLLEYTDSSYEEKKYTMGDAPDYDRSQWLNEKFKLGLDFPNLPYLIDGTHKITQSNAILRYIARKHNLCGESEKEQIREDILENQFMDSRMQLAKLCYDPDFVSPPTPLPVSPSLLPVSPFPAEFVSKIDSFW

SEQ ID NO: 901036 - protein, 107 aa, Homo sapiens
MSMTLGYWDIRGLAHAIRLLLEYTDSSYEEKKYTMGDAPDYDRSQWLNEKFKLGLDFPNIRGVRIRSLLPNSSHSWLSTQPLHDVLCPSSFVHVTVFLCQACHERAQ

SEQ ID NO: 901037 - protein, 314 aa, Homo sapiens
MSMTLGYWDIRGLAHAIRLLLEYTDSSYEEKKYTMGDGNDTLVSGLCPLTLSGTKQPMVATCGYLCRPPLLELQAVPSLSPGEGVLWPCKAECWGGMLGPLFNWVGCPSELPYTLEALAVWGPEPSAGFFVPEPWDVGLSGQILDPPVSGILPLVPWEGPREGGLGSGEVCFHFFFPTAAPDYDRSQWLNEKFKLGLDFPNLPYLIDGAHKITQSNAILCYIARKHNLCGETEEEKIRVDILENQTMDNHMQLGMICYNPEFEKLKPKYLEELPEKLKLYSEFLGKRPWFAGNKITFVDFLVYDVLFSSFQGIS

SEQ ID NO: 901038 - protein, 95 aa, Homo sapiens
GLGLSAESAPTSTMPMILGYWDIRGLAHAIRLLLEYTDSSYEEKKYTMGDGNGTLVFGLCPLTLSWHQATHGGHLWLPLQASPAGAAGCLFPEPR

SEQ ID NO: 901039 - protein, 259 aa, Homo sapiens
MPMTLGYWNIRGLAHSIRLLLEYTDSSYEEKKYTMGDAPDYDRSQWLNEKFKLGLDFPNLPYLIDGTHKITQSNAILRYIARKHNLCGESEKEQIREDILENQFMDSRMQLAKLCYDPDFEKLKPEYLQALPEMLKLYSQFLGKQPWFLGDKITFVDFIAYDVLERNQVFEPSCLDAFPNLKDFISRFERGKVYCRLELEKDIWILVVPDQPKEILWSKPEHTEEARHHHGTLFYTERDTLCRKSRDPGWRTCMGPGKD

SEQ ID NO: 901040 - protein, 104 aa, Homo sapiens
GEAGTRGGDGAPLVQSRHKVRDPPSLTRAVGHLSQLAHSIRLLLEYTDSSYEEKKYTMGDASNLGRLGASLGYAPIWLREWGDAAQMGQPWLKYKAGSGAPQIP

SEQ ID NO: 901041 - protein, 124 aa, Homo sapiens; identical to SEQ ID NO: 901018

SEQ ID NO: 901042 - protein, 204 aa, Homo sapiens
MSMTLGYWDIRGLAHAIRLLLEYTDSSYEEKKYTMGDAPDYDRSQWLNEKFKLGLDFPNIRGVRIRSLLPNSSHSWLSTQPLHDVLCPSSFVHVTVFLCQACHERAQWVPGLPSALAYGKGMLGSLLAQLSFPGFPSIQLPYLIDGAHKITQSNAILCYIARKHNLCGEIRRGEDSCGHFGEPGYGQSPMQLAMSLLQTQTLRN

SEQ ID NO: 901043 - protein, 124 aa, Homo sapiens; identical to SEQ ID NO: 901018

SEQ ID NO: 901044 - protein, 360 aa, Homo sapiens
MSMTLGYWDIRGLAHAIRLLLEYTDSSYEEKKYTMGDGNDTLVSGLCPLTLSGTKQPMVATCGYLCRPPLLELQAVPSLSPGEGVLWPCKAECWGGMLGPLFNWVGCPSELPYTLEALAVWGPEPSAGFFVPEPWDVGLSGQILDPPVSGILPLVPWEGPREGGLGSGEVCFHFFFPTAAPDYDRSQWLNEKFKLGLDFPNLPYLIDGAHKITQSNAILCYIARKHNLCGETEEEKIRVDILENQTMDNHMQLGMICYNPEFEKLKPKYLEELPEKLKLYSEFLGKRPWFAGNKITFVDFLVYDVLDLHRIFEPKCLDAFPNLKDFISRFEGLEKISAYMKSSRFLPRPVFSKMAVWGNK

SEQ ID NO: 901045 - protein, 218 aa, Homo sapiens [sequence omitted]

SEQ ID NO: 901046 - protein, 218 aa, Homo sapiens
MPMILGYWDIRGLAHAIRLLLEYTDSSYEEKKYTMGDAPDYDRSQWLNEKFKLGLDFPNLPYLIDGAHKITQSNAILCYIARKHNLCGETEEEKIRVDILENQTMDNHMQLGMICYNPEFEKLKPKYLEELPEKLKLYSEFLGKRPWFAGNKITFVDFLVYDVLDLHRIFEPKCLDAFPNLKDFISRFEGLEKISAYMKSSRFLPRPVFSKMAVWGNK

SEQ ID NO: 901047 - protein, 151 aa, Homo sapiens; identical to SEQ ID NO: 901035

SEQ ID NO: 901048 - protein, 162 aa, Homo sapiens
MPMTLGYWNIRGLAHSIRLLLEYTDSSYEEKKYTMGDAPDYDRSQWLNEKFKLGLDFPNLPYLIDGTHKITQSNAILRYIARKHNLYLCPKLIPSGEFLVLLTLRMKPRSYTVSVTVLKDGVSGVCSFRCSDVSAVSSFRWVCGLADFRGEAADLRSECYSS

SEQ ID NO: 901049 - protein, 181 aa, Homo sapiens
MPMILGYWDIRGLAHAIRLLLEYTDSSYEEKKYTMGDAPDYDRSQWLNEKFKLGLDFPNLPYLIDGAHKITQSNAILCYIARKHNLCGETEEEKIRVDILENQTMDNHMQLGMICYNPEFEKLKPKYLEELPEKLKLYSEFLGKRPWFAGNKGLEKISAYMKSSRFLPRPVFSKMAVWGNK

SEQ ID NO: 901050 - protein, 218 aa, Homo sapiens; identical to SEQ ID NO: 901023

SEQ ID NO: 901051 - protein, 218 aa, Homo sapiens; identical to SEQ ID NO: 901023

SEQ ID NO: 901052 - protein, 282 aa, Homo sapiens
MSMTLGYWDIRGLAHAIRLLLEYTDSSYEEKKYTMGDGNDTLVSGLCPLTLSGTKQPMVATCGYLCRPPLLELQAVPSLSPGEGVLWPCKAECWGGMLGPLFNWVGCPSELPYTLEALAVWGPEPSAGFFVPEPWDVGLSGQILDPPVSGILPLVPWEGPREGGLGSGEVCFHFFFPTAAPDYDRSQWLNEKFKLGLDFPNLPYLIDGAHKITQSNAILCYIARKHNLCGETEEEKIRVDILENQTMDNHMQLGMICYNPEFEKLKPKYLEELPEKLNMQAL

SEQ ID NO: 901053 - protein, 122 aa, Homo sapiens
AILCYIARKHNLCGETEEEKIRVDILATSIMSMTLGYWDIRGLAHAIRLLLEYTDSSYEEKKYTMGDAPDYDRSQWLNEKFKLGLDFPNLPYLIDGAHKITQSNAILCYIEKLKPEVLGGTP

SEQ ID NO: 901054 - protein, 356 aa, Homo sapiens
WSYTQVRRTGGGGVETVQGPGVSWVHPDGVGVQIDTITPEIRALYNVLAKVKRERDEYKRRWEEELAKRMNLQTMVDTLQEAAQEADAIQEEMNEKIERLKAELVVFKGLMSDPMTDLDTKIQEKAMKVDMDICRRIDITAKLCDVAQQRNSEDVSKIFQVVPKKKERKVASDDDISEQDGEVNRFSDDEVGSMNITDEMKRMFNQLRETFDFDDDCDSLTWEENEDTLLLWEDFTNCNPTIDLQGEQEENLGNLIHETESFFKTRDKEYQETIGQIELELATAKSDMNRHLHEYMEMCSMKRGLDVQMETCRRLIKGSADRNSPSPSSVASSDSGSTDEIQDEFEREADVEPMVS

SEQ ID NO: 901055 - protein, 356 aa, Homo sapiens; identical to SEQ ID NO: 901054

SEQ ID NO: 901056 - protein, 167 aa, Homo sapiens
PDEPDSSRTCYPPDEPDRRETFDFDDDCDSLTWEENEDTLLLWEDFTNCNPTIDLQGEQEENLGNLIHETESFFKTRDKEYQETIGQIELELATAKSDMNRHLHEYMEMCSMKRGLDVQMETCRRLIKGSADRNSPSPSSVASSDSGSTDEIQDEFEREADVEPMVS

SEQ ID NO: 901057 - protein, 356 aa, Homo sapiens; identical to SEQ ID NO: 901054

SEQ ID NO: 901058 - protein, 356 aa, Homo sapiens; identical to SEQ ID NO: 901054

SEQ ID NO: 901059 - protein, 349 aa, Homo sapiens
WSYTQVRRTGGGGVETVQGPGVSWVHPDGVGVQIDTITPEIRALYNVLAKVKRERDEYKRRWEEELAKRMNLQTMVDTLQEAAQEADAIQEEMNEKIERLKAELVVFKGLMSDPMTDLDTKIQEKAMKVDMDICRRIDITAKLCDVAQQRNSEDVSKIFQVVPKKKERKVASDDDISEQDGEVNRFSDDEVGSMNITDEMKRMFNQLRETFDFDDDCDSLTWEENEDTLLLWEDFTNCNPTIDLQGEQEENLGNLIHETESFFKTRDKEYQETIGQIELELATAKSDMNRHLHEYMEMCSMKRGLDVQMETCRRLIKGSADRNSPSPSSVASSVPQRGPLERPQQQLPH

SEQ ID NO: 901060 - protein, 131 aa, Homo sapiens
CLLFSHALWCHPHRRETFDFDDDCDSLTWEENEDTLLLWEDFTNCNPTIDLQGECPAFSGGASLTGSLILSFACSLGSPAKLSLLCPQQEENLGNLIHETESFFKTRDKEYQETIGQIEVRARDVEPTREA

SEQ ID NO: 901061 - protein, 356 aa, Homo sapiens; identical to SEQ ID NO: 901054

SEQ ID NO: 901062 - protein, 188 aa, Homo sapiens
PLRYLLEKQLLQQQSFRMVNSLLFGEMVSVASSDSGSTDEIQDEFEREADVEPMVQNEDTLLLWEDFTNCNPTIDLQGEQEENLGNLIHETESFFKTRDKEYQETIGQIELELATAKSDMNRHLHEYMEMCSMKRGLDVQMETCRRLIKGSADRNSPSPSSVASSDSGSTDEIQDEFEREADVEPMVS

SEQ ID NO: 901063 - protein, 356 aa, Homo sapiens; identical to SEQ ID NO: 901054

SEQ ID NO: 901064 - protein, 356 aa, Homo sapiens; identical to SEQ ID NO: 901054

SEQ ID NO: 901065 - protein, 290 aa, Homo sapiens
AGLDARSKMAANVFPFRDARAAPDPVLEAGPVAHGPLPVPLVLDNGSFQVRAGWACPGQDPGPEPRLQFRAVCARGRGGARGASGPQVGNALGSLEPLRWMLRSPFDRNVPVNLELQELLLDYSFQHLGVSSQGCVDHPIVLTEAVCNPLYSRQMMSELLFECYGIPKVAYGIDSLFSFYHNKPKNSMCSGLIISSGYQCTHVLPILEGRLDAKNCKRINLGGSQAAGYLQRLLQLKYPGHLAAITLSRMEEILHEHSYIAEDYVEGIQEDVCLQLLGVVYLVFLKLLPA

SEQ ID NO: 901066 - protein, 615 aa, Homo sapiens
AGLDARSKMAANVFPFRDARAAPDPVLEAGPVAHGPLPVPLVLDNGSFQVRAGWACPGQDPGPEPRLQFRAVCARGRGGARGASGPQVGNALGSLEPLRWMLRSPFDRNVPVNLELQELLLDYSFQHLGVSSQGCVDHPIVLTEAVCNPLYSRQMMSELLFECYGIPKVAYGIDSLFSFYHNKPKNSMCSGLIISSGYQCTHVLPILEGRLDAKNCKRINLGGSQAAGYLQRLLQLKYPGHLAAITLSRMEEILHEHSYIAEDYVEELHKWRCPDYYENNVHKMQLPFSSKLLGSTLTSEEKQERRQQQLRRLQELNARRREEKLQLDQERLDRLLYVQELLEDGQMDQFHKALIELNMDSPEELQSYIQKLSIAVEQAKQKILQAEVNLEVDVVDSKPETPDLEQLEPSLEDVESMNDFDPLFSEETPGVEKPVTTVQPVFNLAAYHQLFVGTERIRAPEIIFQPSLIGEEQAGIAETLQYILDRYPKDIQEMLVQNVFLTGGNTMYPGMKARMEKELLEMRPFRSSFQVQLASNPVLDAWYGARDWALNHLDDNEVWITRKEYEEKGGEYLKEHCASNIYVPIRLPKQASRSSDAQASSKGSAAGGGGAGEQA

SEQ ID NO: 901067 - protein, 280 aa, Homo sapiens
AGLDARSKMAANVFPFRDARAAPDPVLEAGPVAHGPLPVPLVLDNGSFQVRAGWACPGQDPGPEPRLQFRAVCARGRGGARGASGPQVGNALGSLEPLRWMLRSPFDRNVPVNLELQELLLDYSFQHLGVSSQGCVDHPIVLTEAVCNPLYSRQMMSELLFECYGIPKVAYGIDSLFSFYHNKPKNSMCSGLIISSGYQCTHVLPILEGRLDAKNCKRINLGGSQAAGYLQRLLQLKYPGHLAAITPPARHGKKNSAKHKPSPLKELMGKKFTPKLAGVP

SEQ ID NO: 901068 - protein, 105 aa, Homo sapiens
AVLRLELLRVDRSAGPARGPGPWRRRRLCCGDLTFPAPSRKALTFVGGDPPLLWPCQESHPYPGAPLTLDLLGQRQREGPEQEEKKGLPSRGTAWTKAHRGGGAQ

SEQ ID NO: 901069 - protein, 105 aa, Homo sapiens; identical to SEQ ID NO: 901068

SEQ ID NO: 901070 - protein, 196 aa, Homo sapiens
MEIPVPVQPSWLRRASAPLPGLSAPGRLFDQRFGEGLLEAELAALCPTTLAPYYLRAPSVALPVAQVPTDPGHFSVLLDVKHFSPEEIAVKVVGEHVEVHARHEERPDEHGFVAREFHRRYRLPPGVDPAAVTSALSPEGVLSIQAAPAPREPPQAPSIKADLTPPSQMSRVRQGLSSHPLLDSALTSILDTALIT

SEQ ID NO: 901071 - protein, 160 aa, Homo sapiens
MEIPVPVQPSWLRRASAPLPGLSAPGRLFDQRFGEGLLEAELAALCPTTLAPYYLRAPSVALPVAQVPTDPGHFSVLLDVKHFSPEEIAVKVVGEHVEVHARHEERPDEHGFVAREFHRRYRLPPGVDPAAVTSALSPEGVLSIQAAPASAQAPPPAAAK

SEQ ID NO: 901072 - protein, 160 aa, Homo sapiens; identical to SEQ ID NO: 901071

SEQ ID NO: 901073 - protein, 160 aa, Homo sapiens; identical to SEQ ID NO: 901071

SEQ ID NO: 901074 - protein, 189 aa, Homo sapiens
MEIPVPVQPSWLRRASAPLPGLSAPGRLFDQRFGEGLLEAELAALCPTTLAPYYLRAPSVALPVAQVPTDPGHFSVLLDVKHFSPEEIAVKVVGEHVEVHARHEERPVSRGVGRGWSGYAAAGPEGRGRSSLPPLQDEHGFVAREFHRRYRLPPGVDPAAVTSALSPEGVLSIQAAPASAQAPPPAAAK

SEQ ID NO: 901075 - protein, 160 aa, Homo sapiens; identical to SEQ ID NO: 901071

SEQ ID NO: 901076 - protein, 118 aa, Homo sapiens
IPDAAKATDGRWMKWLSQLGWGPVSCCAPGAGARSGISRIAAAHSPPPSAPPSADDNIKTPAFHPQRMISRHLPSVSSLPFHPQLHPQQMIISRYLLSVCGFRFHHQPMIISQTTFRA

SEQ ID NO: 901077 - protein, 821 aa, Homo sapiens
MVKLSIVLTPQFLSHDQGQLTKELQQHVKSVTCPCEYLRKVINTLADHHHRGTDFGGSPWLHVIIAFPTSYKVVITLWIVYLWVSLLKTIFWSRNGHDGSTDVQQRAWRSNRRRQEGLRSICMHTKKRVSSFRGNKIGLKDVITLRRHVETKVRAKIRKRKVTTKINHHDKINGKRKTARKQKMFQRAQELRRRAEDYHKCKIPPSARKALCNWVRMAAAEHRHSSGLPYWPYLTAETLKNRMGHQPPPPTQQHSITDNSLSLKTPPECLLTPLPPSADDNLKTPPECVLTPLPPSADDNLKTPPECVLTPLPPSADDNLKTPPECLLTPLPPSADDNLKTPPECLTDDNLKTPSERQLTPLPPSAPPLSSTLQQMIISRHLPSVCGGRFHPQQMIISRHLPSVSSLPFHPQLHPQQMIISRHLPSVCGGRFHPQRMIISRHLPSVSSLPFHPQLHPQQMIISRHLPSVCGERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPPLATQEAEAEKPRKPKRQRAAEMEPPPEPKRRRVGDVEPSRKPKRRRAADVEPSSPEPKRRRVGDVEPSRKPKRRRAADVEPSSPEPKRRRVGDVEPSRKPKRRRAADVEPSLPEPKRRRLS

SEQ ID NO: 901078 - protein, 420 aa, Homo sapiens
MVKLSIVLTPQFLSHDQGQLTKELQQHVKSVTCPCEYLRKVINTLADHHHRGTDFGGSPWLHVIIAFPTSYKVVITLWIVYLWVSLLKTIFWSRNGHDGSTDVQQRAWRSNRRRQEGLRSICMHTKKRVSSFRGNKIGLKDVITLRRHVETKVRAKIRKRKVTTKINHHDKINGKRKTARKQKMFQRAQELRRRAEDYHKCKIPPSARKALCNWVRMAAAEHRHSSGLPYWPYLTAETLKNRMGHQPPPPTQQHSITDNSLSLKTPPECLLTPLPPSADDNLKTPPECVLTPLPPSADDNLKTPPECVLTPLPPSADDNLKTPPECLLTPLPPSADDNLKTPPECSHYSPPPSAPPSADDNIKTPAFHPQRMISRHLPSVSSLPFHPQLHPQQMIISRHLPSVCGGRFHPQPMIISRHLP

SEQ ID NO: 901079 - protein, 715 aa, Homo sapiens
YRARPGVERERLRSICMHTKKRVSSFRGNKIGLKDVITLRRHVETKVRAKIRKRKVTTKINHHDKINGKRKTARKQKMFQRAQELRRRAEDYHKCKIPPSARKALCNWVRMAAAEHRHSSGLPYWPYLTAETLKNRMGHQPPPPTQQHSITDNSLSLKTPPECLLTPLPPSADDNLKTPPECVLTPLPPSADDNLKTPPECVLTPLPPSADDNLKTPPECLLTPLPPSADDNLKTPPECLTDDNLKTPSERQLTPLPPSAPPLSSTLQQMIISRHLPSVCGGRFHPQQMIISRHLPSVSSLPFHPQLHPQQMIISRHLPSVCGGRFHPQRMIISRHLPSVSSLPFHPQLHPQQMIISRHLPSVCGERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPPLATQEAEAEKPRKPKRQRAAEMEPPPEPKRRRVGDVEPSRKPKRRRAADVEPSSPEPKRRRVGDVEPSRKPKRRRAADVEPSSPEPKRRRVGDVEPSRKPKRRRAADVEPSLPEPKRRRLS

SEQ ID NO: 901080 - protein, 663 aa, Homo sapiens
MVKLSIVLTPQFLSHDQGQLTKELQQHVKSVTCPCEYLRKVINTLADHHHRGTDFGGSPWLHVIIAFPTSYKVVITLWIVYLWVSLLKTIFWSRNGHDGSTDVQQRAWRSNRRRQEGLRSICMHTKKRVSSFRGNKIGLKDVITLRRHVETKVRAKIRKRKVTTKINHHDKINGKRKTARKQKMFQRAQELRRRAEDYHKCKIPPSARKALCNWVRMAAAEHRHSSGLPYWPYLTAETLKNRMGHQPPPPTQQHSITDNSLSLKTPPECLLTPLPPSADDNLKTPPECVLTPLPPSADDNLKTPPECVLTPLPPSADDNLKTPPECLLTPLPPHPQLYPQLHPQRNDNLKTRAECLLHPLPPSADDNLKTPSERQLTPLPPSAPPSADDNIKTPAERQRLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPPLATQEAEAEKPRKPKRQRAAEMEPPPEPKRRRVGDVEPSRKPKRRRAADVEPSSPEPKRRRVGDVEPSRKPKRRRAADVEPSSPEPKRRRVGDVEPSRKPKRRRAADVEPSLPEPKRRRLS

SEQ ID NO: 901081 - protein, 218 aa, Homo sapiens
MVKLSIVLTPQFLSHDQGQLTKELQQHVKSVTCPCEYLRKVINTLADHHHRGTDFGGSPWLHVIIAFPTSYKVVITLWIVYLWVSLLKTIFWSRNGHDGSTDVQQRAWRSNRRRQEGLRSICMHTKKRVSSFRGNKIGLKDVITLRRHVETKVRAKIRKRKVTTKINHHDKINGKRKTARKQSPLLQERLFATGSEWRQRSIVILQDCPTGPTSQLKL

SEQ ID NO: 901082 - protein, 676 aa, Homo sapiens
MTKSMERGRPPENRSTTSFKRTMPVYKPSCFCPVKHGKCFNVRKSCGGEQRTTTNAKSPLLEDRLFSNWVRMAAAEHRHSSGLPYWPYLTAETLKNRMGHQPPPPTQQHSITDNSLSLKTPPECLLTPLPPSADDNLKTPPECVLTPLPPSADDNLKTPPECVLTPLPPSADDNLKTPPECLLTPLPPSADDNLKTPPECLTDDNLKTPSERQLTPLPPSAPPLSSTLQQMIISRHLPSVCGGRFHPQQMIISRHLPSVSSLPFHPQLHPQQMIISRHLPSVCGGRFHPQRMIISRHLPSVSSLPFHPQLHPQQMIISRHLPSVCGERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPPLATQEAEAEKPRKPKRQRAAEMEPPPEPKRRRVGDVEPSRKPKRRRAADVEPSSPEPKRRRVGDVEPSRKPKRRRAADVEPSSPEPKRRRVGDVEPSRKPKRRRAADVEPSLPEPKRRRLS

SEQ ID NO: 901083 - protein, 821 aa, Homo sapiens; identical to SEQ ID NO: 901077

SEQ ID NO: 901084 - protein, 793 aa, Homo sapiens
MVKLSIVLTPQFLSHDQGQLTKELQQHVKSVTCPCEYLRKVINTLADHHHRGTDFGGSPWLHVIIAFPTSYKVVITLWIVYLWVSLLKTIFWSRNGHDGSTDVQQRAWRSNRRRQEGLRSICMHTKKRVSSFRGNKIGLKDVITLRRHVETKVRAKIRKRKVTTKINHHDKINGKRKTARKQKMFQRAQELRRRAEDYHKCKIPPSARKALCNWVRMAAAEHRHSSGLPYWPYLTAETLKNRMGHQPPPPTQQHSITDNSLSLKTPPECLLTPLPPSADDNLKTPPECVLTPLPPSADDNLKTPPECVLTPLPPSADDNLKTPPECLLTPLPPSADDNLKTPPECLTDDNLKTPSERQLTPLPPSAPPLSSTLQQMIISRHLPSVCGGRFHPQQMIISRHLPSVSSLPFHPQLHPQQMIISRHLPSVCGGRFHPQRMIISRHLPSVSSLPFHPQLHPQQMIISRHLPSVCGERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPPLATQEAEAEKPRKPKRQRAAEMEPSSPEPKRRRVGDVEPSRKPKRRRAADVEPSSPEPKRRRVGDVEPSRKPKRRRAADVEPSLPEPKRRRLS

SEQ ID NO: 901085 - protein, 807 aa, Homo sapiens
MVKLSIVLTPQFLSHDQGQLTKELQQHVKSVTCPCEYLRKVINTLADHHHRGTDFGGSPWLHVIIAFPTSYKVVITLWIVYLWVSLLKTIFWSRNGHDGSTDVQQRAWRSNRRRQEGLRSICMHTKKRVSSFRGNKIGLKDVITLRRHVETKVRAKIRKRKVTTKINHHDKINGKRKTARKQKMFQRAQELRRRAEDYHKCKIPPSARKALCNWVRMAAAEHRHSSGLPYWPYLTAETLKNRMGHQPPPPTQQHSITDNSLSLKTPPECLLTPLPPSADDNLKTPPECVLTPLPPSADDNLKTPPECVLTPLPPSADDNLKTPPECLLTPLPPSADDNLKTPPECLTDDNLKTPSERQLTPLPPSAPPLSSTLQQMIISRHLPSVCGGRFHPQQMIISRHLPSVSSLPFHPQLHPQQMIISRHLPSVCGGRFHPQRMIISRHLPSVSSLPFHPQLHPQQMIISRHLPSVCGERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPPLATQEAEAEKPRKPKRQRAAEMEPPPEPKRRRVGDVEPSRKPKRRRAADVEPSSPEPKRRRAADVEPSSPEPKRRRVGDVEPSRKPKRRRAADVEPSLPEPKRRRLS

SEQ ID NO: 901086 - protein, 807 aa, Homo sapiens; identical to SEQ ID NO: 901085

SEQ ID NO: 901087 - protein, 792 aa, Homo sapiens
MVKLSIVLTPQFLSHDQGQLTKELQQHVKSVTCPCEYLRKVINTLADHHHRGTDFGGSPWLHVIIAFPTSYKVVITLWIVYLWVSLLKTIFWSRNGHDGSTDVQQRAWRSNRRRQEGLRSICMHTKKRVSSFRGNKIGLKDVITLRRHVETKVRAKIRKRKVTTKINHHDKINGKRKTARKQKMFQRAQELRRRAEDYHKCKIPPSARKALCNWVRMAAAEHRHSSGLPYWPYLTAETLKNRMGHQPPPPTQQHSITDNSLSLKTPPECLLTPLPPSADDNLKTPPECVLTPLPPSADDNLKTPPECVLTPLPPSADDNLKTPPECLLTPLPPSADDNLKTPPECLTDDNLKTPSERQLTPLPPSAPPLSSTLQQMIISRHLPSVCGGRFHPQQMIISRHLPSVSSLPFHPQLHPQQMIISRHLPSVCGGRFHPQRMIISRHLPSVSSLPFHPQLHPQQMIISRHLPSVCGERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPPLATQEAEAEKPRKPKRQRAAEMEPPPEPKRRRVGDVEPSRKPKRRRAADVEPSSPEPKRRRVGDVEPSRKPKRRRAADVEPSSPEPKRRRLS

SEQ ID NO: 901088 - protein, 478 aa, Homo sapiens
MVKLSIVLTPQFLSHDQGQLTKELQQHVKSVTCPCEYLRKVINTLADHHHRGTDFGGSPWLHVIIAFPTSYKVVITLWIVYLWVSLLKTIFWSRNGHDGSTDVQQRAWRSNRRRQEGLRSICMHTKKRVSSFRGNKIGLKDVITLRRHVETKVRAKIRKRKVTTKINHHDKINGKRKTARKQKMFQRAQELRRRAEDYHKCKIPPSARKALCNWVRMAAAEHRHSSGLPYWPYLTAETLKNRMGHQPPPPTQQHSITDNSLSLKTPPECLLTPLPPSADDNLKTPPECVLTPLPPSADDNLKTPPECVLTPLPPSADDNLKTPPECLLTPLPPSADDNLKTPPECLTDDNLKTPSERQLTPLPPSAPPSADDNIKTPAERLRGPLPPSADDNLKTPSERQLTPYSPPPSAPPSADDNIKTPAFHPQRMISRHLPSVSSLPFHPQLHPQQMIISRYLLSVCGFRFHHQPMIISQTTFRA

SEQ ID NO: 901089 - protein, 140 aa, Homo sapiens
TFPPLALQVRMAAAEHRHSSGLPYWPYLTAETLKNRMGHQPPPPTQQHSITDNSLSLKTPPECLLTPLPPSADDNLKTPPECVLTPLPPSADDNLKTPPECVLTPLPPSADDNLKTPPECLLTPLPPSADDNLKTPPECS

SEQ ID NO: 901090 - protein, 124 aa, Homo sapiens
MVKLSIVLTPQFLSHDQGQLTKELQQHVKSVTCPCEYLRKVINTLADHHHRGTDFGGSPWLHVIIAFPTSYKVVITLWIVYLWVSILTFCRGILVITNKNKLYKTIHISGLHYEYVVLPKKSGK

SEQ ID NO: 901091 - protein, 817 aa, Homo sapiens
MVKLSIVLTPQFLSHDQGQLTKELQQHVKSVTCPCEYLRKVINTLADHHHRGTDFGGSPWLHVIIAFPTSYKVVITLWIVYLWVSLLKTIFWSRNGHDGSTDVQQRAWRSNRRRQEGLRSICMHTKKRVSSFRGNKIGLKDVITLRRHVETKVRAKIRKRKVTTKINHHDKINGKRKTARKQKMFQRAQELRRRAEDYHKCKIPPSARKALCNWVRMAAAEHRHSSGLPYWPYLTAETLKNRMGHQPPPPTQQHSITDNSLSLKTPPECLLTPLPPSADDNLKTPPECVLTPLPPSADDNLKTPPECVLTPLPPSADDNLKTPPECLLTPLPPSADDNLKTPPECLTDDNLKTPSERQLTPLPPSAPPLSSTLQQMIISRHLPSVCGGRFHPQQMIISRHLPSVSSLPFHPQLHPQQMIISRHLPSVCGGRFHPQRMIISRHLPSVSSLPFHPQLHPQQMIISRHLPSVCGERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSADDNIKTPAERLRGPLPPSADDNLKTPSERQLTPLPPSAPPSADDNIKTPAERLRGPLPPSADDNLKTPPLATQEAEAEKPRKPKRQRAAEMEPPPEPKRRRVGDVEPSRKPKRRRAADVEPSSPEPKRRRVGDVEPSRKPKRRRAADVEPSSPEPKRRRVGDVEPSRKPKRRRAADVEPSLPEPKRRRLS

SEQ ID NO: 901092 - protein, 597 aa, Homo sapiens
MVKLSIVLTPQFLSHDQGQLTKELQQHVKSVTCPCEYLRKVINTLADHHHRGTDFGGSPWLHVIIAFPTSYKVVITLWIVYLWVSLLKTIFWSRNGHDGSTDVQQRAWRSNRRRQEGLRSICMHTKKRVSSFRGNKIGLKDVITLRRHVETKVRAKIRKRKVTTKINHHDKINGKRKTARKQKMFQRAQELRRRAEDYHKCKIPPSARKALCNWVRMAAAEHRHSSGLPYWPYLTAETLKNRMGHQPPPPTQQHSITDNSLSLKTPPECLLTPLPPSADDNLKTPPECVLTPLPPSADDNLKTPPECVLTPLPPSADDNLKTPPECLLTPLPPSADDNLKTPPECLTDDNLKTPSERQLTPLPPSAPPSADDNIKTPAERLRGPLPPSADDNLKTPSERQLTPYSPPPSAPPSADDEYQDTCLPPSADDLKTPSERQLTPLPPSAPPSADDNIKTPAERLRGPLPPSADDNLKTPPLATQEAEAEKPRKPKRQRAAEMEPPPEPKRRRVGDVEPSRKPKRRRAADVEPSSPEPKRRRVGDVEPSRKPKRRRAADVEPSSPEPKRRRVGDVEPSRKPKRRRAADVEPSLPEPKRRRLS

SEQ ID NO: 901093 - protein, 587 aa, Homo sapiens
MVKLSIVLTPQFLSHDQGQLTKELQQHVKSVTCPCEYLRKVINTLADHHHRGTDFGGSPWLHVIIAFPTSYKVVITLWIVYLWVSLLKTIFWSRNGHDGSTDVQQRAWRSNRRRQEGLRSICMHTKKRVSSFRGNKIGLKDVITLRRHVETKVRAKIRKRKVTTKINHHDKINGKRKTARKQKMFQRAQELRRRAEDYHKCKIPPSARKALCNWVRMAAAEHRHSSGLPYWPYLTAETLKNRMGHQPPPPTQQHSITDNSLSLKTPPECLLTPLPPSADDNLKTPPECVLTPLPPSADDNLKTPPECVLTPLPPSADDNLKTPPECLLTPLPPSADDNLKTPPECSHHPQLYPQLHPQRNDNLKTRAECLLHPLPPSADDNLKTPSERQLTPLPPSAPPSADDNIKTPAERLPPSADDNLKTPSERQLTPLPPSAPPSADDNIKTPAERLRGPLPPSADDNLKTPPLATQEAEAEKPRKPKRQRAAEMEPPPEPKRRRVGDVEPSRKPKRRRAADVEPSSPEPKRRRVGDVEPSRKPKRRRAADVEPSSPEPKRRRVGDVEPSRKPKRRRAADVEPSLPEPKRRRLS

SEQ ID NO: 901094 - protein, 857 aa, Homo sapiens
MVKLSIVLTPQFLSHDQGQLTKELQQHVKSVTCPCEYLRKVINTLADHHHRGTDFGGSPWLHVIIAFPTSYKVVITLWIVYLWVSLLKTIFWSRNGHDGSTDVQQRAWRSNRRRQEGLRSICMHTKKRVSSFRGNKIGLKDVITLRRHVETKVRAKIRKRKVTTKINHHDKINGKRKTARKQKMFQRAQELRRRAEDYHKCKEGASSLQLQDSSVLMQMMPRPLDSLNIQFLMCWLFQIPPSARKALCNWVRMAAAEHRHSSGLPYWPYLTAETLKNRMGHQPPPPTQQHSITDNSLSLKTPPECLLTPLPPSADDNLKTPPECVLTPLPPSADDNLKTPPECVLTPLPPSADDNLKTPPECLLTPLPPSADDNLKTPPECLTDDNLKTPSERQLTPLPPSAPPLSSTLQQMIISRHLPSVCGGRFHPQQMIISRHLPSVSSLPFHPQLHPQQMIISRHLPSVCGGRFHPQRMIISRHLPSVSSLPFHPQLHPQQMIISRHLPSVCGERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPPLATQEAEAEKPRKPKRQRAAEMEPPPEPKRRRVGDVEPSRKPKRRRAADVEPSSPEPKRRRVGDVEPSRKPKRRRAADVEPSSPEPKRRRVGDVEPSRKPKRRRAADVEPSLPEPKRRRLS

SEQ ID NO: 901095 - protein, 821 aa, Homo sapiens; identical to SEQ ID NO: 901077

SEQ ID NO: 901096 - protein, 821 aa, Homo sapiens; identical to SEQ ID NO: 901077

SEQ ID NO: 901097 - protein, 821 aa, Homo sapiens; identical to SEQ ID NO: 901077

SEQ ID NO: 901098 - protein, 649 aa, Homo sapiens
MVKLSIVLTPQFLSHDQGQLTKELQQHVKSVTCPCEYLRKVINTLADHHHRGTDFGGSPWLHVIIAFPTSYKVVITLWIVYLWVSLLKTIFWSRNGHDGSTDVQQRAWRSNRRRQEGLRSICMHTKKRVSSFRGNKIGLKDVITLRRHVETKVRAKIRKRKVTTKINHHDKINGKRKTARKQKMFQRAQELRRRAEDYHKCKIPPSARKALCNWVRMAAAEHRHSSGLPYWPYLTAETLKNRMGHQPPPPTQQHSITDNSLSLKTPPECLLTPLPPSADDNLKTPPECVLTPLPPSADDNLKTPPECVLTPLPPSADDNLKTPPECLLTPLPPSADDNLKTPPECSHHPQLYPQLHPQRNDNLKTRAECLLHPLPPSADDNLKTPSERQLTPLPPSAPPSADDNIKTPAERQRLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPPLATQEAEAEKPRKPKRQRAAEMEPSSPEPKRRRVGDVEPSRKPKRRRAADVEPSSPEPKRRRVGDVEPSRKPKRRRAADVEPSLPEPKRRRLS

SEQ ID NO: 901099 - protein, 552 aa, Homo sapiens
MVKLSIVLTPQFLSHDQGQLTKELQQHVKSVTCPCEYLRKVINTLADHHHRGTDFGGSPWLHVIIAFPTSYKVVITLWIVYLWVSLLKTIFWSRNGHDGSTDVQQRAWRSNRRRQEGLRSICMHTKKRVSSFRGNKIGLKDVITLRRHVETKVRAKIRKRKVTTKINHHDKINGKRKTARKQKMFQRAQELRRRAEDYHKCKIPPSARKALCNWVRMAAAEHRHSSGLPYWPYLTAETLKNRMGHQPPPPTQQHSITDNSLSLKTPPECLLTPLPPSADDNLKTPPECVLTPLPPSADDNLKTPPECVLTPLPPSADDNLKTPPECLLTPLPPSADDNLKTPPECLTDDNLKTPSERQLTPLPPSAPPLSSTLQQMIISRHLPSVCGGRFHPQQMIISRHLPSVSSLPFHPQLHPQQMIISRHLPSVCGGRFHPQRMIISRHLPSVSSLPFHPQLHPQQMIISRHLPSVCGERLRGPLPPSADDNLKTPSERQLTPLPPSAPPSADDNIKTPAERLRGPLPPSADDNHQQPGAADDYVRRRRPDVRGGSRSS

SEQ ID NO: 901100 - protein, 182 aa, Homo sapiens
MVKLSIVLTPQFLSHDQGQLTKELQQHVKSVTCPCEYLRKVINTLADHHHRGTDFGGSPWLHVIIAFPTSYKVVITLWIVYLWVSLLKTIFWSRNGHDGSTDVQQRAWRSNRRRQEGLRSICMHTKKRVSSFRGNKIGLKDVITLRRHVETKVRAKIRKRKVTTKINHHDKINGKRKTARKQ

SEQ ID NO: 901101 - protein, 1512 aa, Homo sapiens
MVSEKSHLGNPQEPVQEEPKTRLLSMTVRRGPRSLPPIPSTSRTGFAEFSMRGRMREKLQAARSKAESALLQEIPTPRPRRLRSPSKKELETEFGTEPGKEVERTQQEVDSQSYSRVKFHDSARKIKPKPQVPPGFPSAEEAYNFFTFNFDPEPEGSEEKPKARHRAGTNQEEEEGEEEEPPAQGGGKEMDEEELLNGDDAEDFLLGLDHVADDFVAVRPADYESIHDRLQMEREMLFIPSRQTVPTYKKLPENVQPRFLEDEGLYTGVRPEVARTNQNIMENRLLMQDPERRWFGDDGRILALPNPIKPFPSRPPVLTQEQSIKAELETLYKKAVKYVHSSQHVIRSGDPPGNFQLDIDISGLIFTHHPCFSREHVLAAKLAQLYDQYLARHQRNKAKFLTDKLQALRNAVQTGLDPEKPHQSLDTIQKTINEYKSEIRQTRKFRDAEQEKDRTLLKTIIKVWKEMKSLREFQRFTNTPLKLVLRKEKADQKADEEAYEAEIQAEISELLEEHTEEYAQKMEEYRTSLQQWKAWRKVQRAKKKKRKQAAEEHPGDEIAEPYPEEDLVKPSPPEPTDRAVIEQEVRERAAQSRRRPWEPTLVPELSLAGSVTPNDQCPRAEVSRREDVKKRSVYLKVLFNNKEVSRTVSRPLGADFRVHFGQIFNLQIVNWPESLTLQVYETVGHSSPTLLAEVFLPIPETTVVTGRAPTEEVEFSSNQHVTLDHEGVGSGVPFSFEADGSNQLTLMTSGKVSHSVAWAIGENGIPLIPPLSQQNIGFRSALKKADAISSIGTSGLTDMKKLAKWAAESKLDPNDPNNAPLMQLISVATSGESYVPDFFRLEQLQQEFNFVSDQELNRSKRFRLLHLRSQEVPEFRNYKQVPVYDREIMEKVFQDYEKRLRDRNVIETKEHIDTHRAIVAKYLQQVRESVINRFLIAKQYFLLADMIVEEEVPNISILGLSLFKLAEQKRPLRPRRKGRKKVTAQNLSDGDIKLLVNIVRAYDIPVRKPAVSKFQQPSGSSRMFSEKHAASPSTYSPTHNADYPLGQVLVRPFVEVSFQRTVCHTTTAEGPNPSWNEELELPFRAPNGDYSTASLQSVKDVVFINIFDEVLHDVLEDDRERGSGIHTRIERHWLGCVKMPFSTIYFQARFESQEDEKLLQATEKFQAECALKFPNRQCLTTVIDISGKTVFITRYLKPLNPPQELLNVYPNNLQATAELVARYVSLIPFLPDTVSFGGICDLWSTSDQFLDLLAGDEEEHAVLLCNYFLSLGKKAWLLMGNAIPEGPTAYVLTWEQGRYLIWNPCSGHFYGQFDTFCPLKNVGCLIGPDNIWFNIQRYESPLRINFDVTRPKLWKSFFSRSLPYPGLSSVQPEELIYQRSDKAAAAELQDRIEKILKEKIMDWRPRHLTRWNRYCTSTLRHFLPLLEKSQGEDVEDDHRAELLKQLGDYRFSGFPLHMPYSEVKPLIDAVYSTGVHNIDVPNVEFALAVYIHPYPKNVLSVWIYVASLIRNR

SEQ ID NO: 901102 - protein, 1091 aa, Homo sapiens
MNPREEKVKIITEEFIENDEDADMGRQNKNSKVRRQPRKKQPPTAVPKEMVSEKSHLGNPQEPVQEEPKTRLLSMTVRRGPRSLPPIPSTSRTGFAEFSMRGRMREKLQAARSKAESALLQEIPTPRPRRLRSPSKKELETEFGTEPGKEVERTQQEVDSQSYSRVKFHDSARKIKPKPQVPPGFPSAEEAYNFFTFNFDPEPEGSEEKPKARHRAGTNQEEEEGEEEEPPAQGGGKEMDEEELLNGDDAEDFLLGLDHVADDFVAVRPADYESIHDRLQMEREMLFIPSRQTVPTYKKLPENVQPRFLEDEGLYTGVRPEVARTNQNIMENRLLMQDPERRWFGDDGRILALPNPIKPFPSRPPVLTQEQSIKAELETLYKKAVKYVHSSQHVIRSGDPPGNFQLDIDISGLIFTHHPCFSREHVLAAKLAQLYDQYLARHQRNKAKFLTDKLQALRNAVQTGLDPEKPHQSLDTIQKTINEYKSEIRQTRKFRDAEQEKDRTLLKTIIKVWKEMKSLREFQRFTNTPLKLVLRKEKADQKADEEAYEAEIQAEISELLEEHTEEYAQKMEEYRTSLQQWKAWRKVQRAKKKKRKQAAEEHPGDEIAEPYPEEDLVKPSPPEPTDRAVIEQEVRERAAQSRRRPWEPTLVPELSLAGSVTPNDQCPRAEVSRREDVKKRSVYLKVLFNNKEVSRTVSRPLGADFRVHFGQIFNLQIVNWPESLTLQVYETVGHSSPTLLAEVFLPIPETTVVTGRAPTEEVEFSSNQHVTLDHEGVGSGVPFSFEADGSNQLTLMTSGKVSHSVAWAIGENGIPLIPPLSQQNIGFRSALKKADAISSIGTSGLTDMKKLAKWAAESKLDPNDPNNAPLMQLISVATSGESYVPDFFRLEQLQQEFNFVSDQELNRSKRFRLLHLRSQEVPEFRNYKQVPVYDREIMEKVFQDYEKRLRDRNVIETKEHIDTHRAIVAKYLQQLKEKIMDWRPRHLTRWNRYCTSTLRHFLPLLEKSQGEDVEDDHRAELLKQLGDYRFSGFPLHMPYSEVKPLIDAVYSTGVHNIDVPNVEFALAVYIHPYPKNVLSVWIYVASLIRNR

SEQ ID NO: 901103 - protein, 111 aa, Homo sapiens
MNPREEKVKIITEEFIENDEDADMGRQNKNSKVRRQPRKKQPPTAVPKEMVSEKSHLGNPQEPVQEEPKTRLLSMTVRRGPRRELVVKKSLGRPGTVTHVCNPSTLEGRGG

SEQ ID NO: 901104 - protein, 276 aa, Homo sapiens
MNPREEKVKIITEEFIENDEDADMGRQNKNSKVRRQPRKKQPPTAVPKEMVSEKSHLGNPQEPVQEEPKTRLLSMTVRRGPRSLPPIPSTSRTGFAEFSMRGRMREKLQAARSKAESALLQEIPTPRPRRLRSPSKKELETEFGTEPGKEVERTQQEVDSQSYSRVKFHDSARKIKPKPQVPPGFPSAEEAYNFFTFNFDPEPEGSEEKPKARHRAGTNQEEEEGEEEEPPAQGGGKEMVFNIRMVMRCGWRARRKKLMSLQERKWLRRNLPPPGE

SEQ ID NO: 901105 - protein, 536 aa, Homo sapiens
MNPREEKVKIITEEFIENDEDADMGRQNKNSKVRRQPRKKQPPTAVPKEMVSEKSHLGNPQEPVQEEPKTRLLSMTVRRGPRSLPPIPSTSRTGFAEFSMRGRMREKLQAARSKAESALLQEIPTPRPRRLRSPSKKELETEFGTEPGKEVERTQQEVDSQSYSRVKFHDSARKIKPKPQVPPGFPSAEEAYNFFTFNFDPEPEGSEEKPKARHRAGTNQEEEEGEEEEPPAQGGGKEMDEEELLNGDDAEDFLLGLDHVADDFVAVRPADYESIHDRLQMEREMLFIPSRQTVPTYKKLPENVQPRFLEDEGLYTGVRPEVARTNQNIMENRLLMQDPERRWFGDDGRILALPNPIKPFPSRPPVLTQEQSIKAELETLYKKAVKYVHSSQHVIRSGDPPGNFQLDIDISGLIFTHHPCFSREHVLAAKLAQLYDQYLARHQRNKAKFLTDKLQALRNAVQTGLDPEKPHQSLDTIQKTINEYKSEIRQTRKFRDAEQEKDRTLLKTIIKVWKEMKSLREFQRFTNTPLKLVLRK

SEQ ID NO: 901106 - protein, 124 aa, Homo sapiens
LLFNIMQDEEELLNGDDAEDFLLGLDHVADDFVAVRPADYESIHDRLQMEREMLFIPSRQTGTCSFYFLVQLRHRHLPCHEIWLVYKDASSPELIPVSNLTIKKYLQTNKKNTTWKNIHSTNTY

SEQ ID NO: 901107 - protein, 1601 aa, Homo sapiens
MNPREEKVKIITEEFIENDEDADMGRQNKNSKVRRQPRKKQPPTAVPKEMVSEKSHLGNPQEPVQEEPKTRLLSMTVRRGPRSLPPIPSTSRTGFAEFSMRGRMREKLQAARSKAESALLQEIPTPRPRRLRSPSKKELETEFGTEPGKEVERTQQEVDSQSYSRVKFHDSARKIKPKPQVPPGFPSAEEAYNFFTFNFDPEPEGSEEKPKARHRAGTNQEEEEGEEEEPPAQGGGKEMDEEELLNGDDAEDFLLGLDHVADDFVAVRPADYESIHDRLQMEREMLFIPSRQTVPTYKKLPENVQPRFLEDEGLYTGVRPEVARTNQNIMENRLLMQDPERRWFGDDGRILALPNPIKPFPSRPPVLTQEQSIKAELETLYKKAVKYVHSSQHVIRSGDPPGNFQLDIDISGLIFTHHPCFSREHVLAAKLAQLYDQYLARHQRNKAKFLTDKLQALRNAVQTGLDPEKPHQSLDTIQKTINEYKSEIRQTRKFRDAEQEKDRTLLKTIIKVWKEMKSLREFQRFTNTPLKLVLRKEKADQKADEEAYEAEIQAEISELLEEHTEEYAQKMEEYRTSLQQWKAWRKVQRAKKKKRKQAAEEHPGDEIAEPYPEEDLVKPSPPEPTDRAVIEQEVRERAAQSRRRPWEPTLVPELSLAGSVTPNDQCPRAEVSRREDVKKRSVYLKVLFNNKEVSRTVSRPLGADFRVHFGQIFNLQIVNWPESLTLQVYETVGHSSPTLLAEVFLPIPETTVVTGRAPTEEVEFSSNQHVTLDHEGVGSGVPFSFEADGSNQLTLMTSGKVSHSVAWAIGENGIPLIPPLSQQNIGFRSALKKADAISSIGTSGLTDMKKLAKWAAESKLDPNDPNNAPLMQLISVATSGESYVPDFFRLEQLQQEFNFVSDQELNRSKRFRLLHLRSQEVPEFRNYKQVPVYDREIMEKVFQDYEKRLRDRNVIETKEHIDTHRAIVAKYLQQVRESVINRFLIAKQYFLLADMIVEEEVPNISILGLSLFKLAEQKRPLRPRRKGRKKVTAQNLSDGDIKLLVNIVRAYDIPVRKPAVSKFQQPSGSSRMFSEKHAASPSTYSPTHNADYPLGQVLVRPFVEVSFQRTVCHTTTAEGPNPSWNEELELPFRAPNGDYSTASLQSVKDVVFINIFDEVLHDVLEDDRERGSGIHTRIERHWLGCVKMPFSTIYFQARIDGTFKIDIPPVLLGYSKERNMILEREVLILSEAESEGSYITLFITIEPQLVPGESIREKFESQEDEKLLQATEKFQAECALKFPNRQCLTTVIDISGKTVFITRYLKPLNPPQELLNVYPNNLQATAELVARYVSLIPFLPDTVSFGGICDLWSTSDQFLDLLAGDEEEHAVLLCNYFLSLGKKAWLLMGNAIPEGPTAYVLTWEQGRYLIWNPCSGHFYGQFDTFCPLKNVGCLIGPDNAQAMEIFLFKKPSIPGLSSVQPEELIYQRSDKAAAAELQDRIEKILKEKIMDWRPRHLTRWNRYCTSTLRHFLPLLEKSQGEDVEDDHRAELLKQLGDYRFSGFPLHMPYSEVKPLIDAVYSTGVHNIDVPNVEFALAVYIHPYPKNVLSVWIYVASLIRNR

SEQ ID NO: 901108 - protein, 111 aa, Homo sapiens; identical to SEQ ID NO: 901103

SEQ ID NO: 901109 - protein, 106 aa, Homo sapiens
MMRMQTWEDRIRTQRFEDSQERNRQKPTPFSRACWQILPHLSAGVPLLGWEHPVQGKSFQATNCCPQGNGVRKIPPWQPPGACAGGAQDPPPEYDSPERPTERAGC

SEQ ID NO: 901110 - protein, 114 aa, Homo sapiens
MMRMQTWEDRIRTQRFEDSQERNRQKPTPFSRACWQILPHLSAGVPLLGWEHPVQGKSFQATNCCPQGNGVRKIPPWQPPGACAGGAQDPPPEYDSPERPTEELVVKKSLGLQA

SEQ ID NO: 901111 - protein, 473 aa, Homo sapiens
GGSGKPRSELRVVAMAASGAVEPGPPGAAVAPSPAPAPPPAPDHLFRPISAEDEEQQPTEIESLCMNCYCNGMTRLLLTKIPFFREIIVSSFSCEHCGWNNTEIQSAGRIQDQGVRYTLSVRALEDMNREVVKTDSAATRIPELDFEIPAFSQKGALTTVEGLITRAISGLEQDQPARRANKDATAERIDEFIVKLKELKQVASPFTLIIDDPSGNSFVENPHAPQKDDALVITHYNRTRQQEEMLGLQEEAPAEKPEEEDLRNEVLQFSTNCPECNAPAQTNMKLVQIPHFKEVIIMATNCENCGHRTNEVKSGGAVEPLGTRITLHITDASDMTRDLLKSETCSVEIPELEFELGMAVLGGKFTTLEGLLKDIRELVTKNPFTLGDSSNPGQTERLQEFSQKMDQIIEGNMKAHFIMDDPAGNSYLQNVYAPEDDPEMKVERYKRTFDQNEELGLNDMKTEGYEAGLAPQR

SEQ ID NO: 901112 - protein, 490 aa, Homo sapiens
GGSGKPRSELRVVAMAASGAVEPGPPGAAVAPSPAPAPPPAPDHLFRPISAEDEEQQPTEIESLCMNCYCNGMTRLLLTKIPFFREIIVSSFSCEHCGWNNTEIQSAGRIQDQGVRYTLSVRALEDMNREVVKTDSAATRIPELDFEIPAFSQKGALTTVEGLITRAISGLEQDQPARRANKDATAERIDEFIVKLKELKQVASPFTLIIDDPSGNSFVENPHAPQKDDALVITHYNRTRQQEEMLGLQEEAPAEKPEEEDLRNEVLQFSTNCPECNAPAQTNMKLVHGGLVRLEVDFLNIRFPEIPHFKEVIIMATNCENCGHRTNEVKSGGAVEPLGTRITLHITDASDMTRDLLKSETCSVEIPELEFELGMAVLGGKFTTLEGLLKDIRELVTKNPFTLGDSSNPGQTERLQEFSQKMDQIIEGNMKAHFIMDDPAGNSYLQNVYAPEDDPEMKVERYKRTFDQNEELGLNDMKTEGYEAGLAPQR

SEQ ID NO: 901113 - protein, 457 aa, Homo sapiens
GGSGKPRSELRVVAMAASGAVEPGPPGAAVAPSPAPAPPPAPDHLFRPISAEDEEQQPTEIESLCMNCYCNGMTRLLLTKIPFFREIIVSSFSCEHCGWNNTEIQSAGRIQDQGVRYTLSVRALEDMNREVVKTDSAATRIPELDFEIPAFSQKGALTTVEGLITRAISGLEQDQPARRANKDATAERIDEFIVKLKELKQVASPFTLIIDDPSGNSFVENPHAPQKDDALVITHYNRTRQQEEMLGLQVLQFSTNCPECNAPAQTNMKLVQIPHFKEVIIMATNCENCGHRTNEVKSGGAVEPLGTRITLHITDASDMTRDLLKSETCSVEIPELEFELGMAVLGGKFTTLEGLLKDIRELVTKNPFTLGDSSNPGQTERLQEFSQKMDQIIEGNMKAHFIMDDPAGNSYLQNVYAPEDDPEMKVERYKRTFDQNEELGLNDMKTEGYEAGLAPQR

SEQ ID NO: 901114 - protein, 468 aa, Homo sapiens
PGYFITAWRSVLSYVSGACTSQASVAPDASLGTRASPDHLFRPISAEDEEQQPTEIESLCMNCYCNGMTRLLLTKIPFFREIIVSSFSCEHCGWNNTEIQSAGRIQDQGVRYTLSVRALEDMNREVVKTDSAATRIPELDFEIPAFSQKGALTTVEGLITRAISGLEQDQPARRANKDATAERIDEFIVKLKELKQVASPFTLIIDDPSGNSFVENPHAPQKDDALVITHYNRTRQQEEMLGLQEEAPAEKPEEEDLRNEVLQFSTNCPECNAPAQTNMKLVQIPHFKEVIIMATNCENCGHRTNEVKSGGAVEPLGTRITLHITDASDMTRDLLKSETCSVEIPELEFELGMAVLGGKFTTLEGLLKDIRELVTKNPFTLGDSSNPGQTERLQEFSQKMDQIIEGNMKAHFIMDDPAGNSYLQNVYAPEDDPEMKVERYKRTFDQNEELGLNDMKTEGYEAGLAPQR

SEQ ID NO: 901115 - protein, 347 aa, Homo sapiens [sequence omitted]

SEQ ID NO: 901116 - protein, 82 aa, Homo sapiens
MTRLLLTKIPFFREIIVSSFSCEHCGWNNTEIQSAGRIQDQGVRYTLSVRALEVRGPQSRYLSILERDSVLGSELWSRRSDL

SEQ ID NO: 901117 - protein, 473 aa, Homo sapiens; identical to SEQ ID NO: 901111

SEQ ID NO: 901118 - protein, 429 aa, Homo sapiens
GGSGKPRSELRVVAMAASGAVEPGPPGAAVAPSPAPAPPPAPDHLFRPISAEDEEQQPTEIESLCMNCYCNGMTRLLLTKIPFFREIIVSSFSCEHCGWNNTEIQSAGRIQDQGVRYTLSVRALEDMNREVVKTDSAATRIPELDFEIPAFSQKGALTTVEGLITRAISGLEQDQPARRANKDATAERIDEFIVKLKELKQVASPFTLIIDDPSGNSFVENPHAPQKDDALVITHYNRTRQQEEMLGLQEEAPAEKPEEEDLRNEVLQFSTNCPECNAPAQTNMKLVQIPHFKEVIIMATNCENCGHRTNEVKSGGAVEPLGTRITLHITDASDMTRDLLKSETCSVEIPELEFELGMAVLGGKFTTLEGLLKDIRELVTKNPFTLGDSSNPGQTERLQEFSQKMDQIIEGNMSPLYYGCPTTEICRAT

SEQ ID NO: 901119 - protein, 467 aa, Homo sapiens
MNLLIMDKWYHMLERHQWPPGAAVAPSPAPAPPPAPDHLFRPISAEDEEQQPTEIESLCMNCYCNGMTRLLLTKIPFFREIIVSSFSCEHCGWNNTEIQSAGRIQDQGVRYTLSVRALEDMNREVVKTDSAATRIPELDFEIPAFSQKGALTTVEGLITRAISGLEQDQPARRANKDATAERIDEFIVKLKELKQVASPFTLIIDDPSGNSFVENPHAPQKDDALVITHYNRTRQQEEMLGLQEEAPAEKPEEEDLRNEVLQFSTNCPECNAPAQTNMKLVQIPHFKEVIIMATNCENCGHRTNEVKSGGAVEPLGTRITLHITDASDMTRDLLKSETCSVEIPELEFELGMAVLGGKFTTLEGLLKDIRELVTKNPFTLGDSSNPGQTERLQEFSQKMDQIIEGNMKAHFIMDDPAGNSYLQNVYAPEDDPEMKVERYKRTFDQNEELGLNDMKTEGYEAGLAPQR

SEQ ID NO: 901120 - protein, 175 aa, Homo sapiens
GGSGKPRSELRVVAMAASGAVEPGPPGAAVAPSPAPAPPPAPDHLFRPISAEDEEQQPTEIESLCMNCYCNGMTRLLLTKIPFFREIIVSSFSCEHCGWNNTEIQSAGRIQDQGVRYTLSVRALEDMNREVVKTDSAATRIPELDFEIPAFSQKGALTTVEGLITRSGVFRDPLN

SEQ ID NO: 901121 - protein, 226 aa, Homo sapiens
GRGRGLLLLSFRRLRRALRRTSRLSRAAPPLAAPPPPPLLRHRLPPPEQSARAPAGSVMATRSPGVVISDDEPGYDLDLFCIPNHYAEDLERVFIPHGLIMDRTERLARDVMKEMGGHHIVALCVLKGGYKFFADLLDYIKALNRNSDRSIPMTVDFIRLKSYCNDQSTGDIKVIGGDDLSTLTGKNVIDVEDIMTLAKQADFAFLVSIYPRSSRNCRWTPEVGAS

SEQ ID NO: 901122 - protein, 276 aa, Homo sapiens
GRGRGLLLLSFRRLRRALRRTSRLSRAAPPLAAPPPPPLLRHRLPPPEQSARAPAGSVMATRSPGVVISDDEPGYDLDLFCIPNHYAEDLERVFIPHGLIMDRTERLARDVMKEMGGHHIVALCVLKGGYKFFADLLDYIKALNRNSDRSIPMTVDFIRLKSYCNDQSTGDIKVIGGDDLSTLTGKNVLIVEDIIDTGKTMQTLLSLVRQYNPKMVKVASLLVKRTPRSVGYKPDFVGFEIPDKFVVGYALDYNEYFRDLNHVCVISETGKAKYKA

SEQ ID NO: 901123 - protein, 309 aa, Homo sapiens
GVVISDDEPGYDLDLFCIPNHYAEDLERVFIPHGLIMDRTERLARDVMKEMGGHHIVALCVLKGGYKFFADLLDYIKALNRNSDRSIPMTVDFIRLKSYCISDDEPGYDLDLFCIPNHYAEDLERVFIPHGLIMDRTERLARDVMKEMGGHHIVALCVLKGGYKFFADLLDYIKALNRNSDRSIPMTVDFIRLKSYCNDQSTGDIKVIGGDDLSTLTGKNVLIVEDIIDTGKTMQTLLSLVRQYNPKMVKVASLLVKRTPRSVGYKPDFVGFEIPDKFVVGYALDYNEYFRDLNHVCVISETGKAKYKA

SEQ ID NO: 901124 - protein, 222 aa, Homo sapiens
GRGRGLLLLSFRRLRRALRRTSRLSRAAPPLAAPPPPPLLRHRLPPPEQSARAPAGSVMATRSPGVVISDDEPGYDLDLFCIPNHYAEDLERVFIPHGLIMDRTERLARDVMKEMGGHHIVALCVLKGGYKFFADLLDYIKALNRNSDRSIPMTVDFIRLKSYCNDQSTGDIKVIGGDDLSTLTGKNVLIVEDIIDTGKTMQTLLSLVRQYNPKMVKVARYV

SEQ ID NO: 901125 - protein, 276 aa, Homo sapiens; identical to SEQ ID NO: 901122

SEQ ID NO: 901126 - protein, 276 aa, Homo sapiens; identical to SEQ ID NO: 901122

SEQ ID NO: 901127 - protein, 187 aa, Homo sapiens
AGTSVEGLYVTYHCNQDALMRVGNRARRVSTLPLCVLKGGYKFFADLLDYIKALNRNSDRSIPMTVDFIRLKSYCNDQSTGDIKVIGGDDLSTLTGKNVLIVEDIIDTGKTMQTLLSLVRQYNPKMVKVASLLVKRTPRSVGYKPDFVGFEIPDKFVVGYALDYNEYFRDLNHVCVISETGKAKYKA

SEQ ID NO: 901128 - protein, 606 aa, Homo sapiens
MKGATTNICYNVLDRNVHEKKLGDKVAFYWEGNEPGETTQITYHQLLVQVCQFSNVLRKQGIQKGDRVAIYMPMIPELVVAMLACARIGALHSIVFAGFSSESLCERILDSSCSLLITTDAFYRGEKLVNLKELADEALQKCQEKGFPVRCCIVVKHLGRAELGMGDSTSQSPPIKRSCPDVQISWNQGIDLWWHELMQEAGDECEPEWCDAEDPLFILYTSGSTGKPKGVVHTVGGYMLYVATTFKYVFDFHAEDVFWCTADIGWITGHSYVTYGPLANGATSVLFEGIPTYPDVNRLWSIVDKYKVTKFYTAPTAIRLLMKFGDEPVTKHSRASLQVLGTVGEPINPEAWLWYHRVVGAQRCPIVDTFWQTETGGHMLTPLPGATPMKPGSATFPFFGVAPAILNESGEELEGEAEGYLVFKQPWPGIMRTVYGNHERFETTYFKKFPGYYVTGDGCQRDQDGYYWITGRIDDMLNVSGHLLSTAEVESALVEHEAVAEAAVVGHPHPVKGECLYCFVTLCDGHTFSPKLTEELKKQIREKIGPIATPDYIQNAPGLPKTRSGKIMRRVLRKIAQNDHDLGDMSTVADPSVISHLFSHRCLTIQ

SEQ ID NO: 901129 - protein, 169 aa, Homo sapiens
MGDSTSQSPPIKRSCPDVQISWNQGIDLWWHELMQEAGDECEPEWCDAEDPLFILYTSGSTGKPKGVVHTVGGYMLYVATTFKYVFDFHAEDVFWCTADIGWITGHSYVTYGPLANGATSVLCGGIPPYSGREPAVGPCGPFTGGPVFHNGPRPSLVMKVGDYLFPSIP

SEQ ID NO: 901130 - protein, 666 aa, Homo sapiens
MEICEGKEIEDMSSEEGENLSWFQEFWGDIAKEFYWKTPCPGPFLRYNFDVTKGKIFIEWMKGATTNICYNVLDRNVHEKKLGDKVAFYWEGNEPGETTQITYHQLLVQVCQFSNVLRKQGIQKGDRVAIYMPMIPELVVAMLACARIGALHSIVFAGFSSESLCERILDSSCSLLITTDAFYRGEKLVNLKELADEALQKCQEKGFPVRCCIVVKHLGRAELGMGDSTSQSPPIKRSCPDVQISWNQGIDLWWHELMQEAGDECEPEWCDAEDPLFILYTSGSTGKPKGVVHTVGGYMLYVATTFKYVFDFHAEDVFWCTADIGWITGHSYVTYGPLANGATSVLFEGIPTYPDVNRLWSIVDKYKVTKFYTAPTAIRLLMKFGDEPVTKHSRASLQVLGTVGEPINPEAWLWYHRVVGAQRCPIVDTFWQTETGGHMLTPLPGATPMKPGSATFPFFGVAPAILNESGEELEGEAEGYLVFKQPWPGIMRTVYGNHERFETTYFKKFPGYYVTGDGCQRDQDGYYWITGRIDDMLNVSGHLLSTAEVESALVEHEAVAEAAVVGHPHPVKGECLYCFVTLCDGHTFSPKLTEELKKQIREKIGPIATPDYIQNAPGLPKTRSGKIMRRVLRKIAQNDHDLGDMSTVADPSVISHLFSHRCLTIQ

SEQ ID NO: 901131 - protein, 751 aa, Homo sapiens
MGLPEERVRSGSGSRGQEEAGAGGRARSWSPPPEVSRSAHVPSLQRYRELHRRSVEEPREFWGDIAKEFYWKTPCPGPFLRYNFDVTKGKIFIEWMKGATTNICYNVLDRNVHEKKLGDKVAFYWEGNEPGETTQITYHQLLVQVCQFSNVLRKQGIQKGDRVAIYMPMIPELVVAMLACARIGALHSIVFAGFSSESLCERILDSSCSLLITTDAFYRGEKLVNLKELADEALQKCQEKKCVWLLSELTEPFPSARFLCPLYPKWTWVGLAKFPLSQQGYHFRLFSSPGGFPVRCCIVVKHLGRAELGMGDSTSQSPPIKRSCPDVQISWNQGIDLWWHELMQEAGDECEPEWCDAEDPLFILYTSGSTGKPKGVVHTVGGYMLYVATTFKYVFDFHAEDVFWCTADIGWITGHSYVTYGPLANGATSVLFEGIPTYPDVNRLWSIVDKYKVTKFYTAPTAIRLLMKFGDEPVTKHSRASLQVLGTVGEPINPEAWLWYHRVVGAQRCPIVDTFWQTETGGHMLTPLPGATPMKPGSATFPFFGVAPAILNESGEELEGEAEGYLVFKQPWPGIMRTVYGNHERFETTYFKKFPGYYVTGDGCQRDQDGYYWITGRIDDMLNVSGHLLSTAEVESALVEHEAVAEAAVVGHPHPVKGECLYCFVTLCDGHTFSPKLTEELKKQIREKIGPIATPDYIQNAPGLPKTRSGKIMRRVLRKIAQNDHDLGDMSTVADPSVISHLFSHRCLTIQ

SEQ ID NO: 901132 - protein, 442 aa, Homo sapiens
MGDSTSQSPPIKRSCPDVQISWNQGIDLWWHELMQEAGDECEPEWCDAEDPLFILYTSGSTGKPKGVVHTVGGYMLYVATTFKYVFDFHAEDVFWCTADIGWITGHSYVTYGPLANGATSVLFEGIPTYPDVNRLWSIVDKYKVTKFYTAPTAIRLLMKFGDEPVTKHSRASLQVLGTVGEPINPEAWLWYHRVVGAQRCPIVDTFWQTETGGHMLTPLPGATPMKPGSATFPFFGVAPAILNESGEELEGEAEGYLVFKQPWPGIMRTVYGNHERFETTYFKKFPGYYVTGDGCQRDQDGYYWITGRIDDMLNVSGHLLSTAEVESALVEHEAVAEAAVVGHPHPVKGECLYCFVTLCDGHTFSPKLTEELKKQIREKIGPIATPDYIQNAPGLPKTRSGKIMRRVLRKIAQNDHDLGDMSTVADPSVISHLFSHRCLTIQ

SEQ ID NO: 901133 - protein, 442 aa, Homo sapiens; identical to SEQ ID NO: 901132

SEQ ID NO: 901134 - protein, 701 aa, Homo sapiens [sequence omitted]

SEQ ID NO: 901135 - protein, 701 aa, Homo sapiens [sequence omitted]

SEQ ID NO: 901136 - protein, 176 aa, Homo sapiens [sequence omitted]

SEQ ID NO: 901137 - protein, 681 aa, Homo sapiens
MGLPEERVRSGSGSRGQEEAGAGGRARSWSPPPEVSRSAHVPSLQRYRELHRRSVEEPREFWGDIAKEFYWKTPCPGPFLRYNFDVTKGKIFIEWMKGATTNICYNVLDRNVHEKKLGDKVAFYWEGNEPGETTQITYHQLLVQVCQFSNVLRKQGIQKGDRVAIYMPMIPELVVAMLACARIGALHSIVFAGFSSESLCERILDSSCSLLITTDAFYRGEKLVNLKELADEALQKCQEKGFPVRCCIVVKHLGRAELGMGDSTSQSPPIKRSCPDVQISWNQGIDLWWHELMQEAGDECEPEWCDAEDPLFILYTSGSTGKPKGVVHTVGGYMLYVATTFKYVFDFHAEDVFWCTADIGWITGHSYVTYGPLANGATSVLFEGIPTYPDVNRLWSIVDKYKVTKFYTAPTAIRLLMKFGDEPVTKHSRASLQVLGTVGEPINPEAWLWYHRVVGAQRCPIVDTFWQTETGGHMLTPLPGATPMKPGSATFPFFGVAPAILNESGEELEGEAEGYLVFKQPWPGIMRTVYGNHERFETTYFKKFPGYYVTGDGCQRDQDGYYWITGRIDDMLNVSGHLLSTAEVESALVEHEAVAEAAVVGHPHPVKGECLYCFVTLCDGHTFSPKLTEELKKQIREKIGPIATPDYIQNAPGLPKTRSGMFRGLHGLGWAEAWWWWGVRG

SEQ ID NO: 901138 - protein, 538 aa, Homo sapiens
MGLPEERVRSGSGSRGQEEAGAGGRARSWSPPPEVSRSAHVPSLQRYRELHRRSVEEPREFWGDIAKEFYWKTPCPGPFLRYNFDVTKGKIFIEWMKGATTNICYNVLDRNVHEKKLGDKVAFYWEGNEPGETTQITYHQLLVQVCQFSNVLRKQGIQKGDRVAIYMPMIPELVVAMLACARIGALHSIVFAGFSSESLCERILDSSCSLLITTDAFYRGEKLVNLKELADEALQKCQEKGFPVRCCIVVKHLGRAELGMGDSTSQSPPIKRSCPDVQISWNQGIDLWWHELMQEAGDECEPEWCDAEDPLFILYTSGSTGKPKGVVHTVGGYMLYVATTFKYVFDFHAEDVFWCTADIGWITGHSYVTYGPLANGATSVLFEGIPTYPDVNRLWSIVDKYKVTKFYTAPTAIRLLMKFGDEPVTKHSRASLQVLGTVGEPINPEAWLWYHRVVGAQRCPIVDTFWQTETGGHMLTPLPGATPMKPGSATFPFFGVAPAILNESGEELEGEAEGYLVRPWPLGVFKERGKGSAKGTLL

SEQ ID NO: 901139 - protein, 240 aa, Homo sapiens
MGLPEERVRSGSGSRGQEEAGAGGRARSWSPPPEVSRSAHVPSLQRYRELHRRSVEEPREFWGDIAKEFYWKTPCPGPFLRYNFDVTKGKIFIEWMKGATTNICYNVLDRNVHEKKLGDKVAFYWEGNEPGETTQITYHQLLVQVCQFSNVLRKQGIQKGDRVAIYMPMIPELVVAMLACARIGALHSIVFAGFSSESLCERILDSSCSLLITTDAFYRGEKLVNLKELADEALQKCQEK

SEQ ID NO: 901140 - protein, 701 aa, Homo sapiens [sequence omitted]

SEQ ID NO: 901141 - protein, 244 aa, Homo sapiens
MGDSTSQSPPIKRSCPDVQISWNQGIDLWWHELMQEAGDECEPEWCDAEDPLFILYTSGSTGKPKGVVHTVGGYMLYVATTFKYVFDFHAEDVFWCTADIGWITGHSYVTYGPLANGATSVLFEGIPTYPDVNRLWSIVDKYKVTKFYTAPTAIRLLMKFGDEPVTKHSRASLQVLGTVGEPINPEAWLWYHRVVGAQRCPIVDTFWQTETGGHMLTPLPGATPMKPGSATFPSWVIRIDNREM

SEQ ID NO: 901142 - protein, 701 aa, Homo sapiens [sequence omitted]

SEQ ID NO: 901143 - protein, 650 aa, Homo sapiens
MEICEGKEIEDMSSEEGENLSWFQEFWGDIAKEFYWKTPCPGPFLRYNFDVTKGKIFIEWMKGATTNICYNVLDRNVHEKKLGDKVAFYWEGNEPGETTQITYHQLLVQVCQFSNVLRKQELVVAMLACARIGALHSIVFAGFSSESLCERILDSSCSLLITTDAFYRGEKLVNLKELADEALQKCQEKGFPVRCCIVVKHLGRAELGMGDSTSQSPPIKRSCPDVQISWNQGIDLWWHELMQEAGDECEPEWCDAEDPLFILYTSGSTGKPKGVVHTVGGYMLYVATTFKYVFDFHAEDVFWCTADIGWITGHSYVTYGPLANGATSVLFEGIPTYPDVNRLWSIVDKYKVTKFYTAPTAIRLLMKFGDEPVTKHSRASLQVLGTVGEPINPEAWLWYHRVVGAQRCPIVDTFWQTETGGHMLTPLPGATPMKPGSATFPFFGVAPAILNESGEELEGEAEGYLVFKQPWPGIMRTVYGNHERFETTYFKKFPGYYVTGDGCQRDQDGYYWITGRIDDMLNVSGHLLSTAEVESALVEHEAVAEAAVVGHPHPVKGECLYCFVTLCDGHTFSPKLTEELKKQIREKIGPIATPDYIQNAPGLPKTRSGKIMRRVLRKIAQNDHDLGDMSTVADPSVISHLFSHRCLTIQ

SEQ ID NO: 901144 - protein, 568 aa, Homo sapiens
GNSSYRYTCREGNEPGETTQITYHQLLVQVCQFSNVLRKQGIQKGDRVAIYMPMIPELVVAMLACARIGALHSIVFAGFSSESLCERILDSSCSLLITTDAFYRGEKGFPVRCCIVVKHLGRAELGMGDSTSQSPPIKRSCPDVQISWNQGIDLWWHELMQEAGDECEPEWCDAEDPLFILYTSGSTGKPKGVVHTVGGYMLYVATTFKYVFDFHAEDVFWCTADIGWITGHSYVTYGPLANGATSVLFEGIPTYPDVNRLWSIVDKYKVTKFYTAPTAIRLLMKFGDEPVTKHSRASLQVLGTVGEPINPEAWLWYHRVVGAQRCPIVDTFWQTETGGHMLTPLPGATPMKPGSATFPFFGVAPAILNESGEELEGEAEGYLVFKQPWPGIMRTVYGNHERFETTYFKKFPGYYVTGDGCQRDQDGYYWITGRIDDMLNVSGHLLSTAEVESALVEHEAVAEAAVVGHPHPVKGECLYCFVTLCDGHTFSPKLTEELKKQIREKIGPIATPDYIQNAPGLPKTRSGKIMRRVLRKIAQNDHDLGDMSTVADPSVISHLFSHRCLTIQ

SEQ ID NO: 901145 - protein, 701 aa, Homo sapiens [sequence omitted]

SEQ ID NO: 901146 - protein, 176 aa, Homo sapiens [sequence omitted]

SEQ ID NO: 901147 - protein, 163 aa, Homo sapiens
MSMRKSLEIKLLFTGCQRDQDGYYWITGRIDDMLNVSGHLLSTAEVESALVEHEAVAEAAVVGHPHPVKGECLYCFVTLCDGHTFSPKLTEELKKQIREKIGPIATPDYIQNAPGLPKTRSGKIMRRVLRKIAQNDHDLGDMSTVADPSVISHLFSHRCLTIQ

SEQ ID NO: 901148 - protein, 242 aa, Homo sapiens
MGLPEERVRSGSGSRGQEEAGAGGRARSWSPPPEVSRSAHVPSLQRYRELHRRSVEEPREFWGDIAKEFYWKTPCPGPFLRYNFDVTKGKIFIEWMKGATTNICYNVLDRNVHEKKLGDKVAFYWEGNEPGETTQITYHQLLVQVCQFSNVLRKQGIQKGDRVAIYMPMIPELVVAMLACARIGALHSIVFAGFSSESLCERILDSSCSLLITTDASTVCPLAPGAVWADSVSRGYSDHLLL

SEQ ID NO: 901149 - protein, 115 aa, Homo sapiens
HLLSTAEVESALVEHEAVAEAAVVGHPHPVKGECLYCFVTLCDGHTFSPKLTEELKKQSKEPPWAGTIGSVLEAQLSLQVVGEGLEQAAPQTTNRFQGAPWADCPLPVQSPLVSH

SEQ ID NO: 901150 - protein, 282 aa, Homo sapiens
MEQSSPGFRQTHLQDLSEATQDVKEENHYLTPRSVLLELDNIIASSDSGESIETDGPDQVSGRIECHYEPMESYFFKETSHESVDSSKEEPQTLPETQDGDLHLQEQGSGIDWCLSPADVEAQTTNDQKGSASLTVVQLSILINNIPDESQVEKLNVFLSPPDVINYLALTEATGRICVSQWEGPPRLGCIFCHGDHLLAVNDLKPQSLEEVSLFLTRSIQKEKLKLTIGRIPNSETFHAASCMCPSKCQSAAPSQLDKPRLNRAPKRSPAIKKSQQKGARE

SEQ ID NO: 901151 - protein, 299 aa, Homo sapiens
MEQSSPGFRQTHLQDLSEATQDVKEENHYLTPRSVLLELDNIIASSDSGESIETDGPDQVSGRIECHYEPMESYFFKETSHESVDSSKEEPQTLPETQDGDLHLQEQGSGIDWCLSPADVEAQTTNDQKGSASLTVVQLSILINNIPDESQVEKLNVFLSPPDVINYLALTEATGRICVSQWEGPPRLGCIFCHGDHLLAVNDLKPQSLEEVSLFLTRSIQKEDSFRILSYQVAFGEGTELRDRAPGFRTSDRHDVAKRACMESDWCRDSKTAPSTNLCLSFLFCKIMTNDGAGCWIIK

SEQ ID NO: 901152 - protein, 268 aa, Homo sapiens
MEQSSPGFRQTHLQDLSEATQDVKEENHYLTPRSVLLELDNIIASSDSGESIETDGPDQVSGRIECHYEPMESYFFKETSHESVDSSKEEPQTLPETQDGDLHLQEQGSGIDWCLSPADVEAQTTNDQKGNIPDESQVEKLNVFLSPPDVINYLALTEATGRICVSQWEGPPRLGCIFCHGDHLLAVNDLKPQSLEEVSLFLTRSIQKEKLKLTIGRIPNSETFHAASCMCPSKCQSAAPSQLDKPRLNRAPKRSPAIKKSQQKGARE

SEQ ID NO: 901153 - protein, 500 aa, Homo sapiens
MAPPSAPLPAQGPGKARPSRKRGRRPRALKFVDVAVYFSPEEWGCLRPAQRALYRDVMRETYGHLGALGCAGPKPALISWLERNTDDWEPAALDPQEYPRGLTVQRKSRTRKKNGEKEVFPPKEAPRKGKRGRRPSKPRLIPRQTSGGPICPDCGCTFPDHQALESHKCAQNLKKPYPCPDCGRRFSYPSLLVSHRRAHSGECPYVCDQCGKRFSQRKNLSQHQVIHTGEKPYHCPDCGRCFRRSRSLANHRTTHTGEKPHQCPSCGRRFAYPSLLAIHQRTHTGEKPYTCLECNRRFRQRTALVIHQRIHTGEKPYPCPDCERRFSSSSRLVSHRRVHSGERPYACEHCEARFSQRSTLLQHQLLHTGEKPYPCPDCGRAFRRSGSLAIHRSTHTEEKLHACDDCGRRFAYPSLLASHRRVHSGERPYACDLCSKRFAQWSHLAQHQLLHTGEKPFPCLECGRCFRQRWSLAVHKCSPKAPNCSPRSAIGGSSQRGNAH

SEQ ID NO: 901154 - protein, 466 aa, Homo sapiens
MSGSIAQIVPSFSDWLSLPESNSGKQPRGLLLPPGCAGPKPALISWLERNTDDWEPAALDPQEYPRGLTVQRKSRTRKKNGEKEVFPPKEAPRKGKRGRRPSKPRLIPRQTSGGPICPDCGCTFPDHQALESHKCAQNLKKPYPCPDCGRRFSYPSLLVSHRRAHSGECPYVCDQCGKRFSQRKNLSQHQVIHTGEKPYHCPDCGRCFRRSRSLANHRTTHTGEKPHQCPSCGRRFAYPSLLAIHQRTHTGEKPYTCLECNRRFRQRTALVIHQRIHTGEKPYPCPDCERRFSSSSRLVSHRRVHSGERPYACEHCEARFSQRSTLLQHQLLHTGEKPYPCPDCGRAFRRSGSLAIHRSTHTEEKLHACDDCGRRFAYPSLLASHRRVHSGERPYACDLCSKRFAQWSHLAQHQLLHTGEKPFPCLECGRCFRQRWSLAVHKCSPKAPNCSPRSAIGGSSQRGNAH

SEQ ID NO: 901155 - protein, 249 aa, Homo sapiens [sequence omitted]

SEQ ID NO: 901156 - protein, 412 aa, Homo sapiens
SYERSTSNGSVQSFGWARESRTRKKNGEKEVFPPKEAPRKGKRGRRPSKPRLIPRQTSGGPICPDCGCTFPDHQALESHKCAQNLKKPYPCPDCGRRFSYPSLLVSHRRAHSGECPYVCDQCGKRFSQRKNLSQHQVIHTGEKPYHCPDCGRCFRRSRSLANHRTTHTGEKPHQCPSCGRRFAYPSLLAIHQRTHTGEKPYTCLECNRRFRQRTALVIHQRIHTGEKPYPCPDCERRFSSSSRLVSHRRVHSGERPYACEHCEARFSQRSTLLQHQLLHTGEKPYPCPDCGRAFRRSGSLAIHRSTHTEEKLHACDDCGRRFAYPSLLASHRRVHSGERPYACDLCSKRFAQWSHLAQHQLLHTGEKPFPCLECGRCFRQRWSLAVHKCSPKAPNCSPRSAIGGSSQRGNAH

SEQ ID NO: 901157 - protein, 500 aa, Homo sapiens; identical to SEQ ID NO: 901153

SEQ ID NO: 901158 - protein, 500 aa, Homo sapiens; identical to SEQ ID NO: 901153

SEQ ID NO: 901159 - protein, 484 aa, Homo sapiens
MQLLASFKRTAFASTQSERSIFGSRPMNARIGEGKKDGVKPNRSAITLEGKEGCAGPKPALISWLERNTDDWEPAALDPQEYPRGLTVQRKSRTRKKNGEKEVFPPKEAPRKGKRGRRPSKPRLIPRQTSGGPICPDCGCTFPDHQALESHKCAQNLKKPYPCPDCGRRFSYPSLLVSHRRAHSGECPYVCDQCGKRFSQRKNLSQHQVIHTGEKPYHCPDCGRCFRRSRSLANHRTTHTGEKPHQCPSCGRRFAYPSLLAIHQRTHTGEKPYTCLECNRRFRQRTALVIHQRIHTGEKPYPCPDCERRFSSSSRLVSHRRVHSGERPYACEHCEARFSQRSTLLQHQLLHTGEKPYPCPDCGRAFRRSGSLAIHRSTHTEEKLHACDDCGRRFAYPSLLASHRRVHSGERPYACDLCSKRFAQWSHLAQHQLLHTGEKPFPCLECGRCFRQRWSLAVHKCSPKAPNCSPRSAIGGSSQRGNAH

SEQ ID NO: 901160 - protein, 167 aa, Homo sapiens
RLVELGVNGRPYACEHCEARFSQRSTLLQHQLLHTGEKPYPCPDCGRAFRRSGSLAIHRSTHTEEKLHACDDCGRRFAYPSLLASHRRVHSGERPYACDLCSKRFAQWSHLAQHQLLHTGEKPFPCLECGRCFRQRWSLAVHKCSPKAPNCSPRSAIGGSSQRGNAH

SEQ ID NO: 901161 - protein, 135 aa, Homo sapiens
EEWGCLRPAQRALYRDVMRETYGHLGALGEAGPIRCRGARRDAGAGEGVGREATVLAGDQVVRGGGQGLSRRCRRGDTTRRDLGAGLLICSLSPGCAGPKPALISWLERNTDDWEPAALDPQEYPRGLTVQRSEC

SEQ ID NO: 901162 - protein, 574 aa, Homo sapiens
MWTFLGIATFTYFYKKFGDFITLANREVLLCVLVFLSLGLVLSYRCRHRNGGLLGRQQSGSQFALFSDILSGLPFIGFFWAKSPPESENKEQLEARRRRKGTNISETSLIGTAACTSTSSQNDPEVIIVGAGVLGSALAAVLSRDGRKVTVIERDLKEPDRIVGEFLQPGGYHVLKDLGLGDTVEGLDAQVVNGYMIHDQESKSEVQIPYPLSENNQVQSGRAFHHGRFIMSLRKAAMAEPNAKFIEGVVLQLLEEDDVVMGVQYKDKETGDIKELHAPLTVVADGLFSKFRKSLVSNKVSVSSHFVGFLMKNAPQFKANHAELILANPSPVLIYQISSSETRVLVDIRGEMPRNLREYMVEKIYPQIPDHLKEPFLEATDNSHLRSMPASFLPPSSVKKRGVLLLGDAYNMRHPLTGGGMTVAFKDIKLWRKLLKGIPDLYDDAAIFEAKKSFYWARKTSHSFVVNILAQALYELFSATDDSLHQLRKACFLYFKLGGECVAGPVGLLSVLSPNPLVLIGHFFAVAIYAVYFCFKSEPWITKPRALLSSGAVLYKACSVIFPLIYSEMKYMVH

SEQ ID NO: 901163 - protein, 574 aa, Homo sapiens; identical to SEQ ID NO: 901162

SEQ ID NO: 901164 - protein, 467 aa, Homo sapiens [sequence omitted]

SEQ ID NO: 901165 - protein, 556 aa, Homo sapiens
MWTFLGIATFTYFYKKFGDFITLANREVLLCVLVFLSLGLVLSYRCRHRNGGLLGRQQSGSQFALFSDILSGLPFIGFFWAKSPPESENKEQLEARRRRKGTNISETSLIGTAACTSTSSQNDPEVIIVGAGVLGSALAAVLSRDGRKVTVIERDLKEPDRIVGEFLQPGGYHVLKDLGLGDTVEGLDAQVVNGYMIHDQESKSEVQIPYPLSENNQVQSGRAFHHGRFIMSLRKAAMAEPNAKFIEGVVLQLLEEDDVVMGVQYKDKETGDIKELHAPLTVVADGLFSKFRKSLVSNKVSVSSHFVGFLMKNAPQFKANHAELILANPSPVLIYQISSSETRVLVDIRGEMPRNLREYMVEKIYPQIPDHLKEPFLEATDNSHLRSMPASFLPPSSVKKRGVLLLGDAYNMRHPLTGGGMTVAFKDIKLWRKLLKGIPDLYDDAAIFEAKKSFYWARKTSHSFVVNILAQALYELFSATDDSLHQLSGLLSVLSPNPLVLIGHFFAVAIYAVYFCFKSEPWITKPRALLSSGAVLYKACSVIFPLIYSEMKYMVH

SEQ ID NO: 901166 - protein, 516 aa, Homo sapiens
MLEFHFEGEEQPLSMMKKFLKSSWVRIGFVPEEERNVLRRRKGTNISETSLIGTAACTSTSSQNDPEVIIVGAGVLGSALAAVLSRDGRKVTVIERDLKEPDRIVGEFLQPGGYHVLKDLGLGDTVEGLDAQVVNGYMIHDQESKSEVQIPYPLSENNQVQSGRAFHHGRFIMSLRKAAMAEPNAKFIEGVVLQLLEEDDVVMGVQYKDKETGDIKELHAPLTVVADGLFSKFRKSLVSNKVSVSSHFVGFLMKNAPQFKANHAELILANPSPVLIYQISSSETRVLVDIRGEMPRNLREYMVEKIYPQIPDHLKEPFLEATDNSHLRSMPASFLPPSSVKKRGVLLLGDAYNMRHPLTGGGMTVAFKDIKLWRKLLKGIPDLYDDAAIFEAKKSFYWARKTSHSFVVNILAQALYELFSATDDSLHQLRKACFLYFKLGGECVAGPVGLLSVLSPNPLVLIGHFFAVAIYAVYFCFKSEPWITKPRALLSSGAVLYKACSVIFPLIYSEMKYMVH

SEQ ID NO: 901167 - protein, 528 aa, Homo sapiens
MWTFLGIATFTYFYKKFGDFITLANREVLLCVLVFLSLGLVLSYRCRHRNGGLLGRQQSGSQFALFSDILSGLPFIGFFWAKSPPESENKEQLEARRRRKGTNISETSLIGTAACTSTSSQNDPEVIIVGAGVLGSALAAVLSRDGRKVTVIERDLKEPDRIVGEFLQPGGYHVLKDLGLGDTVEGLDAQVVNGYMIHDQESKSEVQIPYPLSENNQVQSGRAFHHGRFIMSLRKAAMAEPNAKFIEGVVLQLLEEDDVVMGVQYKDKETGDIKELHAPLTVVADGLFSKFRKSLVSNKVSVSSHFVGFLMKNAPQFKANHAELILANPSPVLIYQISSSETRVLVDIRGEMPRNLREYMVEKIYPQIPDHLKEPFLEATDNSHLRSMPASFLPPSSVKKRGVLLLGDAYNMRHPLTGGGMTVAFKDIKLWRKLLKGIPDLYDDAAIFEAKKSFYWARKTSHSFVVNILAQALYELFSATDDSLHQLRKACFLYFKLGGECVAGPVGLLSVLSPNPLVLIGSYLRGML

SEQ ID NO: 901168 - protein, 223 aa, Homo sapiens [sequence omitted]

SEQ ID NO: 901169 - protein, 574 aa, Homo sapiens; identical to SEQ ID NO: 901162

SEQ ID NO: 901170 - protein, 574 aa, Homo sapiens; identical to SEQ ID NO: 901162

SEQ ID NO: 901171 - protein, 297 aa, Homo sapiens
MWTFLGIATFTYFYKKFGDFITLANREVLLCVLVFLSLGLVLSYRCRHRNGGLLGRQQSGSQFALFSDILSGLPFIGFFWAKSPPESENKEQLEARRRRKGTNISETSLIGTAACTSTSSQNDPEVIIVGAGVLGSALAAVLSRDGRKVTVIERDLKEPDRIVGEFLQPGGYHVLKDLGLGDTVEGLDAQVVNGYMIHDQESKSEVQIPYPLSENNQVQSGRAFHHGRFIMSLRKAAMAEPNAKFIEGVVLQLLEEDDVVMGVQYKDKETGDIKSPSSGKAWSPIKFLYHLILLAFL

SEQ ID NO: 901172 - protein, 454 aa, Homo sapiens
MWTFLGIATFTYFYKKFGDFITLANREVLLCVLVFLSLGLVLSYRCRHRNGGLLGRQQSGSQFALFSDILSGLPFIGFFWAKSPPESENKEQLEARRRRKGTNISETSLIGTAACTSTSSQNDPEVIIVGAGVLGSALAAVLSRDGRKVTVIERDLKEPDRIVGEFLQPGGYHVLKDLGLGDTVEGLDAQVVNGYMIHDQESKSEVQIPYPLSENNQVQSGRAFHHGRFIMSLRKAAMAEPNAKFIEGVVLQLLEEDDVVMGVQYKDKETGDIKELHAPLTVVADGLFSKFRKSLVSNKVSVSSHFVGFLMKNAPQFKANHAELILANPSPVLIYQISSSETRVLVDIRGEMPRNLREYMVEKIYPQIPDHLKEPFLEATDNSHLRSMPASFLPPSSVKKRGVLLLGDAYNMRHPLTGGGMTVAFKDIKLWRKLLKGIPDLYDDAAIFEIPCIN

SEQ ID NO: 901173 - protein, 502 aa, Homo sapiens
MPTSFISFHIIMKPLYYFIITSRRKRRKGTNISETSLIGTAACTSTSSQNDPEVIIVGAGVLGSALAAVLSRDGRKVTVIERDLKEPDRIVGEFLQPGGYHVLKDLGLGDTVEGLDAQVVNGYMIHDQESKSEVQIPYPLSENNQVQSGRAFHHGRFIMSLRKAAMAEPNAKFIEGVVLQLLEEDDVVMGVQYKDKETGDIKELHAPLTVVADGLFSKFRKSLVSNKVSVSSHFVGFLMKNAPQFKANHAELILANPSPVLIYQISSSETRVLVDIRGEMPRNLREYMVEKIYPQIPDHLKEPFLEATDNSHLRSMPASFLPPSSVKKRGVLLLGDAYNMRHPLTGGGMTVAFKDIKLWRKLLKGIPDLYDDAAIFEAKKSFYWARKTSHSFVVNILAQALYELFSATDDSLHQLRKACFLYFKLGGECVAGPVGLLSVLSPNPLVLIGHFFAVAIYAVYFCFKSEPWITKPRALLSSGAVLYKACSVIFPLIYSEMKYMVH

SEQ ID NO: 901174 - protein, 467 aa, Homo sapiens [sequence omitted]

SEQ ID NO: 901175 - protein, 116 aa, Homo sapiens [sequence omitted]

SEQ ID NO: 901176 - protein, 66 aa, Homo sapiens
GRVVSTHASEEIPGPWLLGAMRFRFCGDLDCPDWVLAEISTLAKMSSVKLRLLCSQGTKGAAGTGD

SEQ ID NO: 901177 - protein, 77 aa, Homo sapiens
PEAVSPSHVIVDSADPAGPEKEIPGPWLLGAMRFRFCGDLDCPDWVLAEISTLAKMSSVKLRLLCSQGTKGAAGTGD

SEQ ID NO: 901178 - protein, 77 aa, Homo sapiens; identical to SEQ ID NO: 901177

SEQ ID NO: 901179 - protein, 74 aa, Homo sapiens
AAAYYYCSEFKLLTMYGDMSLSADKNGPPGRTEAGPDPDELPGLRRRVFQACVEPPCPYGVTPSELLFGRQPWF

SEQ ID NO: 901180 - protein, 77 aa, Homo sapiens; identical to SEQ ID NO: 901177

SEQ ID NO: 901181 - protein, 86 aa, Homo sapiens
HSGRSEAWAAGAGMRGRQVAPETGGGCTGLSANTVCAGVRARFRFCGDLDCPDWVLAEISTLAKMSSVKLRLLCSQGTKGAAGTGD

SEQ ID NO: 901182 - protein, 208 aa, Homo sapiens
PEAVSPSHVIVDSADPAGPEKEIPGPWLLGAMRFRFCGDLDCPDWVLAEISTLAKMYEKILKLTADAKFESGDVKATVAVLSFILSSAAKHSVDGESLSSELQQLGLPKEHAASLCRCYEEKQSPLQKHLRVCSLRMNRLAGVGWRVDYTLSSSLLQSVEEPMVHLRLEVAAAPGTPAQPVAMSLSADKFQVLLAELKQAQTLMSSLG

SEQ ID NO: 901183 - protein, 122 aa, Homo sapiens
PEAVSPSHVIVDSADPAGPEKEIPGPWLLGAMRFRFCGDLDCPDWVLAEISTLAKMVECTGSSLGGGGVLGVGIVGVEDGEVSLGLGPQCSQPVLPCFVTLISGWPALSQSPGRRGEVCQPG

SEQ ID NO: 901184 - protein, 143 aa, Homo sapiens
MGPSESGDVKATVAVLSFILSSAAKHSVDGESLSSELQQLGLPKEHAASLCRCYEEKQSPLQKHLRVCSLRMNRLAGVGWRVDYTLSSSLLQSVEEPMVHLRLEVAAAPGTPAQPVAMSLSADKFQVLLAELKQAQTLMSSLG

SEQ ID NO: 901185 - protein, 177 aa, Homo sapiens
MASAKSQLICRQTLKELLCQPNDYEKILQLTADAKLETESGDVKATVAVLSFILSSAAKHSVDGESLSSELQQLGLPKEHAASLCRCYEEKQSPLQKHLRVCSLRMNRLAGVGWRVDYTLSSSLLQSVEEPMVHLRLEVAAAPGTPAQPVAMSLSADKFQVLLAELKQAQTLMSSLG

SEQ ID NO: 901186 - protein, 110 aa, Homo sapiens
MLLQSYSILPPEHAASLCRCYEEKQSPLQKHLRVCSLRMNRLAGVGWRVDYTLSSSLLQSVEEPMVHLRLEVAAAPGTPAQPVAMSLSADKFQVLLAELKQAQTLMSSLG

SEQ ID NO: 901187 - protein, 106 aa, Homo sapiens
VYPPGCRIRHELLGAMRFRFCGDLDCPDWVLAEISTLAKMVECTGSSLGGGGVLGVGIVGVEDGEVSLGLGPQCSQPVLPCFVTLISGWPALSQSPGRRGEVCQPG

SEQ ID NO: 901188 - protein, 106 aa, Homo sapiens; identical to SEQ ID NO: 901187

SEQ ID NO: 901189 - protein, 122 aa, Homo sapiens; identical to SEQ ID NO: 901183

SEQ ID NO: 901190 - protein, 122 aa, Homo sapiens; identical to SEQ ID NO: 901183

SEQ ID NO: 901191 - protein, 77 aa, Homo sapiens; identical to SEQ ID NO: 901177

SEQ ID NO: 901192 - protein, 82 aa, Homo sapiens
DMATGWAGVPGAAATSSRRCTMGSSTDCSRLELRCSRPVWSRPARMESRPLNCSSGGSPGSRMLRPWPGLWPPRSPAASLLS

SEQ ID NO: 901193 - protein, 106 aa, Homo sapiens; identical to SEQ ID NO: 901187

SEQ ID NO: 901194 - protein, 77 aa, Homo sapiens; identical to SEQ ID NO: 901177

SEQ ID NO: 901195 - protein, 77 aa, Homo sapiens; identical to SEQ ID NO: 901177

SEQ ID NO: 901196 - protein, 66 aa, Homo sapiens; identical to SEQ ID NO: 901176

SEQ ID NO: 901197 - protein, 92 aa, Homo sapiens
MTRSAAPRSRCYSTPHTPVVRCDIQKVLSTCPSDYLSLVDRDTHHILWVVGVRNNSKCMERPQPPHTRANSYRSSLGEEEIKTNILYDDASS

SEQ ID NO: 901198 - protein, 106 aa, Homo sapiens; identical to SEQ ID NO: 901187

SEQ ID NO: 901199 - protein, 219 aa, Homo sapiens
PEAVSPSHVIVDSADPAGPEKEIPGPWLLGAMRFRFCGDLDCPDWVLAEISTLAKMSSVKLRLLCSQYEKILKLTADAKFESGDVKATVAVLSFILSSAAKHSVDGESLSSELQQLGLPKEHAASLCRCYEEKQSPLQKHLRVCSLRMNRLAGVGWRVDYTLSSSLLQSVEEPMVHLRLEVAAAPGTPAQPVAMSLSADKFQVLLAELKQAQTLMSSLG

SEQ ID NO: 901200 - protein, 122 aa, Homo sapiens; identical to SEQ ID NO: 901183

SEQ ID NO: 901201 - protein, 106 aa, Homo sapiens; identical to SEQ ID NO: 901187

SEQ ID NO: 901202 - protein, 122 aa, Homo sapiens; identical to SEQ ID NO: 901183

SEQ ID NO: 901203 - protein, 122 aa, Homo sapiens; identical to SEQ ID NO: 901183

SEQ ID NO: 901204 - protein, 77 aa, Homo sapiens; identical to SEQ ID NO: 901177

SEQ ID NO: 901205 - protein, 122 aa, Homo sapiens; identical to SEQ ID NO: 901183

SEQ ID NO: 901206 - protein, 144 aa, Homo sapiens
MRGRQVAPETGGGCTGLSANTVCAGVRAVSLVGKSPPLSRSRDGGGGTGRVRQSRPAGLESRCFPGGRKGPCLPGQELGLVWSWESFQVFPIPKRTSQGYPLPQPCRGACTRRCLESGSLFHTVRKPLRSFQSQKVVVLGLRLI

SEQ ID NO: 901207 - protein, 462 aa, Homo sapiens
MFLATLYFALPLLDLLLSAEVSGGDRLDCVKASDQCLKEQSCSTKYRTLRQCVAGKETNFSLASGLEAKDECRSAMEALKQKSLYNCRCKRGMKKEKNCLRIYWSMYQSLQGNDLLEDSPYEPVNSRLSDIFRVVPFISDAVEHIPKGNNCLDAAKACNLDDICKKYRSAYITPCTTSVSNDVCNRRKCHKALRQFFDKVPAKHSYGMLFCSCRDIACTERRRQTIVPVCSYEEREKPNCLNLQDSCKTNYICRSRLADFFTNCQPESRSVSSCLKENYADCLLAYSGLIGTVMTPNYIDSSSLSVAPWCDCSNSGNDLEECLKFLNFFKDNTCLKNAIQAFGNGSDVTVWQPAFPVQTTTATTTTALRVKNKPLGPAGSENEIPTHVLPPCANLQAQKLKSNVSGNTHLCISNGNYEKEGLGASSHITTKSMAAPPSCGLSPLLVLVVTALSTLLSLTETS

SEQ ID NO: 901208 - protein, 462 aa, Homo sapiens; identical to SEQ ID NO: 901207

SEQ ID NO: 901209 - protein, 462 aa, Homo sapiens; identical to SEQ ID NO: 901207

SEQ ID NO: 901210 - protein, 305 aa, Homo sapiens
MTNQYGILFKQEQAHDDAIWSVAWGTNKKENSETVVTGSLDDLVKVWKWRDERLDLQWSLEGHQLGVVSVDISHTLPIAASSSLDAHIRLWDLENGKQIKSIDAGPVDAWTLAFSPDSQYLATGTHVGKVNIFGVESGKKEYSLDTRGKFILSIAYSPDGKYLASGAIDGIINIFDIATGKLLHTLEGHAMPIRSLTFSPDSQLLVTASDDGYIKIYDVQHANLAGTLSGHASWVLNVAFCPDDTHFVSSSSDKSVKVWDVGTRTCVHTFFDHQDQVWGVKYNGNGSKIVSVGDDQEIHIYDCPI

SEQ ID NO: 901211 - protein, 305 aa, Homo sapiens; identical to SEQ ID NO: 901210

SEQ ID NO: 901212 - protein, 305 aa, Homo sapiens; identical to SEQ ID NO: 901210

SEQ ID NO: 901213 - protein, 305 aa, Homo sapiens; identical to SEQ ID NO: 901210

SEQ ID NO: 901214 - protein, 292 aa, Homo sapiens [sequence omitted]

SEQ ID NO: 901215 - protein, 305 aa, Homo sapiens [sequence omitted]

SEQ ID NO: 901216 - protein, 115 aa, Homo sapiens [sequence omitted]

SEQ ID NO: 901217 - protein, 189 aa, Homo sapiens
MTNQYGILFKQEQAHDDAIWSVAWGTNKKENSETVVTGSLDDLVKVWKWRDERLDLQWSLEGHQLGVVSVDISHTLPIAASSSLDAHIRLWDLENGKQIKSIDAGPVDAWTLAFSPDSQYLATGTHVGKVNIFGVESGKKEYSLDTRGKFILSIAYSPDGKYLASGAIDGIINIFDIATGKLLHTLEGG

SEQ ID NO: 901218 - protein, 305 aa, Homo sapiens; identical to SEQ ID NO: 901210

SEQ ID NO: 901219 - protein, 305 aa, Homo sapiens; identical to SEQ ID NO: 901210

SEQ ID NO: 901220 - protein, 305 aa, Homo sapiens; identical to SEQ ID NO: 901210

SEQ ID NO: 901221 - protein, 305 aa, Homo sapiens
MTNQYGILFKQERAHDDAIWSVAWGTNKKENSETVVTGSLDDLVKVWKWRDERLDLQWSLEGHQLGVVSVDISHTLPIAASSSLDAHIRLWDLENGKQIKSIDAGPVDAWTLAFSPDSQYLATGTHVGKVNIFGVESGKKEYSLDTRGKFILSIAYSPDGKYLASGAIDGIINIFDIATGKLLHTLEGHAMPIRSLTFSPDSQLLVTASDDGYIKIYDVQHANLAGTLSGHASWVLNVAFCPDDTHFVSSSSDKSVKVWDVGTRTCVHTFFDHQDQVWGVKYNGNGSKIVSVGDDQEIHIYDCPI

SEQ ID NO: 901222 - protein, 222 aa, Homo sapiens
MMVVIARMRHLSIILLMIDKKHNSPVDLTCFSPDSQYLATGTHVGKVNIFGVESGKKEYSLDTRGKFILSIAYSPDGKYLASGAIDGIINIFDIATGKLLHTLEGHAMPIRSLTFSPDSQLLVTASDDGYIKIYDVQHANLAGTLSGHASWVLNVAFCPDDTHFVSSSSDKSVKVWDVGTRTCVHTFFDHQDQVWGVKYNGNGSKIVSVGDDQEIHIYDCPI

SEQ ID NO: 901223 - protein, 122 aa, Homo sapiens
MWIPFLRIMQITRNLVETQIIRSMRLMLGTQLLYKFERPQYAEILADHPDAPMSQVYGAPHLLRLFVRIGAMLAYTPLDEKSLALLLNYLHDFLKYLAKNSATLFSASDYEVAPPEYHRKAV

SEQ ID NO: 901224 - protein, 175 aa, Homo sapiens
ARKQDPKPKFQEGERVLCFHGPLLYEAKCVKVAIKDKQVKYFIHYSGWNKNWDEWVPESRVLKYVDTNLQKQRELQKANQEQYAEGKMRGAAPGKKTSGLQQKNVEVKTKKNKHLLRLFVRIGAMLAYTPLDEKSLALLLNYLHDFLKYLAKNSATLFSASDYEVAPPEYHRKAV

SEQ ID NO: 901225 - protein, 738 aa, Homo sapiens
MDLRRRDYHMERPLLNQEHLEELGRWGSAPRTHQWRTWLQCSRARAYALLLQHLPVLVWLPRYPVRDWLLGDLLSGLSVAIMQLPQGLAYALLAGLPPVFGLYSSFYPVFIYFLFGTSRHISVGTFAVMSVMVGSVTESLAPQALNDSMINETARDAARVQVASTLSVLVGLFQVGLGLIHFGFVVTYLSEPLVRGYTTAAAVQVFVSQLKYVFGLHLSSHSGPLSLIYTVLEVCWKLPQSKVGTVVTAAVAGVVLVVVKLLNDKLQQQLPMPIPGELLTLIGATGISYGMGLKHRFEVDVVGNIPAGLVPPVAPNTQLFSKLVGSAFTIAVVGFAIAISLGKIFALRHGYRVDSNQELVALGLSNLIGGIFQCFPVSCSMSRSLVQESTGGNSQVAGAISSLFILLIIVKLGELFHDLPKAVLAAIIIVNLKGMLRQLSDMRSLWKANRADLLIWLVTFTATILLNLDLGLVVAVIFSLLLVVVRTQMPHYSVLGQVPDTDIYRDVAEYSEAKEVRGVKVFRSSATVYFANAEFYSDALKQRCGVDVDFLISQKKKLLKKQEQLKLKQLQKEEKLRKQAASPKGASVSINVNTSLEDMRSNNVEDCKMMQVSSGDKMEDATANGQEDSKAPDGSTLKALGLPQPDFHSLILDLGALSFVDTVCLKSLKNIFHDFREIEVEVYMAACHSPVVSQLEAGHFFDASITKKHLFASVHDAVTFALQHPRPVPDSPVSVTRL

SEQ ID NO: 901226 - protein, 759 aa, Homo sapiens
MGLADASGPRDTQALLSATQAMDLRRRDYHMERPLLNQEHLEELGRWGSAPRTHQWRTWLQCSRARAYALLLQHLPVLVWLPRYPVRDWLLGDLLSGLSVAIMQLPQGLAYALLAGLPPVFGLYSSFYPVFIYFLFGTSRHISVGTFAVMSVMVGSVTESLAPQALNDSMINETARDAARVQVASTLSVLVGLFQVGLGLIHFGFVVTYLSEPLVRGYTTAAAVQVFVSQLKYVFGLHLSSHSGPLSLIYTVLEVCWKLPQSKVGTVVTAAVAGVVLVVVKLLNDKLQQQLPMPIPGELLTLIGATGISYGMGLKHRFEVDVVGNIPAGLVPPVAPNTQLFSKLVGSAFTIAVVGFAIAISLGKIFALRHGYRVDSNQELVALGLSNLIGGIFQCFPVSCSMSRSLVQESTGGNSQVAGAISSLFILLIIVKLGELFHDLPKAVLAAIIIVNLKGMLRQLSDMRSLWKANRADLLIWLVTFTATILLNLDLGLVVAVIFSLLLVVVRTQMPHYSVLGQVPDTDIYRDVAEYSEAKEVRGVKVFRSSATVYFANAEFYSDALKQRCGVDVDFLISQKKKLLKKQEQLKLKQLQKEEKLRKQAASPKGASVSINVNTSLEDMRSNNVEDCKMMQVSSGDKMEDATANGQEDSKAPDGSTLKALGLPQPDFHSLILDLGALSFVDTVCLKSLKNIFHDFREIEVEVYMAACHSPVVSQLEAGHFFDASITKKHLFASVHDAVTFALQHPRPVPDSPVSVTRL

SEQ ID NO: 901227 - protein, 749 aa, Homo sapiens
MGLADASGPRDTQALLSATQAMDLRRRDYHMERPLLNQEHLEELGRWGSAPRTHQWRTWLQCSRARAYALLLQHLPVLVWLPRYPVRDWLLGDLLSGLSVAIMQLPQGLAYALLAGLPPVFGLYSSFYPVFIYFLFGTSRHISVGTFAVMSVMVGSVTESLAPQALNDSMINETARDAARVQVASTLSVLVGLFQVGLGLIHFGFVVTYLSEPLVRGYTTAAAVQVFVSQLKYVFGLHLSSHSGPLSLIYTVLEVCWKLPQSKVGTVVTAAVAGVVLVVVKLLNDKLQQQLPMPIPGELLTLIGATGISYGMGLKHRFEAGAPSGPQHPAVLKARGQRLHHRCGWVCHCHLTGEIFALRHGYRVDSNQELVALGLSNLIGGIFQCFPVSCSMSRSLVQESTGGNSQVAGAISSLFILLIIVKLGELFHDLPKAVLAAIIIVNLKGMLRQLSDMRSLWKANRADLLIWLVTFTATILLNLDLGLVVAVIFSLLLVVVRTQMPHYSVLGQVPDTDIYRDVAEYSEAKEVRGVKVFRSSATVYFANAEFYSDALKQRCGVDVDFLISQKKKLLKKQEQLKLKQLQKEEKLRKQAASPKGASVSINVNTSLEDMRSNNVEDCKMMQVSSGDKMEDATANGQEDSKAPDGSTLKALGLPQPDFHSLILDLGALSFVDTVCLKSLKNIFHDFREIEVEVYMAACHSPVVSQLEAGHFFDASITKKHLFASVHDAVTFALQHPRPVPDSPVSVTRL

SEQ ID NO: 901228 - protein, 738 aa, Homo sapiens
MGLADASGPRDTQALLSATQAMDLRRRDYHMERPLLNQEHLEELGRWGSAPRTHQWRTWLQCSRARAYALLLQHLPVLVWLPRYPVRDWLLGDLLSGLSVAIMQLPQGLAYALLAGLPPVFGLYSSFYPVFIYFLFGTSRHISVGTFAVMSVMVGSVTESLAPQALNDSMINETARDAARVQVASTLSVLVGLFQVGLGLIHFGFVVTYLSEPLVRGYTTAAAVQVFVSQLKYVFGLHLSSHSGPLSLIYTVLEVCWKLPQSKVGTVVTAAVAGVVLVVVKLLNDKLQQQLPMPIPGELLTLIGATGISYGMGLKHRFEVDVVGNIPAGLVPPVAPNTQLFSKLVGSAFTIAVVGFAIAISLGKIFALRHGYRVDSNQELVALGLSNLIGGIFQCFPVSCSMSRSLVQESTGGNSQVAGAISSLFILLIIVKLGELFHDLPKAVLAAIIIVNLKGMLRQLSDMRSLWKANRADLLIWLVTFTATILLNLDLGLVVAVIFSLLLVVVRTQMPHYSVLGQVPDTDIYRDVAEYSEAKEVRGVKVFRSSATVYFANAEFYSDALKQRCGVDVDFLISQKKKLAASPKGASVSINVNTSLEDMRSNNVEDCKMMQVSSGDKMEDATANGQEDSKAPDGSTLKALGLPQPDFHSLILDLGALSFVDTVCLKSLKNIFHDFREIEVEVYMAACHSPVVSQLEAGHFFDASITKKHLFASVHDAVTFALQHPRPVPDSPVSVTRL

SEQ ID NO: 901229 - protein, 358 aa, Homo sapiens
MSRSLVQESTGGNSQVAGAISSLFILLIIVKLGELFHDLPKAVLAAIIIVNLKGMLRQLSDMRSLWKANRADLLIWLVTFTATILLNLDLGLVVAVIFSLLLVVVRTQMPHYSVLGQVPDTDIYRDVAEYSEAKEVRGVKVFRSSATVYFANAEFYSDALKQRCGVDVDFLISQKKKLLKKQEQLKLKQLQKEEKLRKQAASPKGASVSINVNTSLEDMRSNNVEDCKMMQVSSGDKMEDATANGQEDSKAPDGSTLKALGLPQPDFHSLILDLGALSFVDTVCLKSLKNIFHDFREIEVEVYMAACHSPVVSQLEAGHFFDASITKKHLFASVHDAVTFALQHPRPVPDSPVSVTRL

SEQ ID NO: 901230 - protein, 778 aa, Homo sapiens
MGLADASGPRDTQALLSATQAMDLRRRDYHMERPLLNQEHLEELGRWGSAPRTHQWRTWLQCSRARAYALLLQHLPVLVWLPRYPVRDWLLGDLLSGLSVAIMQLPQGLAYALLAGLPPVFGLYSSFYPVFIYFLFGTSRHISVGTFAVMSVMVGSVTESLAPQALNDSMINETARDAARVQVASTLSVLVGLFQVGLGLIHFGFVVTYLSEPLVRGYTTAAAVQVFVSQLKYVFGLHLSSHSGPLSLIYTVLEVCWKLPQSKVGTVVTAAVAGVVLVVVKLLNDKLQQQLPMPIPGELLTLIGATGISYGMGLKHRFEVDVVGNIPAGLVPPVAPNTQLFSKLVGSAFTIAVVGFAIAISLGKIFALRHGYRVDSNQELVALGLSNLIGGIFQCFPVSCSMSRSLVQESTGGNSQVAGAISSLFILLIIVKLGELFHDLPKAVLAAIIIVNLKGMLRQLSDMRSLWKANRADLLIWLVTFTATILLNLDLGLVVAVIFSLLLVVVRTQMPHYSVLGQVPDTDIYRDVAEYSEAKEVRGVKVFRSSATVYFANAEFYSDALKQRCGVDVDFLISQKKKLLKKQEQLKLKQLQKEEKLRKQAASPKGASVSINVNTSLEDMRSNNVEDCKMMQVSSGDKMEDATANGQEDSKAPDGSTLKALGLPQPDFHSLILDLGALSFVDTVCLKSLKNIFHDFREIEVEVYMAACHSPVVSQLEAGHFFDASITKKHLFASLHVHTHNSGKEVLGLQVQRSRSGTGPACSQAGSGAVQGGNWCIF

SEQ ID NO: 901231 - protein, 673 aa, Homo sapiens
MGLADASGPRDTQALLSATQAMDLRRRDYHMERPLLNQEHLEELGRWGSAPRTHQWRTWLQCSRARAYALLLQHLPVLVWLPRYPVRDWLLGDLLSGLSVAIMQLPQGLAYALLAGLPPVFGLYSSFYPVFIYFLFGTSRHISVGTFAVMSVMVGSVTESLAPQALNDSMINETARDAARVQVASTLSVLVGLFQVGLGLIHFGFVVTYLSEPLVRGYTTAAAVQVFVSQLKYVFGLHLSSHSGPLSLIYTVLEVCWKLPQSKVGTVVTAAVAGVVLVVVKLLNDKLQQQLPMPIPGELLTLIGATGISYGMGLKHRFEVDVVGNIPAGLVPPVAPNTQLFSKLVGSAFTIAVVGFAIAISLGKIFALRHGYRVDSNQELVALGLSNLIGGIFQCFPVSCSMSRSLVQESTGGNSQVAGAISSLFILLIIVKLGELFHDLPKAVLAAIIIVNLKGMLRQLSDMRSLWKANRADLLIWLVTFTATILLNLDLGLVVAVIFSLLLVVVRTQMPHYSVLGQVPDTDIYRDVAEYSEAKEVRGVKVFRSSATVYFANAEFYSDALKQRCGVDVDFLISQKKKLLKKQEQLKLKQLQKEEKLRKQAASPKGASVSINVNTSLEDMRSNNVEDCKMMVRLEVGKEVTAVSCRDAGSTCLMRNAMDPAAVGSRVLRRWQE

SEQ ID NO: 901232 - protein, 106 aa, Homo sapiens
TREGKAGEQDAARREEIQPPPVLPHPQAKEVRGVKVFRSSATVYFANAEFYSDALKQRVRRSPQDGCQAPAPRELTNPSLMFASSVVWMSTSSSPRRRNCSRSRSS

SEQ ID NO: 901233 - protein, 166 aa, Homo sapiens
MCPMHAPHLTLRVLACLCAASPAFTLSWVALAACLAPQQVSSGDKMEDATANGQEDSKAPDGSTLKALGLPQPDFHSLILDLGALSFVDTVCLKSLKNIFHDFREIEVEVYMAACHSPVVSQLEAGHFFDASITKKHLFASVHDAVTFALQHPRPVPDSPVSVTRL

SEQ ID NO: 901234 - protein, 735 aa, Homo sapiens
MGLADASGPRDTQALLSATQAMDLRRRDYHMERPLLNQEHLEELGRWGSAPRTHQWRTWLQCSRARAYALLLQHLPVLVWLPRYPVRDWLLGDLLSGLSVAIMQLPQGLAYALLAGLPPVFGLYSSFYPVFIYFLFGTSRHISVGTFAVMSVMVGSVTESLAPQALNDSMINETARDAARVQVASTLSVLVGLFQVGLGLIHFGFVVTYLSEPLVRGYTTAAAVQVFVSQLKYVFGLHLSSHSGPLSLIYTVLEVCWKLPQSKVGTVVTAAVAGVVLVVVKLLNDKLQQQLPMPIPGELLTLIGATGISYGMGLKHRFEVDVVGNIPAGLVPPVAPNTQLFSKLVGSAFTIAVVGFAIAISLGKIFALRHGYRVDSNQELVALGLSNLIGGIFQCFPVSCSMSRSLVQESTGGNSQVAGAISSLFILLIIVKLGELFHDLPKAVLAAIIIVNLKGMLRQLSDMRSLWKANRADLLIWLVTFTATILLNLDLGLVVAVIFSLLLVVVRTQMPHYSVLGQVPDTDIYRDVAEYSEAKEVRGVKVFRSSATVYFANAEFYSDALKQRCGVDVDFLISQKKKLLKKQEQLKLKQLQKEEKLRKQAGPLLSEQVSSGDKMEDATANGQEDSKAPDGSTLKALGLPQPDFHSLILDLGALSFVDTVCLKSLKNIFHDFREIEVEVYMAACHSPVVSQLEAGHFFDASITKKHLFASVHDAVTFALQHPRPVPDSPVSVTRL

SEQ ID NO: 901235 - protein, 802 aa, Homo sapiens
MGLADASGPRDTQALLSATQAMDLRRRDYHMERPLLNQEHLEELGRWGSAPRTHQWRTWLQCSRARAYALLLQHLPVLVWLPRYPVRDWLLGDLLSGLSVAIMQLPQGLAYALLAGLPPVFGLYSSFYPVFIYFLFGTSRHISVGTFAVMSVMVGSVTESLAPQALNDSMINETARDAARVQVASTLSVLVGLFQVGLGLIHFGFVVTYLSEPLVRGYTTAAAVQVFVSQLKYVFGLHLSSHSGPLSLIYTVLEVCWKLPQSKVGTVVTAAVAGVVLVVVKLLNDKLQQQLPMPIPGELLTLIGATGISYGMGLKHRFEAGAPSGPQHPAVLKARGQRLHHRCGWVCHCHLTGEIFALRHGYRVDSNQELVALGLSNLIGGIFQCFPVSCSMSRSLVQESTGGNSQVAGAISSLFILLIIVKLGELFHDLPKAVLAAIIIVNLKGMLRQLSDMRSLWKANRADLLIWLVTFTATILLNLDLGLVVAVIFSLLLVVVRTQMESAMLVPSFQLVREYHRAPRSFPHISGDFRLLRTPLLSPFSAPSSCILSLLHRPHYSVLGQVPDTDIYRDVAEYSEAKEVRGVKVFRSSATVYFANAEFYSDALKQRCGVDVDFLISQKKKLLKKQEQLKLKQLQKEEKLRKQAASPKGASVSINVNTSLEDMRSNNVEDCKMMQVSSGDKMEDATANGQEDSKAPDGSTLKALGLPQPDFHSLILDLGALSFVDTVCLKSLKNIFHDFREIEVEVYMAACHSPVVSQLEAGHFFDASITKKHLFASVHDAVTFALQHPRPVPDSPVSVTRL

SEQ ID NO: 901236 - protein, 330 aa, Homo sapiens
EVSWGTPSMTLPKAVLAAIIIVNLKGMLRQLSDMRSLWKANRADLLIWLVTFTATILLNLDLGLVVAVIFSLLLVVVRTQMPHYSVLGQVPDTDIYRDVAEYSEAKEVRGVKVFRSSATVYFANAEFYSDALKQRCGVDVDFLISQKKKLLKKQEQLKLKQLQKEEKLRKQAASPKGASVSINVNTSLEDMRSNNVEDCKMMQVSSGDKMEDATANGQEDSKAPDGSTLKALGLPQPDFHSLILDLGALSFVDTVCLKSLKNIFHDFREIEVEVYMAACHSPVVSQLEAGHFFDASITKKHLFASVHDAVTFALQHPRPVPDSPVSVTRL

SEQ ID NO: 901237 - protein, 764 aa, Homo sapiens
MGLADASGPRDTQALLSATQAMDLRRRDYHMERPLLNQEHLEELGRWGSAPRTHQWRTWLQCSRARAYALLLQHLPVLVWLPRYPVRDWLLGDLLSGLSVAIMQLPQGLAYALLAGLPPVFGLYSSFYPVFIYFLFGTSRHISVGTFAVMSVMVGSVTESLAPQALNDSMINETARDAARVQVASTLSVLVGLFQVGLGLIHFGFVVTYLSEPLVRGYTTAAAVQVFVSQLKYVFGLHLSSHSGPLSLIYTVLEVCWKLPQSKVGTVVTAAVAGVVLVVVKLLNDKLQQQLPMPIPGELLTLIGATGISYGMGLKHRFEVDVVGNIPAGLVPPVAPNTQLFSKLVGSAFTIAVVGFAIAISLGKIFALRHGYRVDSNQELVALGLSNLIGGIFQCFPVSCSMSRSLVQESTGGNSQVAGAISSLFILLIIVKLGELFHDLPKAVLAAIIIVNLKGMLRQLSDMRSLWKANRADLLIWLVTFTATILLNLDLGLVVAVIFSLLLVVVRTQMPHYSVLGQVPDTDIYRDVAEYSEAKEVRGVKVFRSSATVYFANAEFYSDALKQRCGVDVDFLISQKKKLLKKQEQLKLKQLQKEEKLRKQAASPKGASVSINVNTSLEDMRSNNVEDCKMMQVSSGDKMEDATANGQEDSKAPDGSTLKALGLPQPDFHSLILDLGALSFVDTVCLKSLKNIFHDFREIEVEVYMAACHSPVVSQLEAGHFFDASITKKHLFASVHDAVTFALQHPRPVMAAGLAVCHSLSSLV

SEQ ID NO: 901238 - protein, 166 aa, Homo sapiens
MGLADASGPRDTQALLSATQAMDLRRRDYHMERPLLNQEHLEELGRWGSAPRTHQWRTWLQCSRARAYALLLQHLPVLVWLPRYPVRDWLLGDLLSGLSVAIMQLPQGLAYALLAGLPPVFGLYSSFYPVFIYFLFGTSRHISVGHQTLNMLHPAQDCTSGGAGHP

SEQ ID NO: 901239 - protein, 146 aa, Homo sapiens
MSPSSECCCCHSSWLLWAMISQGQVNLGLKGIPLHGPQESLIGDTCRALTTRPELAFSPLGQAHGVEMVPPAEVIAPVLGWPLCPPCLRYALTCWAHKALSTYQEGGHSLARHLFAFHSWVSVHPSREAGLREAGRPVPPALAFLQ

SEQ ID NO: 901240 - protein, 335 aa, Homo sapiens [sequence omitted]

SEQ ID NO: 901241 - protein, 259 aa, Homo sapiens
MALNQFSDMSFAEIKHKYLWSEPQNCSATKSNYLRGTGPYPPSVDWRKKGNFVSPVKNQGACGSCWTFSTTGALESAIAIATGKMLSLAEQQLVDCAQDFNNHGCQGGLPSQAFEYILYNKGIMGEDTYPYQGKDGYCKFQPGKAIGFVKDVANITIYDEEAMVEAVALYNPVSFAFEVTQDFMMYRTGIYSSTSCHKTPDKVNHAVLAVGYGEKNGIPYWIVKNSWGPQWGMNGYFLIERGKNMCGLAACASYPIPLV

SEQ ID NO: 901242 - protein, 259 aa, Homo sapiens; identical to SEQ ID NO: 901241

SEQ ID NO: 901243 - protein, 251 aa, Homo sapiens
MSFAEIKHKYLWSEPQNCSATKSNYLRGTGPYPPSVDWRKKGNFVSPVKNQGACGSCWTFSTTGALESAIAIATGKMLSLAEQQLVDCAQDFNNHGCQGGLPSQAFEYILYNKGIMGEDTYPYQGKDGYCKFQPGKAIGFVKDVANITIYDEEAMVEAVALYNPVSFAFEVTQDFMMYRTGIYSSTSCHKTPDKVNHAVLAVGYGEKNGIPYWIVKNSWGPQWGMNGYFLIERGKNMCGLAACASYPIPLV

SEQ ID NO: 901244 - protein, 320 aa, Homo sapiens
MWATLPLLCAGAWLLGVPVCGAAELSVNSLEKFHFKSWMSKHRKTYSTEEYHHRLQTFASNWRKINAHNNGNHTFKMALNQFSDMSFAEIKHKYLWSEPQNCSATKSNYLRGTGPYPPSVDWRKKGNFVSPVKNQESAIAIATGKMLSLAEQQLVDCAQDFNNHGCQGGLPSQAFEYILYNKGIMGEDTYPYQGKDGYCKFQPGKAIGFVKDVANITIYDEEAMVEAVALYNPVSFAFEVTQDFMMYRTGIYSSTSCHKTPDKVNHAVLAVGYGEKNGIPYWIVKNSWGPQWGMNGYFLIERGKNMCGLAACASYPIPLV

SEQ ID NO: 901245 - protein, 372 aa, Homo sapiens
RSRRSSTLVPPPPRSQLTLWAATSADPERKSQAASAAMWATLPLLCAGAWLLGVPVCGAAELSVNSLEKFHFKSWMSKHRKTYSTEEYHHRLQTFASNWRKINAHNNGNHTFKMALNQFSDMSFAEIKHKYLWSEPQNCSATKSNYLRGTGPYPPSVDWRKKGNFVSPVKNQGACGSCWTFSTTGALESAIAIATGKMLSLAEQQLVDCAQDFNNHGCQGGLPSQAFEYILYNKGIMGEDTYPYQGKDGYCKFQPGKAIGFVKDVANITIYDEEAMVEAVALYNPVSFAFEVTQDFMMYRTGIYSSTSCHKTPDKVNHAVLAVGYGEKNGIPYWIVKNSWGPQWGMNGYFLIERGKNMCGLAACASYPIPLV

SEQ ID NO: 901246 - protein, 372 aa, Homo sapiens; identical to SEQ ID NO: 901245

SEQ ID NO: 901247 - protein, 293 aa, Homo sapiens
SQTRPHTIQSEHEPRQDLSLPEGTRLAPPPVSGQGGAIPGDMNASPVISSSPLRSEAQGQASLSGSVSSSGTRQEDDLPWRCPWATAHRAQEPQPATWASTPFPARDDGSIALGFMVFLEEQMSWSFTDCAQDFNNHGCQGGLPSQAFEYILYNKGIMGEDTYPYQGKDGYCKFQPGKAIGFVKDVANITIYDEEAMVEAVALYNPVSFAFEVTQDFMMYRTGIYSSTSCHKTPDKVNHAVLAVGYGEKNGIPYWIVKNSWGPQWGMNGYFLIERGKNMCGLAACASYPIPLV

SEQ ID NO: 901248 - protein, 372 aa, Homo sapiens; identical to SEQ ID NO: 901245

SEQ ID NO: 901249 - protein, 176 aa, Homo sapiens
MALNQFSDMSFAEIKHKYLWSEPQNCSATKSNYLRGTGPYPPSVDWRKKGNFVSPVKNQGACGSCWTFSTTGALYDEEAMVEAVALYNPVSFAFEVTQDFMMYRTGIYSSTSCHKTPDKVNHAVLAVGYGEKNGIPYWIVKNSWGPQWGMNGYFLIERGKNMCGLAACASYPIPLV

SEQ ID NO: 901250 - protein, 308 aa, Homo sapiens
RSRRSSTLVPPPPRSQLTLWAATSADPERKSQAASAAMWATLPLLCAGAWLLGVPVCGAAELSVNSLEKFHFKSWMSKHRKTYSTEEYHHRLQTFASNWRKINAHNNGNHTFKMALNQFSDMSFAEIKHKYLWSEPQNCSATKSNYLRGTGPYPPSVDWRKKGNFVSPVKNQGACGSCWTFSTTGALESAIAIATGKMLSLAEQQLVDCAQDFNNHGCQGGLPSQAFEYILYNKGIMGEDTYPYQGKDGYCKFQPGKAIGFVKDVANITIVSADPPLGWGMCPDEEASLMLSDSQWAQQGSPSGSTSL

SEQ ID NO: 901251 - protein, 270 aa, Homo sapiens
RSRRSSTLVPPPPRSQLTLWAATSADPERKSQAASAAMWATLPLLCAGAWLLGVPVCGAAELSVNSLEKFHFKSWMSKHRKTYSTEEYHHRLQTFASNWRKINAHNNGNHTFKMALNQFSDMSFAEIKHKYLWSEPQNCSATKSNYLRGTGPYPPSVDWRKKGNFVSPVKNQGACGSCWTFSTTGALESAIAIATGKMLSLAEQQLVDCAQDFNNHGCQGGLPSQAFEYILYNKGIMGEDTYPYQGKDGYCKFQPGKAIGFVKDVANITI

SEQ ID NO: 901252 - protein, 314 aa, Homo sapiens
SQTRPHTIQSEHEPRQDLSLPEGTRLAPPPVSGQGGAIPGDMNASPVISSSPLRSEAQGQASLSGSVSSSGTRQEDDLPWRCPWATAHRAQEPQPATWASTPFPARDDGSIALGFMVFLEEQMSWSFTDCAQDFNNHGCQGGLPSQAFEYILYNKGIMGEDTYPYQGKDGYCKFQPGKAIGFVKDVANITIYDEEAMVEAVALYNPVSFAFEVTQDFMMYRTGIYSSTSCHKTPDKVNHAVLAVGYGDPLGPPTFCPHLCAQPGNLQTRRSSTMSSPVSMTQRSPAMCLSVLLNRLKPHGPRIFFLSRRATFHI

SEQ ID NO: 901253 - protein, 207 aa, Homo sapiens
PPLSGQPQVGSPVCTSCRGLPSQAFEYILYNKGIMGEDTYPYQGKVTPTASTLSSWRTACLASLPPQPWKTSLLPPPPSRRNSHNCLFSPNSSFPSSTHLSPLLYQSRGLFIILTPYPLCGTISFLPEPDFSGPLLPPTCPIFLAPLPPATSAILSPLSMQLASCAKDPLGAHPHPYPIKAAGPPTITSAQPGHSQVPCLSPRPVAP

SEQ ID NO: 901254 - protein, 372 aa, Homo sapiens; identical to SEQ ID NO: 901245

SEQ ID NO: 901255 - protein, 410 aa, Homo sapiens
RSRRSSTLVPPPPRSQLTLWAATSADPERKSQAASAAMWATLPLLCAGAWLLGVPVCGAAELSVNSLGTQRARRPERVLAGPRVDAGENLARAHWAPEERGRAFPEKFHFKSWMSKHRKTYSTEEYHHRLQTFASNWRKINAHNNGNHTFKMALNQFSDMSFAEIKHKYLWSEPQNCSATKSNYLRGTGPYPPSVDWRKKGNFVSPVKNQGACGSCWTFSTTGALESAIAIATGKMLSLAEQQLVDCAQDFNNHGCQGGLPSQAFEYILYNKGIMGEDTYPYQGKDGYCKFQPGKAIGFVKDVANITIYDEEAMVEAVALYNPVSFAFEVTQDFMMYRTGIYSSTSCHKTPDKVNHAVLAVGYGEKNGIPYWIVKNSWGPQWGMNGYFLIERGKNMCGLAACASYPIPLV

SEQ ID NO: 901256 - protein, 297 aa, Homo sapiens
MSKHRKTYSTEEYHHRLQTFASNWRKINAHNNGNHTFKMALNQFSDMSFAEIKHKYLWSEPQNCSATKSNYLRGTGPYPPSVDWRKKGNFVSPVKNQGACGSCWTFSTTGALESAIAIATGKMLSLAEQQLVDCAQDFNNHGCQGGLPSQAFEYILYNKGIMGEDTYPYQGKDGYCKFQPGKAIGFVKDVANITIYDEEAMVEAVALYNPVSFAFEVTQDFMMYRTGIYSSTSCHKTPDKVNHAVLAVGYGEKNGIPYWIVKNSWGPQWGMNGYFLIERGKNMCGLAACASYPIPLV

SEQ ID NO: 901257 - protein, 372 aa, Homo sapiens; identical to SEQ ID NO: 901245

SEQ ID NO: 901258 - protein, 372 aa, Homo sapiens; identical to SEQ ID NO: 901245

SEQ ID NO: 901259 - protein, 372 aa, Homo sapiens; identical to SEQ ID NO: 901245

SEQ ID NO: 901260 - protein, 372 aa, Homo sapiens; identical to SEQ ID NO: 901245

SEQ ID NO: 901261 - protein, 416 aa, Homo sapiens
RSRRSSTLVPPPPRSQLTLWAATSADPERKSQAASAAMWATLPLLCAGAWLLGVPVCGAAELSVNSLEKFHFKSWMSKHRKTYSTEEYHHRLQTFASNWRKINAHNNGNHTFKMALNQFSDMSFAEIKHKYLWSEPQNCSATKSNYLRGTGPYPPSVDWRKKGNFVSPVKNQGACGSCWTFSTTGALESAIAIATGKMLSLAEQQLVDCAQDFNNHGCQGGLPSQAFEYILYNKGIMGEDTYPYQGKDGYCKFQPGKAIGFVKDVANITIYDEEAMVEAVALYNPVSFAFEVTQDFMMYRTGIYSSTSCHKTPDKVNHAVLAVGYGEKNGIPYWIVKNSWGPQWGMNGYFLIERGKNMGSLGLGGNPALEEVVGRSTGTPNILPSPLCPAWKPTDKEEFHHELTRVYDAKITSHVP

SEQ ID NO: 901262 - protein, 273 aa, Homo sapiens
SQTRPHTIQSEHEPRQDLSLPEGTRLAPPPVSGQGGAIPGDMNASPVISSSPLRSEAQGQASLSGSVSSSGTRQEDDLPWRCPWATAHRAQEPQPATWASTPFPARDDGSIALGFMVFLEEQMSWSFTDCAQDFNNHGCQGGLPSQGKDGYCKFQPGKAIGFVKDVANITIYDEEAMVEAVALYNPVSFAFEVTQDFMMYRTGIYSSTSCHKTPDKVNHAVLAVGYGEKNGIPYWIVKNSWGPQWGMNGYFLIERGKNMCGLAACASYPIPLV

SEQ ID NO: 901263 - protein, 109 aa, Homo sapiens
MWATLPLLCAGAWLLGVPVCGAAELSVNSLEKFHFKSWMSKHRKTYSTEEYHHRLQTFASNWRKINAHNNGNHTFKMALNQFSDMSFAEIKHKYLWSEPQVGIIHCNQI

SEQ ID NO: 901264 - protein, 117 aa, Homo sapiens
MTLWAATSADPERKSQAASAAMWATLPLLCAGAWLLGVPVCGAAELSVNSLGTQRARRPERVLAGPRVDAGRTWPGRTGLRRNGAELSPVRGQELCVLARGGVNCIIGGGSRRVGGL

SEQ ID NO: 901265 - protein, 856 aa, Homo sapiens
MALVLGSLLLLGLCGNSFSGGQPSSTDAPKAWNYELPATNYETQDSHKAGPIGILFELVHIFLYVVQPRDFPEDTLRKFLQKAYESKIDYDKIVYYEAGIILCCVLGLLFIILMPLVGYFFCMCRCCNKCGGEMHQRQKENGPFLRKCFAISLLVICIIISIGIFYGFVANHQVRTRIKRSRKLADSNFKDLRTLLNETPEQIKYILAQYNTTKDKAFTDLNSINSVLGGGILDRLRPNIIPVLDEIKSMATAIKETKEALENMNSTLKSLHQQSTQLSSSLTSVKTSLRSSLNDPLCLVHPSSETCNSIRLSLSQLNSNPELRQLPPVDAELDNVNNVLRTDLDGLVQQGYQSLNDIPDRVQRQTTTVVAGIKRVLNSIGSDIDNVTQRLPIQDILSAFSVYVNNTESYIHRNLPTLEEYDSYWWLGGLVICSLLTLIVIFYYLGLLCGVCGYDRHATPTTRGCVSNTGGVFLMVGVGLSFLFCWILMIIVVLTFVFGANVEKLICEPYTSKELFRVLDTPYLLNEDWEYYLSGKLFNKSKMKLTFEQVYSDCKKNRGTYGTLHLQNSFNISEHLNINEHTGSISSELESLKVNLNIFLLGAAGRKNLQDFAACGIDRMNYDSYLAQTGKSPAGVNLLSFAYDLEAKANSLPPGNLRNSLKRDAQTIKTIHQQRVLPIEQSLSTLYQSVKILQRTGNGLLERVTRILASLDFAQNFITNNTSSVIIEETKKYGRTIIGYFEHYLQWIEFSISEKVASCKPVATALDTAVDVFLCSYIIDPLNLFWFGIGKATVFLLPALIFAVKLAKYYRRMDSEDVYDDVETIPMKNMENGNNGYHKDHVYGIHNPVMTSPSQH

SEQ ID NO: 901266 - protein, 865 aa, Homo sapiens
MALVLGSLLLLGLCGNSFSGGQPSSTDAPKAWNYELPATNYETQDSHKAGPIGILFELVHIFLYVVQPRDFPEDTLRKFLQKAYESKIDYDKPETVILGLKIVYYEAGIILCCVLGLLFIILMPLVGYFFCMCRCCNKCGGEMHQRQKENGPFLRKCFAISLLVICIIISIGIFYGFVANHQVRTRIKRSRKLADSNFKDLRTLLNETPEQIKYILAQYNTTKDKAFTDLNSINSVLGGGILDRLRPNIIPVLDEIKSMATAIKETKEALENMNSTLKSLHQQSTQLSSSLTSVKTSLRSSLNDPLCLVHPSSETCNSIRLSLSQLNSNPELRQLPPVDAELDNVNNVLRTDLDGLVQQGYQSLNDIPDRVQRQTTTVVAGIKRVLNSIGSDIDNVTQRLPIQDILSAFSVYVNNTESYIHRNLPTLEEYDSYWWLGGLVICSLLTLIVIFYYLGLLCGVCGYDRHATPTTRGCVSNTGGVFLMVGVGLSFLFCWILMIIVVLTFVFGANVEKLICEPYTSKELFRVLDTPYLLNEDWEYYLSGKLFNKSKMKLTFEQVYSDCKKNRGTYGTLHLQNSFNISEHLNINEHTGSISSELESLKVNLNIFLLGAAGRKNLQDFAACGIDRMNYDSYLAQTGKSPAGVNLLSFAYDLEAKANSLPPGNLRNSLKRDAQTIKTIHQQRVLPIEQSLSTLYQSVKILQRTGNGLLERVTRILASLDFAQNFITNNTSSVIIEETKKYGRTIIGYFEHYLQWIEFSISEKVASCKPVATALDTAVDVFLCSYIIDPLNLFWFGIGKATVFLLPALIFAVKLAKYYRRMDSEDVYDDVETIPMKNMENGNNGYHKDHVYGIHNPVMTSPSQH

SEQ ID NO: 901267 - protein, 856 aa, Homo sapiens; identical to SEQ ID NO: 901265

SEQ ID NO: 901268 - protein, 72 aa, Homo sapiens
PPCMSSPNLMCLMQHCSEARWILQVQRGCDPPEVTVGQGVPELKLPTFQMEFTSLPLAYTFLVVKAIITESL

SEQ ID NO: 901269 - protein, 128 aa, Homo sapiens
PLSRLLRNIFPCVEQTNCSERDAERVRSTHLLPPDYILLWLPYRGVYVIGRRLDELAGRVIGKATVFLLPALIFAVKLAKYYRRMDSEDVYDDVETIPMKNMENGNNGYHKDHVYGIHNPVMTSPSQH

SEQ ID NO: 901270 - protein, 804 aa, Homo sapiens
MALVLGSLLLLGLCGNSFSGGQPSSTDAPKAWNYELPATNYETQDSHKAGPIGILFELVHIFLYVVQPRDFPEDTLRKFLQKAYESKIDYDKIVYYEAGIILCCVLGLLFIILMPLVGYFFCMCRCCNKCGGEMHQRQKENGPFLRKCFAISLLVICIIISIGIFYGFVANHQVRTRIKRSRKLADSNFKDLRTLLNETPEQIKYILAQYNTTKDKAFTDLNSINSVLGGGILDRLRPNIIPVLDEIKSMATAIKETKEALENMNSTLKSLHQQSTQLSSSLTSVKTSLRSSLNDPLCLVHPSSETCNSIRLSLSQLNSNPELRQLPPVDAELDNVNNVLRTDLDGLVQQGYQSLNDIPDRVQRQTTTVVAGIKRVLNSIGSDIDNVTQRLPIQDILSAFSVYVNNTESYIHRNLPTLEEYDSYWWLGGLVICSLLTLIVIFYYLGLLCGVCGYDRHATPTTRGCVSNTGGVFLMVGVGLSFLFCWILMIIVVLTFVFGANVEKLICEPYTSKELFRVLDTPYLLNEDWEYYLSGKLFNKSKMKLTFEQVYSDCKKNRGTYGTLHLQNSFNISEHLNINEHTGSISSELESLKVNLNIFLLGAAGRKNLQDFAACGIDRMNYDSYLAQTGKSPAGVNLLSFAYDLEAKANSLPPGNLRNSLKRDAQTIKTIHQQRVLPIEQSLSTLYQSVKILQRTGNGLLERVTRILASLDFAQNFITNNTSSVIIEETKKYGRTIIGYFEHYLQWIEFSEVSERTLMCRTKTSGASHQVRGQPPPGPLCSPLPYAVLPFASHPLFQVTKGPG

SEQ ID NO: 901271 - protein, 136 aa, Homo sapiens
MLFWLAYHPHIPTPHHRILFSFLPSNSWLPRCQLCSLCLQFKGAPWKKCNNSLTCDWYLTATTPGQQWLTVDKDNFFLSPKPNSLHQLPSQDSLSGPYRCRSGWQLPNLGKRKYPIMATYLHLQLLPVHPQSLLFV

SEQ ID NO: 901272 - protein, 136 aa, Homo sapiens; identical to SEQ ID NO: 901271

SEQ ID NO: 901273 - protein, 136 aa, Homo sapiens; identical to SEQ ID NO: 901271

SEQ ID NO: 901274 - protein, 136 aa, Homo sapiens; identical to SEQ ID NO: 901271

SEQ ID NO: 901275 - protein, 136 aa, Homo sapiens; identical to SEQ ID NO: 901271

SEQ ID NO: 901276 - protein, 136 aa, Homo sapiens; identical to SEQ ID NO: 901271

SEQ ID NO: 901277 - protein, 815 aa, Homo sapiens
MYEGKHIHFSEVDNKPLCSYSPKLCKQRRLNGYAFCIRHVLEDKTAPFKQCEYVAKYNSQRCTNPIPKSEDRRYCNSHLQVLGFIPKKERKKKNDPIDEVKVRHQMDTMAFSLTVPTLALKMPNGLDGMSLSPPGARVPLHYLETELEDPFAFNEEDDDLKKGATVRKKLQSKLAQNRQRQRETEILKVRQEHFSPPPAPSQQQPPQQHSHLSPLSTSLKPPAPPQGSVCKSPQPQNTSLPMQGVAPTTHTIAQARQLSHKRPLPLLPSSRAPTVDPPRTDRILMKATAFSPHFSCISRLQRLVKLCTQKHQLDTDLFPHLGLDWSEESGEEPEDSEQASPYQVAWSIRETLRYQRHASDDDDAESRSSRVTQLCTYFQQKYKHLCRLERAESRQKKCRHTFRKALLQAASKEPECTGQLIQELRRAACSRTSISRTKLREVEPAACSGTVKGEQCANKALPFTRHCFQHILLNHSQQLFSSCTAKFADGQQCSVPVFDITHQTPLCEEHAKKMDNFLRGDNSRKVQHQQQRKPRKKTKPPALTKKHKKKRRRGPRRPQKPIPPAVPQGNLSMPASVSLPVEASHIRSPSTPELSADELPDDIANEITDIPHDLELNQEDFSDVLPRLPDDLQDFDFFEGKNGDLLPTTEEAEELERALQAVTSLECLSTIGVLAQSDGVPVQELSDRGIGVFSTGTGASGIQSLSREVNTDLGELLNGRIVHDNFSSLELDENLLRSATLSNPPTPLAGQIQGQFSAPANVGLTSATLISQSALGERAFPGQFHGLHDGSHASQRPHPAQLLSKADDPNHLIDS

SEQ ID NO: 901278 - protein, 455 aa, Homo sapiens [sequence omitted]

SEQ ID NO: 901279 - protein, 1027 aa, Homo sapiens
MYEGKHIHFSEVDNKPLCSYSPKLCKQRRLNGYAFCIRHVLEDKTAPFKQCEYVAKYNSQRCTNPIPKSEDRRYCNSHLQVLGFIPKKERKKKNDPIDEVKVRHQMDTMAFSLTVPTLALKMPNGLDGMSLSPPGARVPLHYLETELEDPFAFNEEDDDLKKGATVRKKLQSKLAQNRQRQRETEILKVRQEHFSPPPAPSQQQPPQQHSHLSPLSTSLKPPAPPQGSVCKSPQPQNTSLPMQGVAPTTHTIAQARQLSHKRPLPLLPSSRAPTVDPPRTDRILMKATAFSPHFSCISRLQRLVKLCTQKHQLDTDLFPHLGLDWSEESGEEPEDSEQASPYQVAWSIRETLRYQRHASDDDDAESRSSRVTQLCTYFQQKYKHLCRLERAESRQKKCRHTFRKALLQAASKEPECTGQLIQELRRAACSRTSISRTKLREVEPAACSGTVKGEQCANKALPFTRHCFQHILLNHSQQLFSSCTAKFADGQQCSVPVFDITHQTPLCEEHAKKMDNFLRGDNSRKVQHQQQRKPRKKTKPPALTKKHKKKRRRGPRRPQKPIPPAVPQGNLSMPASVSLPVEASHIRSPSTPELSADELPDDIANEITDIPHDLELNQEDFSDVLPRLPDDLQDFDFFEGKNGDLLPTTEEAEELERALQAVTSLECLSTIGVLAQSDGVPVQELSDRGIGVFSTGTGASGIQSLSREVNTDLGELLNGRIVHDNFSSLELDENLLRSATLSNPPTPLAGQIQGQFSAPANVGLTSATLISQSALGERAFPGQFHGLHDGSHASQRPHPAQLLSKADDLITSRQQYSSDHSHSSPHGSHYDSEHVPSPYSDHITSPHTTSYSGDNMAATFSAEMPIMAQHLLPTQLEVPLGGVVNPRTHWGNLPVNLGDPSPFSNLLGADGHLLSTSLSTPPTTSNSETTQPAFATVTPSSSSVLPGLPQTSFSGMGPSAELMASTSPKQQLPQFSAAFGHQLSSHSGIPKDLQPSHSSIAPPTGFTVTGATATSTNNASSPFPSPN

SEQ ID NO: 901280 - protein, 2466 aa, Homo sapiens
MHVSLAEALEVRGGPLQEEEIWAVLNQSAESLQELFRKVSLADPAALGFIISPWSLLLLPSGSVSFTDENISNQDLRAFTAPEVLQNQSLTSLSDVEKIHIYSLGMTLYWGADYEVPQSQPIKLGDHLNSILLGMCEDVIYARVSVRTVLDACSAHIRNSNCAPSFSYVKHLVKLVLGNLSGTDQLSCNSEQKPDRSQAIRDRLRGKGLPTGRSSTSDVLDIQKPPLSHQTFLNKGLSKSMGFLSIKDTQDENYFKDILSDNSGREDSENTFSPYQFKTSGPEKKPIPGIDVLSKKKIWASSMDLLCTADRDFSSGETATYRRCHPEAVTVRTSTTPRKKEARYSDGSIALDIFGPQKMDPIYHTRELPTSSAISSALDRIRERQKKLQVLREAMNVEEPVRRYKTYHGDVFSTSSESPSIISSESDFRQVRRSEASKRFESSSGLPGVDETLSQGQSQRPSRQYETPFEGNLINQEIMLKRQEEELMQLQAKMALRQSRLSLYPGDTIKASMLDITRDPLREIALETAMTQRKLRNFFGPEFVKMTIEPFISLDLPRSILTKKGKNEDNRRKVNIMLLNGQRLELTCDTKTICKDVFDMVVAHIGLVEHHLFALATLKDNEYFFVDPDLKLTKVAPEGWKEEPKKKTKATVNFTLFFRIKFFMDDVSLIQHTLTCHQYYLQLRKDILEERMHCDDETSLLLASLALQAEYGDYQPEVHGVSYFRMEHYLPARVMEKLDLSYIKEELPKLHNTYVGASEKETELEFLKVCQRLTEYGVHFHRVHPEKKSQTGILLGVCSKGVLVFEVHNGVRTLVLRFPWRETKKISFSKKKITLQNTSDGIKHGFQTDNSKICQYLLHLCSYQHKFQLQMRARQSNQDAQDIERASFRSLNLQAESVRGFNMGRAISTGSLASSTLNKLAVRPLSVQAEILKRLSCSELSLYQPLQNSSKEKNDKASWEEKPREMSKSYHDLSQASLYPHRKNVIVNMEPPPQTVAELVGKPSHQMSRSDAESLAGVTKLNNSKSVASLNRSPERRKHESDSSSIEDPGQAYVLDVLHKRWSIVSSPEREITLVNLKKDAKYGLGFQIIGGEKMGRLDLGIFISSVAPGGPADLDGCLKPGDRLISVNSVSLEGVSHHAAIEILQNAPEDVTLVISQPKEKISKVPSTPVHLTNEMKNYMKKSSYMQDSAIDSSSKDHHWSRGTLRHISENSFGPSGGLREGSLSSQDSRTESASLSQSQVNGFFASHLGDQTWQESQHGSPSPSVISKATEKETFTDSNQSKTKKPGISDVTDYSDRGDSDMDEATYSSSQDHQTPKQESSSSVNTSNKMNFKTFSSSPPKPGDIFEVELAKNDNSLGISVTGGVNTSVRHGGIYVKAVIPQGAAESDGRIHKGDRVLAVNGVSLEGATHKQAVETLRNTGQVVHLLLEKGQSPTSKEHVPVTPQCTLSDQNAQGQGPEKVKKTTQVKDYSFVTEENTFEVKLFKNSSGLGFSFSREDNLIPEQINASIVRVKKLFPGQPAAESGKIDVGDVILKVNGASLKGLSQQEVISALRGTAPEVFLLLCRPPPGVLPEIDTALLTPLQSPAQVLPNSSKDSSQPSCVEQSTSSDENEMSDKSKKQCKSPSRRDSYSDSSGSGEDDLVTAPANISNSTWSSALHQTLSNMVSQAQSHHEAPKSQEDTICTMFYYPQKIPNKPEFEDSNPSPLPPDMAPGQSYQPQSESASSSSMDKYHIHHISEPTRQENWTPLKNDLENHLEDFELEVELLITLIKSEKGSLGFTVTKGNQRIGCYVHDVIQDPAKSDGRLKPGDRLIKVNDTDVTNMTHTDAVNLLRAASKTVRLVIGRVLELPRIPMLPHLLPDITLTCNKEELGFSLCGGHDSLYQVVYISDINPRSVAAIEGNLQLLDVIHYVNGVSTQGMTLEEVNRALDMSLPSLVLKATRNDLPVVPSSKRSAVSAPKSTKGNGSYSVGSCSQPALTPNDSFSTVAGEEINEISYPKGKCSTYQIKGSPNLTLPKESYIQEDDIYDDSQEAEVIQSLLDVVDEEAQNLLNENNAAGYSCGPGTLKMNGKLSEERTEDTDCDGSPLPEYFTEATKMNGCEEYCEEKVKSESLIQKPQEKKTDDDEITWGNDELPIERTNHEDSDKDHSFLTNDELAVLPVVKVLPSGKYTGANLKSVIRVLRGLLDQGIPSKELENLQELKPLDQCLIGQTKENRRKNRYKNILPYDATRVPLGDEGGYINASFIKIPVGKEEFVYIACQGPLPTTVGDFWQMIWEQKSTVIAMMTQEVEGEKIKCQRYWPNILGKTTMVSNRLRLALVRMQQLKGFVVRAMTLEDIQTREVRHISHLNFTAWPDHDTPSQPDDLLTFISYMRHIHRSGPIITHCSAGIGRSGTLICIDVVLGLISQDLDFDISDLVRCMRLQRHGMVQTEDQYIFCYQVILYVLTRLQAEEEQKQQPQLLK

SEQ ID NO: 901281 - protein, 2485 aa, Homo sapiens
MHVSLAEALEVRGGPLQEEEIWAVLNQSAESLQELFRKVSLADPAALGFIISPWSLLLLPSGSVSFTDENISNQDLRAFTAPEVLQNQSLTSLSDVEKIHIYSLGMTLYWGADYEVPQSQPIKLGDHLNSILLGMCEDVIYARVSVRTVLDACSAHIRNSNCAPSFSYVKHLVKLVLGNLSGTDQLSCNSEQKPDRSQAIRDRLRGKGLPTGRSSTSDVLDIQKPPLSHQTFLNKGLSKSMGFLSIKDTQDENYFKDILSDNSGREDSENTFSPYQFKTSGPEKKPIPGIDVLSKKKIWASSMDLLCTADRDFSSGETATYRRCHPEAVTVRTSTTPRKKEARYSDGSIALDIFGPQKMDPIYHTRELPTSSAISSALDRIRERQKKLQVLREAMNVEEPVRRYKTYHGDVFSTSSESPSIISSESDFRQVRRSEASKRFESSSGLPGVDETLSQGQSQRPSRQYETPFEGNLINQEIMLKRQEEELMQLQAKMALRQSRLSLYPGDTIKASMLDITRDPLREIALETAMTQRKLRNFFGPEFVKMTIEPFISLDLPRSILTKKGKNEDNRRKVNIMLLNGQRLELTCDTKTICKDVFDMVVAHIGLVEHHLFALATLKDNEYFFVDPDLKLTKVAPEGWKEEPKKKTKATVNFTLFFRIKFFMDDVSLIQHTLTCHQYYLQLRKDILEERMHCDDETSLLLASLALQAEYGDYQPEVHGVSYFRMEHYLPARVMEKLDLSYIKEELPKLHNTYVGASEKETELEFLKVCQRLTEYGVHFHRVHPEKKSQTGILLGVCSKGVLVFEVHNGVRTLVLRFPWRETKKISFSKKKITLQNTSDGIKHGFQTDNSKICQYLLHLCSYQHKFQLQMRARQSNQDAQDIERASFRSLNLQAESVRGFNMGRAISTGSLASSTLNKLAVRPLSVQAEILKRLSCSELSLYQPLQNSSKEKNDKASWEEKPREMSKSYHDLSQASLYPHRKNVIVNMEPPPQTVAELVGKPSHQMSRSDAESLAGVTKLNNSKSVASLNRSPERRKHESDSSSIEDPGQAYVLGMTMHSSGNSSSQVPLKENDVLHKRWSIVSSPEREITLVNLKKDAKYGLGFQIIGGEKMGRLDLGIFISSVAPGGPADLDGCLKPGDRLISVNSVSLEGVSHHAAIEILQNAPEDVTLVISQPKEKISKVPSTPVHLTNEMKNYMKKSSYMQDSAIDSSSKDHHWSRGTLRHISENSFGPSGGLREGSLSSQDSRTESASLSQSQVNGFFASHLGDQTWQESQHGSPSPSVISKATEKETFTDSNQSKTKKPGISDVTDYSDRGDSDMDEATYSSSQDHQTPKQESSSSVNTSNKMNFKTFSSSPPKPGDIFEVELAKNDNSLGISVTGGVNTSVRHGGIYVKAVIPQGAAESDGRIHKGDRVLAVNGVSLEGATHKQAVETLRNTGQVVHLLLEKGQSPTSKEHVPVTPQCTLSDQNAQGQGPEKVKKTTQVKDYSFVTEENTFEVKLFKNSSGLGFSFSREDNLIPEQINASIVRVKKLFPGQPAAESGKIDVGDVILKVNGASLKGLSQQEVISALRGTAPEVFLLLCRPPPGVLPEIDTALLTPLQSPAQVLPNSSKDSSQPSCVEQSTSSDENEMSDKSKKQCKSPSRRDSYSDSSGSGEDDLVTAPANISNSTWSSALHQTLSNMVSQAQSHHEAPKSQEDTICTMFYYPQKIPNKPEFEDSNPSPLPPDMAPGQSYQPQSESASSSSMDKYHIHHISEPTRQENWTPLKNDLENHLEDFELEVELLITLIKSEKGSLGFTVTKGNQRIGCYVHDVIQDPAKSDGRLKPGDRLIKVNDTDVTNMTHTDAVNLLRAASKTVRLVIGRVLELPRIPMLPHLLPDITLTCNKEELGFSLCGGHDSLYQVVYISDINPRSVAAIEGNLQLLDVIHYVNGVSTQGMTLEEVNRALDMSLPSLVLKATRNDLPVVPSSKRSAVSAPKSTKGNGSYSVGSCSQPALTPNDSFSTVAGEEINEISYPKGKCSTYQIKGSPNLTLPKESYIQEDDIYDDSQEAEVIQSLLDVVDEEAQNLLNENNAAGYSCGPGTLKMNGKLSEERTEDTDCDGSPLPEYFTEATKMNGCEEYCEEKVKSESLIQKPQEKKTDDDEITWGNDELPIERTNHEDSDKDHSFLTNDELAVLPVVKVLPSGKYTGANLKSVIRVLRGLLDQGIPSKELENLQELKPLDQCLIGQTKENRRKNRYKNILPYDATRVPLGDEGGYINASFIKIPVGKEEFVYIACQGPLPTTVGDFWQMIWEQKSTVIAMMTQEVEGEKIKCQRYWPNILGKTTMVSNRLRLALVRMQQLKGFVVRAMTLEDIQTREVRHISHLNFTAWPDHDTPSQPDDLLTFISYMRHIHRSGPIITHCSAGIGRSGTLICIDVVLGLISQDLDFDISDLVRCMRLQRHGMVQTEDQYIFCYQVILYVLTRLQAEEEQKQQPQLLK

SEQ ID NO: 901282 - protein, 2294 aa, Homo sapiens
MHVSLAEALEVRGGPLQEEEIWAVLNQSAESLQELFRKVSLADPAALGFIISPWSLLLLPSGSVSFTDENISNQDLRAFTAPEVLQNQSLTSLSDVEKIHIYSLGMTLYWGADYEVPQSQPIKLGDHLNSILLGMCEDVIYARVSVRTVLDACSAHIRNSNCAPSFSYVKHLVKLVLGNLSGTDQLSCNSEQKPDRSQAIRDRLRGKGLPTGRSSTSDVLDIQKPPLSHQTFLNKGLSKSMGFLSIKDTQDENYFKDILSDNSGREDSENTFSPYQFKTSGPEKKPIPGIDVLSKKKIWASSMDLLCTADRDFSSGETATYRRCHPEAVTVRTSTTPRKKEARYSDGSIALDIFGPQKMDPIYHTRELPTSSAISSALDRIRERQKKLQVLREAMNVEEPVRRYKTYHGDVFSTSSESPSIISSESDFRQVRRSEASKRFESSSGLPGVDETLSQGQSQRPSRQYETPFEGNLINQEIMLKRQEEELMQLQAKMALRQSRLSLYPGDTIKASMLDITRDPLREIALETAMTQRKLRNFFGPEFVKMTIEPFISLDLPRSILTKKGKNEDNRRKVNIMLLNGQRLELTCDTKTICKDVFDMVVAHIGLVEHHLFALATLKDNEYFFVDPDLKLTKVAPEGWKEEPKKKTKATVNFTLFFRIKFFMDDVSLIQHTLTCHQYYLQLRKDILEERMHCDDETSLLLASLALQAEYGDYQPEVHGVSYFRMEHYLPARVMEKLDLSYIKEELPKLHNTYVGASEKETELEFLKVCQRLTEYGVHFHRVHPEKKSQTGILLGVCSKGVLVFEVHNGVRTLVLRFPWRETKKISFSKKKITLQNTSDGIKHGFQTDNSKICQYLLHLCSYQHKFQLQMRARQSNQDAQDIDVLHKRWSIVSSPEREITLVNLKKDAKYGLGFQIIGGEKMGRLDLGIFISSVAPGGPADLDGCLKPGDRLISVNSVSLEGVSHHAAIEILQNAPEDVTLVISQPKEKISKVPSTPVHLTNEMKNYMKKSSYMQDSAIDSSSKDHHWSRGTLRHISENSFGPSGGLREGSLSSQDSRTESASLSQSQVNGFFASHLGDQTWQESQHGSPSPSVISKATEKETFTDSNQSKTKKPGISDVTDYSDRGDSDMDEATYSSSQDHQTPKQESSSSVNTSNKMNFKTFSSSPPKPGDIFEVELAKNDNSLGISVTGGVNTSVRHGGIYVKAVIPQGAAESDGRIHKGDRVLAVNGVSLEGATHKQAVETLRNTGQVVHLLLEKGQSPTSKEHVPVTPQCTLSDQNAQGQGPEKVKKTTQVKDYSFVTEENTFEVKLFKNSSGLGFSFSREDNLIPEQINASIVRVKKLFPGQPAAESGKIDVGDVILKVNGASLKGLSQQEVISALRGTAPEVFLLLCRPPPGVLPEIDTALLTPLQSPAQVLPNSSKDSSQPSCVEQSTSSDENEMSDKSKKQCKSPSRRDSYSDSSGSGEDDLVTAPANISNSTWSSALHQTLSNMVSQAQSHHEAPKSQEDTICTMFYYPQKIPNKPEFEDSNPSPLPPDMAPGQSYQPQSESASSSSMDKYHIHHISEPTRQENWTPLKNDLENHLEDFELEVELLITLIKSEKGSLGFTVTKGNQRIGCYVHDVIQDPAKSDGRLKPGDRLIKVNDTDVTNMTHTDAVNLLRAASKTVRLVIGRVLELPRIPMLPHLLPDITLTCNKEELGFSLCGGHDSLYQVVYISDINPRSVAAIEGNLQLLDVIHYVNGVSTQGMTLEEVNRALDMSLPSLVLKATRNDLPVVPSSKRSAVSAPKSTKGNGSYSVGSCSQPALTPNDSFSTVAGEEINEISYPKGKCSTYQIKGSPNLTLPKESYIQEDDIYDDSQEAEVIQSLLDVVDEEAQNLLNENNAAGYSCGPGTLKMNGKLSEERTEDTDCDGSPLPEYFTEATKMNGCEEYCEEKVKSESLIQKPQEKKTDDDEITWGNDELPIERTNHEDSDKDHSFLTNDELAVLPVVKVLPSGKYTGANLKSVIRVLRGLLDQGIPSKELENLQELKPLDQCLIGQTKENRRKNRYKNILPYDATRVPLGDEGGYINASFIKIPVGKEEFVYIACQGPLPTTVGDFWQMIWEQKSTVIAMMTQEVEGEKIKCQRYWPNILGKTTMVSNRLRLALVRMQQLKGFVVRAMTLEDIQTREVRHISHLNFTAWPDHDTPSQPDDLLTFISYMRHIHRSGPIITHCSAGIGRSGTLICIDVVLGLISQDLDFDISDLVRCMRLQRHGMVQTEDQYIFCYQVILYVLTRLQAEEEQKQQPQLLK

SEQ ID NO: 901283 - protein, 2466 aa, Homo sapiens; identical to SEQ ID NO: 901280

SEQ ID NO: 901284 - protein, 2226 aa, Homo sapiens
MGFLSIKDTQDENYFKDILSDNSGREDSENTFSPYQFKTSGPEKKPIPGIDVLSKKKIWASSMDLLCTADRDFSSGETATYRRCHPEAVTVRTSTTPRKKEARYSDGSIALDIFGPQKMDPIYHTRELPTSSAISSALDRIRERQKKLQVLREAMNVEEPVRRYKTYHGDVFSTSSESPSIISSESDFRQVRRSEASKRFESSSGLPGVDETLSQGQSQRPSRQYETPFEGNLINQEIMLKRQEEELMQLQAKMALRQSRLSLYPGDTIKASMLDITRDPLREIALETAMTQRKLRNFFGPEFVKMTIEPFISLDLPRSILTKKGKNEDNRRKVNIMLLNGQRLELTCDTKTICKDVFDMVVAHIGLVEHHLFALATLKDNEYFFVDPDLKLTKVAPEGWKEEPKKKTKATVNFTLFFRIKFFMDDVSLIQHTLTCHQYYLQLRKDILEERMHCDDETSLLLASLALQAEYGDYQPEVHGVSYFRMEHYLPARVMEKLDLSYIKEELPKLHNTYVGASEKETELEFLKVCQRLTEYGVHFHRVHPEKKSQTGILLGVCSKGVLVFEVHNGVRTLVLRFPWRETKKISFSKKKITLQNTSDGIKHGFQTDNSKICQYLLHLCSYQHKFQLQMRARQSNQDAQDIERASFRSLNLQAESVRGFNMGRAISTGSLASSTLNKLAVRPLSVQAEILKRLSCSELSLYQPLQNSSKEKNDKASWEEKPREMSKSYHDLSQASLYPHRKNVIVNMEPPPQTVAELVGKPSHQMSRSDAESLAGVTKLNNSKSVASLNRSPERRKHESDSSSIEDPGQAYVLDVLHKRWSIVSSPEREITLVNLKKDAKYGLGFQIIGGEKMGRLDLGIFISSVAPGGPADLDGCLKPGDRLISVNSVSLEGVSHHAAIEILQNAPEDVTLVISQPKEKISKVPSTPVHLTNEMKNYMKKSSYMQDSAIDSSSKDHHWSRGTLRHISENSFGPSGGLREGSLSSQDSRTESASLSQSQVNGFFASHLGDQTWQESQHGSPSPSVISKATEKETFTDSNQSKTKKPGISDVTDYSDRGDSDMDEATYSSSQDHQTPKQESSSSVNTSNKMNFKTFSSSPPKPGDIFEVELAKNDNSLGISVTGGVNTSVRHGGIYVKAVIPQGAAESDGRIHKGDRVLAVNGVSLEGATHKQAVETLRNTGQVVHLLLEKGQSPTSKEHVPVTPQCTLSDQNAQGQGPEKVKKTTQVKDYSFVTEENTFEVKLFKNSSGLGFSFSREDNLIPEQINASIVRVKKLFPGQPAAESGKIDVGDVILKVNGASLKGLSQQEVISALRGTAPEVFLLLCRPPPGVLPEIDTALLTPLQSPAQVLPNSSKDSSQPSCVEQSTSSDENEMSDKSKKQCKSPSRRDSYSDSSGSGEDDLVTAPANISNSTWSSALHQTLSNMVSQAQSHHEAPKSQEDTICTMFYYPQKIPNKPEFEDSNPSPLPPDMAPGQSYQPQSESASSSSMDKYHIHHISEPTRQENWTPLKNDLENHLEDFELEVELLITLIKSEKGSLGFTVTKGNQRIGCYVHDVIQDPAKSDGRLKPGDRLIKVNDTDVTNMTHTDAVNLLRAASKTVRLVIGRVLELPRIPMLPHLLPDITLTCNKEELGFSLCGGHDSLYQVVYISDINPRSVAAIEGNLQLLDVIHYVNGVSTQGMTLEEVNRALDMSLPSLVLKATRNDLPVVPSSKRSAVSAPKSTKGNGSYSVGSCSQPALTPNDSFSTVAGEEINEISYPKGKCSTYQIKGSPNLTLPKESYIQEDDIYDDSQEAEVIQSLLDVVDEEAQNLLNENNAAGYSCGPGTLKMNGKLSEERTEDTDCDGSPLPEYFTEATKMNGCEEYCEEKVKSESLIQKPQEKKTDDDEITWGNDELPIERTNHEDSDKDHSFLTNDELAVLPVVKVLPSGKYTGANLKSVIRVLRGLLDQGIPSKELENLQELKPLDQCLIGQTKENRRKNRYKNILPYDATRVPLGDEGGYINASFIKIPVGKEEFVYIACQGPLPTTVGDFWQMIWEQKSTVIAMMTQEVEGEKIKCQRYWPNILGKTTMVSNRLRLALVRMQQLKGFVVRAMTLEDIQTREVRHISHLNFTAWPDHDTPSQPDDLLTFISYMRHIHRSGPIITHCSAGIGRSGTLICIDVVLGLISQDLDFDISDLVRCMRLQRHGMVQTEDQYIFCYQVILYVLTRLQAEEEQKQQPQLLK

SEQ ID NO: 901285 - protein, 2265 aa, Homo sapiens
MGFLSIKDTQDENYFKDILSDNSGREDSENTFSPYQFKTSGPEKKPIPGIDVLSKKKIWASSMDLLCTADRDFSSGETATYRRCHPEAVTVRTSTTPRKKEARYSDGSIALDIFGPQKMDPIYHTRELPTSSAISSALDRIRERQKKLQVLREAMNVEEPVRRYKTYHGDVFSTSSESPSIISSESDFRQVRRSEASKRFESSSGLPGVDETLSQGQSQRPSRQYETPFEGNLINQEIMLKRQEEELMQLQAKMALRQSRLSLYPGDTIKASMLDITRDPLREIALETAMTQRKLRNFFGPEFVKMTIEPFISLDLPRSILTKKGKNEDNRRKVNIMLLNGQRLELTCDTKTICKDVFDMVVAHIGLVEHHLFALATLKDNEYFFVDPDLKLTKVAPEGWKEEPKKKTKATVNFTLFFRIKFFMDDVSLIQHTLTCHQYYLQLRKDILEERMHCDDETSLLLASLALQAEYGDYQPEVHGVSYFRMEHYLPARVMEKLDLSYIKEELPKLHNTYVGASEKETELEFLKVCQRLTEYGVHFHRVHPEKKSQTGILLGVCSKGVLVFEVHNGVRTLVLRFPWRETKKISFSKKKITLQNTSDGIKHGFQTDNSKICQYLLHLCSYQHKFQLQMRARQSNQDAQDIERASFRSLNLQAESVRGFNMGRAISTGSLASSTLNKLAVRPLSVQAEILKRLSCSELSLYQPLQNSSKEKNDKASWEEKPREMSKSYHDLSQASLYPHRKNVIVNMEPPPQTVAELVGKPSHQMSRSDAESLAGVTKLNNSKSVASLNRSPERRKHESDSSSIEDPGQAYVLDVLHKRWSIVSSPEREITLVNLKKDAKYGLGFQIIGGEKMGRLDLGIFISSVAPGGPADLDGCLKPGDRLISVNSVSLEGVSHHAAIEILQNAPEDVTLVISQPKEKISKVPSTPVHLTNEMKNYMKKSSYMQDSAIDSSSKDHHWSRGTLRHISENSFGPSGGLREGSLSSQDSRTESASLSQSQVNGFFASHLGDQTWQESQHGSPSPSVISKATEKETFTDSNQSKTKKPGISDVTDYSDRGDSDMDEATYSSSQDHQTPKQESSSSVNTSNKMNFKTFSSSPPKPGDIFEVELAKNDNSLGISVTGGVNTSVRHGGIYVKAVIPQGAAESDGRIHKGDRVLAVNGVSLEGATHKQAVETLRNTGQVVHLLLEKGQSPTSKEHVPVTPQCTLSDQNAQGQGPEKVKKTTQVKDYSFVTEENTFEVKLFKNSSGLGFSFSREDNLIPEQINASIVRVKKLFPGQPAAESGKIDVGDVILKVNGASLKGLSQQVSPKHVEYSIFNDEMDWPFRMVSYCWFNCTFICHSWYPQEVISALRGTAPEVFLLLCRPPPGVLPEIDTALLTPLQSPAQVLPNSSKDSSQPSCVEQSTSSDENEMSDKSKKQCKSPSRRDSYSDSSGSGEDDLVTAPANISNSTWSSALHQTLSNMVSQAQSHHEAPKSQEDTICTMFYYPQKIPNKPEFEDSNPSPLPPDMAPGQSYQPQSESASSSSMDKYHIHHISEPTRQENWTPLKNDLENHLEDFELEVELLITLIKSEKGSLGFTVTKGNQRIGCYVHDVIQDPAKSDGRLKPGDRLIKVNDTDVTNMTHTDAVNLLRAASKTVRLVIGRVLELPRIPMLPHLLPDITLTCNKEELGFSLCGGHDSLYQVVYISDINPRSVAAIEGNLQLLDVIHYVNGVSTQGMTLEEVNRALDMSLPSLVLKATRNDLPVVPSSKRSAVSAPKSTKGNGSYSVGSCSQPALTPNDSFSTVAGEEINEISYPKGKCSTYQIKGSPNLTLPKESYIQEDDIYDDSQEAEVIQSLLDVVDEEAQNLLNENNAAGYSCGPGTLKMNGKLSEERTEDTDCDGSPLPEYFTEATKMNGCEEYCEEKVKSESLIQKPQEKKTDDDEITWGNDELPIERTNHEDSDKDHSFLTNDELAVLPVVKVLPSGKYTGANLKSVIRVLRGLLDQGIPSKELENLQELKPLDQCLIGQTKENRRKNRYKNILPYDATRVPLGDEGGYINASFIKIPVGKEEFVYIACQGPLPTTVGDFWQMIWEQKSTVIAMMTQEVEGEKIKCQRYWPNILGKTTMVSNRLRLALVRMQQLKGFVVRAMTLEDIQTREVRHISHLNFTAWPDHDTPSQPDDLLTFISYMRHIHRSGPIITHCSAGIGRSGTLICIDVVLGLISQDLDFDISDLVRCMRLQRHGMVQTEDQYIFCYQVILYVLTRLQAEEEQKQQPQLLK

SEQ ID NO: 901286 - protein, 963 aa, Homo sapiens
MGFLSIKDTQDENYFKDILSDNSGREDSENTFSPYQFKTSGPEKKPIPGIDVLSKKKIWASSMDLLCTADRDFSSGETATYRRCHPEAVTVRTSTTPRKKEARYSDGSIALDIFGPQKMDPIYHTRELPTSSAISSALDRIRERQKKLQVLREAMNVEEPVRRYKTYHGDVFSTSSESPSIISSESDFRQVRRSEASKRFESSSGLPGVDETLSQGQSQRPSRQYETPFEGNLINQEIMLKRQEEELMQLQAKMALRQSRLSLYPGDTIKASMLDITRDPLREIALETAMTQRKLRNFFGPEFVKMTIEPFISLDLPRSILTKKGKNEDNRRKVNIMLLNGQRLELTCDTKTICKDVFDMVVAHIGLVEHHLFALATLKDNEYFFVDPDLKLTKVAPEGWKEEPKKKTKATVNFTLFFRIKFFMDDVSLIQHTLTCHQYYLQLRKDILEERMHCDDETSLLLASLALQAEYGDYQPEVHGVSYFRMEHYLPARVMEKLDLSYIKEELPKLHNTYVGASEKETELEFLKVCQRLTEYGVHFHRVHPEKKSQTGILLGVCSKGVLVFEVHNGVRTLVLRFPWRETKKISFSKKKITLQNTSDGIKHGFQTDNSKICQYLLHLCSYQHKFQLQMRARQSNQDAQDIERASFRSLNLQAESVRGFNMGRAISTGSLASSTLNKLAVRPLSVQAEILKRLSCSELSLYQPLQNSSKEKNDKASWEEKPREMSKSYHDLSQASLYPHRKNVIVNMEPPPQTVAELVGKPSHQMSRSDAESLAGVTKLNNSKSVASLNRSPERRKHESDSSSIEDPGQAYVLDVLHKRWSIVSSPEREITLVNLKKDAKYGLGFQIIGGEKMGRLDLGIFISSVAPGGPADLDGCLKPGDRLISVNSVSLEGVSHHAAIEILQNAPEDVTLVISQPKEKISKGNVNVSYLCILFHFSVSFLFSDIRTKMDSLCTKLMQLK

SEQ ID NO: 901287 - protein, 2557 aa, Homo sapiens
DYEVPQSQPIKLGDHLNSILLGMCEDVIYARVSVRTVLDACSAHIRNSNCAPSFSYVKHLVKLVLEKSFWGNMHVSLAEALEVRGGPLQEEEIWAVLNQSAESLQELFRKVSLADPAALGFIISPWSLLLLPSGSVSFTDENISNQDLRAFTAPEVLQNQSLTSLSDVEKIHIYSLGMTLYWGADYEVPQSQPIKLGDHLNSILLGMCEDVIYARVSVRTVLDACSAHIRNSNCAPSFSYVKHLVKLVLGNLSGTDQLSCNSEQKPDRSQAIRDRLRGKGLPTGRSSTSDVLDIQKPPLSHQTFLNKGLSKSMGFLSIKDTQDENYFKDILSDNSGREDSENTFSPYQFKTSGPEKKPIPGIDVLSKKKIWASSMDLLCTADRDFSSGETATYRRCHPEAVTVRTSTTPRKKEARYSDGSIALDIFGPQKMDPIYHTRELPTSSAISSALDRIRERQKKLQVLREAMNVEEPVRRYKTYHGDVFSTSSESPSIISSESDFRQVRRSEASKRFESSSGLPGVDETLSQGQSQRPSRQYETPFEGNLINQEIMLKRQEEELMQLQAKMALRQSRLSLYPGDTIKASMLDITRDPLREIALETAMTQRKLRNFFGPEFVKMTIEPFISLDLPRSILTKKGKNEDNRRKVNIMLLNGQRLELTCDTKTICKDVFDMVVAHIGLVEHHLFALATLKDNEYFFVDPDLKLTKVAPEGWKEEPKKKTKATVNFTLFFRIKFFMDDVSLIQHTLTCHQYYLQLRKDILEERMHCDDETSLLLASLALQAEYGDYQPEVHGVSYFRMEHYLPARVMEKLDLSYIKEELPKLHNTYVGASEKETELEFLKVCQRLTEYGVHFHRVHPEKKSQTGILLGVCSKGVLVFEVHNGVRTLVLRFPWRETKKISFSKKKITLQNTSDGIKHGFQTDNSKICQYLLHLCSYQHKFQLQMRARQSNQDAQDIERASFRSLNLQAESVRGFNMGRAISTGSLASSTLNKLAVRPLSVQAEILKRLSCSELSLYQPLQNSSKEKNDKASWEEKPREMSKSYHDLSQASLYPHRKNVIVNMEPPPQTVAELVGKPSHQMSRSDAESLAGVTKLNNSKSVASLNRSPERRKHESDSSSIEDPGQAYVLGMTMHSSGNSSSQVPLKENDVLHKRWSIVSSPEREITLVNLKKDAKYGLGFQIIGGEKMGRLDLGIFISSVAPGGPADLDGCLKPGDRLISVNSVSLEGVSHHAAIEILQNAPEDVTLVISQPKEKISKVPSTPVHLTNEMKNYMKKSSYMQDSAIDSSSKDHHWSRGTLRHISENSFGPSGGLREGSLSSQDSRTESASLSQSQVNGFFASHLGDQTWQESQHGSPSPSVISKATEKETFTDSNQSKTKKPGISDVTDYSDRGDSDMDEATYSSSQDHQTPKQESSSSVNTSNKMNFKTFSSSPPKPGDIFEVELAKNDNSLGISVTGGVNTSVRHGGIYVKAVIPQGAAESDGRIHKGDRVLAVNGVSLEGATHKQAVETLRNTGQVVHLLLEKGQSPTSKEHVPVTPQCTLSDQNAQGQGPEKVKKTTQVKDYSFVTEENTFEVKLFKNSSGLGFSFSREDNLIPEQINASIVRVKKLFPGQPAAESGKIDVGDVILKVNGASLKGLSQQEVISALRGTAPEVFLLLCRPPPGVLPEIDTALLTPLQSPAQVLPNSSKDSSQPSCVEQSTSSDENEMSDKSKKQCKSPSRRDSYSDSSGSGEDDLVTAPANISNSTWSSALHQTLSNMVSQAQSHHEAPKSQEDTICTMFYYPQKIPNKPEFEDSNPSPLPPDMAPGQSYQPQSESASSSSMDKYHIHHISEPTRQENWTPLKNDLENHLEDFELEVELLITLIKSEKGSLGFTVTKGNQRIGCYVHDVIQDPAKSDGRLKPGDRLIKVNDTDVTNMTHTDAVNLLRAASKTVRLVIGRVLELPRIPMLPHLLPDITLTCNKEELGFSLCGGHDSLYQVVYISDINPRSVAAIEGNLQLLDVIHYVNGVSTQGMTLEEVNRALDMSLPSLVLKATRNDLPVVPSSKRSAVSAPKSTKGNGSYSVGSCSQPALTPNDSFSTVAGEEINEISYPKGKCSTYQIKGSPNLTLPKESYIQEDDIYDDSQEAEVIQSLLDVVDEEAQNLLNENNAAGYSCGPGTLKMNGKLSEERTEDTDCDGSPLPEYFTEATKMNGCEEYCEEKVKSESLIQKPQEKKTDDDEITWGNDELPIERTNHEDSDKDHSFLTNDELAVLPVVKVLPSGKYTGANLKSVIRVLRGLLDQGIPSKELENLQELKPLDQCLIGQTKENRRKNRYKNILPYDATRVPLGDEGGYINASFIKIPVGKEEFVYIACQGPLPTTVGDFWQMIWEQKSTVIAMMTQEVEGEKIKCQRYWPNILGKTTMVSNRLRLALVRMQQLKGFVVRAMTLEDIQTREVRHISHLNFTAWPDHDTPSQPDDLLTFISYMRHIHRSGPIITHCSAGIGRSGTLICIDVVLGLISQDLDFDISDLVRCMRLQRHGMVQTEDQYIFCYQVILYVLTRLQAEEEQKQQPQLLK

SEQ ID NO: 901288 - protein, 115 aa, Homo sapiens
MGFLSIKDTQDENYFKDILSDNSGREDSENTFSPYQFKTSGPEKKPIPGIDVLSKKKIWASSMDLLCTADRDFSSGETATYRRCHPEAVTVRTDLESIRKPPFQTDSGRGQGGPA

SEQ ID NO: 901289 - protein, 2466 aa, Homo sapiens; identical to SEQ ID NO: 901280

SEQ ID NO: 901290 - protein, 1265 aa, Homo sapiens
MGFLSIKDTQDENYFKDILSDNSGREDSENTFSPYQFKTSGPEKKPIPGIDVLSKKKIWASSMDLLCTADRDFSSGETATYRRCHPEAVTVRTSTTPRKKEARYSDGSIALDIFGPQKMDPIYHTRELPTSSAISSALDRIRERQKKLQVLREAMNVEEPVRRYKTYHGDVFSTSSESPSIISSESDFRQVRRSEASKRFESSSGLPGVDETLSQGQSQRPSRQYETPFEGNLINQEIMLKRQEEELMQLQAKMALRQSRLSLYPGDTIKASMLDITRDPLREIALETAMTQRKLRNFFGPEFVKMTIEPFISLDLPRSILTKKGKNEDNRRKVNIMLLNGQRLELTCDTKTICKDVFDMVVAHIGLVEHHLFALATLKDNEYFFVDPDLKLTKVAPEGWKEEPKKKTKATVNFTLFFRIKFFMDDVSLIQHTLTCHQYYLQLRKDILEERMHCDDETSLLLASLALQAEYGDYQPEVHGVSYFRMEHYLPARVMEKLDLSYIKEELPKLHNTYVGASEKETELEFLKVCQRLTEYGVHFHRVHPEKKSQTGILLGVCSKGVLVFEVHNGVRTLVLRFPWRETKKISFSKKKITLQNTSDGIKHGFQTDNSKICQYLLHLCSYQHKFQLQMRARQSNQDAQDIERASFRSLNLQAESVRGFNMGRAISTGSLASSTLNKLAVRPLSVQAEILKRLSCSELSLYQPLQNSSKEKNDKASWEEKPREMSKSYHDLSQASLYPHRKNVIVNMEPPPQTVAELVGKPSHQMSRSDAESLAGVTKLNNSKSVASLNRSPERRKHESDSSSIEDPGQAYVLDVLHKRWSIVSSPEREITLVNLKKDAKYGLGFQIIGGEKMGRLDLGIFISSVAPGGPADLDGCLKPGDRLISVNSVSLEGVSHHAAIEILQNAPEDVTLVISQPKEKISKVPSTPVHLTNEMKNYMKKSSYMQDSAIDSSSKDHHWSRGTLRHISENSFGPSGGLREGSLSSQDSRTESASLSQSQVNGFFASHLGDQTWQESQHGSPSPSVISKATEKETFTDSNQSKTKKPGISDVTDYSDRGDSDMDEATYSSSQDHQTPKQESSSSVNTSNKMNFKTFSSSPPKPGDIFEVELAKNDNSLGISVTGGVNTSVRHGGIYVKAVIPQGAAESDGRIHKGDRVLAVNGVSLEGATHKQAVETLRNTGQVVHLLLEKGQSPTSKEHVPVTPQCTLSDQNAQGQGPEKVKKTTQVKDYSFVTEGSHICSQGNCSRSILASLQTSTWCATGN

SEQ ID NO: 901291 - protein, 113 aa, Homo sapiens
MGFLSIKDTQDENYFKDILSDNSGREDSENTFSPYQFKTSGPEKKPIPGIDVLSKKKIWASSMDLLCTADRDFSSGETATYRRCHPEAVTVRTCYPQGLSCVGKMKEEKYEMY

SEQ ID NO: 901292 - protein, 95 aa, Homo sapiens
LLCTADRDFSSGETATYRRCHPEAVTVRTSTTPRKKEARYSDGSIALDIFGPQKMDPIYHTRELPTSSAISSALDRIRERQKKLQVLREAMNVEG

SEQ ID NO: 901293 - protein, 380 aa, Homo sapiens
YAVGWETGAGDSGDRSSGREPLGRQTEPAANAPGALGSNQLMPLCPLAHAMQPQSVLHSGYFHPLLRAWQTATTTLNASNLIYPIFVTDVPDDIQPITSLPGVARYGVKRLEEMLRPLVEEGLRCVLIFGVPSRVPKDERGSAADSEESPAIEAIHLLRKTFPNLLVACDVCLCPYTSHGHCGLLSENGAFRAEESRQRLAEVALAYAKAGCQVVAPSDMMDGRVEAIKEALMAHGLGNRVSVMSYSAKFASCFYGPFRDAAKSSPAFGDRRCYQLPPGARGLALRAVDRDVREGADMLMVKPGMPYLDIVREVKDKHPDLPLAVYHVSGEFAMLWHGAQAGAFDLKAAVLEAMTAFRRAGADIIITYYTPQLLQWLKEE

SEQ ID NO: 901294 - protein, 380 aa, Homo sapiens; identical to SEQ ID NO: 901293

SEQ ID NO: 901295 - protein, 362 aa, Homo sapiens
YAVGWETGAGDSGDRSSGREPLGRQTEPAANAPGALGSNQLMPLCPLAHAMQPQSVLHSGYFHPLLRAWQTATTTLNASNLIYPIFVTDVPDDIQPITSLPGVARYGVKRLEEMLRPLVEEGLRCVLIFGVPSRVPKDERGSAADSEESPAIEAIHLLRKTFPNLLVACDVCLCPYTSHGHCGLCSATLCPPGCQVVAPSDMMDGRVEAIKEALMAHGLGNRVSVMSYSAKFASCFYGPFRDAAKSSPAFGDRRCYQLPPGARGLALRAVDRDVREGADMLMVKPGMPYLDIVREVKDKHPDLPLAVYHVSGEFAMLWHGAQAGAFDLKAAVLEAMTAFRRAGADIIITYYTPQLLQWLKEE

SEQ ID NO: 901296 - protein, 435 aa, Homo sapiens
YAVGWETGAGDSGDRSSGREPLGRQTEPAANAPGALGSNQLMPLCPLAHAMQPQSVLHSGYFHPLLRAWQTATTTLNASNLIYPIFVTPWAWPGREARHWIPSSSHHLHFHISFLLPNHPSQSPPHHWPFPQYQSISHPRSCRDVPDDIQPITSLPGVARYGVKRLEEMLRPLVEEGLRCVLIFGVPSRVPKDERGSAADSEESPAIEAIHLLRKTFPNLLVACDVCLCPYTSHGHCGLLSENGAFRAEESRQRLAEVALAYAKAGCQVVAPSDMMDGRVEAIKEALMAHGLGNRVSVMSYSAKFASCFYGPFRDAAKSSPAFGDRRCYQLPPGARGLALRAVDRDVREGADMLMVKPGMPYLDIVREVKDKHPDLPLAVYHVSGEFAMLWHGAQAGAFDLKAAVLEAMTAFRRAGADIIITYYTPQLLQWLKEE

SEQ ID NO: 901297 - protein, 339 aa, Homo sapiens
MPLCPLAHAMQPQSVLHSGYFHPLLRAWQTATTTLNASNLIYPIFVTDVPDDIQPITSLPGVARYGVKRLEEMLRPLVEEGLRCVLIFGVPSRVPKDERGSAADSEESPAIEAIHLLRKTFPNLLVACDVCLCPYTSHGHCGLLSENGAFRAEESRQRLAEVALAYAKAGCQVVAPSDMMDGRVEAIKEALMAHGLGNRVSVMSYSAKFASCFYGPFRDAAKSSPAFGDRRCYQLPPGARGLALRAVDRDVREGADMLMVKPGMPYLDIVREVKDKHPDLPLAVYHVSGEFAMLWHGAQAGAFDLKAAVLEAMTAFRRAGADIIITYYTPQLLQWLKEE

SEQ ID NO: 901298 - protein, 417 aa, Homo sapiens
YAVGWETGAGDSGDRSSGREPLGRQTEPAANAPGALGSNQLMPLCPLAHAMQPQSVLHSGYFHPLLRAWQTATTTLNASNLIYPIFVTPWAWPGREARHWIPSSSHHLHFHISFLLPNHPSQSPPHHWPFPQYQSISHPRSCRDVPDDIQPITSLPGVARYGVKRLEEMLRPLVEEGLRCVLIFGVPSRVPKDERGSAADSEESPAIEAIHLLRKTFPNLLVACDVCLCPYTSHGHCGLCSATLCPPGCQVVAPSDMMDGRVEAIKEALMAHGLGNRVSVMSYSAKFASCFYGPFRDAAKSSPAFGDRRCYQLPPGARGLALRAVDRDVREGADMLMVKPGMPYLDIVREVKDKHPDLPLAVYHVSGEFAMLWHGAQAGAFDLKAAVLEAMTAFRRAGADIIITYYTPQLLQWLKEE

SEQ ID NO: 901299 - protein, 380 aa, Homo sapiens; identical to SEQ ID NO: 901293

SEQ ID NO: 901300 - protein, 743 aa, Homo sapiens
HEGPGSAGGGPLGPQAAVAAVAAVGPRQAASVAEVAGRVAGGRREGAAGADPPAMKPPAACAGDMADAASPCSVVNDLRWDLSAQQIEERTRELIEQTKRVYDQVGTQEFEDVSYESTLKALADVEVTYTVQRNILDFPQHVSPSKDIRTASTEADKKLSEFDVEMSMREDVYQRIVWLQEKVQKDSLRPEAARYLERLIKLGRRNGLHLPRETQENIKRIKKKLSLLCIDFNKNLNEDTTFLPFTLQELGGLPEDFLNSLEKMEDGKLKVTLKYPHYFPLLKKCHVPETRRKVEEAFNCRCKEENCAILKELVTLRAQKSRLLGFHTHADYVLEMNMAKTSQTVATFLDELAQKLKPLGEQERAVILELKRAECERRGLPFDGRIRAWDMRYYMNQVEETRYCVDQNLLKEYFPVQVVTHGLLGIYQELLGLAFHHEEGASAWHEDVRLYTARDAASGEVVGKFYLDLYPREGKYGHAACFGLQPGCLRQDGSRQIAIAAMVANFTKPTADAPSLLQHDEVETYFHEFGHVMHQLCSQAEFAMFSGTHVERDFVEAPSQMLENWVWEQEPLLRMSRHYRTGSAVPRELLEKLIESRQANTGLFNLRQIVLAKVDQALHTQTDADPAEEYARLCQEILGVPATPGTNMPATFGHLAGGYDAQYYGYLWSEVYSMDMFHTRFKQEGVLNSKVGMDYRSCILRPGGSEDASAMLRRFLGRDPKQDAFLLSKGLQVGGCEPEPQVC

SEQ ID NO: 901301 - protein, 578 aa, Homo sapiens
MSMREDVYQRIVWLQEKVQKDSLRPEAARYLERLIKLGRRNGLHLPRETQENIKRIKKKLSLLCIDFNKNLNEDTTFLPFTLQELGGLPEDFLNSLEKMEDGKLKVTLKYPHYFPLLKKCHVPETRRKVEEAFNCRCKEENCAILKELVTLRAQKSRLLGFHTHADYVLEMNMAKTSQTVATFLDELAQKLKPLGEQERAVILELKRAECERRGLPFDGRIRAWDMRYYMNQVEETRYCVDQNLLKEYFPVQVVTHGLLGIYQELLGLAFHHEEGASAWHEDVRLYTARDAASGEVVGKFYLDLYPREGKYGHAACFGLQPGCLRQDGSRQIAIAAMVANFTKPTADAPSLLQHDEVETYFHEFGHVMHQLCSQAEFAMFSGTHVERDFVEAPSQMLENWVWEQEPLLRMSRHYRTGSAVPRELLEKLIESRQANTGLFNLRQIVLAKVDQALHTQTDADPAEEYARLCQEILGVPATPGTNMPATFGHLAGGYDAQYYGYLWSEVYSMDMFHTRFKQEGVLNSKVGMDYRSCILRPGGSEDASAMLRRFLGRDPKQDAFLLSKGLQVGGCEPEPQVC

SEQ ID NO: 901302 - protein, 632 aa, Homo sapiens
MTRLAPRSLRTCPTRARSRRWPMWRSPTQHVSPSKDIRTASTEADKKLSEFDVEMSMREDVYQRIVWLQEKVQKDSLRPEAARYLERLIKLGRRNGLHLPRETQENIKRIKKKLSLLCIDFNKNLNEDTTFLPFTLQELGGLPEDFLNSLEKMEDGKLKVTLKYPHYFPLLKKCHVPETRRKVEEAFNCRCKEENCAILKELVTLRAQKSRLLGFHTHADYVLEMNMAKTSQTVATFLDELAQKLKPLGEQERAVILELKRAECERRGLPFDGRIRAWDMRYYMNQVEETRYCVDQNLLKEYFPVQVVTHGLLGIYQELLGLAFHHEEGASAWHEDVRLYTARDAASGEVVGKFYLDLYPREGKYGHAACFGLQPGCLRQDGSRQIAIAAMVANFTKPTADAPSLLQHDEVETYFHEFGHVMHQLCSQAEFAMFSGTHVERDFVEAPSQMLENWVWEQEPLLRMSRHYRTGSAVPRELLEKLIESRQANTGLFNLRQIVLAKVDQALHTQTDADPAEEYARLCQEILGVPATPGTNMPATFGHLAGGYDAQYYGYLWSEVYSMDMFHTRFKQEGVLNSKVGMDYRSCILRPGGSEDASAMLRRFLGRDPKQDAFLLSKGLQVGGCEPEPQVC

SEQ ID NO: 901303 - protein, 731 aa, Homo sapiens
HEGPGSAGGGPLGPQAAVAAVAAVGPRQAASVAEVAGRVAGGRREGAAGADPPAMKPPAACAGDMADAASPCSVVNDLRWDLSAQQIEERTRELIEQTKRVYDQVGTQEFEDVSYESTLKALADVEVTYTVQRNILDFPQHVSPSKDIRTASTEADKKLSEFDVEMSMREDVYQRIVWLQEKVQKDSLRPEAARYLERLIKLGRRNGLHLPRETQENIKRIKKKLSLLCIDFNKNLNEDTTFLPFTLQELGGLPEDFLNSLEKMEDGKLKVTLKYPHYFPLLKKCHVPETRRKVEEAFNCRCKEENCAILKELVTLRAQKSRLLGFHTHADYVLEMNMAKTSQTVATFLDELAQKLKPLGEQERAVILELKRAECERRGLPFDGRIRAWDMRYYMNQVEETRYCVDQNLLKEYFPVQVVTHGLLGIYQELLGLAFHHEEGASAWHEDVRLYTARDAASGEVVGKFYLDLYPREGKYGHAACFGLQPGCLRQDGSRQIAIAAMVANFTKPTADAPSLLQHDEVETYFHEFGHVMHQLCSQAEFAMFSGTHVERDFVEAPSQMLENWVWEQEPLLRMSRHYRTGSAVPRELLEKLIESRQANTGLFNLRQIVLAKVDQALHTQTDADPAEEYARLCQEILGVPATPGGYDAQYYGYLWSEVYSMDMFHTRFKQEGVLNSKVGMDYRSCILRPGGSEDASAMLRRFLGRDPKQDAFLLSKGLQVGGCEPEPQVC

SEQ ID NO: 901304 - protein, 743 aa, Homo sapiens; identical to SEQ ID NO: 901300

SEQ ID NO: 901305 - protein, 480 aa, Homo sapiens
MEDGKLKVTLKYPHYFPLLKKCHVPETRRKVEEAFNCRCKEENCAILKELVTLRAQKSRLLGFHTHADYVLEMNMAKTSQTVATFLDELAQKLKPLGEQERAVILELKRAECERRGLPFDGRIRAWDMRYYMNQVEETRYCVDQNLLKEYFPVQVVTHGLLGIYQELLGLAFHHEEGASAWHEDVRLYTARDAASGEVVGKFYLDLYPREGKYGHAACFGLQPGCLRQDGSRQIAIAAMVANFTKPTADAPSLLQHDEVETYFHEFGHVMHQLCSQAEFAMFSGTHVERDFVEAPSQMLENWVWEQEPLLRMSRHYRTGSAVPRELLEKLIESRQANTGLFNLRQIVLAKVDQALHTQTDADPAEEYARLCQEILGVPATPGTNMPATFGHLAGGYDAQYYGYLWSEVYSMDMFHTRFKQEGVLNSKVGMDYRSCILRPGGSEDASAMLRRFLGRDPKQDAFLLSKGLQVGGCEPEPQVC

SEQ ID NO: 901306 - protein, 636 aa, Homo sapiens
HEGPGSAGGGPLGPQAAVAAVAAVGPRQAASVAEVAGRVAGGRREGAAGADPPAMKPPAACAGDMADAASPCSVVNDLRWDLSAQQIEERTRELIEQTKRVYDQVGTQEFEDVSYESTLKALADVEVTYTVQRNILDFPQHVSPSKDIRTASTEADKKLSEFDVEMSMREDVYQRIVWLQEKVQKDSLRPEAARYLERLIKLGRRNGLHLPRETQENIKRIKKKLSLLCIDFNKNLNEDTTFLPFTLQELGGLPEDFLNSLEKMEDGKLKVTLKYPHYFPLLKKCHVPETRRKVEEAFNCRCKEENCAILKELVTLRAQKSRLLGFHTHADYVLEMNMAKTSQTVATFLDELAQKLKPLGEQERAVILELKRAECERRGLPFDGRIRAWDMRYYMNQVEETRYCVDQNLLKEYFPVQVVTHGLLGIYQELLGLAFHHEEGASAWHEDVRLYTARDAASGEVVGKFYLDLYPREGKYGHAACFGLQPGCLRQDGSRQIAIAAMVANFTKPTADAPSLLQHDEVETYFHEFGHVMHQLCSQAEFAMFSGTHVERDFVEAPSQMLENWVWEQEPLLRMSRHYRTGSAVPRELLEKLIESRQANTGLFNLRQIVLGLVFVALTRLLSGKRPLSGDGSSLK

SEQ ID NO: 901307 - protein, 596 aa, Homo sapiens
HEGPGSAGGGPLGPQAAVAAVAAVGPRQAASVAEVAGRVAGGRREGAAGADPPAMKPPAACAGDMADAASPCSVVNDLRWDLSAQQIEERTRELIEQTKRVYDQVGTQEFEDVSYESTLKALADVEVTYTVQRNILDFPQHVSPSKDIRTASTEADKKLSEFDVEMSMREDVYQRIVWLQEKVQKDSLRPEAARYLERLIKLGRRNGLHLPRETQERAVILELKRAECERRGLPFDGRIRAWDMRYYMNQVEETRYCVDQNLLKEYFPVQVVTHGLLGIYQELLGLAFHHEEGASAWHEDVRLYTARDAASGEVVGKFYLDLYPREGKYGHAACFGLQPGCLRQDGSRQIAIAAMVANFTKPTADAPSLLQHDEVETYFHEFGHVMHQLCSQAEFAMFSGTHVERDFVEAPSQMLENWVWEQEPLLRMSRHYRTGSAVPRELLEKLIESRQANTGLFNLRQIVLAKVDQALHTQTDADPAEEYARLCQEILGVPATPGTNMPATFGHLAGGYDAQYYGYLWSEVYSMDMFHTRFKQEGVLNSKVGMDYRSCILRPGGSEDASAMLRRFLGRDPKQDAFLLSKGLQVGGCEPEPQVC

SEQ ID NO: 901308 - protein, 105 aa, Homo sapiens
RALDLTLLDEKRVIPSFPSALLTLTLTEPKADPPGTGFCFCVACAGDMADAASPCSVVNDLRWDLSAQQIEERTRELIEQTKRVYDQVGTQEFEDVSYESTLKAL

SEQ ID NO: 901309 - protein, 268 aa, Homo sapiens
HEGPGSAGGGPLGPQAAVAAVAAVGPRQAASVAEVAGRVAGGRREGAAGADPPAMKPPAACAGDMADAASPCSVVNDLRWDLSAQQIEERTRELIEQTKRVYDQVGTQEFEDVSYESTLKALADVEVTYTVQRNILDFPQHVSPSKDIRTASTEADKKLSEFDVEMSMREDVYQRIVWLQEKVQKDSLRPEAARYLERLIKLGRRNGLHLPRETQENIKRIKKKLSLLCIDFNKNLNEDTTFLPFTLQELVAGPPFPPPPPFTHEVGA

SEQ ID NO: 901310 - protein, 887 aa, Homo sapiens
HEGPGSAGGGPLGPQAAVAAVAAVGPRQAASVAEVAGRVAGGRREGAAGADPPAMKPPAACAGDMADAASPCSVVNDLRWDLSAQQIEERTRELIEQTKRVYDQVGTQEFEDVSYESTLKALADVEVTYTVQRNILDFPQHVSPSKDIRTASTEADKKLSEFDVEMSMREDVYQRIVWLQEKVQKDSLRPEAARYLERLIKLGRRNGLHLPRETQENIKRIKKKLSLLCIDFNKNLNEDTTFLPFTLQELGGLPEDFLNSLEKMEDGKLKVTLKYPHYFPLLKKCHVPETRRKVEEAFNCRCKEENCAILKELVTLRAQKSRLLGFHTHADYVLEMNMAKTSQTVATFLDELAQKLKPLGEQERAVILELKRAECERRGLPFDGRIRAWDMRYYMNQVEETRYCVDQNLLKEYFPVQVVTHGLLGIYQELLGLAFHHEEGASAWHEDVRLYTARDAASGEVVGKFYLDLYPRWVRAAGAGGAPGPGSPRSPVCPSEMGRKSLPAPWGLGDEPRDVAPVGTPQGPKMQLSPFPVSLSHPDRAQLCPGRSPLGEGWQPGPGRGFHAALRQATSAEREVQNLRGARRSGLAVRWLRDAESGTLAVSLVPAGPDAASLPREGKYGHAACFGLQPGCLRQDGSRQIAIAAMVANFTKPTADAPSLLQHDEVETYFHEFGHVMHQLCSQAEFAMFSGTHVERDFVEAPSQMLENWVWEQEPLLRMSRHYRTGSAVPRELLEKLIESRQANTGLFNLRQIVLAKVDQALHTQTDADPAEEYARLCQEILGVPATPGTNMPATFGHLAGGYDAQYYGYLWSEVYSMDMFHTRFKQEGVLNSKVGMDYRSCILRPGGSEDASAMLRRFLGRDPKQDAFLLSKGLQVGGCEPEPQVC

SEQ ID NO: 901311 - protein, 743 aa, Homo sapiens; identical to SEQ ID NO: 901300

SEQ ID NO: 901312 - protein, 758 aa, Homo sapiens
HEGPGSAGGGPLGPQAAVAAVAAVGPRQAASVAEVAGRVAGGRREGAAGADPPAMKPPAACAGDMADAASPCSVVNDLRWDLSAQQIEERTRELIEQTKRVYDQVGTQEFEDVSYESTLKALADVEVTYTVQRNILDFPQHVSPSKDIRTASTEADKKLSEFDVEMSMREDVYQRIVWLQEKVQKDSLRPEAARYLERLIKLGRRNGLHLPRETQENIKRIKKKLSLLCIDFNKNLNEDTTFLPFTLQELGGLPEDFLNSLEKMEDGKLKVTLKYPHYFPLLKKCHVPETRRKVEEAFNCRCKEENCAILKELVTLRAQKSRLLGFHTHADYVLEMNMAKTSQTVATFLDELAQKLKPLGEQERAVILELKRAECERRGLPFDGRIRAWDMRYYMNQVEETRYCVDQNLLKEYFPVQVVTHGLLGIYQELLGLAFHHEEGASAWHEDVRLYTARDAASGEVVGKFYLDLYPREGKYGHAACFGLQPGCLRQDGSRQIAIAAMVANFTKPTADAPSLLQHDEVETYFHEFGHVMHQLCSQAEFAMFSGTHVERDFVEAPSQMLENWVWEQEPLLRMSRHYRTGSAVPRELLEKLIESRQANTGLFNLRQIVLAKVDQALHTQTDADPAEEYARLCQEILGVPATPGTNMPATFGHLAGGYDAQYYGYLWSEVYSMDMFHTRFKQEGVLNSKEAPHWPLRPRAVSAGSSVSSHTSPSGICVIGSEPWAETDPSLEKAWRLPFICSSNLQFPHYEVRPLRH

SEQ ID NO: 901313 - protein, 513 aa, Homo sapiens
DIVGPPARTRAFLPFSLQELGGLPEDFLNSLEKMEDGKLKVTLKYPHYFPLLKKCHVPETRRKVEEAFNCRCKEENCAILKELVTLRAQKSRLLGFHTHADYVLEMNMAKTSQTVATFLDELAQKLKPLGEQERAVILELKRAECERRGLPFDGRIRAWDMRYYMNQVEETRYCVDQNLLKEYFPVQVVTHGLLGIYQELLGLAFHHEEGASAWHEDVRLYTARDAASGEVVGKFYLDLYPREGKYGHAACFGLQPGCLRQDGSRQIAIAAMVANFTKPTADAPSLLQHDEVETYFHEFGHVMHQLCSQAEFAMFSGTHVERDFVEAPSQMLENWVWEQEPLLRMSRHYRTGSAVPRELLEKLIESRQANTGLFNLRQIVLAKVDQALHTQTDADPAEEYARLCQEILGVPATPGTNMPATFGHLAGGYDAQYYGYLWSEVYSMDMFHTRFKQEGVLNSKVGMDYRSCILRPGGSEDASAMLRRFLGRDPKQDAFLLSKGLQVGGCEPEPQVC

SEQ ID NO: 901314 - protein, 119 aa, Homo sapiens
AHPRSEILMKGTCALPPVLMQAAPGLPGNLEGVAPRPPWARVCRLLGSSAFLPGSPPGHSALSPRQVGMDYRSCILRPGGSEDASAMLRRFLGRDPKQDAFLLSKGLQVGGCEPEPQVC

SEQ ID NO: 901315 - protein, 124 aa, Homo sapiens
MADDLKRFLYKKLPSVEGLHAIVVSDRDGVPVIKVANDNAPEHALRPGFLSTFALATDQGSKLGLSKNKSIICYYNTYQVVQFNRLPLVVSFIASSSANTGLIVSLEKELAPLFEELRQVVEVS

SEQ ID NO: 901316 - protein, 124 aa, Homo sapiens; identical to SEQ ID NO: 901315

SEQ ID NO: 901317 - protein, 124 aa, Homo sapiens; identical to SEQ ID NO: 901315

SEQ ID NO: 901318 - protein, 117 aa, Homo sapiens
MADDLKRFLYKKLPSVEGLHAIVVSDRDGVPVIKEHALRPGFLSTFALATDQGSKLGLSKNKSIICYYNTYQVVQFNRLPLVVSFIASSSANTGLIVSLEKELAPLFEELRQVVEVS

SEQ ID NO: 901319 - protein, 124 aa, Homo sapiens; identical to SEQ ID NO: 901315

SEQ ID NO: 901320 - protein, 124 aa, Homo sapiens; identical to SEQ ID NO: 901315

SEQ ID NO: 901321 - protein, 124 aa, Homo sapiens; identical to SEQ ID NO: 901315

SEQ ID NO: 901322 - protein, 120 aa, Homo sapiens
MADDLKRFLYKKLPSVEGLHAIVVSDRDGVPVIKVANDNAPEHALRPGFLSTFALATDQGSKLGLSKNKSIICYYNTYQVVQFNRLPLVVSFIASSSANTDKLWKFLNLTVVSVCTLSSL

SEQ ID NO: 901323 - protein, 654 aa, Homo sapiens
MSEASSEDLVPPLEAGAAPYREEEEAAKKKKEKKKKSKGLANVFCVFTKGKKKKGQPSSAEPEDAAGSRQGLDGPPPTVEELKAALERGQLEAARPLLALERELAAAAAAGGVSEEELVRRQSKVEALYELLRDQVLGVLRRPLEAPPERLRQALAVVAEQEREDRQAAAAGPGTSGLAATRPRRWLQLWRRGVAEAAEERMGQRPAAGAEVPESVFLHLGRTMKEDLEAVVERLKPLFPAEFGVVAAYAESYHQHFAAHLAAVAQFELCERDTYMLLLWVQNLYPNDIINSPKLVGELQGMGLGSLLPPRQIRLLEATFLSSEAANVRELMDRALELEARRWAEDVPPQRLDGHCHSELAIDIIQITSQAQAKAESITLDLGSQIKRVLLVELPAFLRSYQRAFNEFLERGKQLTNYRANVIANINNCLSFRMSMEQNWQVPQDTLSLLLGPLGELKSHGFDTLLQNLHEDLKPLFKRFTHTRWAAPVETLENIIATVDTRLPEFSELQGCFREELMEALHLHLVKEYIIQLSKGRLVLKTAEQQQQLAGYILANADTIQHFCTQHGSPATWLQPALPTLAEIIRLQDPSAIKIEVATYATCYPDFSKGHLSAILAIKGNLSNSEVKRIRSILDVSMGAQEPSRPLFSLIKVG

SEQ ID NO: 901324 - protein, 654 aa, Homo sapiens; identical to SEQ ID NO: 901323

SEQ ID NO: 901325 - protein, 679 aa, Homo sapiens
MSEASSEDLVPPLEAGAAPYREEEEAAKKKKEKKKKSKGLANVFCVFTKGKKKKGQPSSAEPEDAAGSRQGLDGPPPTVEELKAALERGQLEAARPLLALERELAAAAAAGGVSEEELVRRQSKVEALYELLRDQVLGVLAAAAGGAARAAAPGAGRGGGAGARGPPGGGGGAEVPESVFLHLGRTMKEDLEAVVERLKPLFPAEFGVVAAYAESYHQHFAAHLAAVAQFELCERDTYMLLLWVQNLYPNDIINSPKLVGELQGMGLGSLLPPRQIRLLEATFLSSEAANVRELMDRALELEARRWAEDVPPQRLDGHCHSELAIDIIQITSQAQAKAESITLDLGSQIKRVLLVELPAFLRSYQRAFNEFLERGKQLTNYRANVIANINNCLSFRMSMEQNWQVPQDTLSLLLGPLGELKSHGFDTLLQNLHEDLKPLFKRFTHTRWAAPVETLENIIATVDTRLPEFSELQGCFREELMEALHLHLVKEYIIQLSKGRLVLKTAEQQQQLAGYILANADTIQHFCTQHGSPATWLQPALPTLAEIIRLQDPSAIKIEVATYATCYPDFSKGHLSAILAIKGNLSNSEVKRIRSILDVSMGAQEPSRPLFSLIKPRAAVSGIQQWWNGRQNWKRKKEKMSSRLAGAFRVLWRAVSTASVRRHIQVAPRPLQAGPAMGP

SEQ ID NO: 901326 - protein, 409 aa, Homo sapiens
MSEASSEDLVPPLEAGAAPYREEEEAAKKKKEKKKKSKGLANVFCVFTKGKKKKGQPSSAEPEDAAGSRQGLDGPPPTVEELKAALERGQLEAARPLLALERELAAAAAAGGVSEEELVRRQSKVEALYELLRDQVLGVLAAAAGGAARAAAPGAGRGGGAGARGPPGGGGGAEVPESVFLHLGRTMKEDLEAVVERLKPLFPAEFGVVAAYAESYHQHFAAHLAAVAQFELCERDTYMLLLWVQNLYPNDIINSPKLVGELQGMGLGSLLPPRQIRLLEATFLSSEAANVRELMDRALELEARRWAEDVPPQRLDGHCHSELAIDIIQITSQAQAKAESITLDLGSQIKRVLLVELPAFLRSYQRAFNEFLERGKQLTNYRANVIANINNCLSFRMSMEQNWQYPEDH

SEQ ID NO: 901327 - protein, 107 aa, Homo sapiens
PVSSRHSNLALLKPTSRDLTAPPEGASLMTVGGITAPRDVQVWNPRTWESVTLRGKRDPADASAVLSQDLGPALLGLSPFPRYCLTKLWPGSGRYKGCPRSLYVCRS

SEQ ID NO: 901328 - protein, 654 aa, Homo sapiens; identical to SEQ ID NO: 901323

SEQ ID NO: 901329 - protein, 617 aa, Homo sapiens
MSEASSEDLVPPLEAGAAPYREEEEAAKKKKEKKKKSKGLANVFCVFTKGKKKKGQPSSAEPEDAAGSRQGLDGPPPTVEELKAALERGQLEAARPLLALERELAAAAAAGGVSEEELVRRQSKVEALYELLRDQVLGVLAAAAGGAARAAAPGAGRGGGAGARGPPGGGGGAEVPESVFLHLGRTMKEDLEAVVERLKPLFPAEFGVVAAYAESYHQHFAAHLAAVAQFELCERDTYMLLLWVQNLYPNDIINSPKLVGELQGMGLGSLLPPRQIRLLEATFLSSEAANVRELMDRALELEARRWAEDVPPQRLDGHCHSELAIDIIQITSQAQAKAESITLDLGSQIKRVLLVELPAFLRSYQRAFNEFLERGKQLTNYRANVIANINNCLSFRMSMEQNWQVPQDTLSLLLGPLGELKSHGFDTLLQNLHEDLKPLFKRFTHTRWAAPVETLENIIATVDTRLPEFSELQGCFREELMEALHLHLVKEYIIQLSKGRLVLKTAEQQQQLAGYILANADTIQHFCTQHGSPATWLQPALPTLAEIIRLQDPSAIKIEVATYATCYPDFSKGHLSAILAIKGNLSNSEVKRIRSILDVSMGAQEPSRPLFSLIKVG

SEQ ID NO: 901330 - protein, 571 aa, Homo sapiens
MSEASSEDLVPPLEAGAAPYREEEEAAKKKKEKKKKSKGLANVFCVFTKGKKKKGQPSSAEPEDAAGSRQGLDGPPPTVEELKAALERGQLEAARPLLALERELAAAAAAGGVSEEELVRRQSKVEALYELLRDQVLGVLAAAAGGAARAAAPGAGRGGGAGARGPPGGGGGAEVPESVFLHLGRTMKEDLEAVVERLKPLFPAEFGVVAAYAESYHQHFAAHLAAVAQFELCERDTYMLLLWVQNLYPNDIINSPKLVGELQGMGLGSLLPPRQIRLLEATFLSSEAANVRELMDRALELEARRWAEDVPPQRLDGHCHSELAIDIIQITSQAQAKAESITLDLGSQIKRVLLVELPAFLRSYQRAFNEFLERGKQLTNYRANVIANINNCLSFRMSMEQNWQVPQDTLSLLLGPLGELKSHGFDTLLQNLHEDLKPLFKRFTHTRWAAPVETLENIIATVDTRLPEFSELQGCFREELMEALHLHLVKEYIIQLSKGRLVLKTAEQQQQLAGYILANADTIQHFCTQHGSPATWLQPALPTLAEIIRLQDPSAIKIEVATYATCYPDFR

SEQ ID NO: 901331 - protein, 142 aa, Homo sapiens
MAAAVAAAGAGEPQSPDELLPKGDAEKPEEELEEDDDEELDETLSERLWGLTEMFPERVRSAAGATFDLSLFVAQKMYRFSRAALWIGTTSFMILVLPVVFETEKLQMEQQQQLQQRQILLGPNTGLSGGMPGALPSLPGKI

SEQ ID NO: 901332 - protein, 153 aa, Homo sapiens
PPSALPVSPTVMAAAVAAAGAGEPQSPDELLPKGDAEKPEEELEEDDDEELDETLSERLWGLTEMFPERVRSAAGATFDLSLFVAQKMYRFSRAALWIGTTSFMILVLPVVFETEKLQMEQQQQLQQRQILLGPNTGLSGGMPGALPSLPGKI

SEQ ID NO: 901333 - protein, 153 aa, Homo sapiens; identical to SEQ ID NO: 901332

SEQ ID NO: 901334 - protein, 153 aa, Homo sapiens
AKRLLWEAGLGALLGPGCPSSSGARRLPVPQRGQEWMSLFRLRPASTPPQLDETLSERLWGLTEMFPERVRSAAGATFDLSLFVAQKMYRFSRAALWIGTTSFMILVLPVVFETEKLQMEQQQQLQQRQILLGPNTGLSGGMPGALPSLPGKI

SEQ ID NO: 901335 - protein, 174 aa, Homo sapiens
PPSALPVSPTVMAAAVAAAGAGEPQSPDELLPKGDAEKPEEELEEDDDEELDETLSERLWGLTEMFPERVRSAAGATFDLSLFVAQKMYRFSRAALWIGTTSFMILVLPVVFETEKLQMEQQQQLQQRQILLGPNTGLLSEDMARCFLTSSSLGKKGFREDMPYFGIVFEEVLC

SEQ ID NO: 901336 - protein, 153 aa, Homo sapiens; identical to SEQ ID NO: 901332

SEQ ID NO: 901337 - protein, 153 aa, Homo sapiens; identical to SEQ ID NO: 901332

SEQ ID NO: 901338 - protein, 153 aa, Homo sapiens; identical to SEQ ID NO: 901332

SEQ ID NO: 901339 - protein, 76 aa, Homo sapiens
LEHLSFLSHKEGKIKSGSGRDRTTSFMILVLPVVFETEKLQMEQQQQLQQRQILLGPNTGLSGGMPGALPSLPGKI

SEQ ID NO: 901340 - protein, 115 aa, Homo sapiens
QSGERFKKSISNAAPSKEAFKMRSLRKGKDRTVAEGEECAREMGVDIIARSESLGPISELYSDELSEPEHEAARPVYPPHEGREIPTPEPLKVTFKSQVKVEDDESLLLDLKHSS

SEQ ID NO: 901341 - protein, 441 aa, Homo sapiens
MSERSDLLHFKFENYGDSMLQKMNKLREENKFCDVTVLIDDIEVQGHKIVFAAGSPFLRDQFLLNDSREVKISILQSSEVGRQLLLSCYSGVLEFPEMELVNYLTAASFLQMSHIVERCTQALWKFIKPKQPMDSKEGCEPQSASPQSKEQQGDARGSPKQDSPCIHPSEDSMDMEDSDIQIVKVESIGDVSEVRSKKDQNQFISSEPTALHSSEPQHSLINSTVENRVSEIEQNHLHNYALSYTGSDNIIMASKDVFGPNIRGVDKGLQWHHQCPKCTRVFRHLENYANHLKMHKLFMCLLCGKTFTQKGNLHRHMRVHAGIKPFQCKICGKTFSQKCSLQDHLNLHSGDKPHKCNYCDMVFAHKPVLRKHLKQLHGKNSFDNANERNVQDLTVDFDSFACTTVTDSKGCQPQPDATQVLDAGKLAQAVLNLRNDSTCVN

SEQ ID NO: 901342 - protein, 466 aa, Homo sapiens
RSPEGPELLAVPDPDGGLPPGLSAKMSERSDLLHFKFENYGDSMLQKMNKLREENKFCDVTVLIDDIEVQGHKIVFAAGSPFLRDQFLLNDSREVKISILQSSEVGRQLLLSCYSGVLEFPEMELVNYLTAASFLQMSHIVERCTQALWKFIKPKQPMDSKEGCEPQSASPQSKEQQGDARGSPKQDSPCIHPSEDSMDMEDSDIQIVKVESIGDVSEVRSKKDQNQFISSEPTALHSSEPQHSLINSTVENRVSEIEQNHLHNYALSYTGSDNIIMASKDVFGPNIRGVDKGLQWHHQCPKCTRVFRHLENYANHLKMHKLFMCLLCGKTFTQKGNLHRHMRVHAGIKPFQCKICGKTFSQKCSLQDHLNLHSGDKPHKCNYCDMVFAHKPVLRKHLKQLHGKNSFDNANERNVQDLTVDFDSFACTTVTDSKGCQPQPDATQVLDAGKLAQAVLNLRNDSTCVN

SEQ ID NO: 901343 - protein, 406 aa, Homo sapiens
MIHTNLKKKFSCCVLVFLLFAVICVWKEKKKGSYYDSFKLQTKEFQVLKSLGKLAMGSDSQSVSSSSTQDPHRGRQTLGSLRGLAKAKPEASFQVWNKDSSSKNLIPRLQKIWKNYLSMNKYKVSYKGPGPGIKFSAEALRCHLRDHVNVSMVEVTDFPFNTSEWEGYLPKESIRTKAGPWGRCAVVSSAGSLKSSQLGREIDDHDAVLRFNGAPTANFQQDVGTKTTIRLMNSQLVTTEKRFLKDSLYNEGILIVWDPSVYHSDIPKWYQNPDYNFFNNYKTYRKLHPNQPFYILKPQMPWELWDILQEISPEEIQPNPPSSGMLGIIIMMTLCDQVDIYEFLPSKRKTDVCYYYQKFFDSACTMGAYHPLLYEKNLVKHLNQGTDEDIYLLGKATLPGFRTIHC

SEQ ID NO: 901344 - protein, 406 aa, Homo sapiens; identical to SEQ ID NO: 901343

SEQ ID NO: 901345 - protein, 406 aa, Homo sapiens; identical to SEQ ID NO: 901343

SEQ ID NO: 901346 - protein, 406 aa, Homo sapiens; identical to SEQ ID NO: 901343

SEQ ID NO: 901347 - protein, 401 aa, Homo sapiens
MIHTNLKKKFSCCVLVFLLFAVICVWKEKKKGSYYDSFKLQTKEFQVLKSLGKLAMGSDSQSVSSSSTQDPHRGRQTLGSLRGLAKAKPEASFQVWNKDSSSKNLIPRLQKIWKNYLSMNKYKVSYKGPGPGIKFSAEALRCHLRDHVNVSMVEVTDFPFNTSEWEGYLPKESIRTKAGPWGRCAVVSSAGSLKSSQLGREIDDHDAVLRFNGAPTANFQQDVGTKTTIRLMNSQLVTTEKRFLKDSLYNEGILIVWDPSVYHSDIPKWYQNPDYNFFNNYKTYRKLHPNQPFYILKPQMPWELWDILQEISPEEIQPNPPSSGMLGIIIMMTLCDQVDIYEFLPSKRKTDVCYYYQKFFDSACTMGAYHPLLYEKNLVKHLNQGTDEDIYLLGSSPSGIK

SEQ ID NO: 901348 - protein, 406 aa, Homo sapiens; identical to SEQ ID NO: 901343

SEQ ID NO: 901349 - protein, 406 aa, Homo sapiens; identical to SEQ ID NO: 901343

SEQ ID NO: 901350 - protein, 239 aa, Homo sapiens
MGKHYSLAPSPASRLSLFLHIASAHHLFSVSLWFIDDHDAVLRFNGAPTANFQQDVGTKTTIRLMNSQLVTTEKRFLKDSLYNEGILIVWDPSVYHSDIPKWYQNPDYNFFNNYKTYRKLHPNQPFYILKPQMPWELWDILQEISPEEIQPNPPSSGMLGIIIMMTLCDQVDIYEFLPSKRKTDVCYYYQKFFDSACTMGAYHPLLYEKNLVKHLNQGTDEDIYLLGKATLPGFRTIHC

SEQ ID NO: 901351 - protein, 406 aa, Homo sapiens; identical to SEQ ID NO: 901343

SEQ ID NO: 901352 - protein, 406 aa, Homo sapiens; identical to SEQ ID NO: 901343

SEQ ID NO: 901353 - protein, 147 aa, Homo sapiens
LFFLPSPVPSTVRLLSPVLPQRTPLSRLPSGVPSSRAILPLPSAFSGVTWGRGVLGRAGLGKTPGALPGVNKGSRYRPAWARSGRPPPSVLSNRSLRGRECSEQGESQLRRALQPAVPLSLIGNPAGPAQPWCGEVKRLAQDHQVML

SEQ ID NO: 901354 - protein, 253 aa, Homo sapiens [sequence omitted]

SEQ ID NO: 901355 - protein, 231 aa, Homo sapiens
MIHTNLKKKFSCCVLVFLLFAVICVWKEKKKGSYYDSFKLQTKEFQVLKSLGKLAMGSDSQSVSSSSTQDPHRGRQTLGSLRGLAKAKPEASFQVWNKDSSSKNLIPRLQKIWKNYLSMNKYKVSYKGPGPGIKFSAEALRCHLRDHVNVSMVEVTDFPFNTSEWEGYLPKESIRTKAGPWGRCAVVSSAGSLKSSQLGREIGMFWGCSVNGSAYWDWLGILMVWETSGPS

SEQ ID NO: 901356 - protein, 128 aa, Homo sapiens
LFFLPSPVPSTVRLLSPVLPQRTPLSRLPSGVPSSRAILPLPSAFSGVTWGRGVLGRAGLGKTPGALPGVNKGSRYRPAWARSGRPPPSVLSNRSLRGRECSEQGESQLRRALQPAVQGEVVNVMEPS

SEQ ID NO: 901357 - protein, 406 aa, Homo sapiens; identical to SEQ ID NO: 901343

SEQ ID NO: 901358 - protein, 406 aa, Homo sapiens; identical to SEQ ID NO: 901343

SEQ ID NO: 901359 - protein, 406 aa, Homo sapiens; identical to SEQ ID NO: 901343

SEQ ID NO: 901360 - protein, 406 aa, Homo sapiens; identical to SEQ ID NO: 901343

SEQ ID NO: 901361 - protein, 175 aa, Homo sapiens
MNSQLVTTEKRFLKDSLYNEGILIVWDPSVYHSDIPKWYQNPDYNFFNNYKTYRKLHPNQPFYILKPQMPWELWDILQEISPEEIQPNPPSSGMLGIIIMMTLCDQVDIYEFLPSKRKTDVCYYYQKFFDSACTMGAYHPLLYEKNLVKHLNQGTDEDIYLLGKATLPGFRTIHC

SEQ ID NO: 901362 - protein, 406 aa, Homo sapiens; identical to SEQ ID NO: 901343

SEQ ID NO: 901363 - protein, 128 aa, Homo sapiens; identical to SEQ ID NO: 901356

SEQ ID NO: 901364 - protein, 128 aa, Homo sapiens; identical to SEQ ID NO: 901356

SEQ ID NO: 901365 - protein, 261 aa, Homo sapiens
MIHTNLKKKFSCCVLVFLLFAVICVWKEKKKGSYYDSFKLQTKEFQVLKSLGKLAMGSDSQSVSSSSTQDPHRGRQTLGSLRGLAKAKPEASFQVWNKDSSSKNLIPRLQKIWKNYLSMNKYKVSYKGPGPGIKFSAEALRCHLRDHVNVSMVEVTDFPFNTSEWEGYLPKESIRTKAGPWGRCAVVSSAGSLKSSQLGREIDDHDAVLRFNGAPTANFQQDVGTKTTIRLMNSQISVHHCARAARKVAHFPGYTTHPQES

SEQ ID NO: 901366 - protein, 119 aa, Homo sapiens
PSLSSFSPFPSPSAFPWHSLSRTGSCCCSGRSPGSGGCARGAQCHGLHWGRNRRVLHSSQDDVRSSHCQRGWCFCGEPGGYSAVRGGSWTLHIIQHPPGLCWVSVGGLLGEFTFFFSPS

SEQ ID NO: 901367 - protein, 105 aa, Homo sapiens
MGFTGAGIAASSIAAKMMSAAAIANGGGVSAGSLVATLQSVGAAGLSTSSNILLASVGSVLGACLGNSPSSSLPAEPEAKEDEARENVPQGEPPKPPLKSEKHEE

SEQ ID NO: 901368 - protein, 130 aa, Homo sapiens
MMKRAAAAAVGGALAVGAVPVVLSAMGFTGAGIAASSIAAKMMSAAAIANGGGVSAGSLVATLQSVGAAGLSTSSNILLASVGSVLGACLGNSPSSSLPAEPEAKEDEARENVPQGEPPKPPLKSEKHEE

SEQ ID NO: 901369 - protein, 130 aa, Homo sapiens; identical to SEQ ID NO: 901368

SEQ ID NO: 901370 - protein, 630 aa, Homo sapiens
MDEMATTQISKDELDELKEAFAKVDLNSNGFICDYELHELFKEANMPLPGYKVREIIQKLMLDGDRNKDGKISFDEFVYIFQEVKSSDIAKTFRKAINRKEGICALGGTSELSSEGTQHSYSEEEKYAFVNWINKALENDPDCRHVIPMNPNTDDLFKAVGDGIVLCKMINLSVPDTIDERAINKKKLTPFIIQENLNLALNSASAIGCHVVNIGAEDLRAGKPHLVLGLLWQIIKIGLFADIELSRNEALAALLRDGETLEELMKLSPEELLLRWANFHLENSGWQKINNFSADIKDSKAYFHLLNQIAPKGQKEGEPRIDINMSGFNETDDLKRAESMLQQADKLGCRQFVTPADVVSGNPKLNLAFVANLFNKYPALTKPENQDIDWTLLEGETREERTFRNWMNSLGVNPHVNHLYADLQDALVILQLYERIKVPVDWSKVNKPPYPKLGANMKKLENCNYAVELGKHPAKFSLVGIGGQDLNDGNQTLTLALVWQLMRRYTLNVLEDLGDGQKANDDIIVNWVNRTLSEAGKSTSIQSFKDKTISSSLAVVDLIDAIQPGCINYDLVKSGNLTEDDKHNNAKYAVSMARRIGARVYALPEDLVEVKPKMVMTVFACLMGRGMKRV

SEQ ID NO: 901371 - protein, 585 aa, Homo sapiens
MPLPGYKVREIIQKLMLDGDRNKDGKISFDEFVYIFQEVKSSDIAKTFRKAINRKEGICALGGTSELSSEGTQHSYSEEEKYAFVNWINKALENDPDCRHVIPMNPNTDDLFKAVGDGIVLCKMINLSVPDTIDERAINKKKLTPFIIQENLNLALNSASAIGCHVVNIGAEDLRAGKPHLVLGLLWQIIKIGLFADIELSRNEALAALLRDGETLEELMKLSPEELLLRWANFHLENSGWQKINNFSADIKDSKAYFHLLNQIAPKGQKEGEPRIDINMSGFNETDDLKRAESMLQQADKLGCRQFVTPADVVSGNPKLNLAFVANLFNKYPALTKPENQDIDWTLLEGETREERTFRNWMNSLGVNPHVNHLYADLQDALVILQLYERIKVPVDWSKVNKPPYPKLGANMKKLENCNYAVELGKHPAKFSLVGIGGQDLNDGNQTLTLALVWQLMRRYTLNVLEDLGDGQKANDDIIVNWVNRTLSEAGKSTSIQSFKDKTISSSLAVVDLIDAIQPGCINYDLVKSGNLTEDDKHNNAKYAVSMARRIGARVYALPEDLVEVKPKMVMTVFACLMGRGMKRV

SEQ ID NO: 901372 - protein, 366 aa, Homo sapiens [sequence omitted]

SEQ ID NO: 901373 - protein, 630 aa, Homo sapiens; identical to SEQ ID NO: 901370

SEQ ID NO: 901374 - protein, 404 aa, Homo sapiens
LWSKAAKASFLLNSMSPPSRSKAALAALLRDGETLEELMKLSPEELLLRWANFHLENSGWQKINNFSADIKDSKAYFHLLNQIAPKGQKEGEPRIDINMSGFNETDDLKRAESMLQQADKLGCRQFVTPADVVSGNPKLNLAFVANLFNKYPALTKPENQDIDWTLLEGETREERTFRNWMNSLGVNPHVNHLYADLQDALVILQLYERIKVPVDWSKVNKPPYPKLGANMKKLENCNYAVELGKHPAKFSLVGIGGQDLNDGNQTLTLALVWQLMRRYTLNVLEDLGDGQKANDDIIVNWVNRTLSEAGKSTSIQSFKDKTISSSLAVVDLIDAIQPGCINYDLVKSGNLTEDDKHNNAKYAVSMARRIGARVYALPEDLVEVKPKMVMTVFACLMGRGMKRV

SEQ ID NO: 901375 - protein, 376 aa, Homo sapiens
MDEMATTQISKDELDELKEAFAKVDLNSNGFICDYELHELFKEANMPLPGYKVREIIQKLMLDGDRNKDGKISFDEFVYIFQEVKSSDIAKTFRKAINRKEGICALGGTSELSSEGTQHSYSEEEKYAFVNWINKALENDPDCRHVIPMNPNTDDLFKAVGDGIVLCKMINLSVPDTIDERAINKKKLTPFIIQENLNLALNSASAIGCHVVNIGAEDLRAGKPHLVLGLLWQIIKIGLFADIELSRNEALAALLRDGETLEELMKLSPEELLLRWANFHLENSGWQKINNFSADIKDSKAYFHLLNQIAPKGQKEGEPRIDINMSGFNETDDLKRAESMLQQADKLGCRQFVTPADVVSGNPKLNLAFVANLFNK

SEQ ID NO: 901376 - protein, 630 aa, Homo sapiens; identical to SEQ ID NO: 901370

SEQ ID NO: 901377 - protein, 493 aa, Homo sapiens
MDEMATTQISKDELDELKEAFAKVDLNSNGFICDYELHELFKEANMPLPGYKVREIIQKLMLDGDRNKDGKISFDEFVYIFQEVKSSDIAKTFRKAINRKEGICALGGTSELSSEGTQHSYSEEEKYAFVNWINKALENDPDCRHVIPMNPNTDDLFKAVGDGIVLCKMINLSVPDTIDERAINKKKLTPFIIQENLNLALNSASAIGCHVVNIGAEDLRAGKPHLVLGLLWQIIKIGLFADIELSRNEALAALLRDGETLEELMKLSPEELLLRWANFHLENSGWQKINNFSADIKDSKAYFHLLNQIAPKGQKEGEPRIDINMSGFNETDDLKRAESMLQQADKLGCRQFVTPADVVSGNPKLNLAFVANLFNKYPALTKPENQDIDWTLLEGETREERTFRNWMNSLGVNPHVNHLYADLQDALVILQLYERIKVPVDWSKVNKPPYPKLGANMKKLENCNYAVELGKHPVPDFSFKFGTCGEEFPLNAR

SEQ ID NO: 901378 - protein, 630 aa, Homo sapiens; identical to SEQ ID NO: 901370

SEQ ID NO: 901379 - protein, 354 aa, Homo sapiens
MDEMATTQISKDELDELKEAFAKVDLNSNGFICDYELHELFKEANMPLPGYKVREIIQKLMLDGDRNKDGKISFDEFVYIFQEVKSSDIAKTFRKAINRKEGICALGGTSELSSEGTQHSYSEEEKYAFVNWINKALENDPDCRHVIPMNPNTDDLFKAVGDGIVLCKMINLSVPDTIDERAINKKKLTPFIIQENLNLALNSASAIGCHVVNIGAEDLRAGKPHLVLGLLWQIIKIGLFADIELSRNEALAALLRDGETLEELMKLSPEELLLRWANFHLENSGWQKINNFSADIKDSKAYFHLLNQIAPKGQKEGEPRIDINMSGFNETDDLKRAESMLQQADKLGCRQFST

SEQ ID NO: 901380 - protein, 630 aa, Homo sapiens; identical to SEQ ID NO: 901370

SEQ ID NO: 901381 - protein, 630 aa, Homo sapiens; identical to SEQ ID NO: 901370

SEQ ID NO: 901382 - protein, 220 aa, Homo sapiens
MSILHVNHLYADLQDALVILQLYERIKVPVDWSKVNKPPYPKLGANMKKLENCNYAVELGKHPAKFSLVGIGGQDLNDGNQTLTLALVWQLMRRYTLNVLEDLGDGQKANDDIIVNWVNRTLSEAGKSTSIQSFKDKTISSSLAVVDLIDAIQPGCINYDLVKSGNLTEDDKHNNAKYAVSMARRIGARVYALPEDLVEVKPKMVMTVFACLMGRGMKRV

SEQ ID NO: 901383 - protein, 630 aa, Homo sapiens; identical to SEQ ID NO: 901370

SEQ ID NO: 901384 - protein, 421 aa, Homo sapiens
MDEMATTQISKDELDELKEAFAKVDLNSNGFICDYELHELFKEANMPLPGYKVREIIQKLMLDGDRNKDGKISFDEFVYIFQEVKSSDIAKTFRKAINRKEGICALGGTSELSSEGTQHSYSEEEKYAFVNWINKALENDPDCRHVIPMNPNTDDLFKAVGDGIVLCKMINLSVPDTIDERAINKKKLTPFIIQENLNLALNSASAIGCHVVNIGAEDLRAGKPHLVLGLLWQIIKIGLFADIELSRNEALAALLRDGETLEELMKLSPEELLLRWANFHLENSGWQKINNFSADIKDSKAYFHLLNQIAPKGQKEGEPRIDINMSGFNETDDLKRAESMLQQADKLGCRQFVTPADVVSGNPKLNLAFVANLFNKYPALTKPENQDIDWTLLEGETREERTFRNWMNSLGVNPHVNHLYA

SEQ ID NO: 901385 - protein, 1394 aa, Homo sapiens
MAALLRSARWLLRAGAAPRLPLSLRLLPGGPGRLHAASYLPAARAGPVAGGLLSPARLYAIAAKEKDIQEESTFSSRKISNQFDWALMRLDLSVRRTGRIPKKLLQKVFNDTCRSGGLGGSHALLLLRSCGSLLPELKLEERTEFAHRIWDTLQKLGAVYDVSHYNALLKVYLQNEYKFSPTDFLAKMEEANIQPNRVTYQRLIASYCNVGDIEGASKILGFMKTKDLPVTEAVFSALVTGHARAGDMENAENILTVMRDAGIEPGPDTYLALLNAYAEKGDIDHVKQTLEKVEKSELHLMDRDLLQIIFSFSKAGYPQYVSEILEKVTCERRYIPDAMNLILLLVTEKLEDVALQILLACPVSKEDGPSVFGSFFLQHCVTMNTPVEKLTDYCKKLKEVQMHSFPLQFTLHCALLANKTDLAKALMKAVKEEGFPIRPHYFWPLLVGRRKEKNVQGIIEILKGMQELGVHPDQETYTDYVIPCFDSVNSARAILQENGCLSDSDMFSQAGLRSEAANGNLDFVLSFLKSNTLPISLQSIRSSLLLGFRRSMNINLWSEITELLYKDGRYCQEPRGPTEAVGYFLYNLIDSMSDSEVQAKEEHLRQYFHQLEKMNVKIPENIYRGIRNLLESYHVPELIKDAHLLVESKNLDFQKTVQLTSSELESTLETLKAENQPIRDVLKQLILVLCSEENMQKALELKAKYESDMVTGGYAALINLCCRHDKVEDALNLKEEFDRLDSSAVLDTGKYVGLVRVLAKHGKLQDAINILKEMKEKDVLIKDTTALSFFHMLNGAALRGEIETVKQLHEAIVTLGLAEPSTNISFPLVTVHLEKGDLSTALEVAIDCYEKYKVLPRIHDVLCKLVEKGETDLIQKAMDFVSQEQGEMVMLYDLFFAFLQTGNYKEAKKIIETPGIRARSARLQWFCDRCVANNQVETLEKLVELTQKLFECDRDQMYYNLLKLYKINGDWQRADAVWNKIQEENVIPREKTLRLLAEILREGNQEVPFDVPELWYEDEKHSLNSSSASTTEPDFQKDILIACRLNQKKGAYDIFLNAKEQNIVFNAETYSNLIKLLMSEDYFTQAMEVKAFAETHIKGFTLNDAANSRLIITQVRRDYLKEAVTTLKTVLDQQQTPSRLAVTRVIQALAMKGDVENIEVVQKMLNGLEDSIGLSKMVFINNIALAQIKNNNIDAAIENIENMLTSENKVIEPQYFGLAYLFRKVIEEQLEPAVEKISIMAERLANQFAIYKPVTDFFLQLVDAGKVDDARALLQRCGAIAEQTPILLLFLLRNSRKQGKASTVKSVLELIPELNEKEEAYNSLMKSYVSEKDVTSAKALYEHLTAKNTKLDDLFLKRYASLLKYAGEPVPFIEPPESFEFYAQQLRKLRENSS

SEQ ID NO: 901386 - protein, 1094 aa, Homo sapiens
MDRDLLQIIFSFSKAGYPQYVSEILEKVTCERRYIPDAMNLILLLVTEKLEDVALQILLACPVSKEDGPSVFGSFFLQHCVTMNTPVEKLTDYCKKLKEVQMHSFPLQFTLHCALLANKTDLAKALMKAVKEEGFPIRPHYFWPLLVGRRKEKNVQGIIEILKGMQELGVHPDQETYTDYVIPCFDSVNSARAILQENGCLSDSDMFSQAGLRSEAANGNLDFVLSFLKSNTLPISLQSIRSSLLLGFRRSMNINLWSEITELLYKDGRYCQEPRGPTEAVGYFLYNLIDSMSDSEVQAKEEHLRQYFHQLEKMNVKIPENIYRGIRNLLESYHVPELIKDAHLLVESKNLDFQKTVQLTSSELESTLETLKAENQPIRDVLKQLILVLCSEENMQKALELKAKYESDMVTGGYAALINLCCRHDKVEDALNLKEEFDRLDSSAVLDTGKYVGLVRVLAKHGKLQDAINILKEMKEKDVLIKDTTALSFFHMLNGAALRGEIETVKQLHEAIVTLGLAEPSTNISFPLVTVHLEKGDLSTALEVAIDCYEKYKVLPRIHDVLCKLVEKGETDLIQKAMDFVSQEQGEMVMLYDLFFAFLQTGNYKEAKKIIETPGIRARSARLQWFCDRCVANNQVETLEKLVELTQKLFECDRDQMYYNLLKLYKINGDWQRADAVWNKIQEENVIPREKTLRLLAEILREGNQEVPFDVPELWYEDEKHSLNSSSASTTEPDFQKDILIACRLNQKKGAYDIFLNAKEQNIVFNAETYSNLIKLLMSEDYFTQAMEVKAFAETHIKGFTLNDAANSRLIITQVRRDYLKEAVTTLKTVLDQQQTPSRLAVTRVIQALAMKGDVENIEVVQKMLNGLEDSIGLSKMVFINNIALAQIKNNNIDAAIENIENMLTSENKVIEPQYFGLAYLFRKVIEEQLEPAVEKISIMAERLANQFAIYKPVTDFFLQLVDAGKVDDARALLQRCGAIAEQTPILLLFLLRNSRKQGKASTVKSVLELIPELNEKEEAYNSLMKSYVSEKDVTSAKALYEHLTAKNTKLDDLFLKRYASLLKYAGEPVPFIEPPESFEFYAQQLRKLRENSS

SEQ ID NO: 901387 - protein, 1013 aa, Homo sapiens
MAALLRSARWLLRAGAAPRLPLSLRLLPGGPGRLHAASYLPAARAGPVAGGLLSPARLYAIAAKEKDIQEESTFSSRKISNQFDWALMRLDLSVRRTGRIPKKLLQKVFNDTCRSGGLGGSHALLLLRSCGSLLPELKLEERTEFAHRIWDTLQKLGAVYDVSHYNALLKVYLQNEYKFSPTDFLAKMEEANIQPNRVTYQRLIASYCNVGDIEGASKILGFMKTKDLPVTEAVFSALVTGHARAGDMENAENILTVMRDAGIEPGPDTYLALLNAYAEKGDIDHVKQTLEKVEKSELHLMDRDLLQIIFSFSKAGYPQYVSEILEKVTCERRYIPDAMNLILLLVTEKLEDVALQILLACPVSKEDGPSVFGSFFLQHCVTMNTPVEKLTDYCKKLKEVQMHSFPLQFTLHCALLANKTDLAKALMKAVKEEGFPIRPHYFWPLLVGRRKEKNVQGIIEILKGMQELGVHPDQETYTDYVIPCFDSVNSARAILQENGCLSDSDMFSQAGLRSEAANGNLDFVLSFLKSNTLPISLQSIRSSLLLGFRRSMNINLWSEITELLYKDGRYCQEPRGPTEAVGYFLYNLIDSMSDSEVQAKEEHLRQYFHQLEKMNVKIPENIYRGIRNLLESYHVPELIKDAHLLVESKNLDFQKTVQLTSSELESTLETLKAENQPIRDVLKQLILVLCSEENMQKALELKAKYESDMVTGGYAALINLCCRHDKVEDALNLKEEFDRLDSSAVLDTGKYVGLVRVLAKHGKLQDAINILKEMKEKDVLIKDTTALSFFHMLNGAALRGEIETVKQLHEAIVTLGLAEPSTNISFPLVTVHLEKGDLSTALEVAIDCYEKYKVLPRIHDVLCKLVEKGETDLIQKAMDFVSQEQGEMVMLYDLFFAFLQTGNYKEAKKIIETPGIRARSARLQWFCDRCVANNQVETLEKLVELTQKLFECDRDQMYYNLLKLYKINGDWQRADAVWNKIQEENVIPREKTLRLLAERYIDCLPIEPKKRGI

SEQ ID NO: 901388 - protein, 1394 aa, Homo sapiens; identical to SEQ ID NO: 901385

SEQ ID NO: 901389 - protein, 1394 aa, Homo sapiens; identical to SEQ ID NO: 901385

SEQ ID NO: 901390 - protein, 468 aa, Homo sapiens
KKKKKKNNQVETLEKLVELTQKLFECDRDQMYYNLLKLYKINGDWQRADAVWNKIQEENVIPREKTLRLLAEILREGNQEVPFDVPELWYEDEKHSLNSSSASTTEPDFQKDILIACRLNQKKGAYDIFLNAKEQNIVFNAETYSNLIKLLMSEDYFTQAMEVKAFAETHIKGFTLNDAANSRLIITQVRRDYLKEAVTTLKTVLDQQQTPSRLAVTRVIQALAMKGDVENIEVVQKMLNGLEDSIGLSKMVFINNIALAQIKNNNIDAAIENIENMLTSENKVIEPQYFGLAYLFRKVIEEQLEPAVEKISIMAERLANQFAIYKPVTDFFLQLVDAGKVDDARALLQRCGAIAEQTPILLLFLLRNSRKQGKASTVKSVLELIPELNEKEEAYNSLMKSYVSEKDVTSAKALYEHLTAKNTKLDDLFLKRYASLLKYAGEPVPFIEPPESFEFYAQQLRKLRENSS

SEQ ID NO: 901391 - protein, 1277 aa, Homo sapiens
MAALLRSARWLLRAGAAPRLPLSLRLLPGGPGRLHAASYLPAARAGPVAGGLLSPARLYAIAAKEKDIQEESTFSSRKISNQFDWALMRLDLSVRRTGRIPKKLLQKVFNDTCRSGGLGGSHALLLLRSCGSLLPELKLEERTEFAHRIWDTLQKLGAVYDVSHYNALLKVYLQNEYKFSPTDFLAKMEEANIQPNRVTYQRLIASYCNVGDIEGASKILGFMKTKDLPVTEAVFSALVTGHARAGDMENAENILTVMRDAGIEPGPDTYLALLNAYAEKGDIDHVKQTLEKVEKSELHLMDRDLLQIIFSFSKAGYPQYVSEILEKVTCERRYIPDAMNLILLLVTEKLEDVALQILLACPVSKEDGPSVFGSFFLQHCVTMNTPVEKLTDYCKKLKEVQMHSFPLQFTLHCALLANKTDLAKALMKAVKEEGFPIRPHYFWPLLVGRRKEKNVQGIIEILKGMQELGVHPDQETYTDYVIPCFDSVNSARAILQENGCLSDSDMFSQAGLRSEAANGNLDFVLSFLKSNTLPISLQSIRSSLLLGFRRSMNINLWSEITELLYKDGRYCQEPRGPTEAVGYFLYNLIDSMSDSEVQAKEEHLRQYFHQLEKMNVKIPENIYRGIRNLLESYHVPELIKDAHLLVESKNLDFQKTVQLTSSELESTLETLKAENQPIRDVLKQLILVLCSEENMQKALELKAKYESDMVTGGYAALINLCCRHDKVEDALNLKEEFDRLDSSAVLDTGKYVGLVRVLAKHGKLQDAINILKEMKEKDVLIKDTTALSFFHMLNGAALRGEIETVKQLHEAIVTLGLAEPSTNISFPLVTVHLEKGDLSTALEVAIDCYEKYKVLPRIHDVLCKLVEKGETDLIQKAMDFVSQEQGEMVMLYDLFFAFLQTGNYKEAKKIIETPGIRARSARLQWFCDRCVANNQVETLEKLVELTQKLFECDRDQMYYNLLKLYKINGDWQRADAVWNKIQEENVIPREKTLRLLAEILREGNQEVPFDVPELWYEDEKHSLNSSSASTTEPDFQKDILIACRLNQKKGAYDIFLNAKEQNIVFNAETYSNLIKLLMSEDYFTQAMEVKAFAETHIKGFTLNDAANSRLIITQVRRDYLKEAVTTLKTVLDQQQTPSRLAVTRVIQALAMKGDVENIEVVQKMLNGLEDSIGLSKMVFINNIALAQIKNNNIDAAIENIENMLTSENKVIEPQYFGLAYLFRKVIEEQLEPAVEKISIMAERLANQFAIYKPVTDFFLQLVDAGKVDDARALLQEF

SEQ ID NO: 901392 - protein, 112 aa, Homo sapiens
AADTNTKFADDRPRKQGRASTVKSVLELIPELNEKEEAYNSLMKSYVSEKDVTSAKALYEHLTAKNTKLDDLFLKRYASLLKYAGEPVPFIEPPESFEFYAQQLRKLRENSS

SEQ ID NO: 901393 - protein, 837 aa, Homo sapiens
MAALLRSARWLLRAGAAPRLPLSLRLLPGGPGRLHAASYLPAARAGPVAGGLLSPARLYAIAAKEKDIQEESTFSSRKISNQFDWALMRLDLSVRRTGRIPKKLLQKVFNDTCRSGGLGGSHALLLLRSCGSLLPELKLEERTEFAHRIWDTLQKLGAVYDVSHYNALLKVYLQNEYKFSPTDFLAKMEEANIQPNRVTYQRLIASYCNVGDIEGASKILGFMKTKDLPVTEAVFSALVTGHARAGDMENAENILTVMRDAGIEPGPDTYLALLNAYAEKGDIDHVKQTLEKVEKSELHLMDRDLLQIIFSFSKAGYPQYVSEILEKVTCERRYIPDAMNLILLLVTEKLEDVALQILLACPVSKEDGPSVFGSFFLQHCVTMNTPVEKLTDYCKKLKEVQMHSFPLQFTLHCALLANKTDLAKALMKAVKEEGFPIRPHYFWPLLVGRRKEKNVQGIIEILKGMQELGVHPDQETYTDYVIPCFDSVNSARAILQENGCLSDSDMFSQAGLRSEAANGNLDFVLSFLKSNTLPISLQSIRSSLLLGFRRSMNINLWSEITELLYKDGRYCQEPRGPTEAVGYFLYNLIDSMSDSEVQAKEEHLRQYFHQLEKMNVKIPENIYRGIRNLLESYHVPELIKDAHLLVESKNLDFQKTVQLTSSELESTLETLKAENQPIRDVLKQLILVLCSEENMQKALELKAKYESDMVTGGYAALINLCCRHDKVEDALNLKEEFDRLDSSAVLDTGKYVGLVRVLAKHGKLQDAINILKEMKEKDVLIKDTTALSFFHMLNGAALRGEIETVKQLHEAIVTLGLAEPSTNISFPLVTVHLEKES

SEQ ID NO: 901394 - protein, 648 aa, Homo sapiens
MAALLRSARWLLRAGAAPRLPLSLRLLPGGPGRLHAASYLPAARAGPVAGGLLSPARLYAIAAKEKDIQEESTFSSRKISNQFDWALMRLDLSVRRTGRIPKKLLQKVFNDTCRSGGLGGSHALLLLRSCGSLLPELKLEERTEFAHRIWDTLQKLGAVYDVSHYNALLKVYLQNEYKFSPTDFLAKMEEANIQPNRVTYQRLIASYCNVGDIEGASKILGFMKTKDLPVTEAVFSALVTGHARAGDMENAENILTVMRDAGIEPGPDTYLALLNAYAEKGDIDHVKQTLEKVEKSELHLMDRDLLQIIFSFSKAGYPQYVSEILEKVTCERRYIPDAMNLILLLVTEKLEDVALQILLACPVSKEDGPSVFGSFFLQHCVTMNTPVEKLTDYCKKLKEVQMHSFPLQFTLHCALLANKTDLAKALMKAVKEEGFPIRPHYFWPLLVGRRKEKNVQGIIEILKGMQELGVHPDQETYTDYVIPCFDSVNSARAILQENGCLSDSDMFSQAGLRSEAANGNLDFVLSFLKSNTLPISLQSIRSSLLLGFRRSMNINLWSEITELLYKDGRYCQEPRGPTEAVGYFLYNLIDSMSDSEVQAKEEHLRQYFTSPSFPSATVASSTSVHRASLKLSLGHDLSRSRAMCFLSL

SEQ ID NO: 901395 - protein, 1394 aa, Homo sapiens; identical to SEQ ID NO: 901385

SEQ ID NO: 901396 - protein, 1369 aa, Homo sapiens
MAALLRSARWLLRAGAAPRLPLSLRLLPGGPGRLHAASYLPAARAGPVAGGLLSPARLYAIAAKEKDIQEESTFSSRKISNQFDWALMRLDLSVRRTGRIPKKLLQKVFNDTCRSGGLGGSHALLLLRSCGSLLPELKLEERTEFAHRIWDTLQKLGAVYDVSHYNALLKVYLQNEYKFSPTDFLAKMEEANIQPNRVTYQRLIASYCNVGDIEGASKILGFMKTKDLPVTEAVFSALVTGHARAGDMENAENILTVMRDAGIEPGPDTYLALLNAYAEKGDIDHVKQTLEKVEKSELHLMDRDLLQIIFSFSKAGYPQYVSEILEKVTCERRYIPDAMNLILLLVTEKLEDVALQILLACPVSKEDGPSVFGSFFLQHCVTMNTPVEKLTDYCKKLKEVQMHSFPLQFTLHCALLANKTDLAKALMKAVKEEGFPIRPHYFWPLLVGRRKEKNVQGIIEILKGMQELGVHPDQETYTDYVIPCFDSVNSARAILQENGCLSDSDMFSQAGLRSEAANGNLDFVLSFLKSNTLPISLQSIRSSLLLGFRRSMNINLWSEITELLYKDGRYCQEPRGPTEAVGYFLYNLIDSMSDSEVQAKEEHLRQYFHQLEKMNVKIPENIYRGIRNLLESYHVPELIKDAHLLVESKNLDFQKTVQLTSSELESTLETLKAENQPIRDVLKQLILVLCSEENMQKALELKAKYESDMVTGGYAALINLCCRHDKVEDALNLKEEFDRLDSSAVLDTGKYVGLVRVLAKHGKLQDAINILKEMKEKDVLIKDTTALSFFHMLNGAALRGEIETVKQLHEAIVTLGLAEPSTNISFPLVTVHLEKGDLSTALEVAIDCYEKYKVLPRIHDVLCKLVEKGETDLIQKAMDFVSQEQGEMVMLYDLFFAFLQTGNYKEAKKIIETPGIRARSARLQWFCDRCVANNQVETLEKLVELTQKLFECDRDQMYYNLLKLYKINGDWQRADAVWNKIQEENVIPREKTLRLLAEILREGNQEVPFDVPELWYEDEKHSLNSSSASTTEPDFQKDILIACRLNQKKGAYDIFLNAKEQNIVFNAETYSNLIKLLMSEDYFTQAMEVKAFAETHIKGFTLNDAANSRLIITQVRRDYLKEAVTTLKTVLDQQQTPSRLAVTRVIQALAMKGDVENIEVVQKMLNGLEDSIGLSKMVFINNIALAQIKNNNIDAAIENIENMLTSENKVIEPQYFGLAYLFRKVIEEQLEPAVEKISIMAERLANQFAIYKPVTDFFLQLVDAGKVDDARALLQASTVKSVLELIPELNEKEEAYNSLMKSYVSEKDVTSAKALYEHLTAKNTKLDDLFLKRYASLLKYAGEPVPFIEPPESFEFYAQQLRKLRENSS

SEQ ID NO: 901397 - protein, 1394 aa, Homo sapiens; identical to SEQ ID NO: 901385

SEQ ID NO: 901398 - protein, 1382 aa, Homo sapiens
MAALLRSARWLLRAGAAPRLPLSLRLLPGGPGRLHAASYLPAARAGPVAGGLLSPARLYAIAAKEKDIQEESTFSSRKISNQFDWALMRLDLSVRRTGRIPKKLLQKVFNDTCRSGGLGGSHALLLLRSCGSLLPELKLEERTEFAHRIWDTLQKLGAVYDVSHYNALLKVYLQNEYKFSPTDFLAKMEEANIQPNRVTYQRLIASYCNVGDIEGASKILGFMKTKDLPVTEAVFSALVTGHARAGDMENAENILTVMRDAGIEPGPDTYLALLNAYAEKGDIDHVKQTLEKVEKSELHLMDRDLLQIIFSFSKAGYPQYVSEILEKVTCERRYIPDAMNLILLLVTEKLEDVALQILLACPVSKEDGPSVFGSFFLQHCVTMNTPVEKLTDYCKKLKEVQMHSFPLQFTLHCALLANKTDLAKALMKAVKEEGFPIRPHYFWPLLVGRRKEKNVQGIIEILKGMQELGVHPDQETYTDYVIPCFDSVNSARAILQENGCLSDSDMFSQAGLRSEAANGNLDFVLSFLKSNTLPISLQSIRSSLLLGFRRSMNINLWSEITELLYKDGRYCQEPRGPTEAVGYFLYNLIDSMSDSEVQAKEEHLRQYFHQLEKMNVKIPENIYRGIRNLLESYHVPELIKDAHLLVESKNLDFQKTVQLTSSELESTLETLKAENQPIRDVLKQLILVLCSEENMQKALELKAKYESDMVTGGYAALINLCCRHDKVEDALNLKEEFDRLDSSAVLDTGKYVGLVRVLAKHGKLQDAINILKEMKEKDVLIKDTTALSFFHMLNGAALRGEIETVKQLHEAIVTLGLAEPSTNISFPLVTVHLEKGDLSTALEVAIDCYEKYKVLPRIHDVLCKLVEKGETDLIQKAMDFVSQEQGEMVMLYDLFFAFLQTGNYKEAKKIIETPGIRARSARLQWFCDRCVANNQVETLEKLVELTQKLFECDRDQMYYNLLKLYKINGDWQRADAVWNKIQEENVIPREKTLRLLAEILREGNQEVPFDVPELWYEDEKHSLNSSSASTTEPDFQKDILIACRLNQKKGAYDIFLNAKEQNIVFNAETYSNLIKLLMSEDYFTQAMEVKAFAETHIKGFTLNDAANSRLIITQVRRDYLKEAVTTLKTVLDQQQTPSRLAVTRVIQALAMKGDVENIEVVQKMLNGLEDSIGLSKMVFINNIALAQIKNNNIDAAIENIENMLTSENKVIEPQYFGLAYLFRKVIEEQLEPAVEKISIMAERLANQFAIYKPVTDFFLQLVDAGKVDDARALLQRCGAIAEQTPILLLFLLRNSRKQGKVLCFTCLQINDTVRALLRSIEFNIKACCFRTLFENTIEIQDFACLYLESVLSSVSCTGNVKQVHAGIFHLHRYALRAPRKGP

SEQ ID NO: 901399 - protein, 1168 aa, Homo sapiens
MAALLRSARWLLRAGAAPRLPLSLRLLPGGPGRLHAASYLPAARAGPVAGGLLSPARLYAIAAKEKDIQEESTFSSRKISNQFDWALMRLDLSVRRTGRIPKKLLQKVFNDTCRSGGLGGSHALLLLRSCGSLLPELKLEERTEFAHRIWDTLQKLGAVYDVSHYNALLKVYLQNEYKFSPTDFLAKMEEANIQPNRVTYQRLIASYCNVGDIEGASKILGFMKTKDLPVTEAVFSALVTGHARAGDMENAENILTVMRDAGIEPGPDTYLALLNAYAEKGDIDHVKQTLEKVEKSELHLMDRDLLQIIFSFSKAGYPQYVSEILEKVTCERRYIPDAMNLILLLVTEKLEDVALQILLACPVSKEDGPSVFGSFFLQHCVTMNTPVEKLTDYCKKLKEVQMHSFPLQFTLHCALLANKTDLAKALMKAVKEEGFPIRPHYFWPLLVGRRKEKNVQGIIEILKGMQELGVHPDQETYTDYVIPCFDSVNSARAILQENGCLSDSDMFSQAGLRSEAANGNLDFVLSFLKSNTLPISLQSIRSSLLLGFRRSMNINLWSEITELLYKDGRYCQEPRGPTEAVGYFLYNLIDSMSDSEVQAKEEHLRQYFHQLEKMNVKIPENIYRGIRNLLESYHVPELIKDAHLLVESKNLDFQKTVQLTSSELESTLETLKAENQPIRDVLKQLILVLCSEENMQKALELKAKYESDMVTGGYAALINLCCRHDKVEDALNLKEEFDRLDSSAVLDTGKYVGLVRVLAKHGKLQDAINILKEMKEKDVLIKDTTALSFFHMLNGAALRGEIETVKQLHEAIVTLGLAEPSTNISFPLVTVHLEKGDLSTALEVAIDCYEKYKVLPRIHDVLCKLVEKGETDLIQKAMDFVSQEQGEMVMLYDLFFAFLQTGNYKEAKKIIETPGIRARSARLQWFCDRCVANNQVETLEKLVELTQKLFECDRDQMYYNLLKLYKINGDWQRADAVWNKIQEENVIPREKTLRLLAEILREGNQEVPFDVPELWYEDEKHSLNSSSASTTEPDFQKDILIACRLNQKKGAYDIFLNAKEQNIVFNAETYSNLIKLLMSEDYFTQAMEVKAFAETHIKGFTLNDAANSRLIITQVRRDYLKEAVTTLKTVLDQQQTPSRLAVTRVIQALAMKGDVENIEVSCITFELC

SEQ ID NO: 901400 - protein, 1080 aa, Homo sapiens
MAALLRSARWLLRAGAAPRLPLSLRLLPGGPGRLHAASYLPAARAGPVAGGLLSPARLYAIAAKEKDIQEESTFSSRKISNQFDWALMRLDLSVRRTGRIPKKLLQKVFNDTCRSGGLGGSHALLLLRSCGSLLPELKLEERTEFAHRIWDTLQKLGAVYDVSHYNALLKVYLQNEYKFSPTDFLAKMEEANIQPNRVTYQRLIASYCNVGDIEGASKILGFMKTKDLPVTEAVFSALVTGHARAGDMENAENILTVMRDAGIEPGPDTYLALLNAYAEKGDIDHVKQTLEKVEKSELHLMDRDLLQIIFSFSKAGYPQYVSEILEKVTCERRYIPDAMNLILLLVTEKLEDVALQILLACPVSKEDGPSVFGSFFLQHCVTMNTPVEKLTDYCKKLKEVQMHSFPLQFTLHCALLANKTDLAKALMKAVKEEGFPIRPHYFWPLLVGRRKEKNVQGIIEILKGMQELGVHPDQETYTDYVIPCFDSVNSARAILQENGCLSDSDMFSQAGLRSEAANGNLDFVLSFLKSNTLPISLQSIRSSLLLGFRRSMNINLWSEITELLYKDGRYCQEPRGPTEAVGYFLYNLIDSMSDSEVQAKEEHLRQYFHQLEKMNVKIPENIYRGIRNLLESYHVPELIKDAHLLVESKNLDFQKTVQLTSSELESTLETLKAENQPIRDVLKQLILVLCSEENMQKALELKAKYESDMVTGGYAALINLCCRHDKVEDALNLKEEFDRLDSSAVLDTGKYVGLVRVLAKHGKLQDAINILKEMKEKDVLIKDTTALSFFHMLNGAALRGEIETVKQLHEAIVTLGLAEPSTNISFPLVTVHLEKGDLSTALEVAIDCYEKYKVLPRIHDVLCKLVEKGETDLIQKAMDFVSQEQGEMVMLYDLFFAFLQTGNYKEAKKIIETPGIRARSARLQWFCDRCVANNQVETLEKLVELTQKLFECDRDQMYYNLLKLYKINGDWQRADAVWNKIQEENVIPREKTLRLLAEILREGNQEVPFDVPELWYEDEKHSLNSSSASTTEPDFQKDILIACRLNQKKGKHIRGWGCVWGGGLLSNSSVGCKPNQLEVL

SEQ ID NO: 901401 - protein, 91 aa, Homo sapiens
CSRDPPHKGCPENIENMLTSENKVIEPQYFGLAYLFRKVIEEQLEPAVEKISIMAERLANQFAIYKPVTDFFLQLVDAGKVDDARALLQEF

SEQ ID NO: 901402 - protein, 1906 aa, Homo sapiens
MVRERKCILCHIVYSSKKEMDEHMRSMLHHRELENLKGRDISHECRVCGVTEVGLSAYAKHISGQLHKDNVDAQEREDDGKGEEEEEDYFDKELIQLIKQRKEQSRQDEPSNSNQEINSDDRRPQWRREDRIPYQDRESYSQPAWHHRGPPQRDWKWEKDGFNNTRKNSFPHSLRNGGGPRGRSGWHKGVAGGSSTWFHNHSNSGGGWLSNSGAVDWNHNGTGRNSSWLSEGTGGFSSWHMNNSNGNWKSSVRSTNNWNYSGPGDKFQPGRNRNSNCQMEDMTMLWNKKSNKSNKYSHDRYNWQRQENDKLGTVATYRGPSEGFTSDKFPSEGLLDFNFEQLESQTTKQADTATSKVSGKNGSAAREKPRRWTPYPSQKTLDLQSGLKDITGNKSEMIEKPLFDFSLITTGIQEPQTDETRNSPTQKTQKEIHTGSLNHKASSDSAASFEVVRQCPTAEKPEQEHTPNKMPSLKSPLLPCPATKSLSQKQDPKNISKNTKTNFFSPGEHSNPSNKPTVEDNHGPYISKLRSSCPHVLKGNKSTFGSQKQSGDNLNDTLRKAKEVLQCHESLQNPLLSTSKSTRNYAKASRNVEESEKGSLKIEFQVHALEDESDGETSDTEKHGTKIGTLGSATTELLSGSTRTADEKEEDDRILKTSRELSTSPCNPIVRQKESELQMTSAASPHPGLLLDLKTSLEDAQVDDSIKSHVSYETEGFESASLDAELQKSDISQPSGPLLPELSKLGFPASLQRDLTRHISLKSKTGVHLPEPNLNSARRIRNISGHRKSETEKESGLKPTLRQILNASRRNVNWEQVIQQVTKKKQELGKGLPRFGIEMVPLVQNEQEALDLDGEPDLSSLEGFQWEGVSISSSPGLARKRSLSESSVIMDRAPSVYSFFSEEGTGKENEPQQMVSPSNSLRAGQSQKATMHLKQEVTPRAASLRTGERAENVATQRRHSAQLSSDHIIPLMHLAKDLNSQERSIPPSENQNSQESNGEGNCLSSSASSALAISSLADAATDSSCTSGAEQNDGQSIRKKRRATGDGSSPELPSLERKNKRRKIKGKKERSQVDQLLNISLREEELSKSLQCMDNNLLQARAALQTAYVEVQRLLMLKQQITMEMSALRTHRIQILQGLQETYEPSEHPDQVPCSLTRERRNSRSQTSIDAALLPTPFFPLFLEPPSSHVSPSPTGASLQITTSPTFQTHGSVPAPDSSVQIKQEPMSPEQDENVNAVPPSSACNVSKELLEANREISDSCPVYPVITARLSLPESTESFHEPSQELKFSVEQRNTRNRENSPSSQSAGLSSINKEGEEPTKGNSGSEACTSSFLRLSFASETPLEKEPHSPADQPEQQAESTLTSAETRGSKKKKKLRKKKSLRAAHVPENSDTEQDVLTVKPVRKVKAGKLIKGGKVTTSTWEDSRTGREQESVRDEPDSDSSLEVLEIPNPQLEVVAIDSSESGEEKPDSPSKKDIWNSTEQNPLETSRSGCDEVSSTSEIGTRYKDGIPVSVAETQTVISSIKGSKNSSEISSEPGDDDEPTEGSFEGHQAAVNAIQIFGNLLYTCSADKTVRVYNLVSRKCIGVFEGHTSKVNCLLVTQTSGKNAALYTGSSDHTIRCYNVKSRECVEQLQLEDRVLCLHSRWRILYAGLANGTVVTFNIKNNKRLEIFECHGPRAVSCLATAQEGARKLLVVGSYDCTISVRDARNGLLLRTLEGHSKTILCMKVVNDLVFSGSSDQSVHAHNIHTGELVRIYKGHNHAVTVVNILGKVMVTACLDKFVRVYELQSHDRLQVYGGHKDMIMCMTIHKSMIYTGCYDGSIQAVRLNLMQNYRCWWHGCSLIFGVVDHLKQHLLTDHTNPNFQTLKCRWKNCDAFFTARKGSKQDAAGHIERHAEDDSKIDS

SEQ ID NO: 901403 - protein, 1906 aa, Homo sapiens; identical to SEQ ID NO: 901402

SEQ ID NO: 901404 - protein, 1845 aa, Homo sapiens
CPSPFGCPSPFVCPSPFVSSLSRIAQAAPGKELIQLIKQRKEQSRQDEPSNSNQEINSDDRRPQWRREDRIPYQDRESYSQPAWHHRGPPQRDWKWEKDGFNNTRKNSFPHSLRNGGGPRGRSGWHKGVAGGSSTWFHNHSNSGGGWLSNSGAVDWNHNGTGRNSSWLSEGTGGFSSWHMNNSNGNWKSSVRSTNNWNYSGPGDKFQPGRNRNSNCQMEDMTMLWNKKSNKSNKYSHDRYNWQRQENDKLGTVATYRGPSEGFTSDKFPSEGLLDFNFEQLESQTTKQADTATSKVSGKNGSAAREKPRRWTPYPSQKTLDLQSGLKDITGNKSEMIEKPLFDFSLITTGIQEPQTDETRNSPTQKTQKEIHTGSLNHKASSDSAASFEVVRQCPTAEKPEQEHTPNKMPSLKSPLLPCPATKSLSQKQDPKNISKNTKTNFFSPGEHSNPSNKPTVEDNHGPYISKLRSSCPHVLKGNKSTFGSQKQSGDNLNDTLRKAKEVLQCHESLQNPLLSTSKSTRNYAKASRNVEESEKGSLKIEFQVHALEDESDGETSDTEKHGTKIGTLGSATTELLSGSTRTADEKEEDDRILKTSRELSTSPCNPIVRQKESELQMTSAASPHPGLLLDLKTSLEDAQVDDSIKSHVSYETEGFESASLDAELQKSDISQPSGPLLPELSKLGFPASLQRDLTRHISLKSKTGVHLPEPNLNSARRIRNISGHRKSETEKESGLKPTLRQILNASRRNVNWEQVIQQVTKKKQELGKGLPRFGIEMVPLVQNEQEALDLDGEPDLSSLEGFQWEGVSISSSPGLARKRSLSESSVIMDRAPSVYSFFSEEGTGKENEPQQMVSPSNSLRAGQSQKATMHLKQEVTPRAASLRTGERAENVATQRRHSAQLSSDHIIPLMHLAKDLNSQERSIPPSENQNSQESNGEGNCLSSSASSALAISSLADAATDSSCTSGAEQNDGQSIRKKRRATGDGSSPELPSLERKNKRRKIKGKKERSQVDQLLNISLREEELSKSLQCMDNNLLQARAALQTAYVEVQRLLMLKQQITMEMSALRTHRIQILQGLQETYEPSEHPDQVPCSLTRERRNSRSQTSIDAALLPTPFFPLFLEPPSSHVSPSPTGASLQITTSPTFQTHGSVPAPDSSVQIKQEPMSPEQDENVNAVPPSSACNVSKELLEANREISDSCPVYPVITARLSLPESTESFHEPSQELKFSVEQRNTRNRENSPSSQSAGLSSINKEGEEPTKGNSGSEACTSSFLRLSFASETPLEKEPHSPADQPEQQAESTLTSAETRGSKKKKKLRKKKSLRAAHVPENSDTEQDVLTVKPVRKVKAGKLIKGGKVTTSTWEDSRTGREQESVRDEPDSDSSLEVLEIPNPQLEVVAIDSSESGEEKPDSPSKKDIWNSTEQNPLETSRSGCDEVSSTSEIGTRYKDGIPVSVAETQTVISSIKGSKNSSEISSEPGDDDEPTEGSFEGHQAAVNAIQIFGNLLYTCSADKTVRVYNLVSRKCIGVFEGHTSKVNCLLVTQTSGKNAALYTGSSDHTIRCYNVKSRECVEQLQLEDRVLCLHSRWRILYAGLANGTVVTFNIKNNKRLEIFECHGPRAVSCLATAQEGARKLLVVGSYDCTISVRDARNGLLLRTLEGHSKTILCMKVVNDLVFSGSSDQSVHAHNIHTGELVRIYKGHNHAVTVVNILGKVMVTACLDKFVRVYELQSHDRLQVYGGHKDMIMCMTIHKSMIYTGCYDGSIQAVRLNLMQNYRCWWHGCSLIFGVVDHLKQHLLTDHTNPNFQTLKCRWKNCDAFFTARKGSKQDAAGHIERHAEDDSKIDS

SEQ ID NO: 901405 - protein, 1111 aa, Homo sapiens
MVRERKCILCHIVYSSKKEMDEHMRSMLHHRELENLKGRFGIEMVPLVQNEQEALDLDGEPDLSSLEGFQWEGVSISSSPGLARKRSLSESSVIMDRAPSVYSFFSEEGTGKENEPQQMVSPSNSLRAGQSQKATMHLKQEVTPRAASLRTGERAENVATQRRHSAQLSSDHIIPLMHLAKDLNSQERSIPPSENQNSQESNGEGNCLSSSASSALAISSLADAATDSSCTSGAEQNDGQSIRKKRRATGDGSSPELPSLERKNKRRKIKGKKERSQVDQLLNISLREEELSKSLQCMDNNLLQARAALQTAYVEVQRLLMLKQQITMEMSALRTHRIQILQGLQETYEPSEHPDQVPCSLTRERRNSRSQTSIDAALLPTPFFPLFLEPPSSHVSPSPTGASLQITTSPTFQTHGSVPAPDSSVQIKQEPMSPEQDENVNAVPPSSACNVSKELLEANREISDSCPVYPVITARLSLPESTESFHEPSQELKFSVEQRNTRNRENSPSSQSAGLSSINKEGEEPTKGNSGSEACTSSFLRLSFASETPLEKEPHSPADQPEQQAESTLTSAETRGSKKKKKLRKKKSLRAAHVPENSDTEQDVLTVKPVRKVKAGKLIKGGKVTTSTWEDSRTGREQESVRDEPDSDSSLEVLEIPNPQLEVVAIDSSESGEEKPDSPSKKDIWNSTEQNPLETSRSGCDEVSSTSEIGTRYKDGIPVSVAETQTVISSIKGSKNSSEISSEPGDDDEPTEGSFEGHQAAVNAIQIFGNLLYTCSADKTVRVYNLVSRKCIGVFEGHTSKVNCLLVTQTSGKNAALYTGSSDHTIRCYNVKSRECVEQLQLEDRVLCLHSRWRILYAGLANGTVVTFNIKNNKRLEIFECHGPRAVSCLATAQEGARKLLVVGSYDCTISVRDARNGLLLRTLEGHSKTILCMKVVNDLVFSGSSDQSVHAHNIHTGELVRIYKGHNHAVTVVNILGKVMVTACLDKFVRVYELQSHDRLQVYGGHKDMIMCMTIHKSMIYTGCYDGSIQAVRLNLMQNYRCWWHGCSLIFGVVDHLKQHLLTDHTNPNFQTLKCRWKNCDAFFTARKGSKQDAAGHIERHAEDDSKIDS

SEQ ID NO: 901406 - protein, 1862 aa, Homo sapiens
MPVGRIECPSSPSFPRDISHECRVCGVTEVGLSAYAKHISGQLHKDNVDAQEREDDGKGEEEEEDYFDKELIQLIKQRKEQSRQDEPSNSNQEINSDDRRPQWRREDRIPYQDRESYSQPAWHHRGPPQRDWKWEKDGFNNTRKNSFPHSLRNGGGPRGRSGWHKGVAGGSSTWFHNHSNSGGGWLSNSGAVDWNHNGTGRNSSWLSEGTGGFSSWHMNNSNGNWKSSVRSTNNWNYSGPGDKFQPGRNRNSNCQMEDMTMLWNKKSNKSNKYSHDRYNWQRQENDKLGTVATYRGPSEGFTSDKFPSEGLLDFNFEQLESQTTKQADTATSKVSGKNGSAAREKPRRWTPYPSQKTLDLQSGLKDITGNKSEMIEKPLFDFSLITTGIQEPQTDETRNSPTQKTQKEIHTGSLNHKASSDSAASFEVVRQCPTAEKPEQEHTPNKMPSLKSPLLPCPATKSLSQKQDPKNISKNTKTNFFSPGEHSNPSNKPTVEDNHGPYISKLRSSCPHVLKGNKSTFGSQKQSGDNLNDTLRKAKEVLQCHESLQNPLLSTSKSTRNYAKASRNVEESEKGSLKIEFQVHALEDESDGETSDTEKHGTKIGTLGSATTELLSGSTRTADEKEEDDRILKTSRELSTSPCNPIVRQKESELQMTSAASPHPGLLLDLKTSLEDAQVDDSIKSHVSYETEGFESASLDAELQKSDISQPSGPLLPELSKLGFPASLQRDLTRHISLKSKTGVHLPEPNLNSARRIRNISGHRKSETEKESGLKPTLRQILNASRRNVNWEQVIQQVTKKKQELGKGLPRFGIEMVPLVQNEQEALDLDGEPDLSSLEGFQWEGVSISSSPGLARKRSLSESSVIMDRAPSVYSFFSEEGTGKENEPQQMVSPSNSLRAGQSQKATMHLKQEVTPRAASLRTGERAENVATQRRHSAQLSSDHIIPLMHLAKDLNSQERSIPPSENQNSQESNGEGNCLSSSASSALAISSLADAATDSSCTSGAEQNDGQSIRKKRRATGDGSSPELPSLERKNKRRKIKGKKERSQVDQLLNISLREEELSKSLQCMDNNLLQARAALQTAYVEVQRLLMLKQQITMEMSALRTHRIQILQGLQETYEPSEHPDQVPCSLTRERRNSRSQTSIDAALLPTPFFPLFLEPPSSHVSPSPTGASLQITTSPTFQTHGSVPAPDSSVQIKQEPMSPEQDENVNAVPPSSACNVSKELLEANREISDSCPVYPVITARLSLPESTESFHEPSQELKFSVEQRNTRNRENSPSSQSAGLSSINKEGEEPTKGNSGSEACTSSFLRLSFASETPLEKEPHSPADQPEQQAESTLTSAETRGSKKKKKLRKKKSLRAAHVPENSDTEQDVLTVKPVRKVKAGKLIKGGKVTTSTWEDSRTGREQESVRDEPDSDSSLEVLEIPNPQLEVVAIDSSESGEEKPDSPSKKDIWNSTEQNPLETSRSGCDEVSSTSEIGTRYKDGIPVSVAETQTVISSIKGSKNSSEISSEPGDDDEPTEGSFEGHQAAVNAIQIFGNLLYTCSADKTVRVYNLVSRKCIGVFEGHTSKVNCLLVTQTSGKNAALYTGSSDHTIRCYNVKSRECVEQLQLEDRVLCLHSRWRILYAGLANGTVVTFNIKNNKRLEIFECHGPRAVSCLATAQEGARKLLVVGSYDCTISVRDARNGLLLRTLEGHSKTILCMKTGELVRIYKGHNHAVTVVNILGKVMVTACLDKFVRVYELQSHDRLQVYGGHKDMIMCMTIHKSMIYTGCYDGSIQAVRLNLMQNYRCWWHGCSLIFGVVDHLKQHLLTDHTNPNFQTLKCRWKNCDAFFTARKGSKQDAAGHIERHAEDDSKIDS

SEQ ID NO: 901407 - protein, 1883 aa, Homo sapiens
MPVGRIECPSSPSFPRDISHECRVCGVTEVGLSAYAKHISGQLHKDNVDAQEREDDGKGEEEEEDYFDKELIQLIKQRKEQSRQDEPSNSNQEINSDDRRPQWRREDRIPYQDRESYSQPAWHHRGPPQRDWKWEKDGFNNTRKNSFPHSLRNGGGPRGRSGWHKGVAGGSSTWFHNHSNSGGGWLSNSGAVDWNHNGTGRNSSWLSEGTGGFSSWHMNNSNGNWKSSVRSTNNWNYSGPGDKFQPGRNRNSNCQMEDMTMLWNKKSNKSNKYSHDRYNWQRQENDKLGTVATYRGPSEGFTSDKFPSEGLLDFNFEQLESQTTKQADTATSKVSGKNGSAAREKPRRWTPYPSQKTLDLQSGLKDITGNKSEMIEKPLFDFSLITTGIQEPQTDETRNSPTQKTQKEIHTGSLNHKASSDSAASFEVVRQCPTAEKPEQEHTPNKMPSLKSPLLPCPATKSLSQKQDPKNISKNTKTNFFSPGEHSNPSNKPTVEDNHGPYISKLRSSCPHVLKGNKSTFGSQKQSGDNLNDTLRKAKEVLQCHESLQNPLLSTSKSTRNYAKASRNVEESEKGSLKIEFQVHALEDESDGETSDTEKHGTKIGTLGSATTELLSGSTRTADEKEEDDRILKTSRELSTSPCNPIVRQKESELQMTSAASPHPGLLLDLKTSLEDAQVDDSIKSHVSYETEGFESASLDAELQKSDISQPSGPLLPELSKLGFPASLQRDLTRHISLKSKTGVHLPEPNLNSARRIRNISGHRKSETEKESGLKPTLRQILNASRRNVNWEQVIQQVTKKKQELGKGLPRFGIEMVPLVQNEQEALDLDGEPDLSSLEGFQWEGVSISSSPGLARKRSLSESSVIMDRAPSVYSFFSEEGTGKENEPQQMVSPSNSLRAGQSQKATMHLKQEVTPRAASLRTGERAENVATQRRHSAQLSSDHIIPLMHLAKDLNSQERSIPPSENQNSQESNGEGNCLSSSASSALAISSLADAATDSSCTSGAEQNDGQSIRKKRRATGDGSSPELPSLERKNKRRKIKGKKERSQVDQLLNISLREEELSKSLQCMDNNLLQARAALQTAYVEVQRLLMLKQQITMEMSALRTHRIQILQGLQETYEPSEHPDQVPCSLTRERRNSRSQTSIDAALLPTPFFPLFLEPPSSHVSPSPTGASLQITTSPTFQTHGSVPAPDSSVQIKQEPMSPEQDENVNAVPPSSACNVSKELLEANREISDSCPVYPVITARLSLPESTESFHEPSQELKFSVEQRNTRNRENSPSSQSAGLSSINKEGEEPTKGNSGSEACTSSFLRLSFASETPLEKEPHSPADQPEQQAESTLTSAETRGSKKKKKLRKKKSLRAAHVPENSDTEQDVLTVKPVRKVKAGKLIKGGKVTTSTWEDSRTGREQESVRDEPDSDSSLEVLEIPNPQLEVVAIDSSESGEEKPDSPSKKDIWNSTEQNPLETSRSGCDEVSSTSEIGTRYKDGIPVSVAETQTVISSIKGSKNSSEISSEPGDDDEPTEGSFEGHQAAVNAIQIFGNLLYTCSADKTVRVYNLVSRKCIGVFEGHTSKVNCLLVTQTSGKNAALYTGSSDHTIRCYNVKSRECVEQLQLEDRVLCLHSRWRILYAGLANGTVVTFNIKNNKRLEIFECHGPRAVSCLATAQEGARKLLVVGSYDCTISVRDARNGLLLRTLEGHSKTILCMKVVNDLVFSGSSDQSVHAHNIHTGELVRIYKGHNHAVTVVNILGKVMVTACLDKFVRVYELQSHDRLQVYGGHKDMIMCMTIHKSMIYTGCYDGSIQAVRLNLMQNYRCWWHGCSLIFGVVDHLKQHLLTDHTNPNFQTLKCRWKNCDAFFTARKGSKQDAAGHIERHAEDDSKIDS

SEQ ID NO: 901408 - protein, 1883 aa, Homo sapiens; identical to SEQ ID NO: 901407

SEQ ID NO: 901409 - protein, 200 aa, Homo sapiens
MSVFCYTVGILECPSRLLHNHSGKVVNDLVFSGSSDQSVHAHNIHTGELVRIYKGHNHAVTVVNILGKVMVTACLDKFVRVYELQSHDRLQVYGGHKDMIMCMTIHKSMIYTGCYDGSIQAVRLNLMQNYRCWWHGCSLIFGVVDHLKQHLLTDHTNPNFQTLKCRWKNCDAFFTARKGSKQDAAGHIERHAEDDSKIDS

SEQ ID NO: 901410 - protein, 96 aa, Homo sapiens
KLSKAIREARDPHDVSLNMAYSDFLLHDPWCIDIVVYGDYVPRSYKNTYTGWPFSSRCLVRTLGGMDACDRYSLVGVCRPGGADADSSHYLYTNCS

SEQ ID NO: 901411 - protein, 1883 aa, Homo sapiens; identical to SEQ ID NO: 901407

SEQ ID NO: 901412 - protein, 1616 aa, Homo sapiens
MPVGRIECPSSPSFPRDISHECRVCGVTEVGLSAYAKHISGQLHKDNVDAQEREDDGKGEEEEEDYFDKELIQLIKQRKEQSRQDEPSNSNQEINSDDRRPQWRREDRIPYQDRESYSQPAWHHRGPPQRDWKWEKDGFNNTRKNSFPHSLRNGGGPRGRSGWHKGVAGGSSTWFHNHSNSGGGWLSNSGAVDWNHNGTGRNSSWLSEGTGGFSSWHMNNSNGNWKSSVRSTNNWNYSGPGDKFQPGRNRNSNCQMEDMTMLWNKKSNKSNKYSHDRYNWQRQENDKLGTVATYRGPSEGFTSDKFPSEGLLDFNFEQLESQTTKQADTATSKVSGKNGSAAREKPRRWTPYPSQKTLDLQSGLKDITGNKSEMIEKPLFDFSLITTGIQEPQTDETRNSPTQKTQKEIHTGSLNHKASSDSAASFEVVRQCPTAEKPEQEHTPNKMPSLKSPLLPCPATKSLSQKQDPKNISKNTKTNFFSPGEHSNPSNKPTVEDNHGPYISKLRSSCPHVLKGNKSTFGSQKQSGDNLNDTLRKAKEVLQCHESLQNPLLSTSKSTRNYAKASRNVEESEKGSLKIEFQVHALEDESDGETSDTEKHGTKIGTLGSATTELLSGSTRTADEKEEDDRILKTSRELSTSPCNPIVRQKESELQMTSAASPHPGLLLDLKTSLEDAQVDDSIKSHVSYETEGFESASLDAELQKSDISQPSGPLLPELSKLGFPASLQRDLTRHISLKSKTGVHLPEPNLNSARRIRNISGHRKSETEKESGLKPTLRQILNASRRNVNWEQVIQQVTKKKQELGKGLPRFGIEMVPLVQNEQEALDLDGEPDLSSLEGFQWEGVSISSSPGLARKRSLSESSVIMDRAPSVYSFFSEEGTGKENEPQQMVSPSNSLRAGQSQKATMHLKQEVTPRAASLRTGERAENVATQRRHSAQLSSDHIIPLMHLAKDLNSQERSIPPSENQNSQESNGEGNCLSSSASSALAISSLADAATDSSCTSGAEQNDGQSIRKKRRATGDGSSPELPSLERKNKRRKIKGKKERSQVDQLLNISLREEELSKSLQCMDNNLLQARAALQTAYVEVQRLLMLKQQITMEMSALRTHRIQILQGLQETYEPSEHPDQVPCSLTRERRNSRSQTSIDAALLPTPFFPLFLEPPSSHVSPSPTGASLQITTSPTFQTHGSVPAPDSSVQIKQEPMSPEQDENVNAVPPSSACNVSKELLEANREISDSCPVYPVITARLSLPESTESFHEPSQELKFSVEQRNTRNRENSPSSQSAGLSSINKEGEEPTKGNSGSEACTSSFLRLSFASETPLEKEPHSPADQPEQQAESTLTSAETRGSKKKKKLRKKKSLRAAHVPENSDTEQDVLTVKPVRKVKAGKLIKGGKVTTSTWEDSRTGREQESVRDEPDSDSSLEVLEIPNPQLEVVAIDSSESGEEKPDSPSKKDIWNSTEQNPLETSRSGCDEVSSTSEIGTRYKDGIPVSVAETQTVISSIKGSKNSSEISSEPGDDDEPTEGSFEGHQAAVNAIQIFGNLLYTCSADKTVRVYNLVSRKCIGVFEGHTSKVNCLLVTQTSGKNAALYTGSSDHTIRCYNVKVGGSREIQSGSY

SEQ ID NO: 901413 - protein, 1233 aa, Homo sapiens
MPVGRIECPSSPSFPRDISHECRVCGVTEVGLSAYAKHISGQLHKDNVDAQEREDDGKGEEEEEDYFDKELIQLIKQRKEQSRQDEPSNSNQEINSDDRRPQWRREDRIPYQDRESYSQPAWHHRGPPQRDWKWEKDGFNNTRKNSFPHSLRNGGGPRGRSGWHKGVAGGSSTWFHNHSNSGGGWLSNSGAVDWNHNGTGRNSSWLSEGTGGFSSWHMNNSNGNWKSSVRSTNNWNYSGPGDKFQPGRNRNSNCQMEDMTMLWNKKSNKSNKYSHDRYNWQRQENDKLGTVATYRGPSEGFTSDKFPSEGLLDFNFEQLESQTTKQADTATSKVSGKNGSAAREKPRRWTPYPSQKTLDLQSGLKDITGNKSEMIEKPLFDFSLITTGIQEPQTDETRNSPTQKTQKEIHTGSLNHKASSDSAASFEVVRQCPTAEKPEQEHTPNKMPSLKSPLLPCPATKSLSQKQDPKNISKNTKTNFFSPGEHSNPSNKPTVEDNHGPYISKLRSSCPHVLKGNKSTFGSQKQSGDNLNDTLRKAKEVLQCHESLQNPLLSTSKSTRNYAKASRNVEESEKGSLKIEFQVHALEDESDGETSDTEKHGTKIGTLGSATTELLSGSTRTADEKEEDDRILKTSRELSTSPCNPIVRQKESELQMTSAASPHPGLLLDLKTSLEDAQVDDSIKSHVSYETEGFESASLDAELQKSDISQPSGPLLPELSKLGFPASLQRDLTRHISLKSKTGVHLPEPNLNSARRIRNISGHRKSETEKESGLKPTLRQILNASRRNVNWEQVIQQVTKKKQELGKGLPRFGIEMVPLVQNEQEALDLDGEPDLSSLEGFQWEGVSISSSPGLARKRSLSESSVIMDRAPSVYSFFSEEGTGKENEPQQMVSPSNSLRAGQSQKATMHLKQEVTPRAASLRTGERAENVATQRRHSAQLSSDHIIPLMHLAKDLNSQERSIPPSENQNSQESNGEGNCLSSSASSALAISSLADAATDSSCTSGAEQNDGQSIRKKRRATGDGSSPELPSLERKNKRRKIKGKKERSQVDQLLNISLREEELSKSLQCMDNNLLQARAALQTAYVEVQRLLMLKQQITMEMSALRTHRIQILQGLQETYEPSEHPDQVPCSLTRERRNSRSQTSIDAALLPTPFFPLFLEPPSSHVSPSPTGASLQITTSPTFQTHGSVPAPDSSVQIKQEPMSPEQDENVNAVPPSSACNVSKELLEANSM

SEQ ID NO: 901414 - protein, 179 aa, Homo sapiens
MPVGRIECPSSPSFPRDISHECRVCGVTEVGLSAYAKHISGQLHKDNVDAQEREDDGKGEEEEEDYFDKELIQLIKQRKEQSRQDEPSNSNQEINSDDRRPQWRREDRIPYQDRESYSQPAWHHRGPPQRDWKWEKDGFVRNGLLRNGLLRNGLLRNGLLRNGLLRNGLLRNGLLRNGL

SEQ ID NO: 901415 - protein, 121 aa, Homo sapiens
KSDISQPSGPLLPELSKLGFPASLQRDLTRHISLKSKTGVHLPEPNLNSARRIRNISGHRKSETEKESGLKPTLRQILNASRRNVNWEQVIQQVTKKKQELGKGLPRCVLLFGVFFFLTFF

SEQ ID NO: 901416 - protein, 1883 aa, Homo sapiens; identical to SEQ ID NO: 901407

SEQ ID NO: 901417 - protein, 1796 aa, Homo sapiens
MPVGRIECPSSPSFPRDISHECRVCGVTEVGLSAYAKHISGQLHKDNVDAQEREDDGKGEEEEEDYFDKELIQLIKQRKEQSRQDEPSNSNQEINSDDRRPQWRREDRIPYQDRESYSQPAWHHRGPPQRDWKWEKDGFNNTRKNSFPHSLRNGGGPRGRSGWHKGVAGGSSTWFHNHSNSGGGWLSNSGAVDWNHNGTGRNSSWLSEGTGGFSSWHMNNSNGNWKSSVRSTNNWNYSGPGDKFQPGRNRNSNCQMEDMTMLWNKKSNKSNKYSHDRYNWQRQENDKLGTVATYRGPSEGFTSDKFPSEGLLDFNFEQLESQTTKQADTATSKVSGKNGSAAREKPRRWTPYPSQKTLDLQSGLKDITGNKSEMIEKPLFDFSLITTGIQEPQTDETRNSPTQKTQKEIHTGSLNHKASSDSAASFEVVRQCPTAEKPEQEHTPNKMPSLKSPLLPCPATKSLSQKQDPKNISKNTKTNFFSPGEHSNPSNKPTVEDNHGPYISKLRSSCPHVLKGNKSTFGSQKQSGDNLNDTLRKAKEVLQCHESLQNPLLSTSKSTRNYAKASRNVEESEKGSLKIEFQVHALEDESDGETSDTEKHGTKIGTLGSATTELLSGSTRTADEKEEDDRILKTSRELSTSPCNPIVRQKESELQMTSAASPHPGLLLDLKTSLEDAQVDDSIKSHVSYETEGFESASLDAELQKSDISQPSGPLLPELSKLGFPASLQRDLTRHISLKSKTGVHLPEPNLNSARRIRNISGHRKSETEKESGLKPTLRQILNASRRNVNWEQVIQQVTKKKQELGKGLPRFGIEMVPLVQNEQEALDLDGEPDLSSLEGFQWEGVSISSSPGLARKRSLSESSVIMDRAPSVYSFFSEEGTGKENEPQQMVSPSNSLRAGQSQKATMHLKQEVTPRAASLRTGERAENVATQRRHSAQLSSDHIIPLMHLAKDLNSQERSIPPSENQNSQESNGEGNCLSSSASSALAISSLADAATDSSCTSGAEQNDGQSIRKKRRATGDGSSPELPSLERKNKRRKIKGKKERSQVDQLLNISLREEELSKSLQCMDNNLLQARAALQTAYVEVQRLLMLKQQITMEMSALRTHRIQILQGLQETYEPSEHPDQVPCSLTRERRNSRSQTSIDAALLPTPFFPLFLEPPSSHVSPSPTGASLQITTSPTFQTHGSVPAPDSSVQIKQEPMSPEQDENVNAVPPSSACNVSKELLEANKTPLEKEPHSPADQPEQQAESTLTSAETRGSKKKKKLRKKKSLRAAHVPENSDTEQDVLTVKPVRKVKAGKLIKGGKVTTSTWEDSRTGREQESVRDEPDSDSSLEVLEIPNPQLEVVAIDSSESGEEKPDSPSKKDIWNSTEQNPLETSRSGCDEVSSTSEIGTRYKDGIPVSVAETQTVISSIKGSKNSSEISSEPGDDDEPTEGSFEGHQAAVNAIQIFGNLLYTCSADKTVRVYNLVSRKCIGVFEGHTSKVNCLLVTQTSGKNAALYTGSSDHTIRCYNVKSRECVEQLQLEDRVLCLHSRWRILYAGLANGTVVTFNIKNNKRLEIFECHGPRAVSCLATAQEGARKLLVVGSYDCTISVRDARNGLLLRTLEGHSKTILCMKVVNDLVFSGSSDQSVHAHNIHTGELVRIYKGHNHAVTVVNILGKVMVTACLDKFVRVYELQSHDRLQVYGGHKDMIMCMTIHKSMIYTGCYDGSIQAVRLNLMQNYRCWWHGCSLIFGVVDHLKQHLLTDHTNPNFQTLKCRWKNCDAFFTARKGSKQDAAGHIERHAEDDSKIDS

SEQ ID NO: 901418 - protein, 1883 aa, Homo sapiens; identical to SEQ ID NO: 901407

SEQ ID NO: 901419 - protein, 1068 aa, Homo sapiens
MVPLVQNEQEALDLDGEPDLSSLEGFQWEGVSISSSPGLARKRSLSESSVIMDRAPSVYSFFSEEGTGKENEPQQMVSPSNSLRAGQSQKATMHLKQEVTPRAASLRTGERAENVATQRRHSAQLSSDHIIPLMHLAKDLNSQERSIPPSENQNSQESNGEGNCLSSSASSALAISSLADAATDSSCTSGAEQNDGQSIRKKRRATGDGSSPELPSLERKNKRRKIKGKKERSQVDQLLNISLREEELSKSLQCMDNNLLQARAALQTAYVEVQRLLMLKQQITMEMSALRTHRIQILQGLQETYEPSEHPDQVPCSLTRERRNSRSQTSIDAALLPTPFFPLFLEPPSSHVSPSPTGASLQITTSPTFQTHGSVPAPDSSVQIKQEPMSPEQDENVNAVPPSSACNVSKELLEANREISDSCPVYPVITARLSLPESTESFHEPSQELKFSVEQRNTRNRENSPSSQSAGLSSINKEGEEPTKGNSGSEACTSSFLRLSFASETPLEKEPHSPADQPEQQAESTLTSAETRGSKKKKKLRKKKSLRAAHVPENSDTEQDVLTVKPVRKVKAGKLIKGGKVTTSTWEDSRTGREQESVRDEPDSDSSLEVLEIPNPQLEVVAIDSSESGEEKPDSPSKKDIWNSTEQNPLETSRSGCDEVSSTSEIGTRYKDGIPVSVAETQTVISSIKGSKNSSEISSEPGDDDEPTEGSFEGHQAAVNAIQIFGNLLYTCSADKTVRVYNLVSRKCIGVFEGHTSKVNCLLVTQTSGKNAALYTGSSDHTIRCYNVKSRECVEQLQLEDRVLCLHSRWRILYAGLANGTVVTFNIKNNKRLEIFECHGPRAVSCLATAQEGARKLLVVGSYDCTISVRDARNGLLLRTLEGHSKTILCMKVVNDLVFSGSSDQSVHAHNIHTGELVRIYKGHNHAVTVVNILGKVMVTACLDKFVRVYELQSHDRLQVYGGHKDMIMCMTIHKSMIYTGCYDGSIQAVRLNLMQNYRCWWHGCSLIFGVVDHLKQHLLTDHTNPNFQTLKCRWKNCDAFFTARKGSKQDAAGHIERHAEDDSKIDS

SEQ ID NO: 901420 - protein, 1883 aa, Homo sapiens; identical to SEQ ID NO: 901407

SEQ ID NO: 901421 - protein, 178 aa, Homo sapiens
MKVVNDLVFSGSSDQSVHAHNIHTGELVRIYKGHNHAVTVVNILGKVMVTACLDKFVRVYELQSHDRLQVYGGHKDMIMCMTIHKSMIYTGCYDGSIQAVRLNLMQNYRCWWHGCSLIFGVVDHLKQHLLTDHTNPNFQTLKCRWKNCDAFFTARKGSKQDAAGHIERHAEDDSKIDS

SEQ ID NO: 901422 - protein, 1883 aa, Homo sapiens; identical to SEQ ID NO: 901407

SEQ ID NO: 901423 - protein, 1883 aa, Homo sapiens; identical to SEQ ID NO: 901407

SEQ ID NO: 901424 - protein, 1406 aa, Homo sapiens
MPVGRIECPSSPSFPRDISHECRVCGVTEVGLSAYAKHISGQLHKDNVDAQEREDDGKGEEEEEDYFDKELIQLIKQRKEQSRQDEPSNSNQEINSDDRRPQWRREDRIPYQDRESYSQPAWHHRGPPQRDWKWEKDGFNNTRKNSFPHSLRNGGGPRGRSGWHKGVAGGSSTWFHNHSNSGGGWLSNSGAVDWNHNGTGRNSSWLSEGTGGFSSWHMNNSNGNWKSSVRSTNNWNYSGPGDKFQPGRNRNSNCQMEDMTMLWNKKSNKSNKYSHDRYNWQRQENDKLGTVATYRGPSEGFTSDKFPSEGLLDFNFEQLESQTTKQADTATSKVSGKNGSAAREKPRRWTPYPSQKTLDLQSGLKDITGNKSEMIEKPLFDFSLITTGIQEPQTDETRNSPTQKTQKEIHTGSLNHKASSDSAASFEVVRQCPTAEKPEQEHTPNKMPSLKSPLLPCPATKSLSQKQDPKNISKNTKTNFFSPGEHSNPSNKPTVEDNHGPYISKLRSSCPHVLKGNKSTFGSQKQSGDNLNDTLRKAKEVLQCHESLQNPLLSTSKSTRNYAKASRNVEESEKGSLKIEFQVHALEDESDGETSDTEKHGTKIGTLGSATTELLSGSTRTADEKEEDDRILKTSRELSTSPCNPIVRQKESELQMTSAASPHPGLLLDLKTSLEDAQVDDSIKSHVSYETEGFESASLDAELQKSDISQPSGPLLPELSKLGFPASLQRDLTRHISLKSKTGVHLPEPNLNSARRIRNISGHRKSETEKESGLKPTLRQILNASRRNVNWEQVIQQVTKKKQELGKGLPRFGIEMVPLVQNEQEALDLDGEPDLSSLEGFQWEGVSISSSPGLARKRSLSESSVIMDRAPSVYSFFSEEGTGKENEPQQMVSPSNSLRAGQSQKATMHLKQEVTPRAASLRTGERAENVATQRRHSAQLSSDHIIPLMHLAKDLNSQERSIPPSENQNSQESNGEGNCLSSSASSALAISSLADAATDSSCTSGAEQNDGQSIRKKRRATGDGSSPELPSLERKNKRRKIKGKKERSQVDQLLNISLREEELSKSLQCMDNNLLQARAALQTAYVEVQRLLMLKQQITMEMSALRTHRIQILQGLQETYEPSEHPDQVPCSLTRERRNSRSQTSIDAALLPTPFFPLFLEPPSSHVSPSPTGASLQITTSPTFQTHGSVPAPDSSVQIKQEPMSPEQDENVNAVPPSSACNVSKELLEANREISDSCPVYPVITARLSLPESTESFHEPSQELKFSVEQRNTRNRENSPSSQSAGLSSINKEGEEPTKGNSGSEACTSSFLRLSFASETPLEKEPHSPADQPEQQAESTLTSAETRGSKKKKKLRKKKSLRAAHVPENSDTEQDVLTVKPVRKVKAGKLIKGGKVTTSTWEECEL

SEQ ID NO: 901425 - protein, 1037 aa, Homo sapiens
MPVGRIECPSSPSFPRDISHECRVCGVTEVGLSAYAKHISGQLHKDNVDAQEREDDGKGEEEEEDYFDKELIQLIKQRKEQSRQDEPSNSNQEINSDDRRPQWRREDRIPYQDRESYSQPAWHHRGPPQRDWKWEKDGFNNTRKNSFPHSLRNGGGPRGRSGWHKGVAGGSSTWFHNHSNSGGGWLSNSGAVDWNHNGTGRNSSWLSEGTGGFSSWHMNNSNGNWKSSVRSTNNWNYSGPGDKFQPGRNRNSNCQMEDMTMLWNKKSNKSNKYSHDRYNWQRQENDKLGTVATYRGPSEGFTSDKFPSEGLLDFNFEQLESQTTKQADTATSKVSGKNGSAAREKPRRWTPYPSQKTLDLQSGLKDITGNKSEMIEKPLFDFSLITTGIQEPQTDETRNSPTQKTQKEIHTGSLNHKASSDSAASFEVVRQCPTAEKPEQEHTPNKMPSLKSPLLPCPATKSLSQKQDPKNISKNTKTNFFSPGEHSNPSNKPTVEDNHGPYISKLRSSCPHVLKGNKSTFGSQKQSGDNLNDTLRKAKEVLQCHESLQNPLLSTSKSTRNYAKASRNVEESEKGSLKIEFQVHALEDESDGETSDTEKHGTKIGTLGSATTELLSGSTRTADEKEEDDRILKTSRELSTSPCNPIVRQKESELQMTSAASPHPGLLLDLKTSLEDAQVDDSIKSHVSYETEGFESASLDAELQKSDISQPSGPLLPELSKLGFPASLQRDLTRHISLKSKTGVHLPEPNLNSARRIRNISGHRKSETEKESGLKPTLRQILNASRRNVNWEQVIQQVTKKKQELGKGLPRFGIEMVPLVQNEQEALDLDGEPDLSSLEGFQWEGVSISSSPGLARKRSLSESSVIMDRAPSVYSFFSEEGTGKENEPQQMVSPSNSLRAGQSQKATMHLKQEVTPRAASLRTGERAENVATQRRHSAQLSSDHIIPLMHLAKDLNSQERSIPPSENQNSQESNGEGNCLSSSASSALAISSLADAATDSSCTSGAEQNDGQSIRKKRRATGQNGRKYLQTAHVTRD

SEQ ID NO: 901426 - protein, 456 aa, Homo sapiens
EGEDEWGNEFEGSTGRGRKRGVGCGEKDGGEEEEEERGGRDRGGEEGELAGTGGYGINILGMDPLSTPFDNEFYNGLCNRDRDGNTLTYYRRPWNVASLIYETKGEKNFRTEHYEEQIEAFKSIIQEKTSNFNAAISLKFTPTETNKAEQCCEETASSISLHGKGSFRFSYSKNETYQLFLSYSSKKEKMFLHVKGEIHLGRFVMRNRDVVLTTTFVDDIKALPTTYEKGEYFAFLETYGTHYSSSGSLGGLYELIYVLDKASMKRKGVELKDIKRCLGYHLDVSLAFSEISVGAEFNKDDCVKRGEGRAVNITSENLIDDVVSLIRGGTRKYAFELKEKLLRGTVIDVTDFVNWASSINDAPVLISQKLSPIYNLVPVKMKNAHLKKQNLERAIEDYINEFSVRKCHTCQNGGTVILMDGKCLCACPFKFEGIACEISKQKISEGLPALEFPNEK

SEQ ID NO: 901427 - protein, 456 aa, Homo sapiens; identical to SEQ ID NO: 901426

SEQ ID NO: 901428 - protein, 174 aa, Homo sapiens
DEDDCESEPRPPCRDRVVEESELARTAGYGINILGMDPLSTPFDNEFYNGLCNRDRDGNTLTYYRRPWNVASLIYETKGEKNFRTEHYEEQIEAFKSIIQEKTSNFNAAISLKFTPTETNKAEQCCEETASSISLHGKGSFRFSYSKNETYQLFLSYSSKKIAMLCSQQLLWMI

SEQ ID NO: 901429 - protein, 413 aa, Homo sapiens
EGEDEWGNEFEGSTGRGRKRGVGCGEKDGGEEEEEERGGRDRGGEEGELAGTGGYGINILGMDPLSTPFDNEFYNGLCNRDRDGNTLTYYRRPWNVASLIYETKGEKNFRTEHYEEQIEAFKSIIQEKTSNFNAAISLKFTPTETNKAEQCCEETASSISLHGKGSFRFSYSKNETYQLFLSYSSKKEKMFLHVKGEIHLGRFVMRNRDVVLTTTFVDDIKALPTTYEKGEYFAFLETYGTHYSSSGSLGGLYELIYVLDKASMKRKVNITSENLIDDVVSLIRGGTRKYAFELKEKLLRGTVIDVTDFVNWASSINDAPVLISQKLSPIYNLVPVKMKNAHLKKQNLERAIEDYINEFSVRKCHTCQNGGTVILMDGKCLCACPFKFEGIACEISKQKISEGLPALEFPNEK

SEQ ID NO: 901430 - protein, 456 aa, Homo sapiens; identical to SEQ ID NO: 901426

SEQ ID NO: 901431 - protein, 456 aa, Homo sapiens; identical to SEQ ID NO: 901426

SEQ ID NO: 901432 - protein, 430 aa, Homo sapiens
DEDDCESEPRPPCRDRVVEESELARTAGYGINILGMDPLSTPFDNEFYNGLCNRDRDGNTLTYYRRPWNVASLIYETKGEKNFRTEHYEEQIEAFKSIIQEKTSNFNAAISLKFTPTETNKAEQCCEETASSISLHGKGSFRFSYSKNETYQLFLSYSSKKEKMFLHVKGEIHLGRFVMRNRDVVLTTTFVDDIKALPTTYEKGEYFAFLETYGTHYSSSGSLGGLYELIYVLDKASMKRKGVELKDIKRCLGYHLDVSLAFSEISVGAEFNKDDCVKRGEGRAVNITSENLIDDVVSLIRGGTRKYAFELKEKLLRGTVIDVTDFVNWASSINDAPVLISQKLSPIYNLVPVKMKNAHLKKQNLERAIEDYINEFSVRKCHTCQNGGTVILMDGKCLCACPFKFEGIACEISKQKISEGLPALEFPNEK

SEQ ID NO: 901433 - protein, 456 aa, Homo sapiens; identical to SEQ ID NO: 901426

SEQ ID NO: 901434 - protein, 456 aa, Homo sapiens; identical to SEQ ID NO: 901426

SEQ ID NO: 901435 - protein, 424 aa, Homo sapiens
EGEDEWGNEFEGSTGRGRKRGVGCGEKDGGEEEEEERGGRDRGGEEGELAGTGGYGINILGMDPLSTPFDNEFYNGLCNRDRDGNTLTYYRRPWNVASLIYETKGEKNFRTEHYEEQIEAFKSIIQEKTSNFNAAISLKFTPTETNKAEQCCEETASSISLHGKGSFRFSYSKNETYQLFLSYSSKKEKMFLHVKGEIHLGRFVMRNRDVVLTTTFVDDIKALPTTYEKGEYFAFLETYGTHYSSSGSLGGLYELIYVLDKASMKRKGVELKDIKRCLGYHLDVSLAFSEISVGAEFNKDDCVKRGEGRAVNITSENLIDDVVSLIRGGTRKYAFELKEKLLRGTVIDVTDFVNWASSINDAPVLISQKLSPIYNLVPVKMKNAHLKKQNLERAIEDYINEFSVRKCHTCQNGGLPALEFPNEK

SEQ ID NO: 901436 - protein, 258 aa, Homo sapiens
EGEDEWGNEFEGSTGRGRKRGVGCGEKDGGEEEEEERGGRDRGGEEGELAGTGGYGINILGMDPLSTPFDNEFYNGLCNRDRDGNTLTYYRRPWNVASLIYETKGEKNFRTEHYEEQIEAFKSIIQEKTSNFNAAISLKFTPTETNKAEQCCEETASSISLHGKGSFRFSYSKNETYQLFLSYSSKKEKMFLHVKGEIHLGRFVMRNRDVVLTTTFVDDIKALPTTYAGSLGGLYELIYVLDKASMKRKGMPRNRALT

SEQ ID NO: 901437 - protein, 1312 aa, Homo sapiens
MKALDEPPYLTVGTDVSAKYRGAFCEAKIKTAKRLVKVKVTFRHDSSTVEVQDDHIKGPLKVGAIVEVKNLDGAYQEAVINKLTDASWYTVVFDDGDEKTLRRSSLCLKGERHFAESETLDQLPLTNPEHFGTPVIGKKTNRGRRSNHIPEEESSSSSSDEDEDDRKQIDELLGKVVCVDYISLDKKKALWFPALVVCPDCSDEIAVKKDNILVRSFKDGKFTSVPRKDVHEITSDTAPKPDAVLKQAFEQALEFHKSRTIPANWKTELKEDSSSSEAEEEEEEEDDEKEKEDNSSEEEEEIEPFPEERENFLQQLYKFMEDRGTPINKRPVLGYRNLNLFKLFRLVHKLGGFDNIESGAVWKQVYQDLGIPVLNSAAGYNVKCAYKKYLYGFEEYCRSANIEFQMALPEKVVNKQCKECENVKEIKVKEENETEIKEIKMEEERNIIPREEKPIEDEIERKENIKPSLGSKKNLLESIPTHSDQEKEVNIKKPEDNENLDDKDDDTTRVDESLNIKVEAEEEKAKSGDETNKEEDEDDEEAEEEEEEEEEEEDEDDDDNNEEEEFECYPPGMKVQVRYGRGKNQKMYEASIKDSDVEGGEVLYLVHYCGWNVRYDEWIKADKIVRPADKNVPKIKHRKKIKNKLDKEKDKDEKYSPKNCKLRRLSKPPFQTNPSPEMVSKLDLTDAKNSDTAHIKSIEITSILNGLQASESSAEDSEQEDERGAQDMDNNGKEESKIDHLTNNRNDLISKEEQNSSSLLEENKVHADLVISKPVSKSPERLRKDIEVLSEDTDYEEDEVTKKRKDVKKDTTDKSSKPQIKRGKRRYCNTEECLKTGSPGKKEEKAKNKESLCMENSSNSSSDEDEEETKAKMTPTKKYNGLEEKRKSLRTTGFYSGFSEVAEKRIKLLNNSDERLQNSRAKDRKDVWSSIQGQWPKKTLKELFSDSDTEAAASPPHPAPEEGVAEESLQTVAEEESCSPSVELEKPPPVNVDSKPIEEKTVEVNDRKAEFPSSGSNSVLNTPPTTPESPSSVTVTEGSRQQSSVTVSEPLAPNQEEVRSIKSETDSTIEVDSVAGELQDLQSEGNSSPAGFDASVSSSSSNQPEPEHPEKACTGQKRVKDAQGGGSSSKKQKRSHKATVVNNKKKGKGTNSSDSEELSAGESITKSQPVKSVSTGMKSHSTKSPARTQSPGKCGKNGDKDPDLKEPSNRLPKVYKWSFQMSDLENMTSAERITILQEKLQEIRKHYLSLKSEVASIDRRRKRLKKKERESAATSSSSSSPSSSSITAAVMLTLAEPSMSSASQNGMSVECR

SEQ ID NO: 901438 - protein, 125 aa, Homo sapiens
MKALDEPPYLTVGTDVSAKYRGAFCEAKIKTAKRLVKVKVTFRHDSSTVEVQDDHIKGPLKVGAIVEVKNLDGAYQEAVINKLTDASWYTVVFDDGDEKTLRRSSLCLKGERHFAESEVSHHLTN

SEQ ID NO: 901439 - protein, 1344 aa, Homo sapiens
MKAGVQWCNLSLLQSPSPEFKQFCLSLLSSCDYKALDEPPYLTVGTDVSAKYRGAFCEAKIKTAKRLVKVKVTFRHDSSTVEVQDDHIKGPLKVGAIVEVKNLDGAYQEAVINKLTDASWYTVVFDDGDEKTLRRSSLCLKGERHFAESETLDQLPLTNPEHFGTPVIGKKTNRGRRSNHIPEEESSSSSSDEDEDDRKQIDELLGKVVCVDYISLDKKKALWFPALVVCPDCSDEIAVKKDNILVRSFKDGKFTSVPRKDVHEITSDTAPKPDAVLKQAFEQALEFHKSRTIPANWKTELKEDSSSSEAEEEEEEEDDEKEKEDNSSEEEEEIEPFPEERENFLQQLYKFMEDRGTPINKRPVLGYRNLNLFKLFRLVHKLGGFDNIESGAVWKQVYQDLGIPVLNSAAGYNVKCAYKKYLYGFEEYCRSANIEFQMALPEKVVNKQCKECENVKEIKVKEENETEIKEIKMEEERNIIPREEKPIEDEIERKENIKPSLGSKKNLLESIPTHSDQEKEVNIKKPEDNENLDDKDDDTTRVDESLNIKVEAEEEKAKSGDETNKEEDEDDEEAEEEEEEEEEEEDEDDDDNNEEEEFECYPPGMKVQVRYGRGKNQKMYEASIKDSDVEGGEVLYLVHYCGWNVRYDEWIKADKIVRPADKNVPKIKHRKKIKNKLDKEKDKDEKYSPKNCKLRRLSKPPFQTNPSPEMVSKLDLTDAKNSDTAHIKSIEITSILNGLQASESSAEDSEQEDERGAQDMDNNGKEESKIDHLTNNRNDLISKEEQNSSSLLEENKVHADLVISKPVSKSPERLRKDIEVLSEDTDYEEDEVTKKRKDVKKDTTDKSSKPQIKRGKRRYCNTEECLKTGSPGKKEEKAKNKESLCMENSSNSSSDEDEEETKAKMTPTKKYNGLEEKRKSLRTTGFYSGFSEVAEKRIKLLNNSDERLQNSRAKDRKDVWSSIQGQWPKKTLKELFSDSDTEAAASPPHPAPEEGVAEESLQTVAEEESCSPSVELEKPPPVNVDSKPIEEKTVEVNDRKAEFPSSGSNSVLNTPPTTPESPSSVTVTEGSRQQSSVTVSEPLAPNQEEVRSIKSETDSTIEVDSVAGELQDLQSEGNSSPAGFDASVSSSSSNQPEPEHPEKACTGQKRVKDAQGGGSSSKKQKRSHKATVVNNKKKGKGTNSSDSEELSAGESITKSQPVKSVSTGMKSHSTKSPARTQSPGKCGKNGDKDPDLKEPSNRLPKVYKWSFQMSDLENMTSAERITILQEKLQEIRKHYLSLKSEVASIDRRRKRLKKKERESAATSSSSSSPSSSSITAAVMLTLAEPSMSSASQNGMSVECR

SEQ ID NO: 901440 - protein, 1119 aa, Homo sapiens
RCLPVSRVRSEELGRRSGGRLLSFILPPPRPPPGPLPGGSCRGSIAAVLWRAARLGARTSSPGGIFRRPPPPNQGARAAAKQRYQSPPREEEDDEKEKEDNSSEEEEEIEPFPEERENFLQQLYKFMEDRGTPINKRPVLGYRNLNLFKLFRLVHKLGGFDNIESGAVWKQVYQDLGIPVLNSAAGYNVKCAYKKYLYGFEEYCRSANIEFQMALPEKVVNKQCKECENVKEIKVKEENETEIKEIKMEEERNIIPREEKPIEDEIERKENIKPSLGSKKNLLESIPTHSDQEKEVNIKKPEDNENLDDKDDDTTRVDESLNIKVEAEEEKAKSGDETNKEEDEDDEEAEEEEEEEEEEEDEDDDDNNEEEEFECYPPGMKVQVRYGRGKNQKMYEASIKDSDVEGGEVLYLVHYCGWNVRYDEWIKADKIVRPADKNVPKIKHRKKIKNKLDKEKDKDEKYSPKNCKLRRLSKPPFQTNPSPEMVSKLDLTDAKNSDTAHIKSIEITSILNGLQASESSAEDSEQEDERGAQDMDNNGKEESKIDHLTNNRNDLISKEEQNSSSLLEENKVHADLVISKPVSKSPERLRKDIEVLSEDTDYEEDEVTKKRKDVKKDTTDKSSKPQIKRGKRRYCNTEECLKTGSPGKKEEKAKNKESLCMENSSNSSSDEDEEETKAKMTPTKKYNGLEEKRKSLRTTGFYSGFSEVAEKRIKLLNNSDERLQNSRAKDRKDVWSSIQGQWPKKTLKELFSDSDTEAAASPPHPAPEEGVAEESLQTVAEEESCSPSVELEKPPPVNVDSKPIEEKTVEVNDRKAEFPSSGSNSVLNTPPTTPESPSSVTVTEGSRQQSSVTVSEPLAPNQEEVRSIKSETDSTIEVDSVAGELQDLQSEGNSSPAGFDASVSSSSSNQPEPEHPEKACTGQKRVKDAQGGGSSSKKQKRSHKATVVNNKKKGKGTNSSDSEELSAGESITKSQPVKSVSTGMKSHSTKSPARTQSPGKCGKNGDKDPDLKEPSNRLPKVYKWSFQMSDLENMTSAERITILQEKLQEIRKHYLSLKSEVASIDRRRKRLKKKERESAATSSSSSSPSSSSITAAVMLTLAEPSMSSASQNGMSVECR

SEQ ID NO: 901441 - protein, 1814 aa, Homo sapiens
MKALDEPPYLTVGTDVSAKYRGAFCEAKIKTAKRLVKVKVTFRHDSSTVEVQDDHIKGPLKVGAIVEVKNLDGAYQEAVINKLTDASWYTVVFDDGDEKTLRRSSLCLKGERHFAESETLDQLPLTNPEHFGTPVIGKKTNRGRRSNHIPEEESSSSSSDEDEDDRKQIDELLGKVVCVDYISLDKKKALWFPALVVCPDCSDEIAVKKDNILVRSFKDGKFTSVPRKDVHEITSDTAPKPDAVLKQAFEQALEFHKSRTIPANWKTELKEDSSSSEAEEEEEEEDDEKEKEDNSSEEEEEIEPFPEERENFLQQLYKFMEDRGTPINKRPVLGYRNLNLFKLFRLVHKLGGFDNIESGAVWKQVYQDLGIPVLNSAAGYNVKCAYKKYLYGFEEYCRSANIEFQMALPEKVVNKQCKECENVKEIKVKEENETEIKEIKMEEERNIIPREEKPIEDEIERKENIKPSLGSKKNLLESIPTHSDQEKEVNIKKPEDNENLDDKDDDTTRVDESLNIKVEAEEEKAKSGDETNKEEDEDDEEAEEEEEEEEEEEDEDDDDNNEEEEFECYPPGMKVQVRYGRGKNQKMYEASIKDSDVEGGEVLYLVHYCGWNVRYDEWIKADKIVRPADKNVPKIKHRKKIKNKLDKEKDKDEKYSPKNCKLRRLSKPPFQTNPSPEMVSKLDLTDAKNSDTAHIKSIEITSILNGLQASESSAEDSEQEDERGAQDMDNNGKEESKIDHLTNNRNDLISKEEQNSSSLLEENKVHADLVISKPVSKSPERLRKDIEVLSEDTDYEEDEVTKKRKDVKKDTTDKSSKPQIKRGKRRYCNTEECLKTGSPGKKEEKAKNKESLCMENSSNSSSDEDEEETKAKMTPTKKYNGLEEKRKSLRTTGFYSGFSEVAEKRIKLLNNSDERLQNSRAKDRKDVWSSIQGQWPKKTLKELFSDSDTEAAASPPHPAPEEGVAEESLQTVAEEESCSPSVELEKPPPVNVDSKPIEEKTVEVNDRKAEFPSSGSNSVLNTPPTTPESPSSVTVTEGSRQQSSVTVSEPLAPNQEEVRSIKSETDSTIEVDSVAGELQDLQSEGNSSPAGFDASVSSSSSNQPEPEHPEKACTGQKRVKDAQGGGSSSKKQKRSHKATVVNNKKKGKGTNSSDSEELSAGESITKSQPVKSVSTGMKSHSTKSPARTQSPGKCGKNGDKDPDLKEPSNRLPKVYKWSFQMSDLENMTSAERITILQEKLQEIRKHYLSLKSEVASIDRRRKRLKKKERESAATSSSSSSPSSSSITAAVMLTLAEPSMSSASQNGMLQPLPEDVLHSQNEAFLKRRGPPTDGDKPAPSPSASLRRRPAADCRRGGGVARERKCPETRKCELARSCSLGVFGVRMALEGMSKRKRKRSVQEGENPDDGVRGSPPEDYRLGQVASSLFRGEHHSRGGTGRLASLFSSLEPQIQPVYVPVPKQTIKKTKRNEEEESTSQIERPLSQEPAKKVKAKKKHTNAEKKLADRESALASADLEEEIHQKQGQKRKNSQPGVKVADRKILDDTEDTVVSQRKKIQINQEEERLKNERTVFVGNLPVTCNKKKLKSFFKEYGQIESVRFRSLIPAEGTLSKKLAAIKRKIHPDQKNINAYVVFKEESAATQALKRNGAQIADGFRIRVDLASETSSRDKRSVFVGNLPYKVEESAIEKHFLDCGSIMAVRIVRDKMTGIGKGFGYVLFENTDSVHLALKLNNSELMGRKLRVMRSVNKEKFKQQNSNPRLKNVSKPKQGLNFTSKTAEGHPKSLFIGEKAVLLKTKKKGQKKSGRPKKQRKQK

SEQ ID NO: 901442 - protein, 1814 aa, Homo sapiens; identical to SEQ ID NO: 901441

SEQ ID NO: 901443 - protein, 1609 aa, Homo sapiens
MKALDEPPYLTVGTDVSAKYRGAFCEAKIKTAKRLVKVKVTFRHDSSTVEVQDDHIKGPLKVGAIVEVKNLDGAYQEAVINKLTDASWYTVVFDDGDEKTLRRSSLCLKGERHFAESETLDQLPLTNPEHFGTPVIGKKTNRGRRSNHIPEEESSSSSSDEDEDDRKQIDELLGKVVCVDYISLDKKKALWFPALVVCPDCSDEIAVKKDNILVRSFKDGKFTSVPRKDVHEITSDTAPKPDAVLKQAFEQALEFHKSRTIPANWKTELKEDSSSSEAEEEEEEEDDEKEKEDNSSEEEEEIEPFPEERENFLQQLYKFMEDRGTPINKRPVLGYRNLNLFKLFRLVHKLGGFDNIESGAVWKQVYQDLGIPVLNSAAGYNVKCAYKKYLYGFEEYCRSANIEFQMALPEKVVNKQCKECENVKEIKVKEENETEIKEIKMEEERNIIPREEKPIEDEIERKENIKPSLGSKKNLLESIPTHSDQEKEVNIKKPEDNENLDDKDDDTTRVDESLNIKVEAEEEKAKSGDETNKEEDEDDEEAEEEEEEEEEEEDEDDDDNNEEEEFECYPPGMKVQVRYGRGKNQKMYEASIKDSDVEGGEVLYLVHYCGWNVRYDEWIKADKIVRPADKNVPKIKHRKKIKNKLDKEKDKDEKYSPKNCKLRRLSKPPFQTNPSPEMVSKLDLTDAKNSDTAHIKSIEITSILNGLQASESSAEDSEQEDERGAQDMDNNGKEESKIDHLTNNRNDLISKEEQNSSSLLEENKVHADLVISKPVSKSPERLRKDIEVLSEDTDYEEDEVTKKRKDVKKDTTDKSSKPQIKRGKRRYCNTEECLKTGSPGKKEEKAKNKESLCMENSSNSSSDEDEEETKAKMTPTKKYNGLEEKRKSLRTTGFYSGFSEVAEKRIKLLNNSDERLQNSRAKDRKDVWSSIQGQWPKKTLKELFSDSDTEAAASPPHPAPEEGVAEESLQTVAEEESCSPSVELEKPPPVNVDSKPIEEKTVEVNDRKAEFPSSGSNSVLNTPPTTPESPSSVTVTEGSRQQSSVTVSEPLAPNQEEVRSIKSETDSTIEVDSVAGELQDLQSEGNSSPAGFDASVSSSSSNQPEPEHPEKACTGQKRVKDAQGGGSSSKKQKRSHKATVVNNKKKGKGTNSSDSEELSAGESITKSQPVKSVSTGMKSHSTKSPARTQSPGKCGKNGDKDPDLKEPSNRLPKVYKWSFQMSDLENMTSAERITILQEKLQEIRKHYLSLKSEVASIDRRRKRLKKKERESAATSSSSSSPSSSSITAAVMLTLAEPSMSSASQNGMLQPLPEDVLHSQNEAFLKRRGPPTDGDKPAPSPSASLRRRPAADCRRGGGVARERKCPETRKCELARSCSLGVFGVRMALEGMSKRKRKRSVQEGENPDDGVRGSPPEDYRLGQVASSLFRGEHHSRGGTGRLASLFSSLEPQIQPVYVPVPKQTIKKTKRNEEEESTSQIERPLSQEPAKKVKAKKKHTNAEKKLADRESALASADLEEEIHQKQGQKRKNSQPGVKVADRKILDDTEDTVVSQRKKIQINQEEERLKNERTVFVGNLPVTCNKKKLKSFFKEYGQIESVRFRSLVCFIPP

SEQ ID NO: 901444 - protein, 1644 aa, Homo sapiens
MKALDEPPYLTVGTDVSAKYRGAFCEAKIKTAKRLVKVKVTFRHDSSTVEVQDDHIKGPLKVGAIVEVKNLDGAYQEAVINKLTDASWYTVVFDDGDEKTLRRSSLCLKGERHFAESETLDQLPLTNPEHFGTPVIGKKTNRGRRSNHIPEEESSSSSSDEDEDDRKQIDELLGKVVCVDYISLDKKKALWFPALVVCPDCSDEIAVKKDNILVRSFKDGKFTSVPRKDVHEITSDTAPKPDAVLKQAFEQALEFHKSRTIPANWKTELKEDSSSSEAEEEEEEEDDEKEKEDNSSEEEEEIEPFPEERENFLQQLYKFMEDRGTPINKRPVLGYRNLNLFKLFRLVHKLGGFDNIESGAVWKQVYQDLGIPVLNSAAGYNVKCAYKKYLYGFEEYCRSANIEFQMALPEKVVNKQCKECENVKEIKVKEENETEIKEIKMEEERNIIPREEKPIEDEIERKENIKPSLGSKKNLLESIPTHSDQEKEVNIKKPEDNENLDDKDDDTTRVDESLNIKVEAEEEKAKSGDETNKEEDEDDEEAEEEEEEEEEEEDEDDDDNNEEEEFECYPPGMKVQVRYGRGKNQKMYEASIKDSDVEGGEVLYLVHYCGWNVRYDEWIKADKIVRPADKNVPKIKHRKKIKNKLDKEKDKDEKYSPKNCKLRRLSKPPFQTNPSPEMVSKLDLTDAKNSDTAHIKSIEITSILNGLQASESSAEDSEQEDERGAQDMDNNGKEESKIDHLTNNRNDLISKEEQNSSSLLEENKVHADLVISKPVSKSPERLRKDIEVLSEDTDYEEDEVTKKRKDVKKDTTDKSSKPQIKRGKRRYCNTEECLKTGSPGKKEEKAKNKESLCMENSSNSSSDEDEEETKAKMTPTKKYNGLEEKRKSLRTTGFYSGFSEVAEKRIKLLNNSDERLQNSRAKDRKDVWSSIQGQWPKKTLKELFSDSDTEAAASPPHPAPEEGVAEESLQTVAEEESCSPSVELEKPPPVNVDSKPIEEKTVEVNDRKAEFPSSGSNSVLNTPPTTPESPSSVTVTEGSRQQSSVTVSEPLAPNQEEVRSIKSETDSTIEVDSVAGELQDLQSEGNSSPAGFDASVSSSSSNQPEPEHPEKACTGQKRVKDAQGGGSSSKKQKRSHKATVVNNKKKGKGTNSSDSEELSAGESITKSQPVKSVSTGMKSHSTKSPARTQSPGKCGKNGDKDPDLKEPSNRLPKVYKWSFQMSDLENMTSAERITILQEKLQEIRKHYLSLKSEVASIDRRRKRLKKKERESAATSSSSSSPSSSSITAAVMLTLAEPSMSSASQNGMLQPLPEDVLHSQNEAFLKRRGPPTDGDKPAPSPSASLRRRPAADCRRGGGVARERKCPETRKCELARSCSLGVFGVRMALEGMSKRKRKRSVQEGENPDDGVRGSPPEDYRLGQVASSLFRGEHHSRGGTGRLASLFSSLEPQIQPVYVPVPKQTIKKTKRNEEEESTSQIERPLSQEPAKKVKAKKKHTNAEKKLADRESALASADLEEEIHQKQGQKRKNSQPGVKVADRKILDDTEDTVVSQRKKIQINQEEERLKNERTVFVGNLPVTCNKKKLKSFFKEYGQIESVRFRSLIPAEGTLSKKLAAIKLECNGVISAHRNLRLPGSSDSPASAY

SEQ ID NO: 901445 - protein, 1625 aa, Homo sapiens
MKALDEPPYLTVGTDVSAKYRGAFCEAKIKTAKRLVKVKVTFRHDSSTVEVQDDHIKGPLKVGAIVEVKNLDGAYQEAVINKLTDASWYTVVFDDGDEKTLRRSSLCLKGERHFAESETLDQLPLTNPEHFGTPVIGKKTNRGRRSNHIPEEESSSSSSDEDEDDRKQIDELLGKVVCVDYISLDKKKALWFPALVVCPDCSDEIAVKKDNILVRSFKDGKFTSVPRKDVHEITSDTAPKPDAVLKQAFEQALEFHKSRTIPANWKTELKEDSSSSEAEEEEEEEDDEKEKEDNSSEEEEEIEPFPEERENFLQQLYKFMEDRGTPINKRPVLGYRNLNLFKLFRLVHKLGGFDNIESGAVWKQVYQDLGIPVLNSAAGYNVKCAYKKYLYGFEEYCRSANIEFQMALPEKVVNKQCKECENVKEIKVKEENETEIKEIKMEEERNIIPREEKPIEDEIERKENIKPSLGSKKNLLESIPTHSDQEKEVNIKKPEDNENLDDKDDDTTRVDESLNIKVEAEEEKAKSGDETNKEEDEDDEEAEEEEEEEEEEEDEDDDDNNEEEEFECYPPGMKVQVRYGRGKNQKMYEASIKDSDVEGGEVLYLVHYCGWNVRYDEWIKADKIVRPADKNVPKIKHRKKIKNKLDKEKDKDEKYSPKNCKLRRLSKPPFQTNPSPEMVSKLDLTDAKNSDTAHIKSIEITSILNGLQASESSAEDSEQEDERGAQDMDNNGKEESKIDHLTNNRNDLISKEEQNSSSLLEENKVHADLVISKPVSKSPERLRKDIEVLSEDTDYEEDEVTKKRKDVKKDTTDKSSKPQIKRGKRRYCNTEECLKTGSPGKKEEKAKNKESLCMENSSNSSSDEDEEETKAKMTPTKKYNGLEEKRKSLRTTGFYSGFSEVAEKRIKLLNNSDERLQNSRAKDRKDVWSSIQGQWPKKTLKELFSDSDTEAAASPPHPAPEEGVAEESLQTVAEEESCSPSVELEKPPPVNVDSKPIEEKTVEVNDRKAEFPSSGSNSVLNTPPTTPESPSSVTVTEGSRQQSSVTVSEPLAPNQEEVRSIKSETDSTIEVDSVAGELQDLQSEGNSSPAGFDASVSSSSSNQPEPEHPEKACTGQKRVKDAQGGGSSSKKQKRSHKATVVNNKKKGKGTNSSDSEELSAGESITKSQPVKSVSTGMKSHSTKSPARTQSPGKCGKNGDKDPDLKEPSNRLPKVYKWSFQMSDLENMTSAERITILQEKLQEIRKHYLSLKSEVASIDRRRKRLKKKERESAATSSSSSSPSSSSITAAVMLTLAEPSMSSASQNGMLQPLPEDVLHSQNEAFLKRRGPPTDGDKPAPSPSASLRRRPAADCRRGGGVARERKCPETRKCELARSCSLGVFGVRMALEGMSKRKRKRSVQEGENPDDGVRGSPPEDYRLGQVASSLFRGEHHSRGGTGRLASLFSSLEPQIQPVYVPVPKQTIKKTKRNEEEESTSQIERPLSQEPAKKVKAKKKHTNAEKKLADRESALASADLEEEIHQKQGQKRKNSQPGVKVADRKILDDTEDTVVSQRKKIQINQEEERLKNERTVFVGNLPVTCNKKKLKSFFKEYGQIESVRFRSLIPAEGNAIQKLGDKVKSSDRNF

SEQ ID NO: 901446 - protein, 1485 aa, Homo sapiens
MKALDEPPYLTVGTDVSAKYRGAFCEAKIKTAKRLVKVKVTFRHDSSTVEVQDDHIKGPLKVGAIVEVKNLDGAYQEAVINKLTDASWYTVVFDDGDEKTLRRSSLCLKGERHFAESETLDQLPLTNPEHFGTPVIGKKTNRGRRSNHIPEEESSSSSSDEDEDDRKQIDELLGKVVCVDYISLDKKKALWFPALVVCPDCSDEIAVKKDNILVRSFKDGKFTSVPRKDVHEITSDTAPKPDAVLKQAFEQALEFHKSRTIPANWKTELKEDSSSSEAEEEEEEEDDEKEKEDNSSEEEEEIEPFPEERENFLQQLYKFMEDRGTPINKRPVLGYRNLNLFKLFRLVHKLGGFDNIESGAVWKQVYQDLGIPVLNSAAGYNVKCAYKKYLYGFEEYCRSANIEFQMALPEKVVNKQCKECENVKEIKVKEENETEIKEIKMEEERNIIPREEKPIEDEIERKENIKPSLGSKKNLLESIPTHSDQEKEVNIKKPEDNENLDDKDDDTTRVDESLNIKVEAEEEKAKSGDETNKEEDEDDEEAEEEEEEEEEEEDEDDDDNNEEEEFECYPPGMKVQVRYGRGKNQKMYEASIKDSDVEGGEVLYLVHYCGWNVRYDEWIKADKIVRPADKNVPKIKHRKKIKNKLDKEKDKDEKYSPKNCKLRRLSKPPFQTNPSPEMVSKLDLTDAKNSDTAHIKSIEITSILNGLQASESSAEDSEQEDERGAQDMDNNGKEESKIDHLTNNRNDLISKEEQNSSSLLEENKVHADLVISKPVSKSPERLRKDIEVLSEDTDYEEDEVTKKRKDVKKDTTDKSSKPQIKRGKRRYCNTEECLKTGSPGKKEEKAKNKESLCMENSSNSSSDEDEEETKAKMTPTKKYNGLEEKRKSLRTTGFYSGFSEVAEKRIKLLNNSDERLQNSRAKDRKDVWSSIQGQWPKKTLKELFSDSDTEAAASPPHPAPEEGVAEESLQTVAEEESCSPSVELEKPPPVNVDSKPIEEKTVEVNDRKAEFPSSGSNSVLNTPPTTPESPSSVTVTEGSRQQSSVTVSEPLAPNQEEVRSIKSETDSTIEVDSVAGELQDLQSEGNSSPAGFDASVSSSSSNQPEPEHPEKACTGQKRVKDAQGGGSSSKKQKRSHKATVVNNKKKGKGTNSSDSEELSAGESITKSQPVKSVSTGMKSHSTKSPARTQSPGKCGKNGDKDPDLKEPSNRLPKVYKWSFQMSDLENMTSAERITILQEKLQEIRKHYLSLKSEVASIDRRRKRLKKKERESAATSSSSSSPSSSSITAAVMLTLAEPSMSSASQNGMLQPLPEDVLHSQNEAFLKRRGPPTDGDKPAPSPSASLRRRPAADCRRGGGVARERKCPETRKCELARSCSLGVFGVRMALEGMSKRKRKRSVQEGENPDDGVRGSPPEDYRLGQVASSLFRGEHHSRGGTGRLASLFSSLEPQIQPVYVPVPKVSHWAFFPNSSLEPLTYKAIFLPTA

SEQ ID NO: 901447 - protein, 1843 aa, Homo sapiens
MKALDEPPYLTVGTDVSAKYRGAFCEAKIKTAKRLVKVKVTFRHDSSTVEVQDDHIKGPLKVGAIVEVKNLDGAYQEAVINKLTDASWYTVVFDDGDEKTLRRSSLCLKGERHFAESETLDQLPLTNPEHFGTPVIGKKTNRGRRSNHIPEEESSSSSSDEDEDDRKQIDELLGKVVCVDYISLDKKKALWFPALVVCPDCSDEIAVKKDNILVRSFKDGKFTSVPRKDVHEITSDTAPKPDAVLKQAFEQALEFHKSRTIPANWKTELKEDSSSSEAEEEEEEEDDEKEKEDNSSEEEEEIEPFPEERENFLQQLYKFMEDRGTPINKRPVLGYRNLNLFKLFRLVHKLGGFDNIESGAVWKQVYQDLGIPVLNSAAGYNVKCAYKKYLYGFEEYCRSANIEFQMALPEKVVNKQCKECENVKEIKVKEENETEIKEIKMEEERNIIPREEKPIEDEIERKENIKPSLGSKKNLLESIPTHSDQEKEVNIKKPEDNENLDDKDDDTTRVDESLNIKVEAEEEKAKSGDETNKEEDEDDEEAEEEEEEEEEEEDEDDDDNNEEEEFECYPPGMKVQVRYGRGKNQKMYEASIKDSDVEGGEVLYLVHYCGWNVRYDEWIKADKIVRPADKNVPKIKHRKKIKNKLDKEKDKDEKYSPKNCKLRRLSKPPFQTNPSPEMVSKLDLTDAKNSDTAHIKSIEITSILNGLQASESSAEDSEQEDERGAQDMDNNGKEESKIDHLTNNRNDLISKEEQNSSSLLEENKVHADLVISKPVSKSPERLRKDIEVLSEDTDYEEDEVTKKRKDVKKDTTDKSSKPQIKRGKRRYCNTEECLKTGSPGKKEEKAKNKESLCMENSSNSSSDEDEEETKAKMTPTKKYNGLEEKRKSLRTTGFYSGFSEVAEKRIKLLNNSDERLQNSRAKDRKDVWSSIQGQWPKKTLKELFSDSDTEAAASPPHPAPEEGVAEESLQTVAEEESCSPSVELEKPPPVNVDSKPIEEKTVEVNDRKAEFPSSGSNSVLNTPPTTPESPSSVTVTEGSRQQSSVTVSEPLAPNQEEVRSIKSETDSTIEVDSVAGELQDLQSEGNSSPAGFDASVSSSSSNQPEPEHPEKACTGQKRVKDAQGGGSSSKKQKRSHKATVVNNKKKGKGTNSSDSEELSAGESITKSQPVKSVSTGMKSHSTKSPARTQSPGKCGKNGDKDPDLKEPSNRLPKVYKWSFQMSDLENMTSAERITILQEKLQEIRKHYLSLKSEVASIDRRRKRLKKKERESAATSSSSSSPSSSSITAAVMLTLAEPSMSSASQNGMLQPLPEDVLHSQNEAFLKRRGPPTDGDKPAPSPSASLRRRPAADCRRGGGVARERKCPETRKCELARSCSLGVFGVRMALEGMSKRKRKRSVQEGENPDDGVRGSPPEDYRLGQVASSLFRGEHHSRGGTGRLASLFSSLEPQIQPVYVPVPKQTIKKTKRNEEEESTSQIERPLSQEPAKKVKAKKKHTNAEKKLADSSPFRLMLRPCLSISSNTLYCIYRFTIYFWESALASADLEEEIHQKQGQKRKNSQPGVKVADRKILDDTEDTVVSQRKKIQINQEEERLKNERTVFVGNLPVTCNKKKLKSFFKEYGQIESVRFRSLIPAEGTLSKKLAAIKRKIHPDQKNINAYVVFKEESAATQALKRNGAQIADGFRIRVDLASETSSRDKRSVFVGNLPYKVEESAIEKHFLDCGSIMAVRIVRDKMTGIGKGFGYVLFENTDSVHLALKLNNSELMGRKLRVMRSVNKEKFKQQNSNPRLKNVSKPKQGLNFTSKTAEGHPKSLFIGEKAVLLKTKKKGQKKSGRPKKQRKQK

SEQ ID NO: 901448 - protein, 1382 aa, Homo sapiens
MKALDEPPYLTVGTDVSAKYRGAFCEAKIKTAKRLVKVKVTFRHDSSTVEVQDDHIKGPLKVGAIVEVKNLDGAYQEAVINKLTDASWYTVVFDDGDEKTLRRSSLCLKGERHFAESETLDQLPLTNPEHFGTPVIGKKTNRGRRSNHIPEEESSSSSSDEDEDDRKQIDELLGKVVCVDYISLDKKKALWFPALVVCPDCSDEIAVKKDNILVRSFKDGKFTSVPRKDVHEITSDTAPKPDAVLKQAFEQALEFHKSRTIPANWKTELKEDSSSSEAEEEEEEEDDEKEKEDNSSEEEEEIEPFPEERENFLQQLYKFMEDRGTPINKRPVLGYRNLNLFKLFRLVHKLGGFDNIESGAVWKQVYQDLGIPVLNSAAGYNVKCAYKKYLYGFEEYCRSANIEFQMALPEKVVNKQCKECENVKEIKVKEENETEIKEIKMEEERNIIPREEKPIEDEIERKENIKPSLGSKKNLLESIPTHSDQEKEVNIKKPEDNENLDDKDDDTTRVDESLNIKVEAEEEKAKSGDETNKEEDEDDEEAEEEEEEEEEEEDEDDDDNNEEEEFECYPPGMKVQVRYGRGKNQKMYEASIKDSDVEGGEVLYLVHYCGWNVRYDEWIKADKIVRPADKNVPKIKHRKKIKNKLDKEKDKDEKYSPKNCKLRRLSKPPFQTNPSPEMVSKLDLTDAKNSDTAHIKSIEITSILNGLQASESSAEDSEQEDERGAQDMDNNGKEESKIDHLTNNRNDLISKEEQNSSSLLEENKVHADLVISKPVSKSPERLRKDIEVLSEDTDYEEDEVTKKRKDVKKDTTDKSSKPQIKRGKRRYCNTEECLKTGSPGKKEEKAKNKESLCMENSSNSSSDEDEEETKAKMTPTKKYNGLEEKRKSLRTTGFYSGFSEVAEKRIKLLNNSDERLQNSRAKDRKDVWSSIQGQWPKKTLKELFSDSDTEAAASPPHPAPEEGVAEESLQTVAEEESCSPSVELEKPPPVNVDSKPIEEKTVEVNDRKAEFPSSGSNSVLNTPPTTPESPSSVTVTEGSRQQSSVTVSEPLAPNQEEVRSIKSETDSTIEVDSVAGELQDLQSEGNSSPAGFDASVSSSSSNQPEPEHPEKACTGQKRVKDAQGGGSSSKKQKRSHKATVVNNKKKGKGTNSSDSEELSAGESITKSQPVKSVSTGMKSHSTKSPARTQSPGKCGKNGDKDPDLKEPSNRLPKVYKWSFQMSDLENMTSAERITILQEKLQEIRKHYLSLKSEVASIDRRRKRLKKKERESAATSSSSSSPSSSSITAAVMLTLAEPSMSSASQNGMLQPLPEDVLHSQNEAFLKRRGPPTDGDKPAPSPSASLRRRPAADCRRGGGVARERKCPEPGSASWRAAAVWESLE

SEQ ID NO: 901449 - protein, 1516 aa, Homo sapiens
MKALDEPPYLTVGTDVSAKYRGAFCEAKIKTAKRLVKVKVTFRHDSSTVEVQDDHIKGPLKVGAIVEVKNLDGAYQEAVINKLTDASWYTVVFDDGDEKTLRRSSLCLKGERHFAESETLDQLPLTNPEHFGTPVIGKKTNRGRRSNHIPEEESSSSSSDEDEDDRKQIDELLGKVVCVDYISLDKKKALWFPALVVCPDCSDEIAVKKDNILVRSFKDGKFTSVPRKDVHEITSDTAPKPDAVLKQAFEQALEFHKSRTIPANWKTELKEDSSSSEAEEEEEEEDDEKEKEDNSSEEEEEIEPFPEERENFLQQLYKFMEDRGTPINKRPVLGYRNLNLFKLFRLVHKLGGFDNIESGAVWKQVYQDLGIPVLNSAAGYNVKCAYKKYLYGFEEYCRSANIEFQMALPEKVVNKQCKECENVKEIKVKEENETEIKEIKMEEERNIIPREEKPIEDEIERKENIKPSLGSKKNLLESIPTHSDQEKEVNIKKPEDNENLDDKDDDTTRVDESLNIKVEAEEEKAKSGDETNKEEDEDDEEAEEEEEEEEEEEDEDDDDNNEEEEFECYPPGMKVQVRYGRGKNQKMYEASIKDSDVEGGEVLYLVHYCGWNVRYDEWIKADKIVRPADKNVPKIKHRKKIKNKLDKEKDKDEKYSPKNCKLRRLSKPPFQTNPSPEMVSKLDLTDAKNSDTAHIKSIEITSILNGLQASESSAEDSEQEDERGAQDMDNNGKEESKIDHLTNNRNDLISKEEQNSSSLLEENKVHADLVISKPVSKSPERLRKDIEVLSEDTDYEEDEVTKKRKDVKKDTTDKSSKPQIKRGKRRYCNTEECLKTGSPGKKEEKAKNKESLCMENSSNSSSDEDEEETKAKMTPTKKYNGLEEKRKSLRTTGFYSGFSEVAEKRIKLLNNSDERLQNSRAKDRKDVWSSIQGQWPKKTLKELFSDSDTEAAASPPHPAPEEGVAEESLQTVAEEESCSPSVELEKPPPVNVDSKPIEEKTVEVNDRKAEFPSSGSNSVLNTPPTTPESPSSVTVTEGSRQQSSVTVSEPLAPNQEEVRSIKSETDSTIEVDSVAGELQDLQSEGNSSPAGFDASVSSSSSNQPEPEHPEKACTGQKRVKDAQGGGSSSKKQKRSHKATVVNNKKKGKGTNSSDSEELSAGESITKSQPVKSVSTGMKSHSTKSPARTQSPGKCGKNGDKDPDLKEPSNRLPKVYKWSFQMSDLENMTSAERITILQEKLQEIRKHYLSLKSEVASIDRRRKRLKKKERESAATSSSSSSPSSSSITAAVMLTLAEPSMSSASQNGMLQPLPEDVLHSQNEAFLKRRGPPTDGDKPAPSPSASLRRRPAADCRRGGGVARERKCPETRKCELARSCSLGVFGVRMALEGMSKRKRKRSVQEGENPDDGVRGSPPEDYRLGQVASSLFRGEHHSRGGTGRLASLFSSLEPQIQPVYVPVPKQTIKKTKRNEEEESTSQIERPLSQEPAKKVKAKKKHTNAEKKLADRWSLDATPRLQ

SEQ ID NO: 901450 - protein, 1122 aa, Homo sapiens
MKALDEPPYLTVGTDVSAKYRGAFCEAKIKTAKRLVKVKVTFRHDSSTVEVQDDHIKGPLKVGAIVEVKNLDGAYQEAVINKLTDASWYTVVFDDGDEKTLRRSSLCLKGERHFAESETLDQLPLTNPEHFGTPVIGKKTNRGRRSNHIPEEESSSSSSDEDEDDRKQIDELLGKVVCVDYISLDKKKALWFPALVVCPDCSDEIAVKKDNILVRSFKDGKFTSVPRKDVHEITSDTAPKPDAVLKQAFEQALEFHKSRTIPANWKTELKEDSSSSEAEEEEEEEDDEKEKEDNSSEEEEEIEPFPEERENFLQQLYKFMEDRGTPINKRPVLGYRNLNLFKLFRLVHKLGGFDNIESGAVWKQVYQDLGIPVLNSAAGYNVKCAYKKYLYGFEEYCRSANIEFQMALPEKVVNKQCKECENVKEIKVKEENETEIKEIKMEEERNIIPREEKPIEDEIERKENIKPSLGSKKNLLESIPTHSDQEKEVNIKKPEDNENLDDKDDDTTRVDESLNIKVEAEEEKAKSGDETNKEEDEDDEEAEEEEEEEEEEEDEDDDDNNEEEEFECYPPGMKVQVRYGRGKNQKMYEASIKDSDVEGGEVLYLVHYCGWNVRYDEWIKADKIVRPADKNVPKIKHRKKIKNKLDKEKDKDEKYSPKNCKLRRLSKPPFQTNPSPEMVSKLDLTDAKNSDTAHIKSIEITSILNGLQASESSAEDSEQEDERGAQDMDNNGKEESKIDHLTNNRNDLISKEEQNSSSLLEENKVHADLVISKPVSKSPERLRKDIEVLSEDTDYEEDEVTKKRKDVKKDTTDKSSKPQIKRGKRRYCNTEECLKTGSPGKKEEKAKNKESLCMENSSNSSSDEDEEETKAKMTPTKKYNGLEEKRKSLRTTGFYSGFSEVAEKRIKLLNNSDERLQNSRAKDRKDVWSSIQGQWPKKTLKELFSDSDTEAAASPPHPAPEEGVAEESLQTVAEEESCSPSVELEKPPPVNVDSKPIEEKTVEVNDRKAEFPSSGSNSVLNTPPTTPESPSSVTVTEGSRQQSSVTVSEPLAPNQEEVRSIKSETDSTIEVDSVAGELQDLQSEGNSSPAGFDASVSSSSSNQPEPEHPEKGEKENVYVDLF

SEQ ID NO: 901451 - protein, 596 aa, Homo sapiens
MKALDEPPYLTVGTDVSAKYRGAFCEAKIKTAKRLVKVKVTFRHDSSTVEVQDDHIKGPLKVGAIVEVKNLDGAYQEAVINKLTDASWYTVVFDDGDEKTLRRSSLCLKGERHFAESETLDQLPLTNPEHFGTPVIGKKTNRGRRSNHIPEEESSSSSSDEDEDDRKQIDELLGKVVCVDYISLDKKKALWFPALVVCPDCSDEIAVKKDNILVRSFKDGKFTSVPRKDVHEITSDTAPKPDAVLKQAFEQALEFHKSRTIPANWKTELKEDSSSSEAEEEEEEEDDEKEKEDNSSEEEEEIEPFPEERENFLQQLYKFMEDRGTPINKRPVLGYRNLNLFKLFRLVHKLGGFDNIESGAVWKQVYQDLGIPVLNSAAGYNVKCAYKKYLYGFEEYCRSANIEFQMALPEKVVNKQCKECENVKEIKVKEENETEIKEIKMEEERNIIPREEKPIEDEIERKENIKPSLGSKKNLLESIPTHSDQEKEVNIKKPEDNENLDDKDDDTTRVDESLNIKVEAEEEKAKSGDETNKEEDEDDEEAEEEEEEEEEEEDEDDDDNNEEEEFECYPPGMKGIIKLYFLSFFFPLILTLLLIT

SEQ ID NO: 901452 - protein, 444 aa, Homo sapiens
MKALDEPPYLTVGTDVSAKYRGAFCEAKIKTAKRLVKVKVTFRHDSSTVEVQDDHIKGPLKVGAIVEVKNLDGAYQEAVINKLTDASWYTVVFDDGDEKTLRRSSLCLKGERHFAESETLDQLPLTNPEHFGTPVIGKKTNRGRRSNHIPEEESSSSSSDEDEDDRKQIDELLGKVVCVDYISLDKKKALWFPALVVCPDCSDEIAVKKDNILVRSFKDGKFTSVPRKDVHEITSDTAPKPDAVLKQAFEQALEFHKSRTIPANWKTELKEDSSSSEAEEEEEEEDDEKEKEDNSSEEEEEIEPFPEERENFLQQLYKFMEDRGTPINKRPVLGYRNLNLFKLFRLVHKLGGFDNIESGAVWKQVYQDLGIPVLNSAAGYNVKCAYKKYLYGFEEYCRSANIEFQMALPEKVVNKQCKEVARVRKLLGGVYLYETTMHPDTMHC

SEQ ID NO: 901453 - protein, 163 aa, Homo sapiens
MKALDEPPYLTVGTDVSAKYRGAFCEAKIKTAKRLVKVKVTFRHDSSTVEVQDDHIKGPLKVGAIVEVKNLDGAYQEAVINKLTDASWYTVVFDDGDEKTLRRSSLCLKGERHFAESETLDQLPLTNPEHFGTPVIGKKTNRGRRSNHIPEEGEEGGRERERG

SEQ ID NO: 901454 - protein, 155 aa, Homo sapiens
RCLPVSRVRSEELGRRSGGRLLSFILPPPRPPPGPLPGGSCRGSIAAVLWRAARLGARTSSPGGIFRRPPPPNQGARAAAKQRYQSPPREEEEPEPLPQQPLDPPPFFPISPPGLLVLGGRRREGTLDVPGSDLASEEGAAEPGVLEDTLVPESS

SEQ ID NO: 901455 - protein, 1226 aa, Homo sapiens
MKALDEPPYLTVGTDVSAKYRGAFCEAKIKTAKRLVKVKVTFRHDSSTVEVQDDHIKGPLKVGAIVEVKNLDGAYQEAVINKLTDASWYTVVFDDGDEKTLRRSSLCLKGERHFAESETLDQLPLTNPEHFGTPVIGKKTNRGRRSNHIPEEESSSSSSDEDEDDRKQIDELLGKVVCVDYISLDKKKALWFPALVVCPDCSDEIAVKKDNILVRSFKDGKFTSVPRKDVHEITSDTAPKPDAVLKQAFEQALEFHKSRTIPANWKTELKEDSSSSEAEEEEEEEDDEKEKEDNSSEEEEEIEPFPEERENFLQQLYKFMEDRGTPINKRPVLGYRNLNLFKLFRLVHKLGGFDNIESGAVWKQVYQDLGIPVLNSAAGYNVKCAYKKYLYGFEEYCRSANIEFQMALPEKVVNKQCKECENVKEIKVKEENETEIKEIKMEEERNIIPREEKPIEDEIERKENIKPSLGSKKNLLESIPTHSDQEKEVNIKKPEDNENLDDKDDDTTRVDESLNIKVEAEEEKAKSGYDEWIKADKIVRPADKNVPKIKHRKKIKNKLDKEKDKDEKYSPKNCKLRRLSKPPFQTNPSPEMVSKLDLTDAKNSDTAHIKSIEITSILNGLQASESSAEDSEQEDERGAQDMDNNGKEESKIDHLTNNRNDLISKEEQNSSSLLEENKVHADLVISKPVSKSPERLRKDIEVLSEDTDYEEDEVTKKRKDVKKDTTDKSSKPQIKRGKRRYCNTEECLKTGSPGKKEEKAKNKESLCMENSSNSSSDEDEEETKAKMTPTKKYNGLEEKRKSLRTTGFYSGFSEVAEKRIKLLNNSDERLQNSRAKDRKDVWSSIQGQWPKKTLKELFSDSDTEAAASPPHPAPEEGVAEESLQTVAEEESCSPSVELEKPPPVNVDSKPIEEKTVEVNDRKAEFPSSGSNSVLNTPPTTPESPSSVTVTEGSRQQSSVTVSEPLAPNQEEVRSIKSETDSTIEVDSVAGELQDLQSEGNSSPAGFDASVSSSSSNQPEPEHPEKACTGQKRVKDAQGGGSSSKKQKRSHKATVVNNKKKGKGTNSSDSEELSAGESITKSQPVKSVSTGMKSHSTKSPARTQSPGKCGKNGDKDPDLKEPSNRLPKVYKWSFQMSDLENMTSAERITILQEKLQEIRKHYLSLKSEVASIDRRRKRLKKKERESAATSSSSSSPSSSSITAAVMLTLAEPSMSSASQNGMSVECR

SEQ ID NO: 901456 - protein, 960 aa, Homo sapiens
MSSDEFANTMPVRPPTVKRKMNPGLRALWFPALVVCPDCSDEIAVKKDNILVRSFKDGKFTSVPRKDVHEITSDTAPKPDAVLKQAFEQALEFHKSRTIPANWKTELKEDSSSSEAEEEEEEEDDEKEKEDNSSEEEEEIEPFPEERENFLQQLYKFMEDRGTPINKRPVLGYRNLNLFKLFRLVHKLGGFDNIESGAVWKQVYQDLGIPVLNSAAGYNVKCAYKKYLYGFEEYCRSANIEFQMALPEKVVNKQCKECENVKEIKVKEENETEIKEIKMEEERNIIPREEKPIEDEIERKENIKPSLGSKKNLLESIPTHSDQEKEVNIKKPEDNENLDDKDDDTTRVDESLNIKVEAEEEKAKSGDETNKEEDEDDEEAEEEEEEEEEEEDEDDDDNNEEEEFECYPPGMKVQVRYGRGKNQKMYEASIKDSDVEGGEVLYLVHYCGWNVRYDEWIKADKIVRPADKNVPKIKHRKKIKNKLDKEKDKDEKYSPKNCKLRRLSKPPFQTNPSPEMVSKLDLTDAKNSDTAHIKSIEITSILNGLQASESSAEDSEQEDERGAQDMDNNGKEESKIDHLTNNRNDLISKEEQNSSSLLEENKVHADLVISKPVSKSPERLRKDIEVLSEDTDYEEDEVTKKRKDVKKDTTDKSSKPQIKRGKRRYCNTEECLKTGSPGKKEEKAKNKESLCMENSSNSSSDEDEEETKAKMTPTKKYNGLEEKRKSLRTTGFYSGFSEVAEKRIKLLNNSDERLQNSRAKDRKDVWSSIQGQWPKKTLKELFSDSDTEAAASPPHPAPEEGVAEESLQTVAEEESCSPSVELEKPPPVNVDSKPIEEKTVEVNDRKAEFPSSGSNSVLNTPPTTPESPSSVTVTEGSRQQSSVTVSEPLAPNQEEVRSIKSETDSTIEVDSVAGELQDLQSEGNSSPAGFDASVSSSSSNQPEPEHPEKGEKENVYVDLF

SEQ ID NO: 901457 - protein, 144 aa, Homo sapiens
WENDVLSSHDKLLLLFFRNLENDLRFKLAILQVLGNVIRVWEYLYSSLACLFFVRINGNILFFSLPRPEEESSSSSSDEDEDDRKQIDELLGKVVCVDYISLDKKKALWFPALVSSFSIQEFNFKLYKFMKKTIFLLMFFIGTK

SEQ ID NO: 901458 - protein, 993 aa, Homo sapiens
MEDRGTPINKRPVLGYRNLNLFKLFRLVHKLGGFDNIESGAVWKQVYQDLGIPVLNSAAGYNVKCAYKKYLYGFEEYCRSANIEFQMALPEKVVNKQCKECENVKEIKVKEENETEIKEIKMEEERNIIPREEKPIEDEIERKENIKPSLGSKKNLLESIPTHSDQEKEVNIKKPEDNENLDDKDDDTTRVDESLNIKVEAEEEKAKSGDETNKEEDEDDEEAEEEEEEEEEEEDEDDDDNNEEEEFECYPPGMKVQVRYGRGKNQKMYEASIKDSDVEGGEVLYLVHYCGWNVRYDEWIKADKIVRPADKNVPKIKHRKKIKNKLDKEKDKDEKYSPKNCKLRRLSKPPFQTNPSPEMVSKLDLTDAKNSDTAHIKSIEITSILNGLQASESSAEDSEQEDERGAQDMDNNGKEESKIDHLTNNRNDLISKEEQNSSSLLEENKVHADLVISKPVSKSPERLRKDIEVLSEDTDYEEDEVTKKRKDVKKDTTDKSSKPQIKRGKRRYCNTEECLKTGSPGKKEEKAKNKESLCMENSSNSSSDEDEEETKAKMTPTKKYNGLEEKRKSLRTTGFYSGFSEVAEKRIKLLNNSDERLQNSRAKDRKDVWSSIQGQWPKKTLKELFSDSDTEAAASPPHPAPEEGVAEESLQTVAEEESCSPSVELEKPPPVNVDSKPIEEKTVEVNDRKAEFPSSGSNSVLNTPPTTPESPSSVTVTEGSRQQSSVTVSEPLAPNQEEVRSIKSETDSTIEVDSVAGELQDLQSEGNSSPAGFDASVSSSSSNQPEPEHPEKACTGQKRVKDAQGGGSSSKKQKRSHKATVVNNKKKGKGTNSSDSEELSAGESITKSQPVKSVSTGMKSHSTKSPARTQSPGKCGKNGDKDPDLKEPSNRLPKVYKWSFQMSDLENMTSAERITILQEKLQEIRKHYLSLKSEVASIDRRRKRLKKKERESAATSSSSSSPSSSSITAAVMLTLAEPSMSSASQNGMSVECR

SEQ ID NO: 901459 - protein, 1312 aa, Homo sapiens; identical to SEQ ID NO: 901437

SEQ ID NO: 901460 - protein, 1255 aa, Homo sapiens
RGSHSTLHVSAIAQILKAECLAMLGRYPEAQSVASDILRMDPPMQMLCMYEVFALYDEWIKADKIVRPADKNVPKIKHRKKIKNKLDKEKDKDEKYSPKNCKLRRLSKPPFQTNPSPEMVSKLDLTDAKNSDTAHIKSIEITSILNGLQASESSAEDSEQEDERGAQDMDNNGKEESKIDHLTNNRNDLISKEEQNSSSLLEENKVHADLVISKPVSKSPERLRKDIEVLSEDTDYEEDEVTKKRKDVKKDTTDKSSKPQIKRGKRRYCNTEECLKTGSPGKKEEKAKNKESLCMENSSNSSSDEDEEETKAKMTPTKKYNGLEEKRKSLRTTGFYSGFSEVAEKRIKLLNNSDERLQNSRAKDRKDVWSSIQGQWPKKTLKELFSDSDTEAAASPPHPAPEEGVAEESLQTVAEEESCSPSVELEKPPPVNVDSKPIEEKTVEVNDRKAEFPSSGSNSVLNTPPTTPESPSSVTVTEGSRQQSSVTVSEPLAPNQEEVRSIKSETDSTIEVDSVAGELQDLQSEGNSSPAGFDASVSSSSSNQPEPEHPEKACTGQKRVKDAQGGGSSSKKQKRSHKATVVNNKKKGKGTNSSDSEELSAGESITKSQPVKSVSTGMKSHSTKSPARTQSPGKCGKNGDKDPDLKEPSNRLPKVYKWSFQMSDLENMTSAERITILQEKLQEIRKHYLSLKSEVASIDRRRKRLKKKERESAATSSSSSSPSSSSITAAVMLTLAEPSMSSASQNGMLQPLPEDVLHSQNEAFLKRRGPPTDGDKPAPSPSASLRRRPAADCRRGGGVARERKCPETRKCELARSCSLGVFGVRMALEGMSKRKRKRSVQEGENPDDGVRGSPPEDYRLGQVASSLFRGEHHSRGGTGRLASLFSSLEPQIQPVYVPVPKQTIKKTKRNEEEESTSQIERPLSQEPAKKVKAKKKHTNAEKKLADRESALASADLEEEIHQKQGQKRKNSQPGVKVADRKILDDTEDTVVSQRKKIQINQEEERLKNERTVFVGNLPVTCNKKKLKSFFKEYGQIESVRFRSLIPAEGTLSKKLAAIKRKIHPDQKNINAYVVFKEESAATQALKRNGAQIADGFRIRVDLASETSSRDKRSVFVGNLPYKVEESAIEKHFLDCGSIMAVRIVRDKMTGIGKGFGYVLFENTDSVHLALKLNNSELMGRKLRVMRSVNKEKFKQQNSNPRLKNVSKPKQGLNFTSKTAEGHPKSLFIGEKAVLLKTKKKGQKKSGRPKKQRKQK

SEQ ID NO: 901461 - protein, 1382 aa, Homo sapiens; identical to SEQ ID NO: 901448

SEQ ID NO: 901462 - protein, 1613 aa, Homo sapiens
MKALDEPPYLTVGTDVSAKYRGAFCEAKIKTAKRLVKVKVTFRHDSSTVEVQDDHIKGPLKVGAIVEVKNLDGAYQEAVINKLTDASWYTVVFDDGDEKTLRRSSLCLKGERHFAESETLDQLPLTNPEHFGTPVIGKKTNRGRRSNHIPEEESSSSSSDEDEDDRKQIDELLGKVVCVDYISLDKKKALWFPALVVCPDCSDEIAVKKDNILVRSFKDGKFTSVPRKDVHEITSDTAPKPDAVLKQAFEQALEFHKSRTIPANWKTELKEDSSSSEAEEEEEEEDDEKEKEDNSSEEEEEIEPFPEERENFLQQLYKFMEDRGTPINKRPVLGYRNLNLFKLFRLVHKLGGFDNIESGAVWKQVYQDLGIPVLNSAAGYNVKCAYKKYLYGFEEYCRSANIEFQMALPEKVVNKQCKECENVKEIKVKEENETEIKEIKMEEERNIIPREEKPIEDEIERKENIKPSLGSKKNLLESIPTHSDQEKEVNIKKPEDNENLDDKDDDTTRVDESLNIKVEAEEEKAKSGDETNKEEDEDDEEAEEEEEEEEEEEDEDDDDNNEEEEFECYPPGMKVQVRYGRGKNQKMYEASIKDSDVEGGEVLYLVHYCGWNVRYDEWIKADKIVRPADKNVPKIKHRKKIKNKLDKEKDKDEKYSPKNCKLRRLSKPPFQTNPSPEMVSKLDLTDAKNSDTAHIKSIEITSILNGLQASESSAEDSEQEDERGAQDMDNNGKEESKIDHLTNNRNDLISKEEQNSSSLLEENKVHADLVISKPVSKSPERLRKDIEVLSEDTDYEEDEVTKKRKDVKKDTTDKSSKPQIKRGKRRYCNTEECLKTGSPGKKEEKAKNKESLCMENSSNSSSDEDEEETKAKMTPTKKYNGLEEKRKSLRTTGFYSGFSEVAEKRIKLLNNSDERLQNSRAKDRKDVWSSIQGQWPKKTLKELFSDSDTEAAASPPHPAPEEGVAEESLQTVAEEESCSPSVELEKPPPVNVDSKPIEEKTVEVNDRKAEFPSSGSNSVLNTPPTTPESPSSVTVTEGSRQQSSVTVSEPLAPNQEEVRSIKSETDSTIEVDSVAGELQDLQSEGNSSPAGFDASVSSSSSNQPEPEHPEKACTGQKRVKDAQGGGSSSKKQKRSHKATVVNNKKKGKGTNSSDSEELSAGESITKSQPVKSVSTGMKSHSTKSPARTQSPGKCGKNGDKDPDLKEPSNRLPKVYKWSFQMSDLENMTSAERITILQEKLQEIRKHYLSLKSEVASIDRRRKRLKKKERESAATSSSSSSPSSSSITAAVMLTLAEPSMSSASQNGMLQPLPEDVLHSQNEAFLKRRGPPTDGDKPAPSPSASLRRRPAADCRRGGGVARERKCPETRKCELARSCSLGVFGVRMALEGMSKRKRKRSVQEGENPDDGVRGSPPEDYRLGQVASSLFRGEHHSRGGTGRLASLFSSLEPQIQPVYVPVPKQTIKKTKRNEEEESTSQIERPLSQEPAKKVKAKKKHTNAEKKLADRESALASADLEEEIHQKQGQKRKNSQPGVKVADRKILDDTEDTVVSQRKKIQINQEEERLKNERTVFVGNLPVTCNKKKLKSFFKEYGQIESVRFRSLIPVWREGYRA

SEQ ID NO: 901463 - protein, 1794 aa, Homo sapiens
MKALDEPPYLTVGTDVSAKYRGAFCEAKIKTAKRLVKVKVTFRHDSSTVEVQDDHIKGPLKVGAIVEVKNLDGAYQEAVINKLTDASWYTVVFDDGDEKTLRRSSLCLKGERHFAESETLDQLPLTNPEHFGTPVIGKKTNRGRRSNHIPEEESSSSSSDEDEDDRKQIDELLGKVVCVDYISLDKKKALWFPALVVCPDCSDEIAVKKDNILVRSFKDGKFTSVPRKDVHEITSDTAPKPDAVLKQAFEQALEFHKSRTIPANWKTELKEDSSSSEAEEEEEEEDDEKEKEDNSSEEEEEIEPFPEERENFLQQLYKFMEDRGTPINKRPVLGYRNLNLFKLFRLVHKLGGFDNIESGAVWKQVYQDLGIPVLNSAAGYNVKCAYKKYLYGFEEYCRSANIEFQMALPEKVVNKQCKECENVKEIKVKEENETEIKEIKMEEERNIIPREEKPIEDEIERKENIKPSLGSKKNLLESIPTHSDQEKEVNIKKPEDNENLDDKDDDTTRVDESLNIKVEAEEEKAKSGDETNKEEDEDDEEAEEEEEEEEEEEDEDDDDNNEEEEFECYPPGMKVQVRYGRGKNQKMYEASIKDSDVEGGEVLYLVHYCGWNVRYDEWIKADKIVRPADKNVPKIKHRKKIKNKLDKEKDKDEKYSPKNCKLRRLSKPPFQTNPSPEMVSKLDLTDAKNSDTAHIKSIEITSILNGLQASESSAEDSEQEDERGAQDMDNNGKEESKIDHLTNNRNDLISKEEQNSSSLLEENKVHADLVISKPVSKSPERLRKDIEVLSEDTDYEEDEVTKKRKDVKKDTTDKSSKPQIKRGKRRYCNTEECLKTGSPGKKEEKAKNKESLCMENSSNSSSDEDEEETKAKMTPTKKYNGLEEKRKSLRTTGFYSGFSEVAEKRIKLLNNSDERLQNSRAKDRKDVWSSIQGQWPKKTLKELFSDSDTEAAASPPHPAPEEGVAEESLQTVAEEESCSPSVELEKPPPVNVDSKPIEEKTVEVNDRKAEFPSSGSNSVLNTPPTTPESPSSVTVTEGSRQQSSVTVSEPLAPNQEEVRSIKSETDSTIEVDSVAGELQDLQSEGNSSPAGFDASVSSSSSNQPEPEHPEKACTGQKRVKDAQGGGSSSKKQKRSHKATVVNNKKKGKGTNSSDSEELSAGESITKSQPVKSVSTGMKSHSTKSPARTQSPGKCGKNGDKDPDLKEPSNRLPKVYKWSFQMSDLENMTSAERITILQEKLQEIRKHYLSLKSEVASIDRRRKRLKKKERESAATSSSSSSPSSSSITAAVMLTLAEPSMSSASQNGMLQPLPEDVLHSQNEAFLKRRGPPTDGDKPAPSPSASLRRRPAADCRRGGGVARERKCPETRKCELARSCSLGVFGVRMALEGMSKRKRKRSVQEGENPDDGVRGSPPEDYRLGQVASSLFRGEHHSRGGTGRLASLFSSLEPQIQPVYVPVPKQTIKKTKRNEEEESTSQIERPLSQEPAKKVKAKKKHTNAEKKLADRESALASADLEEEIHQKQGQKRKNSQPGVKVADRKILDDTEDTVVSQRKKIQINQEEERLKNERTVFVGNLPVTCNKKIPAEGTLSKKLAAIKRKIHPDQKNINAYVVFKEESAATQALKRNGAQIADGFRIRVDLASETSSRDKRSVFVGNLPYKVEESAIEKHFLDCGSIMAVRIVRDKMTGIGKGFGYVLFENTDSVHLALKLNNSELMGRKLRVMRSVNKEKFKQQNSNPRLKNVSKPKQGLNFTSKTAEGHPKSLFIGEKAVLLKTKKKGQKKSGRPKKQRKQK

SEQ ID NO: 901464 - protein, 1568 aa, Homo sapiens
MKALDEPPYLTVGTDVSAKYRGAFCEAKIKTAKRLVKVKVTFRHDSSTVEVQDDHIKGPLKVGAIVEVKNLDGAYQEAVINKLTDASWYTVVFDDGDEKTLRRSSLCLKGERHFAESETLDQLPLTNPEHFGTPVIGKKTNRGRRSNHIPEEESSSSSSDEDEDDRKQIDELLGKVVCVDYISLDKKKALWFPALVVCPDCSDEIAVKKDNILVRSFKDGKFTSVPRKDVHEITSDTAPKPDAVLKQAFEQALEFHKSRTIPANWKTELKEDSSSSEAEEEEEEEDDEKEKEDNSSEEEEEIEPFPEERENFLQQLYKFMEDRGTPINKRPVLGYRNLNLFKLFRLVHKLGGFDNIESGAVWKQVYQDLGIPVLNSAAGYNVKCAYKKYLYGFEEYCRSANIEFQMALPEKVVNKQCKECENVKEIKVKEENETEIKEIKMEEERNIIPREEKPIEDEIERKENIKPSLGSKKNLLESIPTHSDQEKEVNIKKPEDNENLDDKDDDTTRVDESLNIKVEAEEEKAKSGDETNKEEDEDDEEAEEEEEEEEEEEDEDDDDNNEEEEFECYPPGMKVQVRYGRGKNQKMYEASIKDSDVEGGEVLYLVHYCGWNVRYDEWIKADKIVRPADKNVPKIKHRKKIKNKLDKEKDKDEKYSPKNCKLRRLSKPPFQTNPSPEMVSKLDLTDAKNSDTAHIKSIEITSILNGLQASESSAEDSEQEDERGAQDMDNNGKEESKIDHLTNNRNDLISKEEQNSSSLLEENKVHADLVISKPVSKSPERLRKDIEVLSEDTDYEEDEVTKKRKDVKKDTTDKSSKPQIKRGKRRYCNTEECLKTGSPGKKEEKAKNKESLCMENSSNSSSDEDEEETKAKMTPTKKYNGLEEKRKSLRTTGFYSGFSEVAEKRIKLLNNSDERLQNSRAKDRKDVWSSIQGQWPKKTLKELFSDSDTEAAASPPHPAPEEGVAEESLQTVAEEESCSPSVELEKPPPVNVDSKPIEEKTVEVNDRKAEFPSSGSNSVLNTPPTTPESPSSVTVTEGSRQQSSVTVSEPLAPNQEEVRSIKSETDSTIEVDSVAGELQDLQSEGNSSPAGFDASVSSSSSNQPEPEHPEKACTGQKRVKDAQGGGSSSKKQKRSHKATVVNNKKKGKGTNSSDSEELSAGESITKSQPVKSVSTGMKSHSTKSPARTQSPGKCGKNGDKDPDLKEPSNRLPKVYKWSFQMSDLENMTSAERITILQEKLQEIRKHYLSLKSEVASIDRRRKRLKKKERESAATSSSSSSPSSSSITAAVMLTLAEPSMSSASQNGMLQPLPEDVLHSQNEAFLKRRGPPTDGDKPAPSPSASLRRRPAADCRRGGGVARERKCPETRKCELARSCSLGVFGVRMALEGMSKRKRKRSVQEGENPDDGVRGSPPEDYRLGQVASSLFRGEHHSRGGTGRLASLFSSLEPQIQPVYVPVPKQTIKKTKRNEEEESTSQIERPLSQEPAKKVKAKKKHTNAEKKLADRLVKFSYLMLKKLDGKLTFLYLEYSSVLFHISTFFQNFYYGKSSTYRKVEKAKKPRVLSISNY

SEQ ID NO: 901465 - protein, 693 aa, Homo sapiens
MANFKLPTKICDKFIVTFLFIKSFLSLSANSSDSEELSAGESITKSQPVKSVSTGMKSHSTKSPARTQSPGKCGKNGDKDPDLKEPSNRLPKVYKWSFQMSDLENMTSAERITILQEKLQEIRKHYLSLKSEVASIDRRRKRLKKKERESAATSSSSSSPSSSSITAAVMLTLAEPSMSSASQNGMLQPLPEDVLHSQNEAFLKRRGPPTDGDKPAPSPSASLRRRPAADCRRGGGVARERKCPETRKCELARSCSLGVFGVRMALEGMSKRKRKRSVQEGENPDDGVRGSPPEDYRLGQVASSLFRGEHHSRGGTGRLASLFSSLEPQIQPVYVPVPKQTIKKTKRNEEEESTSQIERPLSQEPAKKVKAKKKHTNAEKKLADRESALASADLEEEIHQKQGQKRKNSQPGVKVADRKILDDTEDTVVSQRKKIQINQEEERLKNERTVFVGNLPVTCNKKKLKSFFKEYGQIESVRFRSLIPAEGTLSKKLAAIKRKIHPDQKNINAYVVFKEESAATQALKRNGAQIADGFRIRVDLASETSSRDKRSVFVGNLPYKVEESAIEKHFLDCGSIMAVRIVRDKMTGIGKGFGYVLFENTDSVHLALKLNNSELMGRKLRVMRSVNKEKFKQQNSNPRLKNVSKPKQGLNFTSKTAEGHPKSLFIGEKAVLLKTKKKGQKKSGRPKKQRKQK

SEQ ID NO: 901466 - protein, 806 aa, Homo sapiens
MKALDEPPYLTVGTDVSAKYRGAFCEAKIKTAKRLVKVKVTFRHDSSTVEVQDDHIKGPLKVGAIVEVKNLDGAYQEAVINKLTDASWYTVVFDDGDEKTLRRSSLCLKGERHFAESETLDQLPLTNPEHFGTPVIGKKTNRGRRSNHIPEEESSSSSSDEDEDDRKQIDELLGKVVCVDYISLDKKKALWFPALVVCPDCSDEIAVKKDNILVRSFKDGKFTSVPRKDVHEITSDTAPKPDAVLKQAFEQALEFHKSRTIPANWKTELKEDSSSSEAEEEEEEEDDEKEKEDNSSEEEEEIEPFPEERENFLQQLYKFMEDRGTPINKRPVLGYRNLNLFKLFRLVHKLGGFDNIESGAVWKQVYQDLGIPVLNSAAGYNVKCAYKKYLYGFEEYCRSANIEFQMALPEKVVNKQCKECENVKEIKVKEENETEIKEIKMEEERNIIPREEKPIEDEIERKENIKPSLGSKKNLLESIPTHSDQEKEVNIKKPEDNENLDDKDDDTTRVDESLNIKVEAEEEKAKSGDETNKEEDEDDEEAEEEEEEEEEEEDEDDDDNNEEEEFECYPPGMKVQVRYGRGKNQKMYEASIKDSDVEGGEVLYLVHYCGWNVRYDEWIKADKIVRPADKNVPKIKHRKKIKNKLDKEKDKDEKYSPKNCKLRRLSKPPFQTNPSPEMVSKLDLTDAKNSDTAHIKSIEITSILNGLQASESSAEDSEQEDERGAQDMDNNGKEESKIDHLTNNRNDLISKEEQNSSSLLEENKVHADLVISKPVSKSPERLRKDLSVVSFLTSFLFFVIFIFFII

SEQ ID NO: 901467 - protein, 382 aa, Homo sapiens
MKALDEPPYLTVGTDVSAKYRGAFCEAKIKTAKRLVKVKVTFRHDSSTVEVQDDHIKGPLKVGAIVEVKNLDGAYQEAVINKLTDASWYTVVFDDGDEKTLRRSSLCLKGERHFAESETLDQLPLTNPEHFGTPVIGKKTNRGRRSNHIPEEESSSSSSDEDEDDRKQIDELLGKVVCVDYISLDKKKALWFPALVVCPDCSDEIAVKKDNILVRSFKDGKFTSVPRKDVHEITSDTAPKPDAVLKQAFEQALEFHKSRTIPANWKTELKEDSSSSEAEEEEEEEDDEKEKEDNSSEEEEEIEPFPEERENFLQQLYKFMEDRGTPINKRPVLGYRNLNLFKLFRLVHKLGGFDNVSVVVKLKHLFHVTCFLRYLPSLKLFF

SEQ ID NO: 901468 - protein, 226 aa, Homo sapiens [sequence omitted]

SEQ ID NO: 901469 - protein, 403 aa, Homo sapiens
VKHLQRRNSQSSSGGGGGGSSSSSRRPSLMDDLCEANGTFAISLFKILGEEDNSRNVFFSPMSISSALAMVFMGAKGSTAAQMSQALCLYKDGDIHRGFQSLLSEVNRTGTQYLLRTANRLFGEKTCDFLPDFKEYCQKFYQAELEELSFAEDTEECRKHINDWVAEKTEGKISEVLDAGTVDPLTKLVLVNAIYFKGKWNEQFDRKYTRGMLFKTNEEKKTVQMMFKEAKFKMGYADEVHTQVLELPYVEEELSMVILLPDDNTDLAVVEKALTYEKFKAWTNSEKLTKSKVQVFLPRLKLEESYDLEPFLRRLGMIDAFDEAKADFSGMSTEKNVPLSKVAHKCFVEVNEEGTEAAAATAVVRNSRCSRMEPRFCADHPFLFFIRHHKTNCILFCGRFSSP

SEQ ID NO: 901470 - protein, 271 aa, Homo sapiens
VKHLQRRNSQSSSGGGGGGSSSSSRRPSLMDDLCEANGTFAISLFKILGEEDNSRNVFFSPMSISSALAMVFMGAKGSTAAQMSQALCLYKDGDIHRGFQSLLSEVNRTGTQYLLRTANRLFGEKTCDFLPDFKEYCQKFYQAELEELSFAEDTEECRKHINDWVAEKTEGKISEVLDAGTVDPLTKLVLVNAIYFKGKWNEQFDRKYTRGMLFKTNEEKKTVQMMFKEAKFKMGYADEVHTQVLELPYVEEELSMVILLPDDNTDLAVKE

SEQ ID NO: 901471 - protein, 288 aa, Homo sapiens
VKHLQRRNSQSSSGGGGGGSSSSSRRPSLMDDLCEANGTFAISLFKILGEEDNSRNVFFSPMSISSALAMVFMGAKGSTAAQMSQALCLYKDGDIHRGFQSLLSEVNRTGTQYLLRTANRLFGEKTCDFLPDFKEYCQKFYQAELEELSFAEDTEECRKHINDWVAEKTEGKISEVLDAGTVDPLTKLVLVNAIYFKGKWNEQFDRKYTRGMLFKTNEEKKTVQMMFKEAKFKMGYADEVHTQVLELPYVEEELSMVILLPDDNTDLAVDTLRSTSFFCDILANIIST

SEQ ID NO: 901472 - protein, 51 aa, Homo sapiens
MTELPAPLSYFQNAQMSEDNHLSNTFPPCLEFLSLTEYNPPGLRLPTDPLD

SEQ ID NO: 901473 - protein, 463 aa, Homo sapiens
MTELPAPLSYFQNAQMSEDNHLSNTNDNRERQEHNDRRSLGHPEPLSNGRPQGNSRQVVEQDEEEDEELTLKYGAKHVIMLFVPVTLCMVVVVATIKSVSFYTRKDGQLIYTPFTEDTETVGQRALHSILNAAIMISVIVVMTILLVVLYKYRCYKVIHAWLIISSLLLLFFFSFIYLGEVFKTYNVAVDYITVALLIWNFGVVGMISIHWKGPLRLQQAYLIMISALMALVFIKYLPEWTAWLILAVISVYDLVAVLCPKGPLRMLVETAQERNETLFPALIYSSTMVWLVNMAEGDPEAQRRVSKNSKYNAESTERESQDTVAENDDGGFSEEWEAQRDSHLGPHRSTPESRAAVQELSSSILAGEDPEERGVKLGLGDFIFYSVLVGKASATASGDWNTTIACFVAILIGLCLTLLLLAIFKKALPALPISITFGLVFYFATDYLVQPFMDQLAFHQFYI

SEQ ID NO: 901474 - protein, 463 aa, Homo sapiens; identical to SEQ ID NO: 901473

SEQ ID NO: 901475 - protein, 374 aa, Homo sapiens
MTELPAPLSYFQNAQMSEDNHLSNTNDNRERQEHNDRRSLGHPEPLSNGRPQGNSRQVVEQDEEEDEELTLKYGAKHVIMLFVPVTLCMVVVVATIKSVSFYTRKDGQLIYTPFTEDTETVGQRALHSILNAAIMISVIVVMTILLVVLYKYRCYKVIHAWLIISSLLLLFFFSFIYLGEVFKTYNVAVDYITVALLIWNFGVVGMISIHWKGPLRLQQAYLIMISALMALVFIKYLPEWTAWLILAVISVYDLVAVLCPKGPLRMLVETAQERNETLFPALIYSSTMVWLVNMAEGDPEAQRRVSKNSKYNAERACLPPAAINLLSIAPMAPRLFMPKGACRPTAQKGSHKTLLQRMMMAGSVRNGKPRGTVI

SEQ ID NO: 901476 - protein, 382 aa, Homo sapiens
AANFKGSPEHVVATIKSVSFYTRKDGQLIYTPFTEDTETVGQRALHSILNAAIMISVIVVMTILLVVLYKYRCYKVIHAWLIISSLLLLFFFSFIYLGEVFKTYNVAVDYITVALLIWNFGVVGMISIHWKGPLRLQQAYLIMISALMALVFIKYLPEWTAWLILAVISVYDLVAVLCPKGPLRMLVETAQERNETLFPALIYSSTMVWLVNMAEGDPEAQRRVSKNSKYNAESTERESQDTVAENDDGGFSEEWEAQRDSHLGPHRSTPESRAAVQELSSSILAGEDPEERGVKLGLGDFIFYSVLVGKASATASGDWNTTIACFVAILIGLCLTLLLLAIFKKALPALPISITFGLVFYFATDYLVQPFMDQLAFHQFYI

SEQ ID NO: 901477 - protein, 463 aa, Homo sapiens; identical to SEQ ID NO: 901473

SEQ ID NO: 901478 - protein, 358 aa, Homo sapiens
MGSVIYTPFTEDTETVGQRALHSILNAAIMISVIVVMTILLVVLYKYRCYKVIHAWLIISSLLLLFFFSFIYLGEVFKTYNVAVDYITVALLIWNFGVVGMISIHWKGPLRLQQAYLIMISALMALVFIKYLPEWTAWLILAVISVYDLVAVLCPKGPLRMLVETAQERNETLFPALIYSSTMVWLVNMAEGDPEAQRRVSKNSKYNAESTERESQDTVAENDDGGFSEEWEAQRDSHLGPHRSTPESRAAVQELSSSILAGEDPEERGVKLGLGDFIFYSVLVGKASATASGDWNTTIACFVAILIGLCLTLLLLAIFKKALPALPISITFGLVFYFATDYLVQPFMDQLAFHQFYI

SEQ ID NO: 901479 - protein, 360 aa, Homo sapiens
MTELPAPLSYFQNAQMSEDNHLSNTNDNRERQEHNDRRSLGHPEPLSNGRPQGNSRQVVEQDEEEDEELTLKYGAKHVIMLFVPVTLCMVVVVATIKSVSFYTRKDGQLIYTPFTEDTETVGQRALHSILNAAIMISVIVVMTILLVVLYKYRCYKVIHAWLIISSLLLLFFFSFIYLGEVFKTYNVAVDYITVALLIWNFGVVGMISIHWKGPLRLQQAYLIMISALMALVFIKYLPEWTAWLILAVISVYDLVAVLCPKGPLRMLVETAQERNETLFPALIYSSTMVWLVNMAEGDPEAQRRVSKNSKYNAEISAEDIRKTLQHKIIPPGTVSHRNLRSTVSYGLIAPPLNPHHVRGF

SEQ ID NO: 901480 - protein, 139 aa, Homo sapiens
MTELPAPLSYFQNAQMSEDNHLSNTNDNRERQEHNDRRSLGHPEPLSNGRPQGNSRQVVEQDEEEDEELTLKYGAKHVIMLFVPVTLCMVVVVATIKSVSFYTRKDGQLIYTPFTEDAQGPEAIRIISGEAPFDSSLPM

SEQ ID NO: 901481 - protein, 101 aa, Homo sapiens
EKENSVLEVVMWLVISINTDLGLLCLFYCRIYTPFTEDTETVGQRALHSILNAAIMISVIVVMTILLVVLYKYRCYKVSMRHRSLLSTLFFLWLGILVTVT

SEQ ID NO: 901482 - protein, 463 aa, Homo sapiens; identical to SEQ ID NO: 901473

SEQ ID NO: 901483 - protein, 463 aa, Homo sapiens; identical to SEQ ID NO: 901473

SEQ ID NO: 901484 - protein, 463 aa, Homo sapiens; identical to SEQ ID NO: 901473

SEQ ID NO: 901485 - protein, 463 aa, Homo sapiens; identical to SEQ ID NO: 901473

SEQ ID NO: 901486 - protein, 170 aa, Homo sapiens
MAEGDPEAQRRVSKNSKYNAESTERESQDTVAENDDGGFSEEWEAQRDSHLGPHRSTPESRAAVQELSSSILAGEDPEERGVKLGLGDFIFYSVLVGKASATASGDWNTTIACFVAILIGLCLTLLLLAIFKKALPALPISITFGLVFYFATDYLVQPFMDQLAFHQFYI

SEQ ID NO: 901487 - protein, 180 aa, Homo sapiens
MTELPAPLSYFQNAQMSEDNHLSNTNDNRERQEHNDRRSLGHPEPLSNGRPQGNSRQVVEQDEEEDEELTLKYGAKHVIMLFVPVTLCMVVVVATIKSVSFYTRKDGQLIYTPFTEDTETVGQRALHSILNAAIMISVIVVMTILLVVLYKYRCYKVSMRHRSLLSTLFFLWLGILVTVT

SEQ ID NO: 901488 - protein, 290 aa, Homo sapiens
RPGPVRRRGKVELIKFVRVQWRRPQVEWRRRRWGPGPGASMAGSEELGLREDTLRVLAAFLRRGEAAGSPVPTPPRSPAQEEPTDFLSRLRRCLPCSLGRGAAPSESPRPCSLPIRPCYGLEPGPATPDFYALVAQRLEQLVQEQLKSPPSPELQGPPSTEKEAILRRLVALLEEEAEVINQKLASDPALRSKLVRLSSDSFARLVELFCSRDDSSRPSRACPGPPPPSPEPLARLALAMELSRRVAGLGGTLAGLSVEHVHSFTPWIQAHGGWEGILAVSPVDLNLPLD

SEQ ID NO: 901489 - protein, 144 aa, Homo sapiens
RPGPVRRRGKVELIKFVRVQWRRPQVEWRRRRWGPGPGASMAGSEELGLREDTLRVLAAFLRRGEAAGSPVPTPPRSPAQEEPTDFLSRLRRCLPCSLGRGRGARAQLHALDPGPRGLGGHPGCFTRGLELAIGLSSFSEAATR

SEQ ID NO: 901490 - protein, 113 aa, Homo sapiens
RPGPVRRRGKVELIKFVRVQWRRPQVEWRRRRWGPGPGASMAGSEELGLREDTLRVLAAFLRRGEAAGSPVPTPPRSPAQEEPTDFLSRLRRCLPCSLGRGRLLPRSPWPAWP

SEQ ID NO: 901491 - protein, 115 aa, Homo sapiens
LTTLCGASFKEAKDSEFMIEEMQVIHPPRPPKVLELQAELPRLDNFLKNFFKVGLIADEFSRWARSSARDFNGMIPFKPTTTSWGSYCPRLVGAERKSPQHAECWNLDLYTKPRL

SEQ ID NO: 901492 - protein, 132 aa, Homo sapiens
RPGPVRRRGKVELIKFVRVQWRRPQVEWRRRRWGPGPGASMAGSEELGLREDTLRVLAAFLRRGEAAGSPVPTPPRPSYSRLLCFGGPAAGTAGPRAAEISAQPRITGSPIDREGSHTAEAGGPAGGGGRSH

SEQ ID NO: 901493 - protein, 132 aa, Homo sapiens; identical to SEQ ID NO: 901492

SEQ ID NO: 901494 - protein, 156 aa, Homo sapiens
MLIVSARTLHWIQAGPKSSLKSPPSPELQGPPSTEKEAILRRLVALLEEEAEVINQKLASDPALRSKLVRLSSDSFARLVELFCSRDDSSRPSRACPGPPPPSPEPLARLALAMELSRRVAGLGGTLAGLSVEHVHSFTPWIQAHGGWVSRCSLSL

SEQ ID NO: 901495 - protein, 199 aa, Homo sapiens
RPGPVRRRGKVELIKFVRVQWRRPQVEWRRRRWGPGPGASMAGSEELGLREDTLRVLAAFLRRGEAAGSPVPTPPRSPAQEEPTDFLSRLRRCLPCSLGRGAAPSESPRPCSLPIRPCYGLEPGPATPDFYALVAQRLEQLVQEQLKSPPSPELQGPPSTEKEAILRRLVALLEEEAEVINQKEGILAVSPVDLNLPLD

SEQ ID NO: 901496 - protein, 463 aa, Homo sapiens
RGRRGLPLGGPLVAGRRRRLRARGSQQDAPALQEAEVRGPERAQPARGRMTKARLFRLWLVLGSVFMILLIIVYWDSAGAAHFYLHTSFSRPHTGPPLPTPGPDRDRELTADSDVDEFLDKFLSAGVKQSDLPRKETEQPPAPGSMEESVRGYDWSPRDARRSPDQGRQQAERRSVLRGFCANSSLAFPTKERAFDDIPNSELSHLIVDDRHGAIYCYVPKVACTNWKRVMIVLSGSLLHRGAPYRDPLRIPREHVHNASAHLTFNKFWRRYGKLSRHLMKVKLKKYTKFLFVRDPFVRLISAFRSKFELENEEFYRKFAVPMLRLYANHTSLPASAREAFRAGLKVSFANFIQYLLDPHTEKLAPFNEHWRQVYRLCHPCQIDYDFVGKLETLDEDAAQLLQLLQVDRQLRFPPSYRNRTASSWEEDWFAKIPLAWRQQLYKLYEADFVLFGYPKPENLLRD

SEQ ID NO: 901497 - protein, 414 aa, Homo sapiens
MTKARLFRLWLVLGSVFMILLIIVYWDSAGAAHFYLHTSFSRPHTGPPLPTPGPDRDRELTADSDVDEFLDKFLSAGVKQSDLPRKETEQPPAPGSMEESVRGYDWSPRDARRSPDQGRQQAERRSVLRGFCANSSLAFPTKERAFDDIPNSELSHLIVDDRHGAIYCYVPKVACTNWKRVMIVLSGSLLHRGAPYRDPLRIPREHVHNASAHLTFNKFWRRYGKLSRHLMKVKLKKYTKFLFVRDPFVRLISAFRSKFELENEEFYRKFAVPMLRLYANHTSLPASAREAFRAGLKVSFANFIQYLLDPHTEKLAPFNEHWRQVYRLCHPCQIDYDFVGKLETLDEDAAQLLQLLQVDRQLRFPPSYRNRTASSWEEDWFAKIPLAWRQQLYKLYEADFVLFGYPKPENLLRD

SEQ ID NO: 901498 - protein, 463 aa, Homo sapiens; identical to SEQ ID NO: 901496

SEQ ID NO: 901499 - protein, 493 aa, Homo sapiens
MRPLCVTCWWLGLLAAMGAVAGQEDGFEGTEEGSPREFIYLNRYKRAGESQDKCTYTFIVPQQRVTGAICVNSKEPEVLLENRVHKQELELLNNELLKQKRQIETLQQLVEVDGGIVSEVKLLRKESRNMNSRVTQLYMQLLHEIIRKRDNALELSQLENRILNQTADMLQLASKYKDLEHKYQHLATLAHNQSEIIAQLEEHCQRVPSARPVPQPPPAAPPRVYQPPTYNRIINQISTNEIQSDQNLKVLPPPLPTMPTLTSLPSSTDKPSGPWRDCLQALEDGHDTSSIYLVKPENTNRLMQVWCDQRHDPGGWTVIQRRLDGSVNFFRNWETYKQGFGNIDGEYWLGLENIYWLTNQGNYKLLVTMEDWSGRKVFAEYASFRLEPESEYYKLRLGRYHGNAGDSFTWHNGKQFTTLDRDHDVYTGNCAHYQKGGWWYNACAHSNLNGVWYRGGHYRSRYQDGVYWAEFRGGSYSLKKVVMMIRPNPNTFH

SEQ ID NO: 901500 - protein, 493 aa, Homo sapiens; identical to SEQ ID NO: 901499

SEQ ID NO: 901501 - protein, 493 aa, Homo sapiens; identical to SEQ ID NO: 901499

SEQ ID NO: 901502 - protein, 165 aa, Homo sapiens
ASARAYHQLMSKKDIIPTPSHPMNIWNSCWAINTIYPQHLPLSQLPLLTSRGHCQEPTLVTLATAQRTTPHQFILRLGGPGCWILFSEVTAADDGTESIRCFLSLLLSFTPDSPSCLQDRTGLQTTLSLNKLSLYNKNTTAKYLHNIHVYEPPLCTYVYTTYICI

SEQ ID NO: 901503 - protein, 493 aa, Homo sapiens; identical to SEQ ID NO: 901499

SEQ ID NO: 901504 - protein, 274 aa, Homo sapiens
MRPLCVTCWWLGLLAAMGAVAGQEDGFEGTEEGSPREFIYLNRYKRAGESQDKCTYTFIVPQQRVTGAICVNSKEPEVLLENRVHKQELELLNNELLKQKRQIETLQQLVEVDGGIVSEVKLLRKESRNMNSRVTQLYMQLLHEIIRKRDNALELSQLENRILNQTADMLQLASKYKDLEHKYQHLATLAHNQSEIIAQLEEHCQRVPSARPVPQPPPAAPPRVYQPPTYNRIINQISTNEIQSDQNLKVLPPPLPTMPTLTSLPSSTDKPSGL

SEQ ID NO: 901505 - protein, 493 aa, Homo sapiens; identical to SEQ ID NO: 901499

SEQ ID NO: 901506 - protein, 364 aa, Homo sapiens
MNSRVTQLYMQLLHEIIRKRDNALELSQLENRILNQTADMLQLASKYKDLEHKYQHLATLAHNQSEIIAQLEEHCQRVPSARPVPQPPPAAPPRVYQPPTYNRIINQISTNEIQSDQNLKVLPPPLPTMPTLTSLPSSTDKPSGPWRDCLQALEDGHDTSSIYLVKPENTNRLMQVWCDQRHDPGGWTVIQRRLDGSVNFFRNWETYKQGFGNIDGEYWLGLENIYWLTNQGNYKLLVTMEDWSGRKVFAEYASFRLEPESEYYKLRLGRYHGNAGDSFTWHNGKQFTTLDRDHDVYTGNCAHYQKGGWWYNACAHSNLNGVWYRGGHYRSRYQDGVYWAEFRGGSYSLKKVVMMIRPNPNTFH

SEQ ID NO: 901507 - protein, 83 aa, Homo sapiens
LSLRFLNWSTRITNLTSGNCAHYQKGGWWYNACAHSNLNGVWYRGGHYRSRYQDGVYWAEFRGGSYSLKKVVMMIRPNPNTFH

SEQ ID NO: 901508 - protein, 446 aa, Homo sapiens
MRPLCVTCWWLGLLAAMGAVAGQEDGFEGTEEGSPREFIYLNRYKRAGESQDKCTYTFIVPQQRVTGAICVNSKEPEVLLENRVHKQELELLNNELLKQKRQIETLQQLVEVDGGIVSEVKLLRKESRNMNSRVTQLYMQLLHEIIRKRDNALELSQLENRILNQTADMLQLASKYKDLEHKYQHLATLAHNQSEIIAQLEEHCQRVPSARPVPQPPPAAPPRVYQPPTYNRIINQISTNEIQSDQNLKVLPPPLPTMPTLTSLPSSTDKPSGPWRDCLQALEDGHDTSSIYLVKPENTNRLMQVWCDQRHDPGGWTVIQRRLDGSVNFFRNWETYKQGFGNIDGEYWLGLENIYWLTNQGNYKLLVTMEDWSGRKVFAEYASFRLEPESEYYKLRLGRYHGNAGDSFTWHNGKQFTTLDRDVGCLVLSMSGCVPITSAFLTKCTM

SEQ ID NO: 901509 - protein, 286 aa, Homo sapiens
RPSSSEESARKQTFPRAMSRLGLPEEPVRNSLLDDAKARLRKYDIGGKYSHLPYNKYSVLLPLVAKEGKLHLLFTVRSEKLRRAPGEVCFPGGKRDPTDMDDAATALREAQEEVGLRPHQVEVVCCLVPCLIDRWGSRYVDEAGLELLASSDPPTSAPKVLGLQTDTLITPFVGLIDHNFQAQPNPAEVKDVFLVPLAYFLHPQVHDQHYVTRLGHRFINHIFEYTNPEDGVTYQIKGMTANLAVLVAFIILEKKPTFEVQFNLNDVLASSEELFLKVHKKATSRL

SEQ ID NO: 901510 - protein, 255 aa, Homo sapiens
RPSSSEESARKQTFPRAMSRLGLPEEPVRNSLLDDAKARLRKYDIGGKYSHLPYNKYSVLLPLVAKEGKLHLLFTVRSEKLRRAPGEVCFPGGKRDPTDMDDAATALREAQEEVGLRPHQVEVVCCLVPCLIDTDTLITPFVGLIDHNFQAQPNPAEVKDVFLVPLAYFLHPQVHDQHYVTRLGHRFINHIFEYTNPEDGVTYQIKGMTANLAVLVAFIILEKKPTFEVQFNLNDVLASSEELFLKVHKKATSRL

SEQ ID NO: 901511 - protein, 71 aa, Homo sapiens
RPSSSEESARKQTFPRAMSRLGLPEEPVRNSLLDDAKARLRKYDIGGKYSHLPYNKYSVLLPLVAKEGQIH

SEQ ID NO: 901512 - protein, 286 aa, Homo sapiens; identical to SEQ ID NO: 901509

SEQ ID NO: 901513 - protein, 89 aa, Homo sapiens
RPSSSEESARKQTFPRAMSRLGLPEEPVRNSLLDDAKARLRKYDIGGKYSHLPYNKYSVLLPLVAKEGKLHLLFTVRSEKVGGQKISCP

SEQ ID NO: 901514 - protein, 202 aa, Homo sapiens
RPSSSEESARKQTFPRAMSRLGLPEEPVRNSLLDDAKARLRKYDIGGKYSHLPYNKYSVLLPLVAKEGKLHLLFTVRSEKTDTLITPFVGLIDHNFQAQPNPAEVKDVFLVPLAYFLHPQVHDQHYVTRLGHRFINHIFEYTNPEDGVTYQIKGMTANLAVLVAFIILEKKPTFEVQFNLNDVLASSEELFLKVHKKATSRL

SEQ ID NO: 901515 - protein, 150 aa, Homo sapiens
TEQLRGVRPETNIPQGNVTTWSSRGASQTDTLITPFVGLIDHNFQAQPNPAEVKDVFLVPLAYFLHPQVHDQHYVTRLGHRFINHIFEYTNPEDGVTYQIKGMTANLAVLVAFIILEKKPTFEVQFNLNDVLASSEELFLKVHKKATSRL

SEQ ID NO: 901516 - protein, 286 aa, Homo sapiens; identical to SEQ ID NO: 901509

SEQ ID NO: 901517 - protein, 121 aa, Homo sapiens
RKENVGGRLGWCDALTSSGADSPYRYLNTDKDEGDHPNNSFSPCSAHDRRCLQKHFAKIRDRSTSGGKMKVNGAPREDARPVPPGGPASRALHQWAPGRRGWACFSPEARQAHELEGTIHN

SEQ ID NO: 901518 - protein, 253 aa, Homo sapiens
MLPLCLVAALLLAAGPGPSLGDEAIHCPPCSEEKLARCRPPVGCEELVREPGCGCCATCALGLGMPCGVYTPRCGSGLRCYPPRGVEKPLHTLMHGQGVCMELAEIEAIQESLQPSDKDEGDHPNNSFSPCSAHDRRCLQKHFAKIRDRSTSGGKMKVNGAPREDARPVPQGSCQSELHRALERLAASQSRTHEDLYIIPIPNCDRNGNFHPKQCHPALDGQRGKCWCVDRKTGVKLPGGLEPKGEPGLPPAG

SEQ ID NO: 901519 - protein, 253 aa, Homo sapiens; identical to SEQ ID NO: 901518

SEQ ID NO: 901520 - protein, 86 aa, Homo sapiens
KSSSVPGGEYGIGNFHAQAVSPSSGWAAWQVLVCGPEDGGEASGGPGAKGGAWTATSWLTAFESEACQQARDSASPATPVLWRLQS

SEQ ID NO: 901521 - protein, 253 aa, Homo sapiens; identical to SEQ ID NO: 901518

SEQ ID NO: 901522 - protein, 253 aa, Homo sapiens; identical to SEQ ID NO: 901518

SEQ ID NO: 901523 - protein, 253 aa, Homo sapiens; identical to SEQ ID NO: 901518

SEQ ID NO: 901524 - protein, 253 aa, Homo sapiens; identical to SEQ ID NO: 901518

SEQ ID NO: 901525 - protein, 103 aa, Homo sapiens
MRGFLGPVPYPICGHSHEVTGMNLSFQWLAPCSSASLSISPSPTPPSPHLPTPLGIFWLDWMEGDLGTYQLAMMSFLLFLFFNKTEQNQKMSKKKKKDIMANW

SEQ ID NO: 901526 - protein, 78 aa, Homo sapiens
RNLRPMRERTAVQGQYLTVEQLTLDFMLHTKYQVVYPFPTFQPAFQLKKDQVVLLNTSYSRWEVDFPPGESEGGQRKT

SEQ ID NO: 901527 - protein, 253 aa, Homo sapiens; identical to SEQ ID NO: 901518

SEQ ID NO: 901528 - protein, 210 aa, Homo sapiens
MLPLCLVAALLLAAGPGPSLGDEAIHCPPCSEEKLARCRPPVGCEELVREPGCGCCATCALGLGMPCGVYTPRCGSGLRCYPPRGVEKPLHTLMHGQGVCMELAEIEAIQESLQPSDKDEGDHPNNSFSPCSAHDRRCLQKHFAKIRDRSTSGGKMKVNGAPREDARPVPPDSCRELPRALARKAAAKKQPLPLNLLPGRAGPFPPACQF

SEQ ID NO: 901529 - protein, 200 aa, Homo sapiens
MLPLCLVAALLLAAGPGPSLGDEAIHCPPCSEEKLARCRPPVGCEELVREPGCGCCATCALGLGMPCGVYTPRCGSGLRCYPPRGVEKPLHTLMHGQGVCMELAEIEAIQESLQPSDKDEGDHPNNSFSPCSAHDRRCLQESNFWKKFGGTREATQVGGGPKGMEKGSKLGGAAPPGGGIGPPGAFVGPPQRGLFPGPQE

SEQ ID NO: 901530 - protein, 253 aa, Homo sapiens; identical to SEQ ID NO: 901518

SEQ ID NO: 901531 - protein, 124 aa, Homo sapiens
MLPLCLVAALLLAAGPGPSLGDEAIHCPPCSEEKLARCRPPVGCEELVREPGCGCCATCALGLGMPCGVYTPRCGSGLRCYPPRGCHPALDGQRGKCWCVDRKTGVKLPGGLEPKGEPGLPPAG

SEQ ID NO: 901532 - protein, 253 aa, Homo sapiens; identical to SEQ ID NO: 901518

SEQ ID NO: 901533 - protein, 253 aa, Homo sapiens; identical to SEQ ID NO: 901518

SEQ ID NO: 901534 - protein, 71 aa, Homo sapiens
SSHPERIRTPRTCSLMKGMSFSAPAVRSSSCGTKTNNVTLTKEMFFYKLLLILECLLYNWVGYQGGALWLA

SEQ ID NO: 901535 - protein, 253 aa, Homo sapiens; identical to SEQ ID NO: 901518

SEQ ID NO: 901536 - protein, 253 aa, Homo sapiens; identical to SEQ ID NO: 901518

SEQ ID NO: 901537 - protein, 224 aa, Homo sapiens
MLPLCLVAALLLAAGPGPSLGDEAIHCPPCSEEKLARCRPPVGCEELVREPGCGCCATCALGLGMPCGVYTPRCGSGLRCYPPRGVEKPLHTLMHGQGVCMELAEIEAIQESLQPSDKDEGDHPNNSFSPCSAHDRRCLQKHFAKIRDRSTSGGKMKVNGAPREDARPVVRTSDAQMCMCIDTHTHMPPAPHMHAPTHTITTRSGACSFSTHSRVTTVCKVQLV

SEQ ID NO: 901538 - protein, 72 aa, Homo sapiens
MLPLCLVAALLLAAGPGPSLGDEAIHCPPCSEEKPAFSFLLLLITMGTKGHNSPCPPQMHPSNKKRHHTQSH

SEQ ID NO: 901539 - protein, 312 aa, Homo sapiens
MADFGISAGQFVAVVWDKSSPVEALKGLVDKLQALTGNEGRVSVENIKQLLQSAHKESSFDIILSGLVPGSTTLHSAEILAEIARILRPGGCLFLKEPVETAVDNNSKVKTASKLCSALTLSGLVEVKELQREPLTPEEVQSVREHLGHESDNLLFVQITGKKPNFEVGSSRQLKLSITKKSSPSVKPAVDPAAAKLWTLSANDMEDDSMDLIDSDELLDPEDLKKPDPASLRAASCGEGKKRKACKNCTCGLAEELEKEKSREQMSSQPKSACGNCYLGDAFRCASCPYLGMPAFKPGEKVLLSDSNLHDA

SEQ ID NO: 901540 - protein, 299 aa, Homo sapiens
MADFGISAGQFVAVVWDKSSPVEALKGLVDKLQALTGNEGRVSVENIKQLLQCLVPGSTTLHSAEILAEIARILRPGGCLFLKEPVETAVDNNSKVKTASKLCSALTLSGLVEVKELQREPLTPEEVQSVREHLGHESDNLLFVQITGKKPNFEVGSSRQLKLSITKKSSPSVKPAVDPAAAKLWTLSANDMEDDSMDLIDSDELLDPEDLKKPDPASLRAASCGEGKKRKACKNCTCGLAEELEKEKSREQMSSQPKSACGNCYLGDAFRCASCPYLGMPAFKPGEKVLLSDSNLHDA

SEQ ID NO: 901541 - protein, 312 aa, Homo sapiens; identical to SEQ ID NO: 901539

SEQ ID NO: 901542 - protein, 312 aa, Homo sapiens; identical to SEQ ID NO: 901539

SEQ ID NO: 901543 - protein, 380 aa, Homo sapiens
MADFGISAGQFVAVVWDKSSPVEALKGLVDKLQALTGNEGRVSVENIKQLLQSAHKESSFDIILSGLVPGSTTLHSAEILAEIARILRPGGCLFLKEPVETAVDNNSKVKTASKLCSALTLSGLVEVKELQREPLTPEEVQSVREHLGHESDNLLFVQITGKKPNFEVGSSRQLKLSITKKSSPSVKPAVDPAAAKLWTLSANDMEDDSMCIFCGCSLTHRWPLEHVVRLNMMINQKEDRVDTFFTLDSKFPLEACSHFSFSLAETTTVSLIALNTLQDLIDSDELLDPEDLKKPDPASLRAASCGEGKKRKACKNCTCGLAEELEKEKSREQMSSQPKSACGNCYLGDAFRCASCPYLGMPAFKPGEKVLLSDSNLHDA

SEQ ID NO: 901544 - protein, 367 aa, Homo sapiens
MADFGISAGQFVAVVWDKSSPVEALKGLVDKLQALTGNEGRVSVENIKQLLQCLVPGSTTLHSAEILAEIARILRPGGCLFLKEPVETAVDNNSKVKTASKLCSALTLSGLVEVKELQREPLTPEEVQSVREHLGHESDNLLFVQITGKKPNFEVGSSRQLKLSITKKSSPSVKPAVDPAAAKLWTLSANDMEDDSMCIFCGCSLTHRWPLEHVVRLNMMINQKEDRVDTFFTLDSKFPLEACSHFSFSLAETTTVSLIALNTLQDLIDSDELLDPEDLKKPDPASLRAASCGEGKKRKACKNCTCGLAEELEKEKSREQMSSQPKSACGNCYLGDAFRCASCPYLGMPAFKPGEKVLLSDSNLHDA

SEQ ID NO: 901545 - protein, 190 aa, Homo sapiens
MADFGISAGQFVAVVWDKSSPVEALKGLVDKLQALTGNEGRVSVENIKQLLQSAHKESSFDIILSGLVPGSTTLHSAEILAEIARILRPGGCLFLKEPVETAVDNNSKVKTASKLCSALTLSGLVEVKELQREPLTPEEVQSVREHLGHESDNLLFVQITGKNETCCGPCCCQAVDPLSQRYGGRQHGSH

SEQ ID NO: 901546 - protein, 249 aa, Homo sapiens
MADFGISAGQFVAVVWDKSSPVEALKGLVDKLQALTGNEGRVSVENIKQLLQSAHKESSFDIILSGLVPGSTTLHSAEILAEIARILRPGGCLFLKEPVETAVDNNSKVKTASKLCSALTLSGLVEVKELQREPLTPEEVQSVREHLGHESDNLLFVQITGKKPNFEVGSSRQLKLSITKKSSPSVKPAVDPAAAKLWTLSANDMEDDSMDLIDSDELLDPEDLKKPDPASLRAASCGEGKKRKACKNW

SEQ ID NO: 901547 - protein, 108 aa, Homo sapiens
MEDDSMDLIDSDELLDPEDLKKPDPASLRAASCGEGKKRKACKNCTCGLAEELEKEKSREQMSSQPKSACGNCYLGDAFRCASCPYLGMPAFKPGEKVLLSDSNLHDA

SEQ ID NO: 901548 - protein, 163 aa, Homo sapiens
MCKRPDVIHHRAGFDVMERSRERAQAAVLIPFWPAVLKPAVDPAAAKLWTLSANDMEDDSMDLIDSDELLDPEDLKKPDPASLRAASCGEGKKRKACKNCTCGLAEELEKEKSREQMSSQPKSACGNCYLGDAFRCASCPYLGMPAFKPGEKVLLSDSNLHDA

SEQ ID NO: 901549 - protein, 246 aa, Homo sapiens
MADFGISAGQFVAVVWDKSSPVEALKGLVDKLQALTGNEGRVSVENIKQLLQSAHKESSFDIILSGLVPGSTTLHSAEILAEIARILRPGGCLFLKEPVETAVDNNSKVKTASKLCSALTLSGLVEVKELQREPLTPEEVQSVREHLGHESDNLLFVQITGKKPNFEVGSSRQLKLSITKKSSPSVKPAVDPAAAKLWTLSANDMEDDSMCYLGDAFRCASCPYLGMPAFKPGEKVLLSDSNLHDA

SEQ ID NO: 901550 - protein, 312 aa, Homo sapiens; identical to SEQ ID NO: 901539

SEQ ID NO: 901551 - protein, 312 aa, Homo sapiens; identical to SEQ ID NO: 901539

SEQ ID NO: 901552 - protein, 312 aa, Homo sapiens; identical to SEQ ID NO: 901539

SEQ ID NO: 901553 - protein, 266 aa, Homo sapiens
MADFGISAGQFVAVVWDKSSPVEALKGLVDKLQALTGNEGRVSVENIKQLLQSAHKESSFDIILSGLVPGSTTLHSAEILAEIARILRPGGCLFLKEPVETAVDNNSKVKTASKLCSALTLSGLVEVKELQREPLTPEEVQSVREHLGHESDNLLFVQITGKKPNFEVGSSRQLKLSITKKSSPSVKPAVDPAAAKLWTLSANDMEDDSMHLWPCRRTGKREVKGTDELPTQVSLWKLLPGRCLPLCQLPLPWDASLQTWGKGASE

SEQ ID NO: 901554 - protein, 277 aa, Homo sapiens
SSLRGASSSRERREAWSRRLERSRERAQAAGLVPGSTTLHSAEILAEIARILRPGGCLFLKEPVETAVDNNSKVKTASKLCSALTLSGLVEVKELQREPLTPEEVQSVREHLGHESDNLLFVQITGKKPNFEVGSSRQLKLSITKKSSPSVKPAVDPAAAKLWTLSANDMEDDSMDLIDSDELLDPEDLKKPDPASLRAASCGEGKKRKACKNCTCGLAEELEKEKSREQMSSQPKSACGNCYLGDAFRCASCPYLGMPAFKPGEKVLLSDSNLHDA

SEQ ID NO: 901555 - protein, 266 aa, Homo sapiens; identical to SEQ ID NO: 901553

SEQ ID NO: 901556 - protein, 317 aa, Homo sapiens
MADFGISAGQFVAVVWDKSSPVEALKGLVDKLQALTGNEGRVSVENIKQLLQSAHKESSFDIILSGLVPGSTTLHSAEILAEIARILRPGGCLFLKEPVETAVDNNSKVKTASKLCSALTLSGLVEVKELQREPLTPEEVQSVREHLGHESDNLLFVQITGKKPNFEVGSSRQLKLSITKKSSPSVKPAVDPAAAKLWTLSANDMEDDSMCIFCGCSLTHRWPLEHVVRLNMMINQKEDRVDTFFTLDSKFPLEACSHFSFSLAETTTVSLIALNTLQDLIDSDELLDPEDLKKPDPASLRAASCGEGKKRKACKNW

SEQ ID NO: 901557 - protein, 475 aa, Homo sapiens
MAGRPHPYDGNSSDPENWDRKLHSRPRKLYKHSSTSSRIAKGGVDHTKMSLHGASGGHERSRDRRRSSDRSRDSSHERTESQLTPCIRNVTSPTRQHHVEREKDHSSSRPSSPRPQKASPNGSISSAGNSSRNSSQSSSDGSCKTAGEMVFVYENAKEGARNIRTSERVTLIVDNTRFVVDPSIFTAQPNTMLGRMFGSGREHNFTRPNEKGEYEVAEGIGSTVFRAILDYYKTGIIRCPDGISIPELREACDYLCISFEYSTIKCRDLSALMHELSNDGARRQFEFYLEEMILPLMVASAQSGERECHIVVLTDDDVVDWDEEYPPQMGEEYSQIIYSTKLYRFFKYIENRDVAKSVLKERGLKKIRLGIEGYPTYKEKVKKRPGGRPEVIYNYVQRPFIRMSWEKEEGKSRHVDFQCVKSKSITNLAAAAADIPQDQLVVMHPTPQVDELDILPIHPPSGNSDLDPDAQNPML

SEQ ID NO: 901558 - protein, 475 aa, Homo sapiens; identical to SEQ ID NO: 901557

SEQ ID NO: 901559 - protein, 427 aa, Homo sapiens
MSLHGASGGHERSRDRRRSSDRSRDSSHERTESQLTPCIRNVTSPTRQHHVEREKDHSSSRPSSPRPQKASPNGSISSAGNSSRNSSQSSSDGSCKTAGEMVFVYENAKEGARNIRTSERVTLIVDNTRFVVDPSIFTAQPNTMLGRMFGSGREHNFTRPNEKGEYEVAEGIGSTVFRAILDYYKTGIIRCPDGISIPELREACDYLCISFEYSTIKCRDLSALMHELSNDGARRQFEFYLEEMILPLMVASAQSGERECHIVVLTDDDVVDWDEEYPPQMGEEYSQIIYSTKLYRFFKYIENRDVAKSVLKERGLKKIRLGIEGYPTYKEKVKKRPGGRPEVIYNYVQRPFIRMSWEKEEGKSRHVDFQCVKSKSITNLAAAAADIPQDQLVVMHPTPQVDELDILPIHPPSGNSDLDPDAQNPML

SEQ ID NO: 901560 - protein, 457 aa, Homo sapiens
MAGRPHPYDGNSSDPENWDRKLHSRPRKLYKHSSTSSRIAKGGVDHTKMSLHGASGGHERSRDRRRSSDRSRDSSHERTESQLTPCIRNVTSPTRQHHVEREKDHSSSRPSSPRPQKASPNGSISSAGNSSRNSSQSSSDGSCKTAGEMVFVYENAKEGARNIRTSERVTLIVDNTRFVVDPSIFTAQPNTMLGRMFGSGREHNFTRPNEKGEYEVAEGIGSTVFRAILDYYKTGIIRCPDGISIPELREACDYLCISFEYSTIKCRDLSALMHELSNDGARRQFEFYLEEMILPLMVASAQSGERECHIVVLTDDDVVDWDEEYPPQMGEEYSQIIYSTKLYRFFKYIENRDVAKSVLKERGLKKIRLGIEGYPTYKEKVKIRMSWEKEEGKSRHVDFQCVKSKSITNLAAAAADIPQDQLVVMHPTPQVDELDILPIHPPSGNSDLDPDAQNPML

SEQ ID NO: 901561 - protein, 475 aa, Homo sapiens; identical to SEQ ID NO: 901557

SEQ ID NO: 901562 - protein, 183 aa, Homo sapiens
MAGRPHPYDGNSSDPENWDRKLHSRPRKLYKHSSTSSRIAKGGVDHTKMSLHGASGGHERSRDRRRSSDRSRDSSHERTESQLTPCIRNVTSPTRQHHVEREKDHSSSRPSSPRPQKASPNGSISSAGNSSRNSSPPFRGPDTPGQGCLQPKGGYNSHVQGTWGPTWAPRAGCRPPQIGARRA

SEQ ID NO: 901563 - protein, 475 aa, Homo sapiens; identical to SEQ ID NO: 901557

SEQ ID NO: 901564 - protein, 475 aa, Homo sapiens; identical to SEQ ID NO: 901557

SEQ ID NO: 901565 - protein, 764 aa, Homo sapiens
MRPADLLQLVLLLDLPRDLGGMGCSSPPCECHQEEDFRVTCKDIQRIPSLPPSTQTLKLIETHLRTIPSHAFSNLPNISRIYVSIDVTLQQLESHSFYNLSKVTHIEIRNTRNLTYIDPDALKELPLLKFLGIFNTGLKMFPDLTKVYSTDIFFILEITDNPYMTSIPVNAFQGLCNETLTLKLYNNGFTSVQGYAFNGTKLDAVYLNKNKYLTVIDKDAFGGVYSGPSLLDVSQTSVTALPSKGLEHLKELIARNTWTLKKLPLSLSFLHLTRADLSYPSHCCAFKNQKKIRGILESLMCNESSMQSLRQRKSVNALNSPLHQEYEENLGDSIVGYKEKSKFQDTHNNAHYYVFFEEQEDEIIGFGQELKNPQEETLQAFDSHYDYTICGDSEDMVCTPKSDEFNPCEDIMGYKFLRIVVWFVSLLALLGNVFVLLILLTSHYKLNVPRFLMCNLAFADFCMGMYLLLIASVDLYTHSEYYNHAIDWQTGPGCNTAGFFTVFASELSVYTLTVITLERWYAITFAMRLDRKIRLRHACAIMVGGWVCCFLLALLPLVGISSYAKVSICLPMDTETPLALAYIVFVLTLNIVAFVIVCCCYVKIYITVRNPQYNPGDKDTKIAKRMAVLIFTDFICMAPISFYALSAILNKPLITVSNSKILLVLFYPLNSCANPFLYAIFTKAFQRDVFILLSKFGICKRQAQAYRGQRVPPKNSTDIQVQKVTHDMRQGLHNMEDVYELIENSHLTPKKQGQISEEYMQTVL

SEQ ID NO: 901566 - protein, 764 aa, Homo sapiens; identical to SEQ ID NO: 901565

SEQ ID NO: 901567 - protein, 253 aa, Homo sapiens
MRPADLLQLVLLLDLPRDLGGMGCSSPPCECHQEEDFRVTCKDIQRIPSLPPSTQTLKLIETHLRTIPSHAFSNLPNISRIYVSIDVTLQQLESHSFYNLSKVTHIEIRNTRNLTYIDPDALKELPLLKFLGIFNTGLKMFPDLTKVYSTDIFFILEITDNPYMTSIPVNAFQGLCNETLTLKLYNNGFTSVQGYAFNGTKLDAVYLNKNKYLTVIDKDAFGGVYSGPSLLLPLGRKSLSFETQKAPSSSMPS

SEQ ID NO: 901568 - protein, 205 aa, Homo sapiens
MRPADLLQLVLLLDLPRDLGGMGCSSPPCECHQEEDFRVTCKDIQRIPSLPPSTQTLKLIETHLRTIPSHAFSNLPNISRIYVSIDVTLQQLESHSFYNLSKVTHIEIRNTRNLTYIDPDALKELPLLKFLGIFNTGLKMFPDLTKVYSTDIFFILEITDNPYMTSIPVNAFQGLCNETLTLKLYNNGFTSVQGYAFNGTKLDAV

SEQ ID NO: 901569 - protein, 764 aa, Homo sapiens; identical to SEQ ID NO: 901565

SEQ ID NO: 901570 - protein, 269 aa, Homo sapiens
MRPADLLQLVLLLDLPRDLGGMGCSSPPCECHQEEDFRVTCKDIQRIPSLPPSTQTLKLIETHLRTIPSHAFSNLPNISRIYVSIDVTLQQLESHSFYNLSKVTHIEIRNTRNLTYIDPDALKELPLLKFLGIFNTGLKMFPDLTKVYSTDIFFILEITDNPYMTSIPVNAFQGLCNETLTLKLYNNGFTSVQGYAFNGTKLDAVYLNKNKYLTVIDKDAFGGVYSGPSLLFLMSPWRLTAPGSVFKDSKDLKVKTSSWDTEAENSRPK

SEQ ID NO: 901571 - protein, 97 aa, Homo sapiens
APGSPLAWGNPRCRAENEAISEDGEIAPSPVENEAGGLAAAGAAARPAQGPGRNGVFVSTLRVPSGGGLQSHLQGYSTHPQLTAQYADSVSTRERSG

SEQ ID NO: 901572 - protein, 1542 aa, Homo sapiens
MFEISRLDLGLSVEVWNKGLIWDTMVGTVWIALKTIRQSDEEGPGEWSTLEAETLMKDDEICGTRNPTPHKILLDTRFELPFDIPEEEARYWTYKWEQINALGADNEYSSQEESQRKPLPTAAAQCSFEDPDSAVDDRDSDYRSETSNSFPPPYHTASQPNASVHQFPVPVRSPQQLLLQGSSRDSCNDSMQSYDLDYPERRAISPTSSSRYGSSCNVSQGSSQLSELDQYHEQDDDHRETDSIHSCHSSHSLSRDGQAGFGEQEKPLEVTGQAEKEAACEPKEMKEDATTHPPPDLVLQKDHFLGPQESFPEENASSPFTQARAHWIRAVTKVRLQLQEIPDDGDPSLPQWLPEGPAGGLYGIDSMPDLRRKKPLPLVSDLSLVQSRKAGITSAMATRTSLKDEELKSHVYKKTLQALIYPISCTTPHNFEVWTATTPTYCYECEGLLWGIARQGMRCSECGVKCHEKCQDLLNADCLQRAAEKSCKHGAEDRTQNIIMAMKDRMKIRERNKPEIFEVIRDVFTVNKAAHVQQMKTVKQSVLDGTSKWSAKITITVVCAQGLQAKDKTGSSDPYVTVQVSKTKKRTKTIFGNLNPVWEEKFHFECHNSSDRIKVRVWDEDDDIKSRVKQRLKRESDDFLGQTIIEVRTLSGEMDVWYNLEKRTDKSAVSGAIRLQISVEIKGEEKVAPYHVQYTCLHENLFHYLTDIQGSGGVRIPEARGDDAWKVYFDETAQEIVDEFAMRYGIESIYQAMTHFACLSSKYMCPGVPAVMSTLLANINAYYAHTTASTNVSASDRFAASNFGKERFVKLLDQLHNSLRIDLSTYRNNFPAGSPERLQDLKSTVDLLTSITFFRMKVQELQSPPRASQVVKDCVKACLNSTYEYIFNNCHDLYSRQYQLKQELPPEEQGPSIRNLDFWPKLITLIVSIIEEDKNSYTPVLNQFPQELNVGKVSAEVMWHLFAQDMKYALEEHEKDHLCKSADYMNLHFKVKWLHNEYVRDLPVLQGQVPEYPAWFEQFVLQWLDENEDVSLEFLRGALERDKKDGFQQTSEHALFSCSVVDVFTQLNQSFEIIRKLECPDPSILAHYMRRFAKTIGKVLMQYADILSKDFPAYCTKEKLPCILMNNVQQLRVQLEKMFEAMGGKELDLEAADSLKELQVKLNTVLDELSMVFGNSFQVRIDECVRQMADILGQVRGTGNASPDARASAAQDADSVLRPLMDFLDGNLTLFATVCEKTVLKRVLKELWRVVMNTMERMIVLPPLTDQTGTQLIFTAAKELSHLSKLKDHMVREETRNLTPKQCAVLDLALDTIKQYFHAGGNGLKKTFLEKSPDLQSLRYALSLYTQTTDTLIKTFVRSQTTQGSGVDDPVGEVSIQVDLFTHPGTGEHKVTVKVVAANDLKWQTAGMFRPFVEVTMVGPHQSDKKRKFTTKSKSNNWAPKYNETFHFLLGNEEGPESYELQICVKDYCFAREDRVLGLAVMPLRDVTAKGSCACWCPLGRKIHMDETGLTILRILSQRSNDEVAREFVKLKSESRSTEEGS

SEQ ID NO: 901573 - protein, 866 aa, Homo sapiens
RCVRNVECLLSRYSTSVVYMSPENLFHYLTDIQGSGGVRIPEARGDDAWKVYFDETAQEIVDEFAMRYGIESIYQAMTHFACLSSKYMCPGVPAVMSTLLANINAYYAHTTASTNVSASDRFAASNFGKERFVKLLDQLHNSLRIDLSTYRNNFPAGSPERLQDLKSTVDLLTSITFFRMKVQELQSPPRASQVVKDCVKACLNSTYEYIFNNCHDLYSRQYQLKQELPPEEQGPSIRNLDFWPKLITLIVSIIEEDKNSYTPVLNQFPQELNVGKVSAEVMWHLFAQDMKYALEEHEKDHLCKSADYMNLHFKVKWLHNEYVRDLPVLQGQVPEYPAWFEQFVLQWLDENEDVSLEFLRGALERDKKDGFQQTSEHALFSCSVVDVFTQLNQSFEIIRKLECPDPSILAHYMRRFAKTIGKVLMQYADILSKDFPAYCTKEKLPCILMNNVQQLRVQLEKMFEAMGGKELDLEAADSLKELQVKLNTVLDELSMVFGNSFQVRIDECVRQMADILGQVRGTGNASPDARASAAQDADSVLRPLMDFLDGNLTLFATVCEKTVLKRVLKELWRVVMNTMERMIVLPPLTDQTGTQLIFTAAKELSHLSKLKDHMVREETRNLTPKQCAVLDLALDTIKQYFHAGGNGLKKTFLEKSPDLQSLRYALSLYTQTTDTLIKTFVRSQTTQGSGVDDPVGEVSIQVDLFTHPGTGEHKVTVKVVAANDLKWQTAGMFRPFVEVTMVGPHQSDKKRKFTTKSKSNNWAPKYNETFHFLLGNEEGPESYELQICVKDYCFAREDRVLGLAVMPLRDVTAKGSCACWCPLGRKIHMDETGLTILRILSQRSNDEVAREFVKLKSESRSTEEGS

SEQ ID NO: 901574 - protein, 1543 aa, Homo sapiens
MSLLCVRVKRAKFQGSPDKFNTYVTLKVQNVKSTTVAVRGDQPSWEQDFMFEISRLDLGLSVEVWNKGLIWDTMVGTVWIALKTIRQSDEEGPGEWSTLEAETLMKDDEICGTRNPTPHKILLDTRFELPFDIPEEEARYWTYKWEQINALGADNEYSSQEESQRKPLPTAAAQCSFEDPDSAVDDRDSDYRSETSNSFPPPYHTASQPNASVHQFPVPVRSPQQLLLQGSSRDSCNDSMQSYDLDYPERRAISPTSSSRYGSSCNVSQGSSQLSELDQYHEQDDDHRETDSIHSCHSSHSLSRDGQAGFGEQEKPLEVTGQAEKEAACEPKEMKEDATTHPPPDLVLQKDHFLGPQESFPEENASSPFTQARAHWIRAVTKVRLQLQEIPDDGDPSLPQWLPEGPAGGLYGIDSMPDLRRKKPLPLVSDLSLVQSRKAGITSAMATRTSLKDEELKSHVYKKTLQALIYPISCTTPHNFEVWTATTPTYCYECEGLLWGIARQGMRCSECGVKCHEKCQDLLNADCLQRAAEKSCKHGAEDRTQNIIMAMKDRMKIRERNKPEIFEVIRDVFTVNKAAHVQQMKTVKQSVLDGTSKWSAKITITVVCAQGLQAKDKTGSSDPYVTVQVSKTKKRTKTIFGNLNPVWEEKFHFECHNSSDRIKVRVWDEDDDIKSRVKQRLKRESDDFLGQTIIEVRTLSGEMDVWYNLEKRTDKSAVSGAIRLQISVEIKGEEKVAPYHVQYTCLHENLFHYLTDIQGSGGVRIPEARGDDAWKVYFDETAQEIVDEFAMRYGIESIYQAMTHFACLSSKYMCPGVPAVMSTLLANINAYYAHTTASTNVSASDRFAASNFGKERFVKLLDQLHNSLRIDLSTYRNNFPAGSPERLQDLKSTVDLLTSITFFRMKVQELQSPPRASQVVKDCVKACLNSTYEYIFNNCHDLYSRQYQLKQELPPEEQGPSIRNLDFWPKLITLIVSIIEEDKNSYTPVLNQFPQELNVGKVSAEVMWHLFAQDMKYALEEHEKDHLCKSADYMNLHFKVKWLHNEYVRDLPVLQGQVPEYPAWFEQFVLQWLDENEDVSLEFLRGALERDKKDGTIGKVLMQYADILSKDFPAYCTKEKLPCILMNNVQQLRVQLEKMFEAMGGKELDLEAADSLKELQVKLNTVLDELSMVFGNSFQVRIDECVRQMADILGQVRGTGNASPDARASAAQDADSVLRPLMDFLDGNLTLFATVCEKTVLKRVLKELWRVVMNTMERMIVLPPLTDQTGTQLIFTAAKELSHLSKLKDHMVREETRNLTPKQCAVLDLALDTIKQYFHAGGNGLKKTFLEKSPDLQSLRYALSLYTQTTDTLIKTFVRSQTTQGSGVDDPVGEVSIQVDLFTHPGTGEHKVTVKVVAANDLKWQTAGMFRPFVEVTMVGPHQSDKKRKFTTKSKSNNWAPKYNETFHFLLGNEEGPESYELQICVKDYCFAREDRVLGLAVMPLRDVTAKGSCACWCPLGRKIHMDETGLTILRILSQRSNDEVAREFVKLKSESRSTEEGS

SEQ ID NO: 901575 - protein, 113 aa, Homo sapiens
DLQVIKDPGTSASHETFHFLLGNEEGPESYELQICVKDYCFAREDRVLGLAVMPLRDVTAKGSCACWCPLGRKIHMDETGLTILRILSQRSNDEVAREFVKLKSESRSTEEGS

SEQ ID NO: 901576 - protein, 1591 aa, Homo sapiens
MSLLCVRVKRAKFQGSPDKFNTYVTLKVQNVKSTTVAVRGDQPSWEQDFMFEISRLDLGLSVEVWNKGLIWDTMVGTVWIALKTIRQSDEEGPGEWSTLEAETLMKDDEICGTRNPTPHKILLDTRFELPFDIPEEEARYWTYKWEQINALGADNEYSSQEESQRKPLPTAAAQCSFEDPDSAVDDRDSDYRSETSNSFPPPYHTASQPNASVHQFPVPVRSPQQLLLQGSSRDSCNDSMQSYDLDYPERRAISPTSSSRYGSSCNVSQGSSQLSELDQYHEQDDDHRETDSIHSCHSSHSLSRDGQAGFGEQEKPLEVTGQAEKEAACEPKEMKEDATTHPPPDLVLQKDHFLGPQESFPEENASSPFTQARAHWIRAVTKVRLQLQEIPDDGDPSLPQWLPEGPAGGLYGIDSMPDLRRKKPLPLVSDLSLVQSRKAGITSAMATRTSLKDEELKSHVYKKTLQALIYPISCTTPHNFEVWTATTPTYCYECEGLLWGIARQGMRCSECGVKCHEKCQDLLNADCLQRAAEKSCKHGAEDRTQNIIMAMKDRMKIRERNKPEIFEVIRDVFTVNKAAHVQQMKTVKQSVLDGTSKWSAKITITVVCAQGLQAKDKTGSSDPYVTVQVSKTKKRTKTIFGNLNPVWEEKFHFECHNSSDRIKVRVWDEDDDIKSRVKQRLKRESDDFLGQTIIEVRTLSGEMDVWYNLEKRTDKSAVSGAIRLQISVEIKGEEKVAPYHVQYTCLHENLFHYLTDIQGSGGVRIPEARGDDAWKVYFDETAQEIVDEFAMRYGIESIYQAMTHFACLSSKYMCPGVPAVMSTLLANINAYYAHTTASTNVSASDRFAASNFGKERFVKLLDQLHNSLRIDLSTYRNNFPAGSPERLQDLKSTVDLLTSITFFRMKVQELQSPPRASQVVKDCVKACLNSTYEYIFNNCHDLYSRQYQLKQELPPEEQGPSIRNLDFWPKLITLIVSIIEEDKNSYTPVLNQFPQELNVGKVSAEVMWHLFAQDMKYALEEHEKDHLCKSADYMNLHFKVKWLHNEYVRDLPVLQGQVPEYPAWFEQFVLQWLDENEDVSLEFLRGALERDKKDGFQQTSEHALFSCSVVDVFTQLNQSFEIIRKLECPDPSILAHYMRRFAKTIGKVLMQYADILSKDFPAYCTKEKLPCILMNNVQQLRVQLEKMFEAMGGKELDLEAADSLKELQVKLNTVLDELSMVFGNSFQVRIDECVRQMADILGQVRGTGNASPDARASAAQDADSVLRPLMDFLDGNLTLFATVCEKTVLKRVLKELWRVVMNTMERMIVLPPLTDQTGTQLIFTAAKELSHLSKLKDHMVREETRNLTPKQCAVLDLALDTIKQYFHAGGNGLKKTFLEKSPDLQSLRYALSLYTQTTDTLIKTFVRSQTTQGSGVDDPVGEVSIQVDLFTHPGTGEHKVTVKVVAANDLKWQTAGMFRPFVEVTMVGPHQSDKKRKFTTKSKSNNWAPKYNETFHFLLGNEEGPESYELQICVKDYCFAREDRVLGLAVMPLRDVTAKGSCACWCPLGRKIHMDETGLTILRILSQRSNDEVAREFVKLKSESRSTEEGS

SEQ ID NO: 901577 - protein, 1610 aa, Homo sapiens
MSLLCVRVKRAKFQGSPDKFNTYVTLKVQNVKSTTVAVRGDQPSWEQDFMFEISRLDLGLSVEVWNKGLIWDTMVGTVWIALKTIRQSDEEGPGEWSTLEAETLMKDDEICGTRNPTPHKILLDTRFELPFDIPEEEARYWTYKWEQINALGADNEYSSQEESQRKPLPTAAAQCSFEDPDSAVDDRDSDYRSETSNSFPPPYHTASQPNASVHQFPVPVRSPQQLLLQGSSRDSCNDSMQSYDLDYPERRAISPTSSSRYGSSCNVSQGSSQLSELDQYHEQDDDHRETDSIHSCHSSHSLSRDGQAGFGEQEKPLEVTGQAEKEAACEPKEMKEDATTHPPPDLVLQKDHFLGPQESFPEENASSPFTQARAHWIRAVTKVRLQLQEIPDDGDPSLPQWLPEGPAGGLYGIDSMPDLRRKKPLPLVSDLSLVQSRKAGITSAMATRTSLKDEELKSHVYKKTLQALIYPISCTTPHNFEVWTATTPTYCYECEGLLWGIARQGMRCSECGVKCHEKCQDLLNADCLQRAAEKSCKHGAEDRTQNIIMAMKDRMKIRERNKPEIFEVIRDVFTVNKAAHVQQMKTVKQSVLDGTSKWSAKITITVVCAQGLQAKDKTGSSDPYVTVQVSKTKKRTKTIFGNLNPVWEEKFHFECHNSSDRIKVRVWDEDDDIKSRVKQRLKRESDDFLGQTIIEVRTLSGEMDVWYNLEKRTDKSAVSGAIRLQISVEIKGEEKVAPYHVQYTCLHENLFHYLTDIQGSGGVRIPEARGDDAWKVYFDETAQEIVDEFAMRYGIESIYQAMTHFACLSSKYMCPGVPAVMSTLLANINAYYAHTTASTNVSASDRFAASNFGKERFVKLLDQLHNSLRIDLSTYRNNFPAGSPERLQDLKSTVDLLTSITFFRMKVQELQSPPRASQVVKDCVKACLNSTYEYIFNNCHDLYSRQYQLKQELPPEEQGPSIRNLDFWPKLITLIVSIIEEDKNSYTPVLNQFPQELNVGKVSAEVMWHLFAQDMKYALEEHEKDHLCKSADYMNLHFKVKWLHNEYVRDLPVLQGQVPEYPAWFEQFVLQWLDENEDVSLEFLRGALERDKKDGFQQTSEHALFSCSVVDVFTQLNQSFEIIRKLECPDPSILAHYMRRFAKTIGKVLMQYADILSKDFPAYCTKEKLPCILMNNVQQLRVQLEKMFEAMGGKELDLEAADSLKELQVKLNTVLDELSMVFGNSFQVRIDECVRQMADILGQVRGTGNASPDARASAAQDADSVLRPLMDFLDGNLTLFATVCEKTVLKRVLKELWRVVMNTMERMIVLPPLTDQTGTQLIFTAAKELSHLSKLKDHMVREETRNLTPKQCAVLDLALDTIKQYFHAGGNGLKKTFLEKSPDLQSLRYALSLYTQTTDTLIKTFVRSQTTQVHDGKGIRFTANEDIRPEKGSGVDDPVGEVSIQVDLFTHPGTGEHKVTVKVVAANDLKWQTAGMFRPFVEVTMVGPHQSDKKRKFTTKSKSNNWAPKYNETFHFLLGNEEGPESYELQICVKDYCFAREDRVLGLAVMPLRDVTAKGSCACWCPLGRKIHMDETGLTILRILSQRSNDEVAREFVKLKSESRSTEEGS

SEQ ID NO: 901578 - protein, 1591 aa, Homo sapiens; identical to SEQ ID NO: 901576

SEQ ID NO: 901579 - protein, 197 aa, Homo sapiens
GGCWGLRGRKVTVRKVCVHRALGFSFFISNMEETYTDSLDPEKLLQCPYDKNHQIRACRFPYHLIKCRKNHPDVASKLATCPFNARHQVPRAEISHHISSCDDRSCIEQDVVNQTRSLRQETLAESTWQCPPCDEDWDKDLWEQTSTPFVWGTTHYSDNNSPASNIVTEHKNNLASGMRVPKSLPYVLPWKNNGNAQ

SEQ ID NO: 901580 - protein, 120 aa, Homo sapiens
GEEGVCPPSTWIQLLHFQHGRNLQIILMLQANWLLVPSMLATRFLELKLVIISQAVMTEVVLSKMLSTKPGALDKRLWLRALGSALLAMKTGIKICGSRPAPHLSGAQLTTLTTTALRAT

SEQ ID NO: 901581 - protein, 197 aa, Homo sapiens; identical to SEQ ID NO: 901579

SEQ ID NO: 901582 - protein, 140 aa, Homo sapiens
RELTDPLILVPQNHPDVASKLATCPFNARHQVPRAEISHHISSCDDRSCIEQDVVNQTRSLRQETLAESTWQCPPCDEDWDKDLWEQTSTPFVWGTTHYSDNNSPASNIVTEHKNNLASGMRVPKSLPYVLPWKNNGNAQ

SEQ ID NO: 901583 - protein, 112 aa, Homo sapiens
RLLGLAWEEGDCEEGVCPPSTWIQLLHFQHGRNLQFLELKLVIISQAVMTEVVLSKMLSTKPGALDKRLWLRALGSALLAMKTGIKICGSRPAPHLSGAQLTTLTTTALRAT

SEQ ID NO: 901584 - protein, 197 aa, Homo sapiens; identical to SEQ ID NO: 901579

SEQ ID NO: 901585 - protein, 196 aa, Homo sapiens
GGCWGLRGRKVTVRKVCVHRALGFSFFISNMEETYTDSLDPEKLLQCPYDKNHQIRACRFPYHLIKCRKNHPDVASKLATCPFNARHQVPRAEISHHISSCDDRSCIEQDVVNQTRSLRQETLAESTWQCPPCDEDWDKDLWEQTSTPFVWGTTHYSDNNSPASNIVTEHKNNLASGMRVPKSLPYVLPWKNNARP

SEQ ID NO: 901586 - protein, 166 aa, Homo sapiens
MASGVTVNDEVIKVFNDMKVRKSSTQEEIKKRKKAVLFCLSDDKRQIIVEEAKQILVGDIGDTVEDPYTSFVKLLPLNDCRYALYDATYETKESKKEDLVFIFWAPESAPLKSKMIYASSKDAIKKKFTGIKHEWQVNGLDDIKDRSTLGEKLGGNVVVSLEGKPL

SEQ ID NO: 901587 - protein, 166 aa, Homo sapiens; identical to SEQ ID NO: 901586

SEQ ID NO: 901588 - protein, 219 aa, Homo sapiens
RCLGPPSPATSLGLQLPACPALSAAHPLARPSFSSQCHRAEARAAAAATAEGTMASGVTVNDEVIKVFNDMKVRKSSTQEEIKKRKKAVLFCLSDDKRQIIVEEAKQILVGDIGDTVEDPYTSFVKLLPLNDCRYALYDATYETKESKKEDLVFIFWAPESAPLKSKMIYASSKDAIKKKFTGIKHEWQVNGLDDIKDRSTLGEKLGGNVVVSLEGKPL

SEQ ID NO: 901589 - protein, 219 aa, Homo sapiens; identical to SEQ ID NO: 901588

SEQ ID NO: 901590 - protein, 219 aa, Homo sapiens; identical to SEQ ID NO: 901588

SEQ ID NO: 901591 - protein, 219 aa, Homo sapiens; identical to SEQ ID NO: 901588

SEQ ID NO: 901592 - protein, 219 aa, Homo sapiens; identical to SEQ ID NO: 901588

SEQ ID NO: 901593 - protein, 171 aa, Homo sapiens
RCLGPPSPATSLGLQLPACPALSAAHPLARPSFSSQCHRAEARAAAAATAEGTMASGVTVNDEVIKVFNDMKVRKSSTQEEIKKRKKAVLFCLSDDKRQIIVEEAKQILAPESAPLKSKMIYASSKDAIKKKFTGIKHEWQVNGLDDIKDRSTLGEKLGGNVVVSLEGKPL

SEQ ID NO: 901594 - protein, 219 aa, Homo sapiens; identical to SEQ ID NO: 901588

SEQ ID NO: 901595 - protein, 137 aa, Homo sapiens
RCLGPPSPATSLGLQLPACPALSAAHPLARPSFSSQCHRAEARAAAAATAEGTMASGVTVNDEVIKVFNDMKVRKAPESAPLKSKMIYASSKDAIKKKFTGIKHEWQVNGLDDIKDRSTLGEKLGGNVVVSLEGKPL

SEQ ID NO: 901596 - protein, 219 aa, Homo sapiens; identical to SEQ ID NO: 901588

SEQ ID NO: 901597 - protein, 149 aa, Homo sapiens
MKVRKSSTQEEIKKRKKAVLFCLSDDKRQIIVEEAKQILVGDIGDTVEDPYTSFVKLLPLNDCRYALYDATYETKESKKEDLVFIFWAPESAPLKSKMIYASSKDAIKKKFTGIKHEWQVNGLDDIKDRSTLGEKLGGNVVVSLEGKPL

SEQ ID NO: 901598 - protein, 155 aa, Homo sapiens
MAVLEDPNQFTSSTQEEIKKRKKAVLFCLSDDKRQIIVEEAKQILVGDIGDTVEDPYTSFVKLLPLNDCRYALYDATYETKESKKEDLVFIFWAPESAPLKSKMIYASSKDAIKKKFTGIKHEWQVNGLDDIKDRSTLGEKLGGNVVVSLEGKPL

SEQ ID NO: 901599 - protein, 137 aa, Homo sapiens; identical to SEQ ID NO: 901595

SEQ ID NO: 901600 - protein, 219 aa, Homo sapiens; identical to SEQ ID NO: 901588

SEQ ID NO: 901601 - protein, 165 aa, Homo sapiens
ARALPARAGSSDCGGIRDGGRAGHHGTGRHRAWRMMNFRQRMGWIGVGLYLLASAAAFYYVFEISETYNRLALEHIQQHPEEPLEGTTWTHSLKAQLLSLPFWVWTVIFLVPYLQMFLFLYSCTRADPKTVGYCIIPICLAVICNRHQAFVKASNQISRLQLIDT

SEQ ID NO: 901602 - protein, 163 aa, Homo sapiens
MPKPPDYSELSDSLTLAVGTGRFSGPLHRAWRMMNFRQRMGWIGVGLYLLASAAAFYYVFEISETYNRLALEHIQQHPEEPLEGTTWTHSLKAQLLSLPFWVWTVIFLVPYLQMFLFLYSCTRADPKTVGYCIIPICLAVICNRHQAFVKASNQISRLQLIDT

SEQ ID NO: 901603 - protein, 199 aa, Homo sapiens
PYTTYKLRVVAHNEVGSTASEWISFTTQKELPQYRAPFSVDSNLSVVCVNWSDTFLLNGQLKEYVLTDGGRRVYSGLDTTLYIPRTADKTFFFQVICTTDEGSVKTPLIQYDTSTGLGLVLTTPGKKKGSRSKSTEFYSELWFIVLMAMLGLILLAIFLSLILQRKIHKEPYIRERPPLVPLQKRMSPLNVYPPGENHM

SEQ ID NO: 901604 - protein, 112 aa, Homo sapiens
SVLEYPSYLRVPGFPHHLTQVPLKSLPDGSAWSAVRQGGWNHFWALWSFPLCSSTSSLQRCSDLCLGRKVEIRMSHGVPWATVALHGNNLLEQGVSSLLGIYPFLEEKPIPP

SEQ ID NO: 901605 - protein, 130 aa, Homo sapiens
MCQGGITTSLRQSQPSPQSQRRLCPAQSSQAFPHHLTQVPLKSLPDGSAWSAVRQGGWNHFWALWSFPLCSSTSSLQRCSDLCLGRKVEIRMSHGVPWATVALHGNNLLEQGVSSLLGIYPFLEEKPIPP

SEQ ID NO: 901606 - protein, 112 aa, Homo sapiens; identical to SEQ ID NO: 901604

SEQ ID NO: 901607 - protein, 452 aa, Homo sapiens
MLIVKQHPQLFCVVSLTPPWKKKKNYGILKTAYDVREKITNSLRVGLFHTHKPIYNIQSNLLTHINIPSYPINCQIINTFIEHLLCVGCKQYWGLTVIKDIVLALSDDCFTEEMEYKKPSNLWNSLLCFSFFFLAVESCSLNESKASLELLGSCGPPALAFSVAGTTGVNTAWKSLNHEELSLKILVIQVVGNLKLYLKNRIREFEIVHKSAKGCINTYFTFTIINFDSKFEYSTLFICGNFRLSPITLISVRHYKYKWAYTFVFALLTNNTQLGGFFFLSILPLNVQHFSDFVIVRLFNSFLEDSIETVIYVTLNSLAFLGTYRYMMVALPVVNSCQNIGFQCLLHMAFSLSTEGCRSLFLRSEPLFLYFLYSFLSLLYKNYACSIVFLFDSLSFIIPSRSDLLFSYVRKADLLVEEKIHPSKSACLIIFEGDLKCGKDCYIRQPNDDMRQ

SEQ ID NO: 901608 - protein, 452 aa, Homo sapiens; identical to SEQ ID NO: 901607

SEQ ID NO: 901609 - protein, 75 aa, Homo sapiens
VPWKQSLVSLPTQSSKKHYSLSQMSTEKYNTYEESSKNYQIVTNLYTHAQVSLSICGALVLGPLMDTNIYGCSSP

SEQ ID NO: 901610 - protein, 109 aa, Homo sapiens
VPEVPSLLPGLRGRGLLTSFVLAPPRPSTRFGPCLVLSVCSYGSEYVCDGPRVTRGLGPLPTLRLASRAVELARAPSPTSASPVRPSLVVGRSSWSLSCAPPHAAGLRV

SEQ ID NO: 901611 - protein, 73 aa, Homo sapiens
SRKCLLSSRVCADAASLPHLSSPLPVPLRVLVPVWCFLFAATAVSISGHRNQSETIASAIKTIVHHGGTHGYL

SEQ ID NO: 901612 - protein, 140 aa, Homo sapiens
MTSMTQSLREVIKAMTKARNFERVLGKITLVSAAPGKVICEMKVEEEHTNAIGTLHGGLTATLVDNISTMALLCTERGAPGVSVDMNITYMSPAKLGEDIVITAHVLKQGKTLAFTSVDLTNKATGKLIAQGRHTKHLGN

SEQ ID NO: 901613 - protein, 218 aa, Homo sapiens
MDNHGPNPAVTYRDLGPSRLSPDFSAAPKSGQKGADSSALCATTFFSTIFLGGFSTLCPFTMAYFSISLHSALDQPSTMTSMTQSLREVIKAMTKARNFERVLGKITLVSAAPGKVICEMKVEEEHTNAIGTLHGGLTATLVDNISTMALLCTERGAPGVSVDMNITYMSPAKLGEDIVITAHVLKQGKTLAFTSVDLTNKATGKLIAQGRHTKHLGN

SEQ ID NO: 901614 - protein, 117 aa, Homo sapiens
MVRKITLVSAAPGKVICEMKVEEEHTNAIGTLHGGLTATLVDNISTMALLCTERGAPGVSVDMNITYMSPAKLGEDIVITAHVLKQGKTLAFTSVDLTNKATGKLIAQGRHTKHLGN

SEQ ID NO: 901615 - protein, 140 aa, Homo sapiens; identical to SEQ ID NO: 901612

SEQ ID NO: 901616 - protein, 124 aa, Homo sapiens
MTQSLREVIKAMTKARNFERVLGKITLVSAAPGKVICEMKVEEEHTNAIGTLHGGLTATLVDNISTMALLCTERGAPDSKYNLLSGSRFAHREVKSICDFSTSFSSRILLRPNGMSLFKHVRSY

SEQ ID NO: 901617 - protein, 126 aa, Homo sapiens [sequence omitted]

SEQ ID NO: 901618 - protein, 140 aa, Homo sapiens; identical to SEQ ID NO: 901612

SEQ ID NO: 901619 - protein, 140 aa, Homo sapiens; identical to SEQ ID NO: 901612

SEQ ID NO: 901620 - protein, 140 aa, Homo sapiens; identical to SEQ ID NO: 901612

SEQ ID NO: 901621 - protein, 563 aa, Homo sapiens
ASGGARRLPGGSGLGAQSGRGSPAPAAMDEERALYIVRAGEAGAIERVLRDYSDKHRATFKFESTDEDKRKKLCEGIFKVLIKDIPTTCQVSCLEVLRILSRDKKVLVPVTTKENMQILLRLAKLNELDDSLEKVSEFPVIVESLKCLCNIVFNSQMAQQLSLELNLAAKLCNLLRKCKDRKFINDIKCFDLRLLFLLSLLHTDIRSQLRYELQGLPLLTQILESAFSIKWTDEYESAIDHNGPPLSPQETDCAIEALKALFNVTVDSWKVHKESDSHQFRVMAAVLRHCLLIVGPTEDKTEELHSNAVNLLSNVPVSCLDVLICPLTHEETAQEATTLDELPSNKTAEKETVLKNNTMVYNGMNMEAIHVLLNFMEKRIDKGSSYREGLTPVLSLLTECSRAHRNIRKFLKDQVLPPLRDVTNRPEVGSTVRNKLVRLMTHVDLGVKQIAAEFLFVLCKERVDSLLKYTGYGNAAGLLAARGLLAGGRGDNWYSEDEDTDTEEYKNAKPNINLITGHLEEPMPNPIDEMTEEQKEYEAMKLVNMLDKLSRRADVKDLHQDGG

SEQ ID NO: 901622 - protein, 547 aa, Homo sapiens
ASGGARRLPGGSGLGAQSGRGSPAPAAMDEERALYIVRAGEAGAIERVLRDYSDKHRATFKFESTDEDKRKKLCEGIFKVLIKDIPTTCQVSCLEVLRILSRDKKVLVPVTTKENMQILLRLAKLNELDDSLEKVSEFPVIVESLKCLCNIVFNSQMAQQLSLELNLAAKLCNLLRKCKDRKFINDIKCFDLRLLFLLSLLHTDIRSQLRYELQGLPLLTQILESAFSIKWTDEYESAIDHNGPPLSPQETDCAIEALKALFNVTVDSWKVHKESDSHQFRVMAAVLRHCLLIVGPTEDKTEELHSNAVNLLSNVPVSCLDVLICPLTHEETAQEATTLDELPSNKTAEKETVLKNNTMVYNGMNMEAIHVLLNFMEKRIDKGSSYREGLTPVLSLLTECSRAHRNIRKFLKDQVLPPLRDVTNRPEVGSTVRNKLVRLMTHVDLGVKQIAAEFLFVLCKERVDSLLKYTGYGNAAGLLAARGLLAGGRGDNWYSEDEDTDTEEYKNAKPKEELLKPMGLKPDGTITPLEEALNQYSVIEETSSDTD

SEQ ID NO: 901623 - protein, 496 aa, Homo sapiens
MLASKLCEGIFKVLIKDIPTTCQVSCLEVLRILSRDKKVLVPVTTKENMQILLRLAKLNELDDSLEKVSEFPVIVESLKCLCNIVFNSQMAQQLSLELNLAAKLCNLLRKCKDRKFINDIKCFDLRLLFLLSLLHTDIRSQLRYELQGLPLLTQILESAFSIKWTDEYESAIDHNGPPLSPQETDCAIEALKALFNVTVDSWKVHKESDSHQFRVMAAVLRHCLLIVGPTEDKTEELHSNAVNLLSNVPVSCLDVLICPLTHEETAQEATTLDELPSNKTAEKETVLKNNTMVYNGMNMEAIHVLLNFMEKRIDKGSSYREGLTPVLSLLTECSRAHRNIRKFLKDQVLPPLRDVTNRPEVGSTVRNKLVRLMTHVDLGVKQIAAEFLFVLCKERVDSLLKYTGYGNAAGLLAARGLLAGGRGDNWYSEDEDTDTEEYKNAKPNINLITGHLEEPMPNPIDEMTEEQKEYEAMKLVNMLDKLSRRADVKDLHQDGG

SEQ ID NO: 901624 - protein, 276 aa, Homo sapiens
ASGGARRLPGGSGLGAQSGRGSPAPAAMDEERALYIVRAGEAGAIERVLRDYSDKHRATFKFESTDEDKRKKLCEGIFKVLIKDIPTTCQVSCLEVLRILSRDKKVLVPVTTKENMQILLRLAKLNELDDSLEKVSEFPVIVESLKCLCNIVFNSQMAQQLSLELNLAAKLCNLLRKCKDRKFINDIKCFDLRLLFLLSLLHTDIRSQLRYELQGLPLLTQILESAFSIKWTDEYESAIDHNGPPLSPQETDCAIEALKALFNVTVDSWKVHKEVR

SEQ ID NO: 901625 - protein, 587 aa, Homo sapiens
ASGGARRLPGGSGLGAQSGRGSPAPAAMDEERALYIVRAGEAGAIERVLRDYSDKHRATFKFESTDEDKRKKLCEGIFKVLIKDIPTTCQVSCLEVLRILSRDKKVLVPVTTKENMQILLRLAKLNELDDSLEKVSEFPVIVESLKCLCNIVFNSQMAQQLSLELNLAAKLCNLLRKCKDRKFINDIKCFDLRLLFLLSLLHTDIRSQLRYELQGLPLLTQILESAFSIKWTDEYESAIDHNGPPLSPQETDCAIEALKALFNVTVDSWKVHKESDSHQFRVMAAVLRHCLLIVGPTEDKTEELHSNAVNLLSNVPVSCLDVLICPLTHEETAQEATTLDELPSNKTAEKETVLKNNTMVYNGMNMEAIHVLLNFMEKRIDKGSSYREGLTPVLSLLTECSRAHRNIRKFLKDQVLPPLRDVTNRPEVGSTVRNKLVRLMTHVDLGVKQIAAEFLFVLCKERVDSLLKYTGYGNAAGLLAARGLLAGGRGDNWYSEDEDTDTEEYKNAKPNINLITGHLEEPMPNPIDEMTEEQKEYEAMKLVNMLDKLSREELLKPMGLKPDGTITPLEEALNQYSVIEETSSDTD

SEQ ID NO: 901626 - protein, 556 aa, Homo sapiens
ASGGARRLPGGSGLGAQSGRGSPAPAAMDEERALYIVRAGEAGAIERVLRDYSDKHRATFKFESTDEDKRKKLCEGIFKVLIKDIPTTCQVSCLEVLRILSRDKKVLVPVTTKENMQILLRLAKLNELDDSLEKVSEFPVIVESLKCLCNIVFNSQMAQQLSLELNLAAKLCNLLRKCKDRKFINDIKCFDLRLLFLLSLLHTDIRSQLRYELQGLPLLTQILESAFSIKWTDEYESAIDHNGPPLSPQETDCAIEALKALFNVTVDSWKVHKESDSHQFRVMAAVLRHCLLIVGPTEDKTEELHSNAVNLLSNVPVSCLDVLICPLTHEETAQEATTLDELPSNKTAEKETVLKNNTMVYNGMNMEAIHVLLNFMEKRIDKGSSYREGLTPVLSLLTECSRAHRNIRKFLKDQVLPPLRDVTNRPEVGSTVRNKLVRLMTHVDLGVKQIAAEFLFVLCKERVDSLLKYTGYGNAAGLLAARGLLAGGRGDNWYSEDEDTDTEEYKNAKPNINLITGHLEEPMPNPIDEMTEEQKEYEAMKLVNMLDKLSRGIHIF

SEQ ID NO: 901627 - protein, 519 aa, Homo sapiens
ASGGARRLPGGSGLGAQSGRGSPAPAAMDEERALYIVRAGEAGAIERVLRDYSDKHRATFKFESTDEDKRKKLCEGIFKVLIKDIPTTCQVSCLEVLRILSRDKKVLVPVTTKENMQILLRLAKLNELDDSLEKVSEFPVIVESLKCLCNIVFNSQMAQQLSLELNLAAKLCNLLRKCKDRKFINDIKCFDLRLLFLLSLLHTDIRSQLRYELQGLPLLTQILESAFSIKWTDEYESAIDHNGPPLSPQETDCAIEALKALFNVTVDSWKVHKESDSHQFRVMAAVLRHCLLIVGPTEDKTEELHSNAVNLLSNVPVSCLDVLICPLTHEETAQEATTLDELPSNKTAEKETVLKNNTMVYNGMNMEAIHVLLNFMEKRIDKGSSYREGLTPVLSLLTECSRAHRNIRKFLKDQVLPPLRDVTNRPEVGSTVRNKLVRLMTHVDLGVKQIAAEFLFVLCKERVDSLLKYTGYGNAAGLLAARGLLAGGRGDNWYSEDEDTDTEEYKNAKPKYSIKFLFT

SEQ ID NO: 901628 - protein, 113 aa, Homo sapiens
PEGPAPPFSAGNGAAPRSSSPAMAFTFAAFCYMLALLLTAALIFFAIWHIIAFDELKTDYKNPIDQCNTLNPLVLPEYLIHAFFCVMFLCAAEWLTLGLNMPLCGISYLEVYE

SEQ ID NO: 901629 - protein, 118 aa, Homo sapiens
ALVVDEAGVDGEQAHKQEQVRPLKKVCQISLFAAFCYMLALLLTAALIFFAIWHIIAFDELKTDYKNPIDQCNTLNPLVLPEYLIHAFFCVMFLCAAEWLTLGLNMPLCGISYLEVYE

SEQ ID NO: 901630 - protein, 113 aa, Homo sapiens; identical to SEQ ID NO: 901628

SEQ ID NO: 901631 - protein, 113 aa, Homo sapiens; identical to SEQ ID NO: 901628

SEQ ID NO: 901632 - protein, 129 aa, Homo sapiens
PEGPAPPFSAGNGAAPRSSSPAMAFTFAAFCYMLALLLTAALIFFAIWHIIAFDELKTDYKNPIDQCNTLNPTVEKVKKIKRVKIALKLVLPEYLIHAFFCVMFLCAAEWLTLGLNMPLCGISYLEVYE

SEQ ID NO: 901633 - protein, 90 aa, Homo sapiens
PEGPAPPFSAGNGAAPRSSSPAMAFTFAAFCYMLALLLTAALIFFAIWHLVLPEYLIHAFFCVMFLCAAEWLTLGLNMPLCGISYLEVYE

SEQ ID NO: 901634 - protein, 108 aa, Homo sapiens
MCWLRCCLQRARRLVQYCTYVHLWYIILSIYEGRVRDLSYDEVLIYTMVDNSAWISSTLVSSLRKIARSYTTTSSYHVVYSAPCGGAEWLTLGLNMPLCGISYLEVYE

SEQ ID NO: 901635 - protein, 113 aa, Homo sapiens; identical to SEQ ID NO: 901628

SEQ ID NO: 901636 - protein, 113 aa, Homo sapiens; identical to SEQ ID NO: 901628

SEQ ID NO: 901637 - protein, 147 aa, Homo sapiens
MGDLEIPHYSLYSQSTSSTLSSVSCFFVQQSGLHWVSICPSVAYHIWRYMSRPVMSGPGLYDPTTIMNADILAYCQKEGWCKLAFYLLAFFYYLYGDLEIPHTEYSGLIELTPEVIVNLASPAVSSLKVRLIFKIVSPGPSIAPNSK

SEQ ID NO: 901638 - protein, 113 aa, Homo sapiens; identical to SEQ ID NO: 901628

SEQ ID NO: 901639 - protein, 70 aa, Homo sapiens
TQRALRRLSPLATAPLPAPPPQPWRSRSRPSATCWRCCSLPRSSSSPFGTIKRNLDKQLKLFFYSEDYFE

SEQ ID NO: 901640 - protein, 75 aa, Homo sapiens
PEGPAPPFSAGNGAAPRSSSPAMAFTFAAFCYMLALLLTAALIFFAIWHIIAFDELKTDYKNPIDQCNTLNPVYE

SEQ ID NO: 901641 - protein, 150 aa, Homo sapiens
PEGPAPPFSAGNGAAPRSSSPAMAFTFAAFCYMLALLLTAALIFFAIWHIIAFDELKTDYKNPIDQCNTLNPLVLPEYLIHAFFCVMFLCAAEWLTLGLNMPLCGISYLEHDLCFGELLEQHTEECGPVKCMQKKPPNEGILSSKDPVQE

SEQ ID NO: 901642 - protein, 274 aa, Homo sapiens
WKSCGGQKAEPLLGDGGISFAMAAGPISERNQDATVYVGGLDEKVSEPLLWELFLQAGPVVNTHMPKDRVTGQHQGYGFVEFLSEEDADYAIKIMNMIKLYGKPIRVNKASAHNKNLDVGANIFIGNLDPEIDEKLLYDTFSAFGVILQTPKIMRDPDTGNSKGYAFINFASFDASDAAIEAMNGQYLCNRPITVSYAFKKDSKGERHGSAAERLLAAQNPLSQADRPHQLFADAPPPPSAPNPVVSSLGSGLPPPGMPLWVLFPPGASGAPVP

SEQ ID NO: 901643 - protein, 424 aa, Homo sapiens
MAAGPISERNQDATVYVGGLDEKVSEPLLWELFLQAGPVVNTHMPKDRVTGQHQGYGFVEFLSEEDADYAIKIMNMIKLYGKPIRVNKASAHNKNLDVGANIFIGNLDPEIDEKLLYDTFSAFGVILQTPKIMRDPDTGNSKGYAFINFASFDASDAAIEAMNGQYLCNRPITVSYAFKKDSKGERHGSAAERLLAAQNPLSQADRPHQLFADAPPPPSAPNPVVSSLGSGLPPPGMPPPGSFPPPVPPPGALPPGIPPAMPPPPMPPGAAGHGPPSAGTPGAGHPGHGHSHPHPFPPGGMPHPGMSQMQLAHHGPHGLGHPHAGPPGSGGQPPPRPPPGMPHPGPPPMGMPPRGPPFGSPMGHPGPMPPHGMRGPPPLMPPHGYTGPPRPPPYGYQRGPLPPPRPTPRPPVPPRGPLRGPLPQ

SEQ ID NO: 901644 - protein, 441 aa, Homo sapiens
TQTASRAAFKSGRGSFRHGCGPISERNQDATVYVGGLDEKVSEPLLWELFLQAGPVVNTHMPKDRVTGQHQGYGFVEFLSEEDADYAIKIMNMIKLYGKPIRVNKASAHNKNLDVGANIFIGNLDPEIDEKLLYDTFSAFGVILQTPKIMRDPDTGNSKGYAFINFASFDASDAAIEAMNGQYLCNRPITVSYAFKKDSKGERHGSAAERLLAAQNPLSQADRPHQLFADAPPPPSAPNPVVSSLGSGLPPPGMPPPGSFPPPVPPPGALPPGIPPAMPPPPMPPGAAGHGPPSAGTPGAGHPGHGHSHPHPFPPGGMPHPGMSQMQLAHHGPHGLGHPHAGPPGSGGQPPPRPPPGMPHPGPPPMGMPPRGPPFGSPMGHPGPMPPHGMRGPPPLMPPHGYTGPPRPPPYGYQRGPLPPPRPTPRPPVPPRGPLRGPLPQ

SEQ ID NO: 901645 - protein, 369 aa, Homo sapiens
WKSCGGQKAEPLLGDGGISFAMAAGPISERNQDATVYVGGLDEKVSEPLLWELFLQAGPVVNTHMPKDRVTGQHQGYGFVEFLSEEDADYAIKIMNMIKLYGKPIRVNKASAHNKNLDVGANIFIGNLDPEIDEKLLYDTFSAFGVILQTPKIMRDPDTGNSKGYAFINFASFDASDAAIEAMNGQYLCNRPITVSYAFKKDSKGERHGSAAERLLAAQNPLSQADRPHQLFADAPPPPSAPNPVVSSLGSGLPPPGMPPPGSFPPPVPPPGALPPGIPPAMPPPPMPPGAAGHGPPSAGTPGAGHPGHGHSHPHPFPPGGMPHPDRILDELTHYANPDPALGSSADTLMLSDSHGSPGLLIHGTVFSM

SEQ ID NO: 901646 - protein, 462 aa, Homo sapiens
WKSCGGQKAEPLLGDGGISFAMAAGPISERNQDATVYVGGLDEKVSEPLLWELFLQAGPVVNTHMPKDRVTGQHQGYGFVEFLSEEDADYAIKIMNMIKLYGKPIRVNKASAHNKNLDVGANIFIGNLDPEIDEKLLYDTFSAFGVILQTPKIMRDPDTGNSKGYAFINFASFDASDAAIEAMNGQYLCNRPITVSYAFKKDSKGERHGSAAERLLAAQNPLSQADRPHQLFADAPPPPSAPNPVVSSLGSGLPPPGMPPPGSFPPPVPPPGALPPGIPPAMPPPPMPPGAAGHGPPSAGTPGAGHPGHGHSHPHPFPPGGMPHPARPPPGMPHPGPPPMGMPPRGPPFGSPMGHPGPMPPHGMRGPPPLMPPHGYTGPPRASDHYWFNNGGLIPSTETPTSPGWTQLLTSYGPPFSRPRRSVTYQFYVGSSLRSLVYHFALQSLSSRTFPVGKRLETKWAC

SEQ ID NO: 901647 - protein, 188 aa, Homo sapiens
MPPPGSFPPPVPPPGALPPGIPPAMPPPPMPPGAAGHGPPSAGTPGAGHPGHGHSHPHPFPPGGMPHPGMSQMQLAHHGPHGLGHPHAGPPGSGGQPPPRPPPGMPHPGPPPMGMPPRGPPFGSPMGHPGPMPPHGMRGPPPLMPPHGYTGPPRPPPYGYQRGPLPPPRPTPRPPVPPRGPLRGPLPQ

SEQ ID NO: 901648 - protein, 445 aa, Homo sapiens
WKSCGGQKAEPLLGDGGISFAMAAGPISERNQDATVYVGGLDEKVSEPLLWELFLQAGPVVNTHMPKDRVTGQHQGYGFVEFLSEEDADYAIKIMNMIKLYGKPIRVNKASAHNKNLDVGANIFIGNLDPEIDEKLLYDTFSAFGVILQTPKIMRDPDTGNSKGYAFINFASFDASDAAIEAMNGQYLCNRPITVSYAFKKDSKGERHGSAAERLLAAQNPLSQADRPHQLFADAPPPPSAPNPVVSSLGSGLPPPGMPPPGSFPPPVPPPGALPPGIPPAMPPPPMPPGAAGHGPPSAGTPGAGHPGHGHSHPHPFPPGGMPHPGMSQMQLAHHGPHGLGHPHAGPPGSGGQPPPRPPPGMPHPGPPPMGMPPRGPPFGSPMGHPGPMPPHGMRGPPPLMPPHGYTGPPRPPPYGYQRGPLPPPRPTPRPPVPPRGPLRGPLPQ

SEQ ID NO: 901649 - protein, 446 aa, Homo sapiens
NYLRRRSLVCHFQSRGTCAIGLYRYLVSGAYILDATVYVGGLDEKVSEPLLWELFLQAGPVVNTHMPKDRVTGQHQGYGFVEFLSEEDADYAIKIMNMIKLYGKPIRVNKASAHNKNLDVGANIFIGNLDPEIDEKLLYDTFSAFGVILQTPKIMRDPDTGNSKGYAFINFASFDASDAAIEAMNGQYLCNRPITVSYAFKKDSKGERHGSAAERLLAAQNPLSQADRPHQLFADAPPPPSAPNPVVSSLGSGLPPPGMPPPGSFPPPVPPPGALPPGIPPAMPPPPMPPGAAGHGPPSAGTPGAGHPGHGHSHPHPFPPGGMPHPGMSQMQLAHHGPHGLGHPHAGPPGSGGQPPPRPPPGMPHPGPPPMGMPPRGPPFGSPMGHPGPMPPHGMRGPPPLMPPHGYTGPPRPPPYGYQRGPLPPPRPTPRPPVPPRGPLRGPLPQ

SEQ ID NO: 901650 - protein, 470 aa, Homo sapiens
MEHVYYVANVFSQLGYETKTIPHCSNMLKKSSEGEEMDAQLSHQWMLLEWPISERNQDATVYVGGLDEKVSEPLLWELFLQAGPVVNTHMPKDRVTGQHQGYGFVEFLSEEDADYAIKIMNMIKLYGKPIRVNKASAHNKNLDVGANIFIGNLDPEIDEKLLYDTFSAFGVILQTPKIMRDPDTGNSKGYAFINFASFDASDAAIEAMNGQYLCNRPITVSYAFKKDSKGERHGSAAERLLAAQNPLSQADRPHQLFADAPPPPSAPNPVVSSLGSGLPPPGMPPPGSFPPPVPPPGALPPGIPPAMPPPPMPPGAAGHGPPSAGTPGAGHPGHGHSHPHPFPPGGMPHPGMSQMQLAHHGPHGLGHPHAGPPGSGGQPPPRPPPGMPHPGPPPMGMPPRGPPFGSPMGHPGPMPPHGMRGPPPLMPPHGYTGPPRPPPYGYQRGPLPPPRPTPRPPVPPRGPLRGPLPQ

SEQ ID NO: 901651 - protein, 305 aa, Homo sapiens
MAAGPISERNQDATVYVGGLDEKVSEPLLWELFLQAGPVVNTHMPKDRVTGQHQGYGFVEFLSEEDADYAIKIMNMIKLYGKPIRVNKASLFADAPPPPSAPNPVVSSLGSGLPPPGMPPPGSFPPPVPPPGALPPGIPPAMPPPPMPPGAAGHGPPSAGTPGAGHPGHGHSHPHPFPPGGMPHPGMSQMQLAHHGPHGLGHPHAGPPGSGGQPPPRPPPGMPHPGPPPMGMPPRGPPFGSPMGHPGPMPPHGMRGPPPLMPPHGYTGPPRPPPYGYQRGPLPPPRPTPRPPVPPRGPLRGPLPQ

SEQ ID NO: 901652 - protein, 119 aa, Homo sapiens
RRGVRAPGPGAGARHHPLRQGKARFPQFLGRPPSIRGLGHLRSQRDAQGGTLGGILIVIRRFHARAVGGTAGISRRRVSRAFAGGLNGLEAKTLGVGATGSAMGANEDVGLWVQHPTVL

SEQ ID NO: 901653 - protein, 409 aa, Homo sapiens
RSMDAEGPAGRARRVSGEPQQSGDGSLSPQAEAIEVAAGESAGRSPGELAWDAAEEAEVPGVKGSEEAAPGDARADAGEDRVGDGPQQEPGEDEERRERSPEGPREEEAAGGEEESPDSSPHGEASRGAAEPEAQLSNHLAEEGPAEGSGEAARVNGRREDGEASEPRALGQEHDITLFVKAGYDGESIGNCPFSQRLFMILWLKGVIFNVTTVDLKRKPADLQNLAPGTNPPFMTFDGEVKTDVNKIEEFLEEKLAPPRYPKLGTQHPESNSAGNDVFAKFSAFIKNTKKDANEIHEKNLLKALRKLDNYLNSPLPDEIDAYSTEDVTVSGRKFLDGDELTLADCNLLPKLHIIKIVAKKYRDFEFPSEMTGIWRYLNNAYARDEFTNTCPADQEIEHAYSDVAKRMK

SEQ ID NO: 901654 - protein, 437 aa, Homo sapiens
SLQIKFRKDSEFWTPGKPMAMRLILFFGALFGHIYCLETFVGDQVLEIVPSNEEQIKNLLQLEAQEHLQLDFWKSPTTPGETAHVRVPFVNVQAVKVFLESQGIAYSIMIEDVQVLLDKENEEMLFNRRRERSGNFNFGAYHTLEEISQEMDNLVAEHPGLVSKVNIGSSFENRPMNVLKFSTGGDKPAIWLDAGIHAREWVTQATALWTANKIVSDYGKDPSITSILDALDIFLLPVTNPDGYVFSQTKNRMWRKTRSKVSGSLCVGVDPNRNWDAGFGGPGASSNPCSDSYHGPSANSEVEVKSIVDFIKSHGKVKAFITLHSYSQLLMFPYGYKCTKLDDFDELSEVAQKAAQSLRSLHGTKYKVGPICSVIYQASGGSIDWSYDYGIKYSFAFELRDTGRYGFLLPARQILPTAEETWLGLKAIMEHVRDHPY

SEQ ID NO: 901655 - protein, 412 aa, Homo sapiens
SLQIKFRKDSEFWTPGKPMAMRLILFFGALFGHIYCLETFVGDQVLEIVPSNEEQIKNLLQLEAQEHLQLDFWKSPTTPGETAHVRVPFVNVQAVKVFLESQGIAYSIMIEDVQVLLDKENEEMLFNRRRERSGNFNFGAYHTLEEISQEMDNLVAEHPGLVSKVNIGSSFENRPMNVLKFSTGGDKPAIWLDAGIHAREWVTQATALWTANKIVSDYGKDPSITSILDALDIFLLPVTNPDGYVFSQTKNRMWRKTRSKVSGSLCVGVDPNRNWDAGFGGPGASSNPCSDSYHGPSANSEVEVKSIVDFIKSHGKVKAFITLHSYSQLLMFPYGYKCTKYKVGPICSVIYQASGGSIDWSYDYGIKYSFAFELRDTGRYGFLLPARQILPTAEETWLGLKAIMEHVRDHPY

SEQ ID NO: 901656 - protein, 299 aa, Homo sapiens
IYSLETFQISQEMDNLVAEHPGLVSKVNIGSSFENRPMNVLKFSTGGDKPAIWLDAGIHAREWVTQATALWTANKIVSDYGKDPSITSILDALDIFLLPVTNPDGYVFSQTKNRMWRKTRSKVSGSLCVGVDPNRNWDAGFGGPGASSNPCSDSYHGPSANSEVEVKSIVDFIKSHGKVKAFITLHSYSQLLMFPYGYKCTKLDDFDELSEVAQKAAQSLRSLHGTKYKVGPICSVIYQASGGSIDWSYDYGIKYSFAFELRDTGRYGFLLPARQILPTAEETWLGLKAIMEHVRDHPY

SEQ ID NO: 901657 - protein, 276 aa, Homo sapiens
SLQIKFRKDSEFWTPGKPMAMRLILFFGALFGHIYCLETFVGDQVLEIVPSNEEQIKNLLQLEAQEHLQLDFWKSPTTPGETAHVRVPFVNVQAVKVFLESQGIAYSIMIEDVQVLLDKENEEMLFNRRRERSGNFNFGAYHTLEEISQEMDNLVAEHPGLVSKVNIGSSFENRPMNVLKFSTGGDKPAIWLDAGIHAREWVTQATALWTANKIVSDYGKDPSITSILDALDIFLLPVTNPDGYVFSQTKPGFCSLLQQGPKEMCRNFKSKIKILI

SEQ ID NO: 901658 - protein, 437 aa, Homo sapiens; identical to SEQ ID NO: 901654

SEQ ID NO: 901659 - protein, 437 aa, Homo sapiens; identical to SEQ ID NO: 901654

SEQ ID NO: 901660 - protein, 362 aa, Homo sapiens
SLQIKFRKDSEFWTPGKPMAMRLILFFGALFGHIYCLETFVGDQVLEIVPSNEEQIKNLLQLEAQEHLQLDFWKSPTTPGETAHVRVPFVNVQAVKVFLESQGIAYSIMIEDVQISQEMDNLVAEHPGLVSKVNIGSSFENRPMNVLKFSTGGDKPAIWLDAGIHAREWVTQATALWTANKIVSDYGKDPSITSILDALDIFLLPVTNPDGYVFSQTKHGPSANSEVEVKSIVDFIKSHGKVKAFITLHSYSQLLMFPYGYKCTKLDDFDELSEVAQKAAQSLRSLHGTKYKVGPICSVIYQASGGSIDWSYDYGIKYSFAFELRDTGRYGFLLPARQILPTAEETWLGLKAIMEHVRDHPY

SEQ ID NO: 901661 - protein, 1128 aa, Homo sapiens
MHSLPGVVAVGYINEAIDEGNPLRTLETLLLPTANISDVDPAHAQHYQDVLYHAKSQKLGDSESVSKVLWLDEIQQAVDEANVDEDRAKQWVTLVVDVNQCLEGKKSSDILSVLKSSTSNANDIIPECADKYYDALVKAKELKSERVSSDGSWLKLNLHKKYDYYYNTDSKESSWVTPESCLYKESWLTGKEIEDIIEEVTVGYIRENIWSASEELLLRFQATSSGPILREEFEARKSFLHEQEENVVKIQAFWKGYKQRKEYMHRRQTFIDNTDSIVKIQSWFRMATARKSYLSRLQYFRDHNNEIVKIQSLLRANKARDDYKTLVGSENPPLTVIRKFVYLLDQSDLDFQEELEVARLREEVVTKIRANQQLEKDLNLMDIKIGLLVKNRITLEDVISHSKKLNKKKGGEMEILNNTDNQGIKSLSKERRKTLETYQQLFYLLQTNPLYLAKLIFQMPQNKSTKFMDTVIFTLYNYASNQREEYLLLKLFKTALEEEIKSKVDQVQDIVTGNPTVIKMVVSFNRGARGQNTLRQLLAPVVKEIIDDKSLIINTNPVEVYKAWVNQLETQTGEASKLPYDVTTEQALTYPEVKNKLEASIENLRRVTDKVLNSIISSLDLLPYGLRYIAKVLKNSIHEKFPDATEDELLKIVGNLLYYRYMNPAIVAPDGFDIIDMTAGGQINSDQRRNLGSVAKVLQHAASNKLFEGENEHLSSMNNYLSETYQEFRKYFKEACNVPEPEEKFNMDKYTDLVTVSKPVIYISIEEIISTHSLLLEHQDAIAPEKNDLLSELLGSLGEVPTVESFLGEGAVDPNDPNKANTLSQLSKTEISLVLTSKYDIEDGEAIDSRSLMIKTKKLIIDVIRNQPGNTLTEILETPATAQQEVDHATDMVSRAMIDSRTPEEMKHSQSMIEDAQLPLEQKKRKIQRNLRTLEQTGHVSSENKYQDILNEIAKDIRNQRIYRKLRKAELAKLQQTLNALNKKAAFYEEQINYYDTYIKTCLDNLKRKNTRRSIKLDGKGEPKGAKRAKPVKYTAAKLHEKGVLLDIDDLQTNQFKNVTFDIIATEDVGIFDVRSKFLGVEMEKVQLNIQDLLQMQYEGVAVMKMFDKVKVNVNLLIYLLNKKFYGK

SEQ ID NO: 901662 - protein, 1110 aa, Homo sapiens
MHSLPGVVAVGYINEAIDEGNPLRTLETLLLPTANISDVDPAHAQHYQDVLYHAKSQKLGDSESVSKVLWLDEIQQAVDEANVDEDRAKQWVTLVVDVNQCLEGKKSSDILSVLKSSTSNANDIIPECADKYYDALVKAKELKSERVSSDGSWLKLNLHKKYDYYYNTDSKESSWVTPESCLYKESWLTGKEIEDIIEEVTVGYIRENIWSASEELLLRFQATSSGPILREEFEARKSFLHEQEENVVKIQAFWKGYKQRKEYMHRRQTFIDNTDSIVKIQSWFRMATARKSYLSRLQYFRDHNNEIVKIQSLLRANKARDDYKTLVGSENPPLTVIRKFVYLLDQSDLDFQEELEVARLREEVVTKIRANQQLEKDLNLMDIKIGLLVKNRITLEDVISHSKKLNKKKGGEMEILNNTDNQGIKSLSKERRKTLETYQQLFYLLQTNPLYLAKLIFQMPQNKSTKFMDTVIFTLYNYASNQREEYLLLKLFKTALEEEIKSKVDQVQDIVTGNPTVIKMVVSFNRGARGQNTLRQLLAPVVKEIIDDKSLIINTNPVEVYKAWVNQLETQTGEASKLPYDVTTEQALTYPEVKNKLEASIENLRRVTDKVLNSIISSLDLLPYGLRYIAKVLKNSIHEKFPDATEDELLKIVGNLLYYRYMNPAIVAPDGFDIIDMTAGGQINSDQRRNLGSVAKVLQHAASNKLFEGENEHLSSMNNYLSETYQEFRKYFKEACNVPEPEEKFNMDKYTDLVTVSKPVIYISIEEIISTHSLLLEHQDAIAPEKNDFREGAVDPNDPNKANTLSQLSKTEISLVLTSKYDIEDGEAIDSRSLMIKTKKLIIDVIRNQPGNTLTEILETPATAQQEVDHATDMVSRAMIDSRTPEEMKHSQSMIEDAQLPLEQKKRKIQRNLRTLEQTGHVSSENKYQDILNEIAKDIRNQRIYRKLRKAELAKLQQTLNALNKKAAFYEEQINYYDTYIKTCLDNLKRKNTRRSIKLDGKGEPKGAKRAKPVKYTAAKLHEKGVLLDIDDLQTNQFKNVTFDIIATEDVGIFDVRSKFLGVEMEKVQLNIQDLLQMQYEGVAVMKMFDKVKVNVNLLIYLLNKKFYGK

SEQ ID NO: 901663 - protein, 820 aa, Homo sapiens
AKRVTEVDGSGCLQNNSWFGSENPPLTVIRKFVYLLDQSDLDFQEELEVARLREEVVTKIRANQQLEKDLNLMDIKIGLLVKNRITLEDVISHSKKLNKKKGGEMEILNNTDNQGIKSLSKERRKTLETYQQLFYLLQTNPLYLAKLIFQMPQNKSTKFMDTVIFTLYNYASNQREEYLLLKLFKTALEEEIKSKVDQVQDIVTGNPTVIKMVVSFNRGARGQNTLRQLLAPVVKEIIDDKSLIINTNPVEVYKAWVNQLETQTGEASKLPYDVTTEQALTYPEVKNKLEASIENLRRVTDKVLNSIISSLDLLPYGLRYIAKVLKNSIHEKFPDATEDELLKIVGNLLYYRYMNPAIVAPDGFDIIDMTAGGQINSDQRRNLGSVAKVLQHAASNKLFEGENEHLSSMNNYLSETYQEFRKYFKEACNVPEPEEKFNMDKYTDLVTVSKPVIYISIEEIISTHSLLLEHQDAIAPEKNDLLSELLGSLGEVPTVESFLGEGAVDPNDPNKANTLSQLSKTEISLVLTSKYDIEDGEAIDSRSLMIKTKKLIIDVIRNQPGNTLTEILETPATAQQEVDHATDMVSRAMIDSRTPEEMKHSQSMIEDAQLPLEQKKRKIQRNLRTLEQTGHVSSENKYQDILNEIAKDIRNQRIYRKLRKAELAKLQQTLNALNKKAAFYEEQINYYDTYIKTCLDNLKRKNTRRSIKLDGKGEPKGAKRAKPVKYTAAKLHEKGVLLDIDDLQTNQFKNVTFDIIATEDVGIFDVRSKFLGVEMEKVQLNIQDLLQMQYEGVAVMKMFDKVKVNVNLLIYLLNKKFYGK

SEQ ID NO: 901664 - protein, 1128 aa, Homo sapiens; identical to SEQ ID NO: 901661

SEQ ID NO: 901665 - protein, 1128 aa, Homo sapiens; identical to SEQ ID NO: 901661

SEQ ID NO: 901666 - protein, 791 aa, Homo sapiens
MHSLPGVVAVGYINEAIDEGNPLRTLETLLLPTANISDVDPAHAQHYQDVLYHAKSQKLGDSESVSKVLWLDEIQQAVDEANVDEDRAKQWVTLVVDVNQCLEGKKSSDILSVLKSSTSNANDIIPECADKYYDALVKAKELKSERVSSDGSWLKLNLHKKYDYYYNTDSKESSWVTPESCLYKESWLTGKEIEDIIEEVTVGYIRENIWSASEELLLRFQATSSGPILREEFEARKSFLHEQEENVVKIQAFWKGYKQRKEYMHRRQTFIDNTDSIVKIQSWFRMATARKSYLSRLQYFRDHNNEIVKIQSLLRANKARDDYKTLVGSENPPLTVIRKFVYLLDQSDLDFQEELEVARLREEVVTKIRANQQLEKDLNLMDIKIGLLVKNRITLEDVISHSKKLNKKKGGEMEILNNTDNQGIKSLSKERRKTLETYQQLFYLLQTNPLYLAKLIFQMPQNKSTKFMDTVIFTLYNYASNQREEYLLLKLFKTALEEEIKSKVDQVQDIVTGNPTVIKMVVSFNRGARGQNTLRQLLAPVVKEIIDDKSLIINTNPVEVYKAWVNQLETQTGEASKLPYDVTTEQALTYPEVKNKLEASIENLRRVTDKVLNSIISSLDLLPYGLRYIAKVLKNSIHEKFPDATEDELLKIVGNLLYYRYMNPAIVAPDGFDIIDMTAGGQINSDQRRNLGSVAKVLQHAASNKLFEGENEHLSSMNNYLSETYQEFRKYFKEACNVPEPEEKFNMDKYTDLVTVSKPVIYISIEEIISTHSLLLEHQDAIAPEKNDLSE

SEQ ID NO: 901667 - protein, 400 aa, Homo sapiens
MHSLPGVVAVGYINEAIDEGNPLRTLETLLLPTANISDVDPAHAQHYQDVLYHAKSQKLGDSESVSKVLWLDEIQQAVDEANVDEDRAKQWVTLVVDVNQCLEGKKSSDILSVLKSSTSNANDIIPECADKYYDALVKAKELKSERVSSDGSWLKLNLHKKYDYYYNTDSKESSWVTPESCLYKESWLTGKEIEDIIEEVTVGYIRENIWSASEELLLRFQATSSGPILREEFEARKSFLHEQEENVVKIQAFWKGYKQRKEYMHRRQTFIDNTDSIVKIQSWFRMATARKSYLSRLQYFRDHNNEIVKIQSLLRANKARDDYKTLVGSENPPLTVIRKFVYLLDQSDLDFQEELEVARLREEVVTKIRANQQLEKDLNLMDIKIGLLVKNRITLEFSEN

SEQ ID NO: 901668 - protein, 1649 aa, Homo sapiens
REESSLLLQCQRAAAVAGSGERAPREWVADLRAARGNRREAGSERAGGGAEPASLASEGSRGGRAPGGPPETRRMPHEELPSLQRPRYGSIVDDERLSAEEMDERRRQNIAYEYLCHLEEAKRWMEVCLVEELPPTTELEEGLRNGVYLAKLAKFFAPKMVSEKKIYDVEQTRYKKSGLHFRHTDNTVQWLRAMESIGLPKIFYPETTDVYDRKNIPRMIYCIHALSLYLFKLGIAPQIQDLLGKVDFTEEEISNMRKELEKYGIQMPSFSKIGGILANELSVDEAALHAAVIAINEAVEKGIAEQTVVTLRNPNAVLTLVDDNLAPEYQKELWDAKKKKEENARLKNSCISEEERDAYEELLTQAEIQGNINKVNRQAAVDHINAVIPEGDPENTLLALKKPEAQLPAVYPFAAAMYQNELFNLQKQNTMNYLAHEELLIAVEMLSAVALLNQALESNDLVSVQNQLRSPAIGLNNLDKAYVERYANTLLSVKLEVLSQGQDNLSWNEIQNCIDMVNAQIQEENDRVVAVGYINEAIDEGNPLRTLETLLLPTANISDVDPAHAQHYQDVLYHAKSQKLGDSESVSKVLWLDEIQQAVDEANVDEDRAKQWVTLVVDVNQCLEGKKSSDILSVLKSSTSNANDIIPECADKYYDALVKAKELKSERVSSDGSWLKLNLHKKYDYYYNTDSKESSWVTPESCLYKESWLTGKEIEDIIEEVTVGYIRENIWSASEELLLRFQATSSGPILREEFEARKSFLHEQEENVVKIQAFWKGYKQRKEYMHRRQTFIDNTDSIVKIQSWFRMATARKSYLSRLQYFRDHNNEIVKIQSLLRANKARDDYKTLVGSENPPLTVIRKFVYLLDQSDLDFQEELEVARLREEVVTKIRANQQLEKDLNLMDIKIGLLVKNRITLEDVISHSKKLNKKKGGEMEILNNTDNQGIKSLSKERRKTLETYQQLFYLLQTNPLYLAKLIFQMPQNKSTKFMDTVIFTLYNYASNQREEYLLLKLFKTALEEEIKSKVDQVQDIVTGNPTVIKMVVSFNRGARGQNTLRQLLAPVVKEIIDDKSLIINTNPVEVYKAWVNQLETQTGEASKLPYDVTTEQALTYPEVKNKLEASIENLRRVTDKVLNSIISSLDLLPYGLRYIAKVLKNSIHEKFPDATEDELLKIVGNLLYYRYMNPAIVAPDGFDIIDMTAGGQINSDQRRNLGSVAKVLQHAASNKLFEGENEHLSSMNNYLSETYQEFRKYFKEACNVPEPEEKFNMDKYTDLVTVSKPVIYISIEEIISTHSLLLEHQDAIAPEKNDLLSELLGSLGEVPTVESFLGEGAVDPNDPNKANTLSQLSKTEISLVLTSKYDIEDGEAIDSRSLMIKTKKLIIDVIRNQPGNTLTEILETPATAQQEVDHATDMVSRAMIDSRTPEEMKHSQSMIEDAQLPLEQKKRKIQRNLRTLEQTGHVSSENKYQDILNEIAKDIRNQRIYRKLRKAELAKLQQTLNALNKKAAFYEEQINYYDTYIKTCLDNLKRKNTRRSIKLDGKGEPKGAKRAKPVKYTAAKLHEKGVLLDIDDLQTNQFKNVTFDIIATEDVGIFDVRSKFLGVEMEKVQLNIQDLLQMQYEGVAVMKMFDKVKVNVNLLIYLLNKKFYGK

SEQ ID NO: 901669 - protein, 1128 aa, Homo sapiens
MGCFKGVVAVGYINEAIDEGNPLRTLETLLLPTANISDVDPAHAQHYQDVLYHAKSQKLGDSESVSKVLWLDEIQQAVDEANVDEDRAKQWVTLVVDVNQCLEGKKSSDILSVLKSSTSNANDIIPECADKYYDALVKAKELKSERVSSDGSWLKLNLHKKYDYYYNTDSKESSWVTPESCLYKESWLTGKEIEDIIEEVTVGYIRENIWSASEELLLRFQATSSGPILREEFEARKSFLHEQEENVVKIQAFWKGYKQRKEYMHRRQTFIDNTDSIVKIQSWFRMATARKSYLSRLQYFRDHNNEIVKIQSLLRANKARDDYKTLVGSENPPLTVIRKFVYLLDQSDLDFQEELEVARLREEVVTKIRANQQLEKDLNLMDIKIGLLVKNRITLEDVISHSKKLNKKKGGEMEILNNTDNQGIKSLSKERRKTLETYQQLFYLLQTNPLYLAKLIFQMPQNKSTKFMDTVIFTLYNYASNQREEYLLLKLFKTALEEEIKSKVDQVQDIVTGNPTVIKMVVSFNRGARGQNTLRQLLAPVVKEIIDDKSLIINTNPVEVYKAWVNQLETQTGEASKLPYDVTTEQALTYPEVKNKLEASIENLRRVTDKVLNSIISSLDLLPYGLRYIAKVLKNSIHEKFPDATEDELLKIVGNLLYYRYMNPAIVAPDGFDIIDMTAGGQINSDQRRNLGSVAKVLQHAASNKLFEGENEHLSSMNNYLSETYQEFRKYFKEACNVPEPEEKFNMDKYTDLVTVSKPVIYISIEEIISTHSLLLEHQDAIAPEKNDLLSELLGSLGEVPTVESFLGEGAVDPNDPNKANTLSQLSKTEISLVLTSKYDIEDGEAIDSRSLMIKTKKLIIDVIRNQPGNTLTEILETPATAQQEVDHATDMVSRAMIDSRTPEEMKHSQSMIEDAQLPLEQKKRKIQRNLRTLEQTGHVSSENKYQDILNEIAKDIRNQRIYRKLRKAELAKLQQTLNALNKKAAFYEEQINYYDTYIKTCLDNLKRKNTRRSIKLDGKGEPKGAKRAKPVKYTAAKLHEKGVLLDIDDLQTNQFKNVTFDIIATEDVGIFDVRSKFLGVEMEKVQLNIQDLLQMQYEGVAVMKMFDKVKVNVNLLIYLLNKKFYGK

SEQ ID NO: 901670 - protein, 740 aa, Homo sapiens
SGVPVISTDVISHSKKLNKKKGGEMEILNNTDNQGIKSLSKERRKTLETYQQLFYLLQTNPLYLAKLIFQMPQNKSTKFMDTVIFTLYNYASNQREEYLLLKLFKTALEEEIKSKVDQVQDIVTGNPTVIKMVVSFNRGARGQNTLRQLLAPVVKEIIDDKSLIINTNPVEVYKAWVNQLETQTGEASKLPYDVTTEQALTYPEVKNKLEASIENLRRVTDKVLNSIISSLDLLPYGLRYIAKVLKNSIHEKFPDATEDELLKIVGNLLYYRYMNPAIVAPDGFDIIDMTAGGQINSDQRRNLGSVAKVLQHAASNKLFEGENEHLSSMNNYLSETYQEFRKYFKEACNVPEPEEKFNMDKYTDLVTVSKPVIYISIEEIISTHSLLLEHQDAIAPEKNDLLSELLGSLGEVPTVESFLGEGAVDPNDPNKANTLSQLSKTEISLVLTSKYDIEDGEAIDSRSLMIKTKKLIIDVIRNQPGNTLTEILETPATAQQEVDHATDMVSRAMIDSRTPEEMKHSQSMIEDAQLPLEQKKRKIQRNLRTLEQTGHVSSENKYQDILNEIAKDIRNQRIYRKLRKAELAKLQQTLNALNKKAAFYEEQINYYDTYIKTCLDNLKRKNTRRSIKLDGKGEPKGAKRAKPVKYTAAKLHEKGVLLDIDDLQTNQFKNVTFDIIATEDVGIFDVRSKFLGVEMEKVQLNIQDLLQMQYEGVAVMKMFDKVKVNVNLLIYLLNKKFYGK

SEQ ID NO: 901671 - protein, 103 aa, Homo sapiens
MLLPEMESHSAAQAGVQWWDLGSLQPPPPRFKNVTFDIIATEDVGIFDVRSKFLGVEMEKVQLNIQDLLQMQYEGVAVMKMFDKVKVNVNLLIYLLNKKFYGK

SEQ ID NO: 901672 - protein, 852 aa, Homo sapiens
MHSLPGVVAVGYINEAIDEGNPLRTLETLLLPTANISDVDPAHAQHYQDVLYHAKSQKLGDSESVSKVLWLDEIQQAVDEANVDEDRAKQWVTLVVDVNQCLEGKKSSDILSVLKSSTSNANDIIPECADKYYDALVKAKELKSERVSSDGSWLKLNLHKKYDYYYNTDSKESSWVTPESCLYKESWLTGKEIEDIIEEVTVGYIRENIWSASEELLLRFQATSSGPILREEFEARKSFLHEQEENVVKIQAFWKGYKQRKEYMHRRQTFIDNTDSIVKIQSWFRMATARKSYLSRLQYFRDHNNEIVKIQSLLRANKARDDYKTLVGSENPPLTVIRKFVYLLDQSDLDFQEELEVARLREEVVTKIRANQQLEKDLNLMDIKIGLLVKNRITLEDVISHSKKLNKKKGGEMEILNNTDNQGIKSLSKERRKTLETYQQLFYLLQTNPLYLAKLIFQMPQNKSTKFMDTVIFTLYNYASNQREEYLLLKLFKTALEEEIKSKVDQVQDIVTGNPTVIKMVVSFNRGARGQNTLRQLLAPVVKEIIDDKSLIINTNPVEVYKAWVNQLETQTGEASKLPYDVTTEQALTYPEVKNKLEASIENLRRVTDKVLNSIISSLDLLPYGLRYIAKVLKNSIHEKFPDATEDELLKIVGNLLYYRYMNPAIVAPDGFDIIDMTAGGQINSDQRRNLGSVAKVLQHAASNKLFEGENEHLSSMNNYLSETYQEFRKYFKEACNVPEPEEKFNMDKYTDLVTVSKPVIYISIEEIISTHSLLLEHQDAIAPEKNDLLSELLGSLGEVPTVESFLGEGAVDPNDPNKANTLSQLSKTEISLVLTSKYDIEDGEAIDRPRS

SEQ ID NO: 901673 - protein, 353 aa, Homo sapiens
AAIAGPAWPPCAAALRPLRGRSGSAGLTGNLPDRAHVSPRPEKSPARPASPAPRPGGTARAQENHIFVPAPEAPVGKIVSQRVPEAPPGQAGFPRAFPRSPAWPGGWTNSALAGGPNPAGEVDMRLAGPLRIVVLVVSVGVTWIVVSILLGGPGSGFPRIQQLFTSPESSVTAAPRARKYKCGLPQPCPEEHLAFRVVSGAANVIGPKICLEDKMLMSSVKDNVGRGLNIALVNGVSGELIEARAFDMWAGDVNDLLKFIRPLHEGTLVFVASYDDPATKMNEETRKLFSELGSRNAKELAFRDSWVFVGAKGVQNKSPFEQHVKNSKHSNKYEGWPEALEMEGCIPRRSTAS

SEQ ID NO: 901674 - protein, 156 aa, Homo sapiens
CPEEHLAFRVVSGAANVIGPKICLEDKMLMSSVKDNVGRGLNIALVNRASDEHIEARAFDIWTGDVNERPLRIVVLVVSVGVTWIVVSILLGGPGSGFPRIQQLFTSPESSVTAAPRARKYKCGLPQPCPEEHLAFRVVSGAANVIGPKICLEDKM

SEQ ID NO: 901675 - protein, 244 aa, Homo sapiens
MDRGQHPPGWAWQWLSSHPATLHQLECSGAISVHCNLYLLGSSDSSAPASRVAETTGPESSVTAAPRARKYKCGLPQPCPEEHLAFRVVSGAANVIGPKICLEDKMLMSSVKDNVGRGLNIALVNGVSGELIEARAFDMWAGDVNDLLKFIRPLHEGTLVFVASYDDPATKMNEETRKLFSELGSRNAKELAFRDSWVFVGAKGVQNKSPFEQHVKNSKHSNKYEGWPEALEMEGCIPRRSTAS

SEQ ID NO: 901676 - protein, 230 aa, Homo sapiens
MRLAGPLRIVVLVVSVGVTWIVVSILLGGPGSGFPRIQQLFTSPESSVTAAPRARKYKCGLPQPCPEEHLAFRVVSGAANVIGPKICLEDKMLMSSVKDNVGRGLNIALVNGVSGELIEARAFDMWAGDVNDLLKFIRPLHEGTLVFVASYDDPATKMNEETRKLFSELGSRNAKELAFRDSWVFVGAKGVQNKSPFEQHVKNSKHSNKYEGWPEALEMEGCIPRRSTAS

SEQ ID NO: 901677 - protein, 244 aa, Homo sapiens; identical to SEQ ID NO: 901675

SEQ ID NO: 901678 - protein, 361 aa, Homo sapiens
AAIAGPAWPPCAAALRPLRGRSGSAGLTGNLPDRAHVSPRPEKSPARPASPAPRPGGTARAQENHIFVPAPDPHPNLSFRFAPKQCTCRRSQPSRRSGHEVGRPSPHCGPSRQCGCHMDRGQHPPGWAWQWLSSHPATLHQLECSGAISVHCNLYLLGSSDSSAPASRVAETTGPESSVTAAPRARKYKCGLPQPCPEEHLAFRVVSGAANVIGPKICLEDKMLMSSVKDNVGRGLNIALVNGVSGELIEARAFDMWAGDVNDLLKFIRPLHEGTLVFVASYDDPATKMNEETRKLFSELGSRNAKELAFRDSWVFVGAKGVQNKSPFEQHVKNSKHSNKYEGWPEALEMEGCIPRRSTAS

SEQ ID NO: 901679 - protein, 315 aa, Homo sapiens
AAIAGPAWPPCAAALRPLRGRSGSAGLTGNLPDRAHVSPRPEKSPARPASPAPRPGGTARAQENHIFVPAPEAPVGKIVSQRVPEAPPGQAGFPRAFPRSPAWPGGWTNSALAGGPNPAGEVDMRLAGPESSVTAAPRARKYKCGLPQPCPEEHLAFRVVSGAANVIGPKICLEDKMLMSSVKDNVGRGLNIALVNGVSGELIEARAFDMWAGDVNDLLKFIRPLHEGTLVFVASYDDPATKMNEETRKLFSELGSRNAKELAFRDSWVFVGAKGVQNKSPFEQHVKNSKHSNKYEGWPEALEMEGCIPRRSTAS

SEQ ID NO: 901680 - protein, 230 aa, Homo sapiens; identical to SEQ ID NO: 901676

SEQ ID NO: 901681 - protein, 230 aa, Homo sapiens; identical to SEQ ID NO: 901676

SEQ ID NO: 901682 - protein, 203 aa, Homo sapiens
MRLAGPLRIVVLVVSVGVTWIVVSILLGGPGSGFPRIQQLFTSPESSVTAAPRARKYKCGLPQPCPEEHLAFRVVSGAANVIGPKICLEDKMLMSSVKDNVGRGLNIALVNGVSGELIEARAFDMWAGDVNDLLKFIRPLHEGTLVFVASYDDPATKMNEETRKLFSELGSRNAKELAFRDSWVFVGAKGVQNKSPFEQGCRG

SEQ ID NO: 901683 - protein, 192 aa, Homo sapiens
MRLAGPLRIVVLVVSVGVTWIVVSILLGGPGSGFPRIQQLFTSPESSVTAAPRARKYKCGLPQPCPEEHLAFRVVSGAANVIGPKICLEDKMTRRGNRQGIRQRDHKRKSRLAQERREQGDSGRQGPEEPLTCGPEMSTTLVEVYSATGTKAPLCVPVEHIRLRSLTSMASQDIERKKVAQNNTDYEVLGAY

SEQ ID NO: 901684 - protein, 230 aa, Homo sapiens; identical to SEQ ID NO: 901676

SEQ ID NO: 901685 - protein, 244 aa, Homo sapiens; identical to SEQ ID NO: 901675

SEQ ID NO: 901686 - protein, 189 aa, Homo sapiens
MDNTCYPCPAPRARKYKCGLPQPCPEEHLAFRVVSGAANVIGPKICLEDKMLMSSVKDNVGRGLNIALVNGVSGELIEARAFDMWAGDVNDLLKFIRPLHEGTLVFVASYDDPATKMNEETRKLFSELGSRNAKELAFRDSWVFVGAKGVQNKSPFEQHVKNSKHSNKYEGWPEALEMEGCIPRRSTAS

SEQ ID NO: 901687 - protein, 237 aa, Homo sapiens
MRLAGPLRIVVLVVSVGVTWIVVSILLGGPGSGFPRIQQLFTSPESSVTAAPRARKYKCGLPQPCPEEHLAFRVVSGAANVIGPKICLEDKMLMSSVKDNVGRGLNIALVNGPLPPDTGVSGELIEARAFDMWAGDVNDLLKFIRPLHEGTLVFVASYDDPATKMNEETRKLFSELGSRNAKELAFRDSWVFVGAKGVQNKSPFEQHVKNSKHSNKYEGWPEALEMEGCIPRRSTAS

SEQ ID NO: 901688 - protein, 189 aa, Homo sapiens; identical to SEQ ID NO: 901686

SEQ ID NO: 901689 - protein, 213 aa, Homo sapiens
MRLAGPLRIVVLVVSVGVTWIVVSILLGGPGSGFPRIQQLFTSPESSVTAAPRARKYKCGLPQPCPEEHLAFRVVSGAANVIGPKICLEDKMLMSSVKDNVGRGLNIALVNDVNDLLKFIRPLHEGTLVFVASYDDPATKMNEETRKLFSELGSRNAKELAFRDSWVFVGAKGVQNKSPFEQHVKNSKHSNKYEGWPEALEMEGCIPRRSTAS

SEQ ID NO: 901690 - protein, 227 aa, Homo sapiens
MDRGQHPPGWAWQWLSSHPATLHQLECSGAISVHCNLYLLGSSDSSAPASRVAETTGPESSVTAAPRARKYKCGLPQPCPEEHLAFRVVSGAANVIGPKICLEDKMLMSSVKDNVGRGLNIALVNDVNDLLKFIRPLHEGTLVFVASYDDPATKMNEETRKLFSELGSRNAKELAFRDSWVFVGAKGVQNKSPFEQHVKNSKHSNKYEGWPEALEMEGCIPRRSTAS

SEQ ID NO: 901691 - protein, 338 aa, Homo sapiens
MRLAGPLRIVVLVVSVGVTWIVVSILLGGPGSGFPRIQQLFTSPESSVTAAPRARKYKCGLPQPCPEEHLAFRVVSGAANVIGPKICLEDKMLMSSVKDNVGRGLNIALVNGVSGELIEARAFDMWAGDVNDLLKFIRPLHEGTLVFVASYDDPATKMNEETRKLFSELGSRNAKELAFRDSWVFVGAKGVQNKSPFEQHVKNSKHSNKYEGWPEALEMEGCIPRRSTANTSGLRGSDQNVVSRWWGLWGLQGVALPHFVTGAQGTRLLFVTLFPPVSPSSPVLHSSRHLHPHLESWNGPGCLPLTVQLWEQPGRLGRLPEPLPSGATLHCGLNMFPV

SEQ ID NO: 901692 - protein, 59 aa, Homo sapiens
GGCSVVPDDPCSVAPAPPDVNDLLKFIRPLHEGTLVFVASYDDPATKKVLGEASLSLAL

SEQ ID NO: 901693 - protein, 528 aa, Homo sapiens
SGDLQDYRCSRDSAPSPVPHELVITIELPLLRSAEQAALEVTRKLLCLDSRKPDYRLRLSLPYPVDDGRGKAQFNKARRQLVVTLPVVLPAARREPAVAVAAAAPEESADRSGTDGQACASAREGEAGPARSRAEDGGHDTCVAGAAGSGVTTLGDPEVAPPPAAAGEERVPKPGEQDLSRHAGSPPGSVEEPSPGGENSPGGGGSPCLSSRSLAWGSSAGRESARGDSSVETREESEGTGGQRSACAMGGPGTKSGEPLCPPLLCNQDKETLTLLIQVPRIQPQSLQGDLNPLWYKLRFSAQDLVYSFFLQFAPENKLSTTEPVISISSNNAVIELAKSPESHGHWREWYYGVNNDSLELQECSNSDQLQGKEERVNEESHLTEKEYIEHCNTPTTDSDSSIAVKALQIDSFGLVTCFQQESLDVSQMILGKSQQPESKMQSEFIKEKSATCSNEEKDNLNESVITEEKETDGDHLSSLLNKTTVHNIPGFDSIKETNMQDGSVQVIKDHVTNCAFSFQNSLLYDLD

SEQ ID NO: 901694 - protein, 576 aa, Homo sapiens
SGDLQDYRCSRDSAPSPVPHELVITIELPLLRSAEQAALEVTRKLLCLDSRKPDYRLRLSLPYPVDDGRGKAQFNKARRQLVVTLPVVLPAARREPAVAVAAAAPEESADRSGTDGQACASAREGEAGPARSRAEDGGHDTCVAGAAGSGVTTLGDPEVAPPPAAAGEERVPKPGEQDLSRHAGSPPGSVEEPSPGGENSPGGGGSPCLSSRSLAWGSSAGRESARGDSSVETREESEGTGGQRSACAMGGPGTKSGEPLCPPLLCNQDKETLTLLIQVPRIQPQSLQGDLNPLWYKLRFSAQDLVYSFFLQFAPENKLSTTEPVISISSNNAVIELAKSPESHGHWREWYYGVNNDSLEERLFVNEENVNEFLEEVLSSPFKQSMSLTPPLIEVLQVTDNKIQINAKLQECSNSDQLQGKEERVNEESHLTEKEYIEHCNTPTTDSDSSIAVKALQIDSFGLVTCFQQESLDVSQMILGKSQQPESKMQSEFIKEKSATCSNEEKDNLNESVITEEKETDGDHLSSLLNKTTVHNIPGFDSIKETNMQDGSVQVIKDHVTNCAFSFQNSLLYDLD

SEQ ID NO: 901695 - protein, 233 aa, Homo sapiens
NSLHNPLTLYINTTSVRERLFVNEENVNEFLEEVLSSPFKQSMSLTPPLIEVLQVTDNKIQINAKLQECSNSDQLQGKEERVNEESHLTEKEYIEHCNTPTTDSDSSIAVKALQIDSFGLVTCFQQESLDVSQMILGKSQQPESKMQSEFIKEKSATCSNEEKDNLNESVITEEKETDGDHLSSLLNKTTVHNIPGFDSIKETNMQDGSVQVIKDHVTNCAFSFQNSLLYDLD

SEQ ID NO: 901696 - protein, 576 aa, Homo sapiens; identical to SEQ ID NO: 901694

SEQ ID NO: 901697 - protein, 576 aa, Homo sapiens; identical to SEQ ID NO: 901694

SEQ ID NO: 901698 - protein, 110 aa, Homo sapiens
QVPRIQPQSLQGDLNPLWYKLRFSAQDLVYSFFLQFAPENKLSTTEPVISISSNNAVIELAKSPESHGHWREWYYGVNNDSLEVTVLSRVLIFEISHLTLKICYYRPGAV

SEQ ID NO: 901699 - protein, 212 aa, Homo sapiens
QALKNAENAYHIHQARTRSFDEDAKESRAAALRAANKSGTGFGESYSLANPSIRAGEDIPQPTIFNGKLKGYQLKGMNWLANLYEQGINGILADEMGLGKTVQSIALLAHLAERENIWGPFLIISPASTLNNWHQEFTRFVPKFKVLPYWGNPHDRKVIRRFWSQKTLYTQDAPFHVVITSYQLVVQDVKYFQRVKWQYMVLDEAQALKSSS

SEQ ID NO: 901700 - protein, 157 aa, Homo sapiens
QALKNAENAYHIHQARTRSFDEDAKESRAAALRAANKSGTGFGESYSLANPSIRAGEDIPQPTIFNGKLKGYQLKGMNWLANLYEQGINGILADEMGLGKTVQSIALLAHLAERENIWGPFLIISPASTLNNWHQEFTRFVPKFKVNISPTKTSIAL

SEQ ID NO: 901701 - protein, 423 aa, Homo sapiens
MEDKRSLSMARCEERNSRGQDHGLERVPFPPQLQSETYLHPADPSPAWDDPGSTGSPNLRLLTEEIAFQPLAEEASFRRPHPDGDVPPQGEDNLLSLPFPQKLWRLVSSNQFSSIWWDDSGACRVINQKLFEKEILKRDVAHKVFATTSIKSFFRQLNLYGFRKRRQCTFRTFTRIFSAKRLVSILNKLEFYCHPYFQRDSPHLLVRMKRRVGVKSAPRHQEEDKPEAAGSCLAPADTEQQDHTSPNENDQVTPQHREPAGPNTQIRSGSAPPATPVMVPDSAVASDNSPVTQPAGEWSEGSQAHVTPVAAVPGPAALPFLYVPGSPTQMNSYGPVVALPTASRSTLAMDTTGLPAPGMLPFCHLWVPVTLVAAGAAQPAASMVMFPHLPALHHHCPHSHRTSQYMPASDGPQAYPDYADQST

SEQ ID NO: 901702 - protein, 216 aa, Homo sapiens [sequence omitted]

SEQ ID NO: 901703 - protein, 134 aa, Homo sapiens
ATEPGPQAPPRQLFRSSHSRQTRLLSPMARAALSAAPSNPRLLRVALLLLLLVAAGRRAAGASVATELRCQCLQTLQGIHPKNIQSVNVKSPGPHCAQTEVIATLKNGRKACLNPASPIVKKIIEKMLNSDKSN

SEQ ID NO: 901704 - protein, 142 aa, Homo sapiens
ATEPGPQAPPRQLFRSSHSRQTRLLSPMARAALSAAPSNPRLLRVALLLLLLVAAGRRAAVSESPSSLGASVATELRCQCLQTLQGIHPKNIQSVNVKSPGPHCAQTEVIATLKNGRKACLNPASPIVKKIIEKMLNSDKSN

SEQ ID NO: 901705 - protein, 134 aa, Homo sapiens; identical to SEQ ID NO: 901703

SEQ ID NO: 901706 - protein, 85 aa, Homo sapiens
VCGSSLEKCSRAPCLIGSFLFMVELWEFWAYSGPPAPRVPRCSYWKTEFSHTVGELIEVHLRRQDSIPAFLSSLTLELFSRQTVA

SEQ ID NO: 901707 - protein, 352 aa, Homo sapiens
ARGYSDEDLAAYDSELTPAEYSPQLTRRMREAEEMVQKVHSHSAEMEAQLSQALEELGGQKQRADMLEMELKMLKSQSSSAEQSFLFSRGGGHAQVKVEELEGERSRLEEEKRMLEAQLERRALQGDYDQSRTKVLHMSLNPTSVARQRLHEDHSQLQAECERLRGLLRAMERGGTVPADLEAAAASLPSSKEVAELKKQVESAELKNQRLKEVFQTKIQEFRKACYTLTGYQIDITTENQYRLTSLYAEHPGDCLIFKATSPSGSKMQLLEDRVLTHRGRAHRGAPAAPGQHPCLPQLAHPRALQPPDRGVACRLGGIAGATLLGLTCRSPAPPATGWVHVLPLQPHRAAA

SEQ ID NO: 901708 - protein, 159 aa, Homo sapiens
LPHSVPLVRARWDTMGLGSGWWDQRLVRPLSPRHRVSTAHVAELEWGPGTHSLAHVFHGRAAEVPGPPGQALSASRGAGEPQARPGQPGSGLECSGHNGRRECLHEEPPAPRVPRCSYWETEFSHTVGELIEVHLRRQDSIPAFLSSLTLELFSRQTVA

SEQ ID NO: 901709 - protein, 217 aa, Homo sapiens
ARGYSDEDLAAYDSELTPAEYSPQLTRRMREAEEMVQKVHSHSAEMEAQLSQALEELGGQKQRADMLEMELKMLKSQSSSAEQSFLFSRGGGHAQVKVEELEGERSRLEEEKRMLEAQLERRALATSPSGSKMQLLEDRVLTHRGRAHRGAPAAPGQHPCLPQLAHPRALQPPDRGVACRLGGIAGATLLGLTCRSPAPPATGWVHVLPLQPHRAAA

SEQ ID NO: 901710 - protein, 259 aa, Homo sapiens
GSAKRARVLQPGLPSVGALCHRVMGPGGPWFQGDYDQSRTKVLHMSLNPTSVARQRLHEDHSQLQAECERLRGLLRAMERGGTVPADLEAAAASLPSSKEVAELKKQVESAELKNQRLKEVFQTKIQEFRKACYTLTGYQIDITTENQYRLTSLYAEHPGDCLIFKATSPSGSKMQLLEDRVLTHRGRAHRGAPAAPGQHPCLPQLAHPRALQPPDRGVACRLGGIAGATLLGLTCRSPAPPATGWVHVLPLQPHRAAA

SEQ ID NO: 901711 - protein, 85 aa, Homo sapiens; identical to SEQ ID NO: 901706

SEQ ID NO: 901712 - protein, 259 aa, Homo sapiens; identical to SEQ ID NO: 901710

SEQ ID NO: 901713 - protein, 159 aa, Homo sapiens; identical to SEQ ID NO: 901708

SEQ ID NO: 901714 - protein, 151 aa, Homo sapiens
MGVPNDLRALNSLVGVTSSLRFHFLMNLVTDQSFTEPLLHARSPVLGERICAESTVIFSRSTGENGQLLGCWEVVRSLWEEVICGLGTHFQGGEGDKAWEDSARCHCLTDFALEGHGHRIPTVLPHRWTKCDPPSGFRGTGPPGGDARLGE

SEQ ID NO: 901715 - protein, 737 aa, Homo sapiens
MQPRGAQAPGVQLLPALALMRLLLGAGPQGSSLANPVPAAPLSAPGPCAAQPCRNGGVCTSRPEPDPQHPAPAGEPGYSCTCPAGISGANCQLVADPCASNPCHHGNCSSSSSSSSDGYLCICNEGYEGPNCEQALPSLPATGWTESMAPRQLQPVPATQEPDKILPRSQATVTLPTWQPKTGQKVVEMKWDQVEVIPDIACGNASSNSSAGGRLVSFEVPQNTSVKIRQDATASLILLWKVTATGFQQCSLIDGRSVTPLQASGGLVLLEEMLALGNNHFIGFVNDSVTKSIVALRLTLVVKVSTCVPGESHANDLECSGKGKCTTKPSEATFSCTCEEQYVGTFCEEYDACQRKPCQNNASCIDANEKQDGSNFTCVCLPGYTGELCQSKIDYCILDPCRNGATCISSLSGFTCQCPEGYFGSACEEKVDPCASSPCQNNGTCYVDGVHFTCNCSPGFTGPTCAQLIDFCALSPCAHGTCRSVGTSYKCLCDPGYHGLYCEEEYNECLSAPCLNAATCRDLVNGYECVCLAEYKGTHCELYKDPCANVSCLNGATCDSDGLNGTCICAPGFTGEECDIDINECDSNPCHHGGSCLDQPNGYNCHCPHGWVGANCEIHLQWKSGHMAESLTNMPRHSLYIIIGALCVAFILMLIILIVGICRISRIEYQGSSRPAYEEFYNCRSIDSEFSNAIASIRHARFGKKSRPAMYDVSPIAYEDYSPDDKPLVTLIKTKDL

SEQ ID NO: 901716 - protein, 722 aa, Homo sapiens
QLSSPLPPPPPSLRPGSGSRPSRAAPLSAPGPCAAQPCRNGGVCTSRPEPDPQHPAPAGEPGYSCTCPAGISGANCQLVADPCASNPCHHGNCSSSSSSSSDGYLCICNEGYEGPNCEQALPSLPATGWTESMAPRQLQPVPATQEPDKILPRSQATVTLPTWQPKTGQKVVEMKWDQVEVIPDIACGNASSNSSAGGRLVSFEVPQNTSVKIRQDATASLILLWKVTATGFQQCSLIDGRSVTPLQASGGLVLLEEMLALGNNHFIGFVNDSVTKSIVALRLTLVVKVSTCVPGESHANDLECSGKGKCTTKPSEATFSCTCEEQYVGTFCEEYDACQRKPCQNNASCIDANEKQDGSNFTCVCLPGYTGELCQSKIDYCILDPCRNGATCISSLSGFTCQCPEGYFGSACEEKVDPCASSPCQNNGTCYVDGVHFTCNCSPGFTGPTCAQLIDFCALSPCAHGTCRSVGTSYKCLCDPGYHGLYCEEEYNECLSAPCLNAATCRDLVNGYECVCLAEYKGTHCELYKDPCANVSCLNGATCDSDGLNGTCICAPGFTGEECDIDINECDSNPCHHGGSCLDQPNGYNCHCPHGWVGANCEIHLQWKSGHMAESLTNMPRHSLYIIIGALCVAFILMLIILIVGICRISRIEYQGSSRPAYEEFYNCRSIDSEFSNAIASIRHARFGKKSRPAMYDVSPIAYEDYSPDDKPLVTLIKTKDL

SEQ ID NO: 901717 - protein, 681 aa, Homo sapiens
QLSSPLPPPPPSLRPGSGSRPSRAAPLSAPGPCAAQPCRNGGVCTSRPEPDPQHPAPAGEPGYSCTCPAGISGANCQLVADPCASNPCHHGNCSSSSSSSSDGYLCICNEGYEGPNCEQALPSLPATGWTESMAPRQLQPVPATQEPDKILPRSQATVTLPTWQPKTGQKVVEMKWDQVEVIPDIACGNASSNSSAGGRLVSFEVPQNTSVKIRQDATASLILLWKVTATGFQQCSLIDGRSVTPLQASGGLVLLEEMLALGNNHFIGFVNDSVTKSIVALRLTLVVKVSTCVPGESHANDLECSGKGKCTTKPSEATFSCTCEEQYVGTFCEEYDACQRKPCQNNASCIDANEKQDGSNFTCVCLPGYTGELCQSKIDYCILDPCRNGATCISSLSGFTCQCPEGYFGSACEEKVDPCASSPCQNNGTCYVDGVHFTCNCSPGFTGPTCAQLIDFCALSPCAHGTCRSVGTSYKCLCDPGTHCELYKDPCANVSCLNGATCDSDGLNGTCICAPGFTGEECDIDINECDSNPCHHGGSCLDQPNGYNCHCPHGWVGANCEIHLQWKSGHMAESLTNMPRHSLYIIIGALCVAFILMLIILIVGICRISRIEYQGSSRPAYEEFYNCRSIDSEFSNAIASIRHARFGKKSRPAMYDVSPIAYEDYSPDDKPLVTLIKTKDL

SEQ ID NO: 901718 - protein, 219 aa, Homo sapiens
MDAIKKKMQMLKLDKENAIDRAEQAEADKKQAEDRCKQLEEEQQALQKKLKGTEDEVEKYSESVKEAQEKLEQAEKKATDAEADVASLNRRIQLVEEELDRAQERLATALQKLEEAEKAADESERGMKVIENRAMKDEEKMELQEMQLKEAKHIAEDSDRKYEEVARKLVILEGELERSEERAEVAESRVQTAGGGTSNHGPGPQVPDGLRGGVFHQRR

SEQ ID NO: 901719 - protein, 284 aa, Homo sapiens
MDAIKKKMQMLKLDKENAIDRAEQAEADKKQAEDRCKQLEEEQQALQKKLKGTEDEVEKYSESVKEAQEKLEQAEKKATDAEADVASLNRRIQLVEEELDRAQERLATALQKLEEAEKAADESERGMKVIENRAMKDEEKMELQEMQLKEAKHIAEDSDRKYEEVARKLVILEGELERSEERAEVAESKCGDLEEELKIVTNNLKSLEAQADKYSTKEDKYEEEIKLLEEKLKEAETRAEFAERSVAKLEKTIDDLEDEVYAQKMKYKAISEELDNALNDITSL

SEQ ID NO: 901720 - protein, 218 aa, Homo sapiens
MDAIKKKMQMLKLDKENAIDRAEQAEADKKQAEDRCKQLEEEQQALQKKLKGTEDEVEKYSESVKEAQEKLEQAEKKATDAEADVASLNRRIQLVEEELDRAQERLATALQKLEEAEKAADESERGMKVIENRAMKDEEKMELQEMQLKEAKHIAEDSDRKYEEVARKLVILEGELERSEERAEVAESRVQTAGGGTSNHGPGPQVPDGLRGGVNVGT

SEQ ID NO: 901721 - protein, 188 aa, Homo sapiens
MDAIKKKMQMLKLDKENAIDRAEQAEADKKQAEDRCKQLEEEQQALQKKLKGTEDEVEKYSESVKEAQEKLEQAEKKATDAEADVASLNRRIQLVEEELDRAQERLATALQKLEEAEKAADESERGMKVIENRAMKDEEKMELQEMQLKEAKHIAEDSDRKYEEVARKLVILEGELERSEERAEVAER

SEQ ID NO: 901722 - protein, 284 aa, Homo sapiens; identical to SEQ ID NO: 901719

SEQ ID NO: 901723 - protein, 284 aa, Homo sapiens; identical to SEQ ID NO: 901719

SEQ ID NO: 901724 - protein, 219 aa, Homo sapiens; identical to SEQ ID NO: 901718

SEQ ID NO: 901725 - protein, 268 aa, Homo sapiens
LLLLNSRPRRPDKKQAEDRCKQLEEEQQALQKKLKGTEDEVEKYSESVKEAQEKLEQAEKKATDAEADVASLNRRIQLVEEELDRAQERLATALQKLEEAEKAADESERGMKVIENRAMKDEEKMELQEMQLKEAKHIAEDSDRKYEEVARKLVILEGELERSEERAEVAESKCGDLEEELKIVTNNLKSLEAQADKYSTKEDKYEEEIKLLEEKLKEAETRAEFAERSVAKLEKTIDDLEDEVYAQKMKYKAISEELDNALNDITSL

SEQ ID NO: 901726 - protein, 125 aa, Homo sapiens
MDAIKKKMQMLKLDKENAIDRAEQAEADKKQAEDRCKQLEEEQQALQKKLKGTEDEVEKYSESVKEAQEKLEQAEKKATDAEADVASLNRRIQLVEEELDRAQERLATALQKLEEAEKAADESES

SEQ ID NO: 901727 - protein, 152 aa, Homo sapiens
GPCSYEVGETGAARRRHDAEADVASLNRRIQLVEEELDRAQERLATALQKLEEAEKAADESERGMKVIENRAMKDEEKMELQEMQLKEAKHIAEDSDRKYEEVARKLVILEGELERSEERAEVAESRVQTAGGGTSNHGPGPQVPDGLRGGG

SEQ ID NO: 901728 - protein, 114 aa, Homo sapiens
MISETGTRSEAADEVAASKCGDLEEELKIVTNNLKSLEAQADKYSTKEDKYEEEIKLLEEKLKEAETRAEFAERSVAKLEKTIDDLEDEVYAQKMKYKAISEELDNALNDITSL

SEQ ID NO: 901729 - protein, 219 aa, Homo sapiens; identical to SEQ ID NO: 901718

SEQ ID NO: 901730 - protein, 308 aa, Homo sapiens
MDAIKKKMQMLKLDKENAIDRAEQAEADKKQAEDRCKQLEEEQQALQKKLKGTEDEVEKYSESVKEAQEKLEQAEKKATDAEADVASLNRRIQLVEEELDRAQERLATALQKLEEAEKAADESERGMKVIENRAMKDEEKMELQEMQLKEAKHIAEDSDRKYEEVARKLVILEGELERSEERAEVAESKCGDLEEELKIVTNNLKSLEAQADKYSTKEDKYEEEIKLLEEKLKEAETRAEFAERSVAKLEKTIDDLEESTSIATTEHWFTPDTLALTDTPSPCTEPTHKTPWPTLKPLCTGTPLAVAL

SEQ ID NO: 901731 - protein, 218 aa, Homo sapiens; identical to SEQ ID NO: 901720

SEQ ID NO: 901732 - protein, 214 aa, Homo sapiens
MDAIKKKMQMLKLDKENAIDRAEQAEADKKQAEDRCKQLEEEQQALQKKLKGTEDEVEKYSESVKEAQEKLEQAEKKATDAEADVASLNRRIQLVEEELDRAQERLATALQKLEEAEKAADESERGMKVIENRAMKDEEKMELQEMQLKEAKHIAEDSDRKYEEVARKLVILEGELERSEERAEVAESRVQTAGGGTSNHGPGPQVPDGLRGGG

SEQ ID NO: 901733 - protein, 240 aa, Homo sapiens
MDAIKKKMQMLKLDKENAIDRAEQAEADKKQAEDRCKQLEEEQQALQKKLKGTEDEVEKYSESVKEAQEKLEQAEKKATDAEADVASLNRRIQLVEEELDRAQERLATALQKLEEAEKAADESERGMKVIENRAMKDEEKMELQEMQLKEAKHIAEDSDRKYEEVARKLVILEGELLSSLLSFPFSLWGGEQAGGAEIANIAQPGWEQPRESPHHAHHPLWHWLHPLPIPFHPPLLLNKF

SEQ ID NO: 901734 - protein, 206 aa, Homo sapiens
MDAIKKKMQMLKLDKENAIDRAEQAEADKKQAEDRCKQLEEEQQALQKKLKGTEDEVEKYSESVKEAQEKLEQAEKKATDAEADVASLNRRIQLVEEELDRAQERLATALQKLEEAEKAADESERGMKVIENRAMKDEEKMELQEMQLKEAKHIAEDSDRKYEEVARKLVILEGELERSEERAEVAESRARQLWKGGGLLKEIDYH

SEQ ID NO: 901735 - protein, 128 aa, Homo sapiens
MGAGPQGRRSPVGGRRGRPHPPAGPCFCPYKVWAEVGEGPGCRPRPVPPRLLGARVAGTSQSRSVLLACHRCTQSAHPAQSVRSSPPAGRPTPHRSHGRHQEEDADAEAGQGERHRPRRAGRSRQEAS

SEQ ID NO: 901736 - protein, 152 aa, Homo sapiens
MDAIKKKMQMLKLDKENAIDRAEQAEADKKQAEDRCKQLEEEQQALQKKLKGTEDEVEKYSESVKEAQEKLEQAEKKATDAEADVASLNRRIQLVEEELDRAQERLATALQKRQIRKYEEVARKLVIIEGDLERTERAELAESKCSLEELEG

SEQ ID NO: 901737 - protein, 185 aa, Homo sapiens
MGAGPQGRRSPVGGRRGRPHPPAGPCFCPYKVWAEVGEGPGCRPRPVPPRLLGARVAGTSQSRSVLLACHRCTQSAHPAQSVRSSPPAGRPTPHRSHGRHQEEDADAEVTPTTTPTGTQTPTTTPITTTSRVTPTPTECLRVERVQARKTTKMIRMINASSSTAITAPTIPYTRLLAMLTFTGLS

SEQ ID NO: 901738 - protein, 219 aa, Homo sapiens; identical to SEQ ID NO: 901718

SEQ ID NO: 901739 - protein, 214 aa, Homo sapiens; identical to SEQ ID NO: 901732

SEQ ID NO: 901740 - protein, 214 aa, Homo sapiens; identical to SEQ ID NO: 901732

SEQ ID NO: 901741 - protein, 284 aa, Homo sapiens; identical to SEQ ID NO: 901719

SEQ ID NO: 901742 - protein, 214 aa, Homo sapiens; identical to SEQ ID NO: 901732

SEQ ID NO: 901743 - protein, 219 aa, Homo sapiens; identical to SEQ ID NO: 901718

SEQ ID NO: 901744 - protein, 158 aa, Homo sapiens
MKVIENRAMKDEEKMELQEMQLKEAKHIAEDSDRKYEEVARKLVILEGELERSEERAEVAESKCGDLEEELKIVTNNLKSLEAQADKYSTKEDKYEEEIKLLEEKLKEAETRAEFAERSVAKLEKTIDDLEDEVYAQKMKYKAISEELDNALNDITSL

SEQ ID NO: 901745 - protein, 219 aa, Homo sapiens; identical to SEQ ID NO: 901718

SEQ ID NO: 901746 - protein, 219 aa, Homo sapiens; identical to SEQ ID NO: 901718

SEQ ID NO: 901747 - protein, 219 aa, Homo sapiens; identical to SEQ ID NO: 901718

SEQ ID NO: 901748 - protein, 219 aa, Homo sapiens; identical to SEQ ID NO: 901718

SEQ ID NO: 901749 - protein, 301 aa, Homo sapiens
MDAIKKKMQMLKLDKENAIDRAEQAEADKKQAEDRCKQLEEEQQALQKKLKGTEDEVEKYSESVKEAQEKLEQAEKKATDAEADVASLNRRIQLVEEELDRAQERLATALQKLEEAEKAADESERGMKVIENRAMKDEEKMELQEMQLKEAKHIAEDSDRKYEEVARKLVILEGELERSEERAEVAESKCGDLEEELKIVTNNLKSLEAQADKYSTKEDKYEEEIKLLEEKLKEAETRAEFAERSVAKLEKTIDDLEGDLGQCQGGERRDSPDLGPDPAGTQQPVRASPTPSQAMVATPTQ

SEQ ID NO: 901750 - protein, 188 aa, Homo sapiens
MDAIKKKMQMLKLDKENAIDRAEQAEADKKQAEDRCKQLEEEQQALQKKLKGTEDEVEKYSESVKEAQEKLEQAEKKATDAEADVASLNRRIQLVEEELDRAQERLATALQKLEEAEKAADESERGMKVIENRAMKDEEKMELQEMQLKEAKHIAEDSDRKYEEGLGVQRRQDDQEPTGYNGEMKDLW

SEQ ID NO: 901751 - protein, 184 aa, Homo sapiens
MDAIKKKMQMLKLDKENAIDRAEQAEADKKQAEDRCKQLEEEQQALQKKLKGTEDEVEKYSESVKEAQEKLEQAEKKATDAEADVASLNRRIQLVEEELDRAQERLATALQKLEEAEKAADESERGMKVIENRAMKDEEKMELQEMQRAPLSPPRSTGSLLTPWHLLTPPAPALSPPTKHHGPR

SEQ ID NO: 901752 - protein, 136 aa, Homo sapiens
MGSMSGKEERSKLIMPYWVEVMMEVEIWCCEIVLGNSFSSQVRSKEGGKGKVLGAERLATALQKLEEAEKAADESERGMKVIENRAMKDEEKMELQEMQRAPLSPPRSTGSLLTPWHLLTPPAPALSPPTKHHGPR

SEQ ID NO: 901753 - protein, 950 aa, Homo sapiens
MLYSSRGDPEGQPLLLSLLILAMWVVGSGQLHYSVPEEAEHGTFVGRIAQDLGLELAELVPRLFQLDSKGRGDLLEVNLQNGILFVNSRIDREELCGRSAECSIHLEVIVDRPLQVFHVDVEVKDINDNPPVFPATQKNLFIAESRPLDSRFPLEGASDADIGENALLTYRLSPNEYFFLDVPTSNQQVKPLGLVLRKLLDREETPELHLLLTATDGGKPELTGTVQLLITVLDNNDNAPVFDRTLYTVKLPENVSIGTLVIHPNASDLDEGLNGDIIYSFSSDVSPDIKSKFHMDPLSGAITVIGHMDFEESRAHKIPVEAVDKGFPPLAGHCTVLVEVVDVNDNAPQLTIKTLSVPVKEDAQLGTVIALISVIDLDADANGQVTCSLTPHVPFKLVSTYKNYYSLVLDRALDRESVSAYELVVTARDGGSPSLWATARVSVEVADVNDNAPAFAQSEYTVFVKENNPPGCHIFTVSARDADAQENALVSYSLVERRLGERSLSSYVSVHAESGKVYALQPLDHEELELLQFQVSARDAGVPPLGSNVTLQVFVLDENDNAPALLTPRMRGTDGAVSEMVLRSVGAGVVVGKVRAVDADSGYNAWLSYELQPETASASIPFRVGLYTGEISTTRALDETDAPRQRLLVLVKDHGEPALTATATVLVSLVESGQAPKSSSRASVGATGPEVTLVDVNVYLIIAICAVSSLLVLTLLLYTVLRCSAMPTEGECAPGKPTLVCSSAVGSWSYSQQRRQRVCSGEGKQKTDLMAFSPGLSPCAGSTERTGEPSASSDSTGKPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 901754 - protein, 947 aa, Homo sapiens
MEFSWGSGQESRRLLLLLLLLAAWEAGNGQLHYSVSEEAKHGTFVGRIAQDLGLELAELVPRLFRVASKGRGGLLEVNLQNGILFVNSRIDREELCRRSAECSIHLEVIVDRPLQVFHVDVEVRDINDNPPVFPATQKNLSIAESRPLDSRFPLEGASDADIGENALLTYRLSPNEYFSLEKPPDDELVKGLGLILRKSLDREEAPEIFLVLTATDGGKPELTGTVQLLITVLDANDNAPAFDRTIYKVRLLENVPNGTLVIKLNASDLDEGLNGDIVYSFSNDISPNVKSKFHIDPITGQIIVKGYIDFEESKSYEIIVEGIDKGQLPLSGHCRVIVEVEDNNDNVPDLEFKSLSLPIREDAPLGTVIALISVSDKDMGVNGLVTCSLTSHVPFKLVSTFKNYYSLVLDSALDRESVSAYELVVTARDGGSPSLWATASVSVEVADVNDNAPAFAQPEYTVFVKENNPPGCHIFTVSAWDADAQENALVSYSLVERRVGERALSSYVSVHAESGKVYALQPLDHEELELLQFQVTARDAGVPPLGSNVTLQVFVLDENDNAPALLAPRAGGTGGAVSELVPWSVGVGHVVAKVRAVDADSGYNAWLSYELQPGTGGARIPFRVGLYTGEISTTRALDETDAPRHRLLVLVKDHGEPALTATATVLVSLVESGQAPKASSRALVGAVGPDAALVDVNVYLIIAICAVSSLLVLTLLLYTALRCSALPTEGACAPGKPTLVCSSAVGSWSYSQQRRPRVCSGEGPPKTDLMAFSPSLPDSRDREDQLQTTEESFAKPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 901755 - protein, 959 aa, Homo sapiens
MEIKPEVFDMVFTPEDRLGKQCLLLPLLLLAAWKVGSGQLHYSVPEEAKHGTFVGRIAQDLGLELAELVPRLFRMASKDREDLLEVNLQNGILFVNSRIDREELCGRSAECSIHLEVIVDRPLQVFHVDVEVRDINDNPPLFPVEEQRVLIYESRLPDSVFPLEGASDADVGSNSILTYKLSSSEYFGLDVKINSDDNKQIGLLLKKSLDREEAPAHNLFLTATDGGKPELTGTVQLLVTVLDVNDNAPTFEQSEYEVRIFENADNGTTVIRLNASDRDEGANGAISYSFNSLVAAMVIDHFSIDRNTGEIVIRGNLDFEQENLYKILIDATDKGHPPMAGHCTVLVRILDKNDNVPEIALTSLSLPVREDAQFGTVIALISVNDLDSGANGQVNCSLTPHVPFKLVSTFKNYYSLVLDSALDRESVSAYELVVTARDGGSPSLWATASLSVEVADMNDNAPAFAQPEYTVFVKENNPPGCHIFTVSARDADAQENALVSYSLVERRVGERALSSYISVHAESGKVYALQPLDHEELELLQFQVSARDAGVPPLGSNVTLQVFVLDENDNAPALLAPRVGGTGGAVSELVPRSLGAGQVVAKVRAVDADSGYNAWLSYELQPPASSARFPFRVGLYTGEISTTRVLDEADSPRHRLLVLVKDHGEPALTATATVLVSLVESGQAPKASSRASVGAAGPEAALVDVNVYLIIAICAVSSLLVLTLLLYTALRCSAPPTEGACTADKPTLVCSSAVGSWSYSQQRRQRVCSGEGPPKMDLMAFSPSLSPCPIMMGKAENQDLNEDHDAKPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 901756 - protein, 937 aa, Homo sapiens
MVCPNGYDPGGRHLLLFIIILAAWEAGRGQLHYSVPEEAKHGNFVGRIAQDLGLELAELVPRLFRAVCKFRGDLLEVNLQNGILFVNSRIDREELCGRSAECSIHLEVIVERPLQVFHVDVEVKDINDNPPVFPATQRNLFIAESRPLDSRFPLEGASDADIGENALLTYRLSPNEYFFLDVPTSNQQVKPLGLVLRKLLDREETPELHLLLTATDGGKPELTGTVQLLITVLDNNDNAPVFDRTLYTVKLPENVSIGTLVIHPNASDLDEGLNGDIIYSFSSDVSPDIKSKFHMDPLSGAITVIGHMDFEESRAHKIPVEAVDKGFPPLAGHCTVLVEVVDVNDNAPQLTLTSLSLPIPEDAQPGTVITLISVFDRDFGVNGQVTCSLTPRVPFKLVSTFKNYYSLVLDSALDRESVSAYELVVTARDGGSPSLWATASVSVEVADVNDNAPAFAQPEYTVFVKENNPPGCHIFTVSAGDADAQKNALVSYSLVELRVGERALSSYVSVHAESGKVYALQPLDHEELELLQFQVSARDAGVPPLGSNVTLQVFVLDENDNAPALLAPRVGGTGGAVRELVPRSVGAGHVVAKVRAVDADSGYNAWLSYELQPVAAGASIPFRVGLYTGEISTTRALDETDAPRHRLLVLVKDHGEPSLTATATVLVSLVESGQAPKASSRASLGIAGPETELVDVNVYLIIAICAVSSLLVLTLLLYTALRCSAPSSEGACSLVKPTLVCSSAVGSWSFSQQRRQRVCSGEGPPKTDLMAFSPSLPQGPSSTDNPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 901757 - protein, 950 aa, Homo sapiens
MVFSRRGGLGARDLLLWLLLLAAWEVGSGQLHYSIPEEAKHGTFVGRVAQDLGLELAELVPRLFRVASKTHRDLLEVNLQNGILFVNSRIDREELCQWSAECSIHLELIADRPLQVFHVEVKVKDINDNPPVFRGREQIIFIPESRLLNSRFPIEGAADADIGANALLTYTLSPSDYFSLDVEASDELSKSLWLELRKYLDREETPELHLLLTATDGGKPELQGTVELLITVLDVNDNAPLFDQAVYRVHLLETTANGTLVTTLNASDADEGVNGEVVFSFDSGISRDIQEKFKVDSSSGEIRLIDKLDYEETKSYEIQVKAVDKGSPPMSNHCKVLVKVLDVNDNAPELAVTSLYLPIREDAPLSTVIALITVSDRDSGANGQVTCSLMPHVPFKLVSTFKNYYSLVLDSALDRESLSVYELVVTARDGGSPSLWATARVSVEVADVNDNAPAFAQPEYTVFVKENNPPGCHIFTVSARDADAQENALVSYSLVERRVGERALSNYVSVHAESGKVYALQPLDHEELELLQFQVSARDAGVPPLGSNVTLQVFVLDENDNAPALLAPRVGGTIGAVSELVPRLVGAGHVVAKVRAVDADSGYNAWLSYELQPAAGGARIPFRVGLYTGEISTTRVLDEADLSRYRLLVLVKDHGEPALTATATVLVSLVESGQAPKASSRASVGVAGPEAALVDVNVYLIIAICAVSSLLVLTLLLYTALRCSVPPTEGAYVPGKPTLVCSSALGSWSNSQQRRQRVCSSEGPPKTDLMAFSPGLSPSLNTSERNEQPEANLDLSGNPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 901758 - protein, 936 aa, Homo sapiens
MVYSRRGSLGSRLLLLWLLLAYWKAGSGQLHYSIPEEAKHGTFVGRIAQDLGLELAELVPRLFRVASKGRGDLLEVNLQNGILFVNSRIDREELCRRRAECSIHLEVIVDRPLQVFHVEVAVKDINDNPPRFSRQEQRLFILESRMPDSRFPLEGASDLDIGANAQLRYRLNPNEYFDLDVKTNEEETNFLELVLRKSLDREETQEHRLLVIATDGGKPELTGTVQLLINVLDANDNAPEFDKSIYNVRLLENAPSGTLVIKLNASDADEGINKEIVYFFSNLVLDDVKSKFIINSNTGEIKVNGELDYEDYNSYEINIDAMDKSTFPLSGHCKVVVKLLDVNDNTPEMAITTLFLPVKEDAPLSTVIALISVSDRDSGANGQVTCSLMPHVPFKLVSTFKNYYSLVLDSALDRESVSVYELVVTARDGGSPSLWATASVSVEVADVNDNAPAFAQPQYTVFVKENNPPGCHIFTVSARDADAQENALVSYSLVERRVGERPLSSYVSVHAESGKVYALQPLDHEEVELLQFQVSARDAGVPPLGSNVTLQVFVLDENDNAPALLVPRVGGTGGAVSELVPRSVGAGHVVAKVRAVDPDSGYNAWLSYELQPAPGSARIPFRVGLYTGEISTTRSLDETEAPRHRLLVLVKDHGEPPLTATATVLVSLVESGQAPKASSRASAGAVGPEAALVDVNVYLIIAICAVSSLLVLTLLLYTALRCSAQPTEAVCTRGKPTLLCSSAVGSWSYSQQRRQRVCSGEAPPKTDLMAFSPSLPQGPTSTDNPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 901759 - protein, 950 aa, Homo sapiens
MLFSWREDPGAQCLLLSLLLLAASEVGSGQLHYSVSEEAKHGTFVGRIAQDLGLELAELVPRLFRVASKRHGDLLEVNLQNGILFVNSRIDREELCGRSAECSIHLEVIVDRPLQVFHVEVEVKDINDNAPVFPMAVKNLFISESRQPGSRFSLEGASDADIGTNSLLTYSLDSTEYFTLDVKRNDEEIKSLGLVLKKNLNREDTPKHYLLITAIDGGKPELTGTTQLKITVLDVNDNAPAFERTIYKVRLLENAPNGTLVVTVNATDLDEGVNKDIAYSFNTDMSADILSKFHLDPVNGQISVKGNIDFEESKSYEIQVEATDKGNPPMSDHCTVLLEIVDINDNVPELVIQSLSLPVLEDSPLSTVIALISVSDRDSGVNGQVTCSLTPHVPFKLVSTFKNYYSLVLDSPLDRESVSAYELVVTARDGGSPSLWATASVSVEVADVNDNAPAFSQSEYTVFVKENNPPGCHIFTVSARDADAQENALVSYSLVERRVGERALSSYVSVHAESGKVYALQPLDHEELELLQFQVSARDAGVPPLGSNVTLQVFVLDENDNAPALLMPRVGGIGGAVSELVPRSVGAGHVVAKVRAVDADSGYNAWLSYELQPGTGGARIPFRVGLYTGEISTTRALDEVDAPRHRLLVLVKDHGEPSLTATATVLVSLVESGQAPKASSQASAGATGPEAALVDVNVYLIVAICAVSSLLVLTLLLYTALRCSAPPTEGDCGPGKPTLVCSSAVGSWSYSQQRQQRVCSGEGLPKTDLMAFSPSLPPCPISRDREEKQDVDVDLSAKPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 901760 - protein, 842 aa, Homo sapiens
MLYSSRGDPEGQPLLLSLLILAMWVVGSGQLHYSVPEEAEHGTFVGRIAQDLGLELAELVPRLFQLDSKGRGDLLEVNLQNGILFVNSRIDREELCGRSAECSIHLEVIVDRPLQVFHVDVEVKDINDNPPVFPATQKNLFIAESRPLDSRFPLEGASDADIGENALLTYRLSPNEYFFLDVPTSNQQVKPLGLVLRKLLDREETPELHLLLTATDGGKPELTGTVQLLITVLDNNDNAPVFDRTLYTVKLPENVSIGTLVIHPNASDLDEGLNGDIIYSFSSDVSPDIKSKFHMDPLSGAITVIGHMDFEESRAHKIPVEAVDKGFPPLAGHCTVLVEVVDVNDNAPQLTIKTLSVPVKEDAQLGTVIALISVIDLDADANGQVTCSLTPHVPFKLVSTYKNYYSLVLDRALDRESVSAYELVVTARDGGSPSLWATARVSVEVADVNDNAPAFAQSEYTVFVKENNPPGCHIFTVSARDADAQENALVSYSLVERRLGERSLSSYVSVHAESGKVYALQPLDHEELELLQFQVSARDAGVPPLGSNVTLQVFVLDENDNAPALLTPRMRGTDGAVSEMVLRSVGAGVVVGKVRAVDADSGYNAWLSYELQPETASASIPFRVGLYTGEISTTRALDETDAPRQRLLVLVKDHGEPALTATATVLVSLVESGQAPKSSSRASVGATGPEVTLVDVNVYLIIAICAVSSLLVLTLLLYTVLRCSAMPTEGECAPGKPTLVCSSAVGSWSYSQQRRQRVCSGEGKQKTDLMAFSPGLSPCAGSTERTGEPSASSDSTGKVGFSSILFIYIIFFLERYYRLLPGAVQIVLFIFLEIQQIFFLIK

SEQ ID NO: 901761 - protein, 686 aa, Homo sapiens
MVFSRRGGLGARDLLLWLLLLAAWEVGSGQLHYSIPEEAKHGTFVGRVAQDLGLELAELVPRLFRVASKTHRDLLEVNLQNGILFVNSRIDREELCQWSAECSIHLELIADRPLQVFHVEVKVKDINDNPPVFRGREQIIFIPESRLLNSRFPIEGAADADIGANALLTYTLSPSDYFSLDVEASDELSKSLWLELRKYLDREETPELHLLLTATDGGKPELQGTVELLITVLDVNDNAPLFDQAVYRVHLLETTANGTLVTTLNASDADEGVNGEVVFSFDSGISRDIQEKFKVDSSSGEIRLIDKLDYEETKSYEIQVKAVDKGSPPMSNHCKVLVKVLDVNDNAPELAVTSLYLPIREDAPLSTVIALITVSDRDSGANGQVTCSLMPHVPFKLVSTFKNYYSLVLDSALDRESLSVYELVVTARDGGSPSLWATARVSVEVADVNDNAPAFAQPEYTVFVKENNPPGCHIFTVSARDADAQENALVSYSLVERRVGERALSNYVSVHAESGKVYALQPLDHEELELLQFQPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 901762 - protein, 685 aa, Homo sapiens
MVSRCSCLGVQCLLLSLLLLAAWEVGSGQLHYSVYEEARHGTFVGRIAQDLGLELAELVQRLFRVASKRHGDLLEVNLQNGILFVNSRIDREELCGRSVECSIHLEVIVDRPLQVFHVDVEVKDINDNPPRFSVTEQKLSIPESRLLDSRFPLEGASDADVGENALLTYKLSPNEYFVLDIINKKDKDKFPVLVLRKLLDREENPQLKLLLTATDGGKPEFTGSVSLLILVLDANDNAPIFDRPVYEVKMYENQVNQTLVIRLNASDSDEGINKEMMYSFSSLVPPTIRRKFWINERTGEIKVNDAIDFEDSNTYEIHVDVTDKGNPPMVGHCTVLVELLDENDNSPEVIVTSLSLPVKEDAQVGTVIALISVSDHDSGANGQVTCSLTPHVPFKLVSTYKNYYSLVLDSALDRERVSAYELVVTARDGGSPPLWATASVSVEVADVNDNAPAFAQSEYTVFVKENNPPGCHIFTVSAWDADAQENALVSYSLVERRLGERSLSSYVSVHAESGKVYALQPLDHEELELLQFQPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 901763 - protein, 810 aa, Homo sapiens
MFGFQRRGLGTPRLQLWLLLLEFWEVGSGQLHYSVSEEAKHGTFVGRIAQDLGLELAELVQRLFRVASKTHGDLLEVNLQNGILFVNSRIDREELCGQSAECSIHLEVIVDRPLQVFHVNVEVKDINDNPPVFSLREQKLLIAESKQSDSRFPLEGASDADIEENALLTYRLSKNEYFSLDSPTNGKQIKRLSLILKKSLDREKTPELNLLLTATDGGKPELTGTVRLLVQVLDVNDNDPEFDKSEYKVSLMENAAKETLVLKLNATDRDEGVNGEVTYSLMSIKPNGRHLFTLDQNNGEVRVNGTLDYEENKFYKIEVQATDKGTPPMAGHCTVWVEILDTNDNSPEVAVTSLSLPVREDAQPSTVIALISVSDRDSGVNGQVTCSLTPHVPFKLVSTFKNYYSLVLDSALDRENVWAYELVVTARDGGSPSLWATARVSVEVADVNDNAPAFAQPEYTVFVKENNPPGCHIFTVSARDADAQENALVSYSLVERRLGDRALSSYVSVHAESGKVYALQPLDHEELELLQFQVSARDAGVPPLSSNVTLQVFVLDENDNAPALLATQAGSAGGAVNKLVPRSVGAGHVVAKVRAVDADSGYNAWLSYELQPAAGGSRIPFRVGLYTGEISTTRALDEADSPRHRLLVLVKDHGEPALTATATVLVSLVESGQAPKASSRTLAGAASPEAALVDVNVYLIIAICVVSSLLVLTLLLYTALWWSATPTEGACAPGKPTLVCSRAVGSWSYSQQRRQRVCSEEGPPKTDLMAFSPSLPLGLNKEEEGERQEPGSNHPGQVSFLQIPPIRKCM

SEQ ID NO: 901764 - protein, 807 aa, Homo sapiens
MVFSRRGGLGARDLLLWLLLLAAWEVGSGQLHYSIPEEAKHGTFVGRVAQDLGLELAELVPRLFRVASKTHRDLLEVNLQNGILFVNSRIDREELCQWSAECSIHLELIADRPLQVFHVEVKVKDINDNPPVFRGREQIIFIPESRLLNSRFPIEGAADADIGANALLTYTLSPSDYFSLDVEASDELSKSLWLELRKYLDREETPELHLLLTATDGGKPELQGTVELLITVLDVNDNAPLFDQAVYRVHLLETTANGTLVTTLNASDADEGVNGEVVFSFDSGISRDIQEKFKVDSSSGEIRLIDKLDYEETKSYEIQVKAVDKGSPPMSNHCKVLVKVLDVNDNAPELAVTSLYLPIREDAPLSTVIALITVSDRDSGANGQVTCSLMPHVPFKLVSTFKNYYSLVLDSALDRESLSVYELVVTARDGGSPSLWATARVSVEVADVNDNAPAFAQPEYTVFVKENNPPGCHIFTVSARDADAQENALVSYSLVERRVGERALSNYVSVHAESGKVYALQPLDHEELELLQFQVSARDAGVPPLGSNVTLQVFVLDENDNAPALLAPRVGGTIGAVSELVPRLVGAGHVVAKVRAVDADSGYNAWLSYELQPAAGGARIPFRVGLYTGEISTTRVLDEADLSRYRLLVLVKDHGEPALTATATVLVSLVESGQAPKASSRASVGVAGPEAALVDVNVYLIIAICAVSSLLVLTLLLYTALRCSVPPTEGAYVPGKPTLVCSSALGSWSNSQQRRQRVCSSEGPPKTDLMAFSPGLSPSLNTSERNEQPEANLDLSGNVSPTFEFWL

SEQ ID NO: 901765 - protein, 807 aa, Homo sapiens
MLSSWQGGPRPRQLLLWLLILAAWETGSGQLHYSVPEEAKHGTFVGRIAQDLGLELAELVPRLFRVASKRHGDLLEVNLQNGILFVNSRIDREELCGRSAECSIHLEVIVDRPLQVFHVEVKVRDINDNPPIFPESKKRIIIAESRPPETRFPLDGASDADIGVNSALTYRLDPNDYFTLDAQNSLEQMSSLSLVLRKTLDREEIQEHSLLLTASDGGKPELTGTVQLLITILDVNDNAPEFYQSVYKVTVLENAFNGTLVIKLNATDPDDGTNGDIVYSFRRPVWPAVVYAFTINPNNGEIRTKGKLDFEEKKLYEISVEAVDKGNIPMAGHCTLLVEVLDVNDNAPEVTITSLSLPIREDTQPSAIIALISVSDRDSGSNGQVTCTLTPHVPFKLVSTYKNYYSLVLDSALDRESVSAYELVVTARDGGSPSLWATASVSVGVADVNDNAPAFAQPEYTVFVKENNPPGCHIFTVSAQDADAQENALVSYSLVERRVGERALSSYVSVHAESGKVYALQPLDHEELELLQFQVSARDSGVPPLGSNVTLQVFVLDENDNAPALLTPGAGSAGGTVSELMPRSVGAGHVVAKVRAVDADSGYNAWLSYELQLAAVGARIPFRVGLYTGEISTTRPLDEVDAPHHRLLVLVKDHGEPALTATATVLLSLVESGQAPQASSRASAGAVGPEAALVDVNVYLIIAICAVSSLLVLTLLLYTALRCSAPPTEGACAPGKPTLVCSSAAGSWSYSQQRRPRVCSGEGPHKTDLMAFSPSLPPCLGSAEGTGQREEDSECLKEVSLYFKKLS

SEQ ID NO: 901766 - protein, 824 aa, Homo sapiens
MLFSWREDPGAQCLLLSLLLLAASEVGSGQLHYSVSEEAKHGTFVGRIAQDLGLELAELVPRLFRVASKRHGDLLEVNLQNGILFVNSRIDREELCGRSAECSIHLEVIVDRPLQVFHVEVEVKDINDNAPVFPMAVKNLFISESRQPGSRFSLEGASDADIGTNSLLTYSLDSTEYFTLDVKRNDEEIKSLGLVLKKNLNREDTPKHYLLITAIDGGKPELTGTTQLKITVLDVNDNAPAFERTIYKVRLLENAPNGTLVVTVNATDLDEGVNKDIAYSFNTDMSADILSKFHLDPVNGQISVKGNIDFEESKSYEIQVEATDKGNPPMSDHCTVLLEIVDINDNVPELVIQSLSLPVLEDSPLSTVIALISVSDRDSGVNGQVTCSLTPHVPFKLVSTFKNYYSLVLDSPLDRESVSAYELVVTARDGGSPSLWATASVSVEVADVNDNAPAFSQSEYTVFVKENNPPGCHIFTVSARDADAQENALVSYSLVERRVGERALSSYVSVHAESGKVYALQPLDHEELELLQFQVSARDAGVPPLGSNVTLQVFVLDENDNAPALLMPRVGGIGGAVSELVPRSVGAGHVVAKVRAVDADSGYNAWLSYELQPGTGGARIPFRVGLYTGEISTTRALDEVDAPRHRLLVLVKDHGEPSLTATATVLVSLVESGQAPKASSQASAGATGPEAALVDVNVYLIVAICAVSSLLVLTLLLYTALRCSAPPTEGDCGPGKPTLVCSSAVGSWSYSQQRQQRVCSGEGLPKTDLMAFSPSLPPCPISRDREEKQDVDVDLSAKVSNFYLFFPKCLCFSFLNVSTPLEIH

SEQ ID NO: 901767 - protein, 884 aa, Homo sapiens; identical to SEQ ID NO: 750498

SEQ ID NO: 901768 - protein, 808 aa, Homo sapiens
MASSIRRGRGAWTRLLSLLLLAAWEVGSGQLRYSVPEEAKHGTFVGRIAQDLGLELEELVPRLFRVASKRHGDLLEVNLQNGILFVNSRIDREELCGRSAECSIHVEVIVDRPLQVFHVEVEVKDINDNPPIFPMTVKTIRFPESRLLDSRFPLEGASDADIGVNALLSYKLSSSEFFFLDIQANDELSESLSLVLGKSLDREETAEVNLLLVATDGGKPELTGTVQILIKVLDVNDNEPTFAQSVYKVKLLENTANGTLVVKLNASDADEGPNSEIVYSLGSDVSSTIQTKFTIDPISGEIRTKGKLDYEEAKSYEIQVTATDKGTPSMSGHCKISLKLVDINDNTPEVSITSLSLPISENASLGTVIALITVSDRDSGTNGHVTCSLTPHVPFKLVSTFKNYYSLVLDSALDRESVSAYELVVTARDGGSPSLWATTSVSIEVADVNDNAPAFAQPEYTVFVKENNPPGCHIFTVSAWDADAQENALVSYSLVERRVGERALSSYVSVHAESGKVYALQPLDHEEVELLQFQVSARDAGVPPLGSNVTLQVFVLDENDNAPALLAPRAGTAAGAVSELVPWSVGAGHVVAKVRAVDADSGYNAWLSYELQLGTGSARIPFRVGLYTGEISTTRALDEADSPRHRLLVLVKDHGEPALTATATVLVSLVESGQAPKASSRAWVGAAGSEATLVDVNVYLIIAICAVSSLLVLTVLLYTALRCSVPPTEGARAPGKPTLVCSSAVGSWSYSQQRRQRVCSGEDPPKTDLMAFSPSLSQGPDSAEEKQLSESEYVGKIWNFNLQIQLAS

SEQ ID NO: 901769 - protein, 983 aa, Homo sapiens
DCDAGKNLLNMYLQKRVTAHKIPQASDPLKLIVPTQRPSFSAMVIIGPRGPGSQRLLLSLLLLAAWEVGSGQLHYSVYEEAKHGTFVGRIAQDLGLELAELVPRLFRVASKRHGDLLEVNLQNGILFVNSRIDREKLCGRSAECSIHLEVIVDRPLQVFHVDVEVKDINDNPPVFREREQKVPVSESAPLDSHFPLEGASDADIGVNSLLTYALSLNENFELKIKTKKDKSILPELVLRKLLDREQTPKLNLLLMVIDGGKPELTGSVQIQITVLDVNDNGPAFDKPSYKVVLSENVQNDTRVIQLNASDPDEGLNGEISYGIKMILPVSEKCMFSINPDTGEIRIYGELDFEENNAYEIQVNAIDKGIPSMAGHSMVLVEVLDVNDNVPEVMVTSLSLPVQEDAQVGTVIALISVSDRDSGANGQVICSLTPHVPFKLVSTYKNYYSLVLDSALDRESVSAYELVVTARDGGSPSLWATARVSVEVADVNDNAPAFAQPEYTVFVKENNPPGCHIFTVSAWDADAQKNALVSYSLVERRVGEHALSSYVSVHAESGKVYALQPLDHEELELLQFQVSARDAGVPPLGSNVTLQVFVLDENDNAPALLATPAGSAGGAVSELVPRSVGAGHVVAKVRAVDADSGYNAWLSYELQPAAVGAHIPFHVGLYTGEISTTRILDEADAPRHRLLVLVKDHGEPALTSTATVLVSLVENGQAPKTSSRASVGAVDPEAALVDINVYLIIAICAVSSLLVLTLLLYTALRCSAPPTVSRCAPGKPTLVCSSAVGSWSYSQQRRQRVCSAESPPKTDLMAFSPSLQLSREDCLNPPSEPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 901770 - protein, 949 aa, Homo sapiens
MFGFQRRGLGTPRLQLWLLLLEFWEVGSGQLHYSVSEEAKHGTFVGRIAQDLGLELAELVQRLFRVASKTHGDLLEVNLQNGILFVNSRIDREELCGQSAECSIHLEVIVDRPLQVFHVNVEVKDINDNPPVFSLREQKLLIAESKQSDSRFPLEGASDADIEENALLTYRLSKNEYFSLDSPTNGKQIKRLSLILKKSLDREKTPELNLLLTATDGGKPELTGTVRLLVQVLDVNDNDPEFDKSEYKVSLMENAAKETLVLKLNATDRDEGVNGEVTYSLMSIKPNGRHLFTLDQNNGEVRVNGTLDYEENKFYKIEVQATDKGTPPMAGHCTVWVEILDTNDNSPEVAVTSLSLPVREDAQPSTVIALISVSDRDSGVNGQVTCSLTPHVPFKLVSTFKNYYSLVLDSALDRENVWAYELVVTARDGGSPSLWATARVSVEVADVNDNAPAFAQPEYTVFVKENNPPGCHIFTVSARDADAQENALVSYSLVERRLGDRALSSYVSVHAESGKVYALQPLDHEELELLQFQVSARDAGVPPLSSNVTLQVFVLDENDNAPALLATQAGSAGGAVNKLVPRSVGAGHVVAKVRAVDADSGYNAWLSYELQPAAGGSRIPFRVGLYTGEISTTRALDEADSPRHRLLVLVKDHGEPALTATATVLVSLVESGQAPKASSRTLAGAASPEAALVDVNVYLIIAICVVSSLLVLTLLLYTALWWSATPTEGACAPGKPTLVCSRAVGSWSYSQQRRQRVCSEEGPPKTDLMAFSPSLPLGLNKEEEGERQEPGSNHPGQPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 901771 - protein, 948 aa, Homo sapiens
MVSRCSCLGVQCLLLSLLLLAAWEVGSGQLHYSVYEEARHGTFVGRIAQDLGLELAELVQRLFRVASKRHGDLLEVNLQNGILFVNSRIDREELCGRSVECSIHLEVIVDRPLQVFHVDVEVKDINDNPPRFSVTEQKLSIPESRLLDSRFPLEGASDADVGENALLTYKLSPNEYFVLDIINKKDKDKFPVLVLRKLLDREENPQLKLLLTATDGGKPEFTGSVSLLILVLDANDNAPIFDRPVYEVKMYENQVNQTLVIRLNASDSDEGINKEMMYSFSSLVPPTIRRKFWINERTGEIKVNDAIDFEDSNTYEIHVDVTDKGNPPMVGHCTVLVELLDENDNSPEVIVTSLSLPVKEDAQVGTVIALISVSDHDSGANGQVTCSLTPHVPFKLVSTYKNYYSLVLDSALDRERVSAYELVVTARDGGSPPLWATASVSVEVADVNDNAPAFAQSEYTVFVKENNPPGCHIFTVSAWDADAQENALVSYSLVERRLGERSLSSYVSVHAESGKVYALQPLDHEELELLQFQVSARDGGVPPLGSNLTLQVFVLDENDNAPALLASPAGSAGGAVSELVLRSVVAGHVVAKVRAVDADSGYNAWLSYELQSAAVGARIPFRVGLYTGEISTTRALDETDSPRQRLLVLVKDHGEPSLTATATVLVSLVEGSQAPKASSRASVGVAPEVALVDVNVYLIIAICAVSSLLVLTLLLYTALRCSAAPTEGACGPVKPTLVCSSAVGSWSYSQQRRQRVCSGEGLPKADLMAFSPSLPPCPMVDVDGEDQSIGGDHSRKPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 901772 - protein, 950 aa, Homo sapiens
MLSSWQGGPRPRQLLLWLLILAAWETGSGQLHYSVPEEAKHGTFVGRIAQDLGLELAELVPRLFRVASKRHGDLLEVNLQNGILFVNSRIDREELCGRSAECSIHLEVIVDRPLQVFHVEVKVRDINDNPPIFPESKKRIIIAESRPPETRFPLDGASDADIGVNSALTYRLDPNDYFTLDAQNSLEQMSSLSLVLRKTLDREEIQEHSLLLTASDGGKPELTGTVQLLITILDVNDNAPEFYQSVYKVTVLENAFNGTLVIKLNATDPDDGTNGDIVYSFRRPVWPAVVYAFTINPNNGEIRTKGKLDFEEKKLYEISVEAVDKGNIPMAGHCTLLVEVLDVNDNAPEVTITSLSLPIREDTQPSAIIALISVSDRDSGSNGQVTCTLTPHVPFKLVSTYKNYYSLVLDSALDRESVSAYELVVTARDGGSPSLWATASVSVGVADVNDNAPAFAQPEYTVFVKENNPPGCHIFTVSAQDADAQENALVSYSLVERRVGERALSSYVSVHAESGKVYALQPLDHEELELLQFQVSARDSGVPPLGSNVTLQVFVLDENDNAPALLTPGAGSAGGTVSELMPRSVGAGHVVAKVRAVDADSGYNAWLSYELQLAAVGARIPFRVGLYTGEISTTRPLDEVDAPHHRLLVLVKDHGEPALTATATVLLSLVESGQAPQASSRASAGAVGPEAALVDVNVYLIIAICAVSSLLVLTLLLYTALRCSAPPTEGACAPGKPTLVCSSAAGSWSYSQQRRPRVCSGEGPHKTDLMAFSPSLPPCLGSAEGTGQREEDSECLKEPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 901773 - protein, 950 aa, Homo sapiens
MDYHWRGELGSWRLLLLLLLLAAWKVGSGQLHYSVPEEAKHGTFVGRIAQDLGLELAELVPRLFRVASKRHRDLLEVSLQNGILFVNSRIDREELCGRSAECSIHLEVIVDRPLQVFHVDVEVKDVNDNPPVFRVKDQKLFVSESRMPDSRFPLEGASDADVGANSVLTYRLSSHDYFMLDVNSKNDENKLVELVLRKSLDREDAPAHHLFLTATDGGKPELTGTVQLLVTVLDVNDNAPTFEQSEYEVRIFENADNGTTVIKLNASDPDEGANGAISYSFNSLVETMVIDHFSIDRNTGEIVIRGNLDFEQENLYKILIDATDKGHPPMAGHCTVLVRILDKNDNVPEIALTSLSLPVREDAQFGTVIALISVNDLDSGANGQVTCSLMPHVPFKLVSTFKNYYSLVLDSALDRERVSAYELVVTARDGGSPSLWATASLSVEVADVNDNAPAFAQPEYTVFVKENNPPGCHIFTVSARDADAQENALVSYSLVERRVGERSLSSYISVHTESGKVYALQPLDHEELELLQFQVSARDAGVPPLGSNVTLQVFVLDENDNAPALLEPRVGGTGGAASKLVPRSVGAGHVVAKVRAVDADSGYNAWLSYELQPAASSPRIPFRVGLYTGEISTTRVLDEADSPRHRLLVLVKDHGEPALTATATVLVSLVESGQAPKASSRQSAGVLGPEAALVDVNVYLIIAICAVSSLLVLTLLLYTALRCSALPTEGGCRAGKPTLVCSSAVGSWSYSQQQPQRVCSGEGPPKTDLMAFSPCLPPDLGSVDVGEEQDLNVDHGLKPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 901774 - protein, 695 aa, Homo sapiens
MEIKPEVFDMVFTPEDRLGKQCLLLPLLLLAAWKVGSGQLHYSVPEEAKHGTFVGRIAQDLGLELAELVPRLFRMASKDREDLLEVNLQNGILFVNSRIDREELCGRSAECSIHLEVIVDRPLQVFHVDVEVRDINDNPPLFPVEEQRVLIYESRLPDSVFPLEGASDADVGSNSILTYKLSSSEYFGLDVKINSDDNKQIGLLLKKSLDREEAPAHNLFLTATDGGKPELTGTVQLLVTVLDVNDNAPTFEQSEYEVRIFENADNGTTVIRLNASDRDEGANGAISYSFNSLVAAMVIDHFSIDRNTGEIVIRGNLDFEQENLYKILIDATDKGHPPMAGHCTVLVRILDKNDNVPEIALTSLSLPVREDAQFGTVIALISVNDLDSGANGQVNCSLTPHVPFKLVSTFKNYYSLVLDSALDRESVSAYELVVTARDGGSPSLWATASLSVEVADMNDNAPAFAQPEYTVFVKENNPPGCHIFTVSARDADAQENALVSYSLVERRVGERALSSYISVHAESGKVYALQPLDHEELELLQFQPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 901775 - protein, 1007 aa, Homo sapiens; identical to SEQ ID NO: 750495

SEQ ID NO: 901776 - protein, 844 aa, Homo sapiens
MVSRCSCLGVQCLLLSLLLLAAWEVGSGQLHYSVYEEARHGTFVGRIAQDLGLELAELVQRLFRVASKRHGDLLEVNLQNGILFVNSRIDREELCGRSVECSIHLEVIVDRPLQVFHVDVEVKDINDNPPRFSVTEQKLSIPESRLLDSRFPLEGASDADVGENALLTYKLSPNEYFVLDIINKKDKDKFPVLVLRKLLDREENPQLKLLLTATDGGKPEFTGSVSLLILVLDANDNAPIFDRPVYEVKMYENQVNQTLVIRLNASDSDEGINKEMMYSFSSLVPPTIRRKFWINERTGEIKVNDAIDFEDSNTYEIHVDVTDKGNPPMVGHCTVLVELLDENDNSPEVIVTSLSLPVKEDAQVGTVIALISVSDHDSGANGQVTCSLTPHVPFKLVSTYKNYYSLVLDSALDRERVSAYELVVTARDGGSPPLWATASVSVEVADVNDNAPAFAQSEYTVFVKENNPPGCHIFTVSAWDADAQENALVSYSLVERRLGERSLSSYVSVHAESGKVYALQPLDHEELELLQFQVSARDGGVPPLGSNLTLQVFVLDENDNAPALLASPAGSAGGAVSELVLRSVVAGHVVAKVRAVDADSGYNAWLSYELQSAAVGARIPFRVGLYTGEISTTRALDETDSPRQRLLVLVKDHGEPSLTATATVLVSLVEGSQAPKASSRASVGVAPEVALVDVNVYLIIAICAVSSLLVLTLLLYTALRCSAAPTEGACGPVKPTLVCSSAVGSWSYSQQRRQRVCSGEGLPKADLMAFSPSLPPCPMVDVDGEDQSIGGDHSRKVGYYVFIFLLCFMNNIFSYRIFSNMYQNISFLSTFHLCLNISSDTFVI

SEQ ID NO: 901777 - protein, 816 aa, Homo sapiens
MVYSRRGSLGSRLLLLWLLLAYWKAGSGQLHYSIPEEAKHGTFVGRIAQDLGLELAELVPRLFRVASKGRGDLLEVNLQNGILFVNSRIDREELCRRRAECSIHLEVIVDRPLQVFHVEVAVKDINDNPPRFSRQEQRLFILESRMPDSRFPLEGASDLDIGANAQLRYRLNPNEYFDLDVKTNEEETNFLELVLRKSLDREETQEHRLLVIATDGGKPELTGTVQLLINVLDANDNAPEFDKSIYNVRLLENAPSGTLVIKLNASDADEGINKEIVYFFSNLVLDDVKSKFIINSNTGEIKVNGELDYEDYNSYEINIDAMDKSTFPLSGHCKVVVKLLDVNDNTPEMAITTLFLPVKEDAPLSTVIALISVSDRDSGANGQVTCSLMPHVPFKLVSTFKNYYSLVLDSALDRESVSVYELVVTARDGGSPSLWATASVSVEVADVNDNAPAFAQPQYTVFVKENNPPGCHIFTVSARDADAQENALVSYSLVERRVGERPLSSYVSVHAESGKVYALQPLDHEEVELLQFQVSARDAGVPPLGSNVTLQVFVLDENDNAPALLVPRVGGTGGAVSELVPRSVGAGHVVAKVRAVDPDSGYNAWLSYELQPAPGSARIPFRVGLYTGEISTTRSLDETEAPRHRLLVLVKDHGEPPLTATATVLVSLVESGQAPKASSRASAGAVGPEAALVDVNVYLIIAICAVSSLLVLTLLLYTALRCSAQPTEAVCTRGKPTLLCSSAVGSWSYSQQRRQRVCSGEAPPKTDLMAFSPSLPQGPTSTDNVSFLILTSIFPSQFSNIKCHIHPLFLYLKIMS

SEQ ID NO: 901778 - protein, 814 aa, Homo sapiens
MDYHWRGELGSWRLLLLLLLLAAWKVGSGQLHYSVPEEAKHGTFVGRIAQDLGLELAELVPRLFRVASKRHRDLLEVSLQNGILFVNSRIDREELCGRSAECSIHLEVIVDRPLQVFHVDVEVKDVNDNPPVFRVKDQKLFVSESRMPDSRFPLEGASDADVGANSVLTYRLSSHDYFMLDVNSKNDENKLVELVLRKSLDREDAPAHHLFLTATDGGKPELTGTVQLLVTVLDVNDNAPTFEQSEYEVRIFENADNGTTVIKLNASDPDEGANGAISYSFNSLVETMVIDHFSIDRNTGEIVIRGNLDFEQENLYKILIDATDKGHPPMAGHCTVLVRILDKNDNVPEIALTSLSLPVREDAQFGTVIALISVNDLDSGANGQVTCSLMPHVPFKLVSTFKNYYSLVLDSALDRERVSAYELVVTARDGGSPSLWATASLSVEVADVNDNAPAFAQPEYTVFVKENNPPGCHIFTVSARDADAQENALVSYSLVERRVGERSLSSYISVHTESGKVYALQPLDHEELELLQFQVSARDAGVPPLGSNVTLQVFVLDENDNAPALLEPRVGGTGGAASKLVPRSVGAGHVVAKVRAVDADSGYNAWLSYELQPAASSPRIPFRVGLYTGEISTTRVLDEADSPRHRLLVLVKDHGEPALTATATVLVSLVESGQAPKASSRQSAGVLGPEAALVDVNVYLIIAICAVSSLLVLTLLLYTALRCSALPTEGGCRAGKPTLVCSSAVGSWSYSQQQPQRVCSGEGPPKTDLMAFSPCLPPDLGSVDVGEEQDLNVDHGLKVSPFKFRTHKFYLWKL

SEQ ID NO: 901779 - protein, 948 aa, Homo sapiens
MASSIRRGRGAWTRLLSLLLLAAWEVGSGQLRYSVPEEAKHGTFVGRIAQDLGLELEELVPRLFRVASKRHGDLLEVNLQNGILFVNSRIDREELCGRSAECSIHVEVIVDRPLQVFHVEVEVKDINDNPPIFPMTVKTIRFPESRLLDSRFPLEGASDADIGVNALLSYKLSSSEFFFLDIQANDELSESLSLVLGKSLDREETAEVNLLLVATDGGKPELTGTVQILIKVLDVNDNEPTFAQSVYKVKLLENTANGTLVVKLNASDADEGPNSEIVYSLGSDVSSTIQTKFTIDPISGEIRTKGKLDYEEAKSYEIQVTATDKGTPSMSGHCKISLKLVDINDNTPEVSITSLSLPISENASLGTVIALITVSDRDSGTNGHVTCSLTPHVPFKLVSTFKNYYSLVLDSALDRESVSAYELVVTARDGGSPSLWATTSVSIEVADVNDNAPAFAQPEYTVFVKENNPPGCHIFTVSAWDADAQENALVSYSLVERRVGERALSSYVSVHAESGKVYALQPLDHEEVELLQFQVSARDAGVPPLGSNVTLQVFVLDENDNAPALLAPRAGTAAGAVSELVPWSVGAGHVVAKVRAVDADSGYNAWLSYELQLGTGSARIPFRVGLYTGEISTTRALDEADSPRHRLLVLVKDHGEPALTATATVLVSLVESGQAPKASSRAWVGAAGSEATLVDVNVYLIIAICAVSSLLVLTVLLYTALRCSVPPTEGARAPGKPTLVCSSAVGSWSYSQQRRQRVCSGEDPPKTDLMAFSPSLSQGPDSAEEKQLSESEYVGKPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 901780 - protein, 824 aa, Homo sapiens
MASSIRRGRGAWTRLLSLLLLAAWEVGSGQLRYSVPEEAKHGTFVGRIAQDLGLELEELVPRLFRVASKRHGDLLEVNLQNGILFVNSRIDREELCGRSAECSIHVEVIVDRPLQVFHVEVEVKDINDNPPIFPMTVKTIRFPESRLLDSRFPLEGASDADIGVNALLSYKLSSSEFFFLDIQANDELSESLSLVLGKSLDREETAEVNLLLVATDGGKPELTGTVQILIKVLDVNDNEPTFAQSVYKVKLLENTANGTLVVKLNASDADEGPNSEIVYSLGSDVSSTIQTKFTIDPISGEIRTKGKLDYEEAKSYEIQVTATDKGTPSMSGHCKISLKLVDINDNTPEVSITSLSLPISENASLGTVIALITVSDRDSGTNGHVTCSLTPHVPFKLVSTFKNYYSLVLDSALDRESVSAYELVVTARDGGSPSLWATTSVSIEVADVNDNAPAFAQPEYTVFVKENNPPGCHIFTVSAWDADAQENALVSYSLVERRVGERALSSYVSVHAESGKVYALQPLDHEEVELLQFQVSARDAGVPPLGSNVTLQVFVLDENDNAPALLAPRAGTAAGAVSELVPWSVGAGHVVAKVRAVDADSGYNAWLSYELQLGTGSARIPFRVGLYTGEISTTRALDEADSPRHRLLVLVKDHGEPALTATATVLVSLVESGQAPKASSRAWVGAAGSEATLVDVNVYLIIAICAVSSLLVLTVLLYTALRCSVPPTEGARAPGKPTLVCSSAVGSWSYSQQRRQRVCSGEDPPKTDLMAFSPSLSQGPDSAEEKQLSESEYVGKVSLLLFLANSKIVLFKKFYMISTSYLDS

SEQ ID NO: 901781 - protein, 284 aa, Homo sapiens
PRLRYNGLRCWRILLRTRTASGRLFPRARSILYRARAKTTEVDSGARTQLRPASDPRIPRRPARVVWIAEGMPRRAENWDEAEVGAEEAGVEEYGPEEDGGEESGAEESGPEESGPEELGAEEEMEAGRPRPVLRSVNSREPSQVIFCNRSPRVVLPVWLNFDGEPQPYPTLPPGTGRRIHSYRGHLWLFRDAGTHDGLLVNQTELFVPSLNVDGQPIFANITLPVYTLKERCLQVVRSLVKPENYRRLDIVRSLYEDLEDHPNVQKDLERLTQERIAHQRMGD

SEQ ID NO: 901782 - protein, 284 aa, Homo sapiens; identical to SEQ ID NO: 901781

SEQ ID NO: 901783 - protein, 284 aa, Homo sapiens; identical to SEQ ID NO: 901781

SEQ ID NO: 901784 - protein, 284 aa, Homo sapiens; identical to SEQ ID NO: 901781

SEQ ID NO: 901785 - protein, 284 aa, Homo sapiens; identical to SEQ ID NO: 901781

SEQ ID NO: 901786 - protein, 284 aa, Homo sapiens; identical to SEQ ID NO: 901781

SEQ ID NO: 901787 - protein, 243 aa, Homo sapiens
PRLRYNGLRCWRILLRTRTASGRLFPRARSILYRARAKTTEVDSGARTQLRPASDPRIPRRPARVVWIAEGMPRRAENWDEAEVGAEEAGVEEYGPEEDGGEESGAEESGPEESGPEELGAEEEMEAGRPRPVLRSVNSREPSQVIFCNRSPRVVLPVWLNFDGEPQPYPTLPPGTGRRIHSYRVYTLKERCLQVVRSLVKPENYRRLDIVRSLYEDLEDHPNVQKDLERLTQERIAHQRMGD

SEQ ID NO: 901788 - protein, 284 aa, Homo sapiens; identical to SEQ ID NO: 901781

SEQ ID NO: 901789 - protein, 284 aa, Homo sapiens; identical to SEQ ID NO: 901781

SEQ ID NO: 901790 - protein, 284 aa, Homo sapiens; identical to SEQ ID NO: 901781

SEQ ID NO: 901791 - protein, 149 aa, Homo sapiens
VRLLRRLRRRRRRAARPRVVLPVWLNFDGEPQPYPTLPPGTGRRIHSYRGHLWLFRDAGTHDGLLVNQTELFVPSLNVDGQPIFANITLPVYTLKERCLQVVRSLVKPENYRRLDIVRSLYEDLEDHPNVQKDLERLTQERIAHQRMGD

SEQ ID NO: 901792 - protein, 284 aa, Homo sapiens; identical to SEQ ID NO: 901781

SEQ ID NO: 901793 - protein, 202 aa, Homo sapiens
PRLRYNGLRCWRILLRTRTASGRLFPRARSILYRARAKTTEVDSGARTQLRPASDPRIPRRPARVVWIAEGMPRRAENWDEAEVGAEEAGVEEYGPEEDGGEESGAEESGPEESGPEELGAEEEMEAGRPRPVLRSVNSREPSQVIFCNRSPRVVLPVWLNFDGEPQPYPTLPPGTGRRIHSYRGTGPALRPDPAGTIARSE

SEQ ID NO: 901794 - protein, 284 aa, Homo sapiens; identical to SEQ ID NO: 901781

SEQ ID NO: 901795 - protein, 284 aa, Homo sapiens; identical to SEQ ID NO: 901781

SEQ ID NO: 901796 - protein, 149 aa, Homo sapiens; identical to SEQ ID NO: 901791

SEQ ID NO: 901797 - protein, 284 aa, Homo sapiens; identical to SEQ ID NO: 901781

SEQ ID NO: 901798 - protein, 280 aa, Homo sapiens
PRLRYNGLRCWRILLRTRTASGRLFPRARSILYRARAKTTEVDSGARTQLRPASDPRIPRRPARVVWIAEGMPRRAENWDEAEVGAEEAGVEEYGPEEDGGEESGAEESGPEESGPEELGAEEEMEAGRPRPVLRSVNSREPSQVIFCNRSPRVVLPVWLNFDGEPQPYPTLPPGTGRRIHSYRESHCVTQAGVQWRVILAHCNLCLSGSSDSPASAAGTTVYTLKERCLQVVRSLVKPENYRRLDIVRSLYEDLEDHPNVQKDLERLTQERIAHQRMGD

SEQ ID NO: 901799 - protein, 284 aa, Homo sapiens; identical to SEQ ID NO: 901781

SEQ ID NO: 901800 - protein, 253 aa, Homo sapiens
PRLRYNGLRCWRILLRTRTASGRLFPRARSILYRARAKTTEVDSGARTQLRPASDPRIPRRPARVVWIAEGMPRRAENWDEAEVGAEEAGVEEYGPEEDGGEESGAEESGPEESGPEELGAEEEMEAGRPRPVLRSVNSREPSQVIFCNRSPRVVLPVWLNFDGEPQPYPTLPPGTGRRIHSYRVLMTPVGQFCVVPALVENTFLLGRLTDAKTGTSQGHVGAGRADRVWRGKLTYLPAGRWRGCGVWATVPG

SEQ ID NO: 901801 - protein, 149 aa, Homo sapiens; identical to SEQ ID NO: 901791

SEQ ID NO: 901802 - protein, 275 aa, Homo sapiens
ASTSWAQAILPAHADDLFPFFLRHAKQIFPVLDCKDDLRKISDLRIPPNWYPDARAMQRKIIFHSGPTNSGKTYHAIQKYFSAKSGVYCGPLKLLAHEIFEKSNAAGVPCDLVTGEERVTVQPNGKQASHVSCTVEMCSVTTPYEVAVIDEIQMIRDPARGWAWTRALLGLCAEEVHLCGEPAAIDLVMELMYTTGEEVEISLLFSPSSSCSSYSPTPLSSSTTRFFSSSLICTSSHFPLLYVPLITLYTSSSSTLHLPSIFSLSHFHSHPSPFL

SEQ ID NO: 901803 - protein, 806 aa, Homo sapiens
SGLSAAVSAAAPDSVEPAASMSFSRALLWARLPAGRQAGHRAAICSALRPHFGPFPGVLGQVSVLATASSSASGGSKIPNTSLFVPLTVKPQGPSADGDVGAELTRPLDKNEVKKVLDKFYKRKEIQKLGADYGLDARLFHQAFISFRNYIMQSHSLDVDIHIVLNDICFGAAHADDLFPFFLRHAKQIFPVLDCKDDLRKISDLRIPPNWYPDARAMQRKIIFHSGPTNSGKTYHAIQKYFSAKSGVYCGPLKLLAHEIFEKSNAAGVPCDLVTGEERVTVQPNGKQASHVSCTVEMCSVTTPYEVAVIDEIQMIRDPARGWAWTRALLGLCAEEVHLCGEPAAIDLVMELMYTTGEEVEVRDYKRLTPISVLDHALESLDNLRPGDCIVCFSKNDIYSVSRQIEIRGLESAVIYGSLPPGTKLAQAKKFNDPNDPCKILVATDAIGMGLNLSIRRIIFYSLIKPSINEKGERELEPITTSQALQIAGRAGRFSSRFKEGEVTTMNHEDLSLLKEILKRPVDPIRAAGLHPTAEQIEMFAYHLPDATLSNLIDIFVDFSQVDGQYFVCNMDDFKFSAELIQHIPLSLRVRYVFCTAPINKKQPFVCSSLLQFARQYSRNEPLTFAWLRRYIKWPLLPPKNIKDLMDLEAVHDVLDLYLWLSYRFMDMFPDASLIRDLQKELDGIIQDGVHNITKLIKMSETHKLLNLEGFPSGSQSRLSGTLKSQARRTRGTKALGSKATEPPSPDAGELSLASRLVQQGLLTPDMLKQLEKEWMTQQTEHNKEKTESGTHPKGTRRKKKEPDSD

SEQ ID NO: 901804 - protein, 851 aa, Homo sapiens
SVTVRRRVRGCARQCRTCGLDVLLPCPIVGSAPGGAPGWPPGSHLLCPSSPLWALSRGSGASFCPCHRLLLCLRWLQNTKHVLVRAPDCETSGPQRRRRRRGRANPASGQDYSNSPENVNVFAASCKKIELRHGFVSTRFSSGGESLELHWVCVPDEVKKVLDKFYKRKEIQKLGADYGLDARLFHQAFISFRNYIMQSHSLDVDIHIVLNDICFGAAHADDLFPFFLRHAKQIFPVLDCKDDLRKISDLRIPPNWYPDARAMQRKIIFHSGPTNSGKTYHAIQKYFSAKSGVYCGPLKLLAHEIFEKSNAAGVPCDLVTGEERVTVQPNGKQASHVSCTVEMCSVTTPYEVAVIDEIQMIRDPARGWAWTRALLGLCAEEVHLCGEPAAIDLVMELMYTTGEEVEVRDYKRLTPISVLDHALESLDNLRPGDCIVCFSKNDIYSVSRQIEIRGLESAVIYGSLPPGTKLAQAKKFNDPNDPCKILVATDAIGMGLNLSIRRIIFYSLIKPSINEKGERELEPITTSQALQIAGRAGRFSSRFKEGEVTTMNHEDLSLLKEILKRPVDPIRAAGLHPTAEQIEMFAYHLPDATLSNLIDIFVDFSQVDGQYFVCNMDDFKFSAELIQHIPLSLRVRYVFCTAPINKKQPFVCSSLLQFARQYSRNEPLTFAWLRRYIKWPLLPPKNIKDLMDLEAVHDVLDLYLWLSYRFMDMFPDASLIRDLQKELDGIIQDGVHNITKLIKMSETHKLLNLEGFPSGSQSRLSGTLKSQARRTRGTKALGSKATEPPSPDAGELSLASRLVQQGLLTPDMLKQLEKEWMTQQTEHNKEKTESGTHPKGTRRKKKEPDSD

SEQ ID NO: 901805 - protein, 612 aa, Homo sapiens
SGLSAAVSAAAPDSVEPAASMSFSRALLWARLPAGRQAGHRAAICSALRPHFGPFPGVLGQVSVLATASSSASGGSKIPNTSLFVPLTVKPQGPSADGDVGAELTRPLDKNEVAVIDEIQMIRDPARGWAWTRALLGLCAEEVHLCGEPAAIDLVMELMYTTGEEVEVRDYKRLTPISVLDHALESLDNLRPGDCIVCFSKNDIYSVSRQIEIRGLESAVIYGSLPPGTKLAQAKKFNDPNDPCKILVATDAIGMGLNLSIRRIIFYSLIKPSINEKGERELEPITTSQALQIAGRAGRFSSRFKEGEVTTMNHEDLSLLKEILKRPVDPIRAAGLHPTAEQIEMFAYHLPDATLSNLIDIFVDFSQVDGQYFVCNMDDFKFSAELIQHIPLSLRVRYVFCTAPINKKQPFVCSSLLQFARQYSRNEPLTFAWLRRYIKWPLLPPKNIKDLMDLEAVHDVLDLYLWLSYRFMDMFPDASLIRDLQKELDGIIQDGVHNITKLIKMSETHKLLNLEGFPSGSQSRLSGTLKSQARRTRGTKALGSKATEPPSPDAGELSLASRLVQQGLLTPDMLKQLEKEWMTQQTEHNKEKTESGTHPKGTRRKKKEPDSD

SEQ ID NO: 901806 - protein, 390 aa, Homo sapiens
SGLSAAVSAAAPDSVEPAASMSFSRALLWARLPAGRQAGHRAAICSALRPHFGPFPGVLGQVSVLATASSSASGGSKIPNTSLFVPLTVKPQGPSADGDVGAELTRPLDKNEVKKVLDKFYKRKEIQKLGADYGLDARLFHQAFISFRNYIMQSHSLDVDIHIVLNDICFGAAHADDLFPFFLRHAKQIFPVLDCKDDLRKISDLRIPPNWYPDARAMQRKIIFHSGPTNSGKTYHAIQKYFSAKSGVYCGPLKLLAHEIFEKSNAAGVPCDLVTGEERVTVQPNGKQASHVSCTVEMCSVTTPCMYMLFKKLWFGIFNFFFFSRQSLALLSRLECNGTISAHCDLCLPSSSDSPASASQVAGITGARHHTRLIFVFLLETGFLHVGQAG

SEQ ID NO: 901807 - protein, 806 aa, Homo sapiens; identical to SEQ ID NO: 901803

SEQ ID NO: 901808 - protein, 728 aa, Homo sapiens
MTLDSIGRIVYSKHENSILRHEGNTQEYPSHSLRVDLNILRTSYCIDSSYLRPTDFIIETILNKLTIMQLLNRSMELLEQFTLACLVIDIGFEAAHADDLFPFFLRHAKQIFPVLDCKDDLRKISDLRIPPNWYPDARAMQRKIIFHSGPTNSGKTYHAIQKYFSAKSGVYCGPLKLLAHEIFEKSNAAGVPCDLVTGEERVTVQPNGKQASHVSCTVEMCSVTTPYEVAVIDEIQMIRDPARGWAWTRALLGLCAEEVHLCGEPAAIDLVMELMYTTGEEVEVRDYKRLTPISVLDHALESLDNLRPGDCIVCFSKNDIYSVSRQIEIRGLESAVIYGSLPPGTKLAQAKKFNDPNDPCKILVATDAIGMGLNLSIRRIIFYSLIKPSINEKGERELEPITTSQALQIAGRAGRFSSRFKEGEVTTMNHEDLSLLKEILKRPVDPIRAAGLHPTAEQIEMFAYHLPDATLSNLIDIFVDFSQVDGQYFVCNMDDFKFSAELIQHIPLSLRVRYVFCTAPINKKQPFVCSSLLQFARQYSRNEPLTFAWLRRYIKWPLLPPKNIKDLMDLEAVHDVLDLYLWLSYRFMDMFPDASLIRDLQKELDGIIQDGVHNITKLIKMSETHKLLNLEGFPSGSQSRLSGTLKSQARRTRGTKALGSKATEPPSPDAGELSLASRLVQQGLLTPDMLKQLEKEWMTQQTEHNKEKTESGTHPKGTRRKKKEPDSD

SEQ ID NO: 901809 - protein, 334 aa, Homo sapiens
SGLSAAVSAAAPDSVEPAASMSFSRALLWARLPAGRQAGHRAAICSALRPHFGPFPGVLGQVSVLATASSSASGGSKIPNTSLFVPLTVKPQGPSADGDVGAELTRPLDKNEVKKVLDKFYKRKEIQKLGADYGLDARLFHQAFISFRNYIMQSHSLDVDIHIVLNDICFGAAHADDLFPFFLRHAKQIFPVLDCKDDLRKISDLRIPPNWYPDARAMQRKIIFHSGPTNSGKTYHAIQKYFSAKSGVYCGPLKLLAHEIFEKSNAAGVPCDLVTGEERVTVQPNGKQASHVSCTVEMCSVTTPYEVAVIDEIQMIRDPARGWAWTRALLGWWS

SEQ ID NO: 901810 - protein, 153 aa, Homo sapiens
MSIHIGHKQFMCQWCGKDFNMKQYFDEHMKTHTGEKPYICEICGKSFTSRPNMKRHRRTHTGEKPYPCDVCGQRFRFSNMLKAHKEKCFRVSHTLAGDGVPAAPGLPPTQPQAHALPLLPGLPQTLPPPPHLPPPPPLFPTTASPGGRMNANN

SEQ ID NO: 901811 - protein, 456 aa, Homo sapiens
EEEGGGSGREEEEEEEGGSQGEEEEEEEDGHSEQEEEEEEEEEEGPSEQDQESSEEEEGEEGEAGGKQGPRGSRSSRADPPPHSHMATRSRENARRRGTPEPEEAGRRGGKRPKPPPGVASASARGPPATDGLGAKVKLEEKQHHPCQKCPRVFNNRWYLEKHMNVTHSRMQICDQCGKRFLLESELLLHRQTDCERNIQCVTCGKAFKKLWSLHEHNKIVHGYAEKKFSCEICEKKFYTMAHVRKHMVAHTKDMPFTCETCGKSFKRSMSLKVHSLQHSGEKPFRCENCNERFQYKYQLRSHMSIHIGHKQFMCQWCGKDFNMKQYFDEHMKTHTGEKPYICEICGKSFTSRPNMKRHRRTHTGEKPYPCDVCGQRFRFSNMLKAHKEKCFRVSHTLAGDGVPAAPGLPPTQPQAHALPLLPGLPQTLPPPPHLPPPPPLFPTTASPGGRMNANN

SEQ ID NO: 901812 - protein, 456 aa, Homo sapiens; identical to SEQ ID NO: 901811

SEQ ID NO: 901813 - protein, 456 aa, Homo sapiens; identical to SEQ ID NO: 901811

SEQ ID NO: 901814 - protein, 456 aa, Homo sapiens; identical to SEQ ID NO: 901811

SEQ ID NO: 901815 - protein, 407 aa, Homo sapiens
MLFDKVKAFSVQLDGATAGVEPVFSGGQAVAGRVLLELSSAARVGALRLRARGRAHVHWTESRSAGSSTAYTQSYSERVEVVSHRATLLAPDTGETTTLPPGRHEFLFSFQLPPTLVTSFEGKHGSVRYCIKATLHRPWVPARRARKVFTVIEPVDINTPALLAPQAGAREKVARSWYCNRGLVSLSAKIDRKGYTPGEVIPVFAEIDNGSTRPVLPRAAVVQTQTFMARGARKQKRAVVASLAGEPVGPGQRALWQGRALRIPPVGPSILHCRVLHVDYALKVCVDIPGTSKLLLELPLVIGTIPLHPFGSRSSSVGSHASFLLDWRLGALPERPEAPPEYSEVVADTEEAALGQSPFPLPQDPDMSLEGPFFAYIQEFRYRPPPLYSEEDPNPLLGDMRPRCMTC

SEQ ID NO: 901816 - protein, 294 aa, Homo sapiens
PGSSPTTRPPWATGAGPSSPGGPGGSLGDATGERGNPGDLQARPGRVPSLRVSKPCPQPRAMRSGGVRSFALELARGPGGAYRGGERLCGRVLLEAAAPLRVRALEVKARGGAATHWLEGRSVGVNAVSSDYAAAETYLRRRQLLLRDTGETTTLPPGRHEFLFSFQLPPTLVTSFEGKHGSVRYCIKATLHRPWVPARRARKVFTVIEPVDINTPALLAPQAGAREKVARSWYCNRGLVSLSAKIDRKGYTPGEVIPVFAEIAGPCTPSIRPGWHVPEPTRPAPSPHPSSPLA

SEQ ID NO: 901817 - protein, 449 aa, Homo sapiens
MLFDKVKAFSVQLDGATAGVEPVFSGGQAVAGRVLLELSSAARVGALRLRARGRAHVHWTESRSAGSSTAYTQSYSERVEVVSHRATLLAPGTDGGPLLQHQLCASHHLDGGTSVSPGTPAQPLSRLLFLLPADTGETTTLPPGRHEFLFSFQLPPTLVTSFEGKHGSVRYCIKATLHRPWVPARRARKVFTVIEPVDINTPALLAPQAGAREKVARSWYCNRGLVSLSAKIDRKGYTPGEVIPVFAEIDNGSTRPVLPRAAVVQTQTFMARGARKQKRAVVASLAGEPVGPGQRALWQGRALRIPPVGPSILHCRVLHVDYALKVCVDIPGTSKLLLELPLVIGTIPLHPFGSRSSSVGSHASFLLDWRLGALPERPEAPPEYSEVVADTEEAALGQSPFPLPQDPDMSLEGPFFAYIQEFRYRPPPLYSEEDPNPLLGDMRPRCMTC

SEQ ID NO: 901818 - protein, 407 aa, Homo sapiens; identical to SEQ ID NO: 901815

SEQ ID NO: 901819 - protein, 515 aa, Homo sapiens
MLFDKVKAFSVQLDGATAGVEPVFSGGQAVAGRVLLELSSAARVGALRLRARGRAHVHWTESRSAGSSTAYTQSYSERVEVVSHRATLLAPGTDGGPLLQHQLCASHHLDGGTSVSPGTPAQPLSRLLFLLPADTGETTTLPPGRHEFLFSFQLPPPVSPLGCRVALSLQPLPDWYLQYWISGHLLSPKTLPLGGPRSVCVSFSLPACLCILSPEVPSLHPRTLVTSFEGKHGSVRYCIKATLHRPWVPARRARKVFTVIEPVDINTPALLAPQAGAREKVARSWYCNRGLVSLSAKIDRKGYTPGEVIPVFAEIDNGSTRPVLPRAAVVQTQTFMARGARKQKRAVVASLAGEPVGPGQRALWQGRALRIPPVGPSILHCRVLHVDYALKVCVDIPGTSKLLLELPLVIGTIPLHPFGSRSSSVGSHASFLLDWRLGALPERPEAPPEYSEVVADTEEAALGQSPFPLPQDPDMSLEGPFFAYIQEFRYRPPPLYSEEDPNPLLGDMRPRCMTC

SEQ ID NO: 901820 - protein, 174 aa, Homo sapiens
PGSSPTTRPPWATGAGPSSPGGPGGSLGDATGERGNPGDLQARPGRVPSLRVSKPCPQPRAMRSGGVRSFALELARGPGGAYRGGERLCGRVLLEAAAPLRVRALEVKARGGAATHWLEGRSVGVNAVSSDYAAAETYLRRRQLLLRDTGETTTLPPGRHEFLFSFQLPPDLQL

SEQ ID NO: 901821 - protein, 468 aa, Homo sapiens
PGSSPTTRPPWATGAGPSSPGGPGGSLGDATGERGNPGDLQARPGRVPSLRVSKPCPQPRAMRSGGVRSFALELARGPGGAYRGGERLCGRVLLEAAAPLRVRALEVKARGGAATHWLEGRSVGVNAVSSDYAAAETYLRRRQLLLRDTGETTTLPPGRHEFLFSFQLPPTLVTSFEGKHGSVRYCIKATLHRPWVPARRARKVFTVIEPVDINTPALLAPQAGAREKVARSWYCNRGLVSLSAKIDRKGYTPGEVIPVFAEIDNGSTRPVLPRAAVVQTQTFMARGARKQKRAVVASLAGEPVGPGQRALWQGRALRIPPVGPSILHCRVLHVDYALKVLCWISPGTYKSLMLDKHAHIGRIRPPISHMDTHYSGTRYTYPRRWEPSQKTQDNTRGMGTMDREPWERHQLGRDKPGPGQGIPYTVHDTVGTRVNKPRNTYDRKRKTQQRKPTNTHITRITPQGTPEH

SEQ ID NO: 901822 - protein, 179 aa, Homo sapiens
MLFDKVKAFSVQLDGATAGVEPVFSGGQAVAGRVLLELSSAARVGALRLRARGRAHVHWTESRSAGSSTAYTQSYSERVEVVSHRATLLAPGTDGGPLLQHQLCASHHLDGGTSVSLGPQRNRSVASFFSYLQIPGRPRRCLLGAMSSCSASSCPPGQAPNCRVPALAGAGPRPGTQHF

SEQ ID NO: 901823 - protein, 463 aa, Homo sapiens
PGSSPTTRPPWATGAGPSSPGGPGGSLGDATGERGNPGDLQARPGRVPSLRVSKPCPQPRAMRSGGVRSFALELARGPGGAYRGGERLCGRVLLEAAAPLRVRALEVKARGGAATHWLEGRSVGVNAVSSDYAAAETYLRRRQLLLRDTGETTTLPPGRHEFLFSFQLPPTLVTSFEGKHGSVRYCIKATLHRPWVPARRARKVFTVIEPVDINTPALLAPQAGAREKVARSWYCNRGLVSLSAKIDRKGYTPGEVIPVFAEIDNGSTRPVLPRAAVVQTQTFMARGARKQKRAVVASLAGEPVGPGQRALWQGRALRIPPVGPSILHCRVLHVDYALKVCVDIPGTSKLLLELPLVIGTIPLHPFGSRSSSVGSHASFLLDWRLGALPERPEAPPEYSEVVADTEEAALGQSPFPLPQDPDMSLEGPFFAYIQEFRYRPPPLYSEEDPNPLLGDMRPRCMTC

SEQ ID NO: 901824 - protein, 407 aa, Homo sapiens; identical to SEQ ID NO: 901815

SEQ ID NO: 901825 - protein, 407 aa, Homo sapiens; identical to SEQ ID NO: 901815

SEQ ID NO: 901826 - protein, 220 aa, Homo sapiens [sequence omitted]

SEQ ID NO: 901827 - protein, 690 aa, Homo sapiens
SPLSPALGSHPCVPGPNHSPERAAGGVWLGGPRRVKHLSPPYLKACPLSTSFTLIKTSRMQQDGLGVGTRNGSGKGRSVHPSWPWCAPRPLRYFGRDARARRAQTAAMALLAGGLSRGLGSHPAAAGRDAVVFVWLLLSTWCTAPARAIQVTVSNPYHVVILFQPVTLPCTYQMTSTPTQPIVIWKYKSFCRDRIADAFSPASVDNQLNAQLAAGNPGYNPYVECQDSVRTVRVVATKQGNAVTLGDYYQGRRITITGNADLTFDQTAWGDSGVYYCSVVSAQDLQGNNEAYAELIVLDWLFVVVVCLAAFLIFLLLGICWCQCCPHTCCCYVRCPCCPDKCCCPEALYAAGKAATSGVPSIYAPSTYAHLSPAKTPPPPAMIPMGPAYNGYPGGYPGDVDRSSSAGGQGSYVPLLRDTDSSVASEVRSGYRIQASQQDDSMRVLYYMEKELANFDPSRPGPPSGRVERAMSEVTSLHEDDWRSRPSRGPALTPIRDEEWGGHSPRSPRGWDQEPAREQAGGGWRARRPRARSVDALDDLTPPSTAESGSRSPTSNGGRRSRAYMPPRSRSRDDLYDQDDSRDFPRSRDPHYDDFRSRERPPADPRSHHHRTRDPRDNGSRSGDLPYDGRLLEEAVRKKGSEERRRPHKEEEEEAYYPPAPPPYSETDSQASRERRLKKNLALSRESLVV

SEQ ID NO: 901828 - protein, 709 aa, Homo sapiens
SPLSPALGSHPCVPGPNHSPERAAGGVWLGGPRRVKHLSPPYLKACPLSTSFTLIKTSRMQQDGLGVGTRNGSGKGRSVHPSWPWCAPRPLRYFGRDARARRAQTAAMALLAGGLSRGLGSHPAAAGRDAVVFVWLLLSTWCTAPARAIQVTVSNPYHVVILFQPVTLPCTYQMTSTPTQPIVIWKYKSFCRDRIADAFSPASVDNQLNAQLAAGNPGYNPYVECQDSVRTVRVVATKQGNAVTLGDYYQGRRITITGNADLTFDQTAWGDSGVYYCSVVSAQDLQGNNEAYAELIVLGRTSGVAELLPGFQAGPIEDWLFVVVVCLAAFLIFLLLGICWCQCCPHTCCCYVRCPCCPDKCCCPEALYAAGKAATSGVPSIYAPSTYAHLSPAKTPPPPAMIPMGPAYNGYPGGYPGDVDRSSSAGGQGSYVPLLRDTDSSVASEVRSGYRIQASQQDDSMRVLYYMEKELANFDPSRPGPPSGRVERAMSEVTSLHEDDWRSRPSRGPALTPIRDEEWGGHSPRSPRGWDQEPAREQAGGGWRARRPRARSVDALDDLTPPSTAESGSRSPTSNGGRRSRAYMPPRSRSRDDLYDQDDSRDFPRSRDPHYDDFRSRERPPADPRSHHHRTRDPRDNGSRSGDLPYDGRLLEEAVRKKGSEERRRPHKEEEEEAYYPPAPPPYSETDSQASRERRLKKNLALSRESLVV

SEQ ID NO: 901829 - protein, 660 aa, Homo sapiens
SPLSPALGSHPCVPGPNHSPERAAGGVWLGGPRRVKHLSPPYLKACPLSTSFTLIKTSRMQQDGLGVGTRNGSGKGRSVHPSWPWCAPRPLRYFGRDARARRAQTAAMALLAGGLSRGLGSHPAAAGRDAVVFVWLLLSTWCTAPARAIQVTVSNPYHVVILFQPVTLPCTYQMTSTPTQPIVIWKYKSFCRDRIADAFSPASVDNQLNAQLAAGNPGYNPYVECQDSVRTVRVVATKQGNAVTLGDYYQGRRITITGNADLTFDQTAWGDSGVYYCSVVSAQDLQGNNEAYAELIVLGRTSGVAELLPGFQAGPIEVYAAGKAATSGVPSIYAPSTYAHLSPAKTPPPPAMIPMGPAYNGYPGGYPGDVDRSSSAGGQGSYVPLLRDTDSSVASEVRSGYRIQASQQDDSMRVLYYMEKELANFDPSRPGPPSGRVERAMSEVTSLHEDDWRSRPSRGPALTPIRDEEWGGHSPRSPRGWDQEPAREQAGGGWRARRPRARSVDALDDLTPPSTAESGSRSPTSNGGRRSRAYMPPRSRSRDDLYDQDDSRDFPRSRDPHYDDFRSRERPPADPRSHHHRTRDPRDNGSRSGDLPYDGRLLEEAVRKKGSEERRRPHKEEEEEAYYPPAPPPYSETDSQASRERRLKKNLALSRESLVV

SEQ ID NO: 901830 - protein, 623 aa, Homo sapiens
PQWKWRSQAPPTSLSQPGLCLDSLLPAGAPRRVHRQPGRGVWAGREQVRGGTRPISTAPARAIQVTVSNPYHVVILFQPVTLPCTYQMTSTPTQPIVIWKYKSFCRDRIADAFSPASVDNQLNAQLAAGNPGYNPYVECQDSVRTVRVVATKQGNAVTLGDYYQGRRITITGNADLTFDQTAWGDSGVYYCSVVSAQDLQGNNEAYAELIVLGRTSGVAELLPGFQAGPIEDWLFVVVVCLAAFLIFLLLGICWCQCCPHTCCCYVRCPCCPDKCCCPEALYAAGKAATSGVPSIYAPSTYAHLSPAKTPPPPAMIPMGPAYNGYPGGYPGDVDRSSSAGGQGSYVPLLRDTDSSVASEVRSGYRIQASQQDDSMRVLYYMEKELANFDPSRPGPPSGRVERAMSEVTSLHEDDWRSRPSRGPALTPIRDEEWGGHSPRSPRGWDQEPAREQAGGGWRARRPRARSVDALDDLTPPSTAESGSRSPTSNGGRRSRAYMPPRSRSRDDLYDQDDSRDFPRSRDPHYDDFRSRERPPADPRSHHHRTRDPRDNGSRSGDLPYDGRLLEEAVRKKGSEERRRPHKEEEEEAYYPPAPPPYSETDSQASRERRLKKNLALSRESLVV

SEQ ID NO: 901831 - protein, 388 aa, Homo sapiens [sequence omitted]

SEQ ID NO: 901832 - protein, 442 aa, Homo sapiens
SPLSPALGSHPCVPGPNHSPERAAGGVWLGGPRRVKHLSPPYLKACPLSTSFTLIKTSRMQQDGLGVGTRNGSGKGRSVHPSWPWCAPRPLRYFGRDARARRAQTAAMALLAGGLSRGLGSHPAAAGRDAVVFVWLLLSTWCTAPARAIQVTVSNPYHVVILFQPVTLPCTYQMTSTPTQPIVIWKYKSFCRDRIADAFSPASVDNQLNAQLAAGNPGYNPYVECQDSVRTVRVVATKQGNAVTLGDYYQGRRITITGNADLTFDQTAWGDSGVYYCSVVSAQDLQGNNEAYAELIVLVYAAGKAATSGVPSIYAPSTYAHLSPAKTPPPPAMIPMGPAYNGYPGGYPGDVDRSSSAGGQGSYVPLLRDTDSSVASEVRSGYRIQASQQDDSMRVLYYMEKELANFDPSRPGPPSGRVERGGRPGRPHPAEHRRVREQVSHE

SEQ ID NO: 901833 - protein, 327 aa, Homo sapiens
SPLSPALGSHPCVPGPNHSPERAAGGVWLGGPRRVKHLSPPYLKACPLSTSFTLIKTSRMQQDGLGVGTRNGSGKGRSVHPSWPWCAPRPLRYFGRDARARRAQTAAMALLAGGLSRGLGSHPAAAGRDAVVFVWLLLSTWCTAPARAIQVTVSNPYHVVILFQPVTLPCTYQMTSTPTQPIVIWKYKSFCRDRIADAFSPASVDNQLNAQLAAGNPGYNPYVECQDSVRTVRVVATKQGNAVTLGDYYQGRRITITGNADLTFDQTAWGDSGVYYCSVVSAQDHKEEEEEAYYPPAPPPYSETDSQASRERRLKKNLALSRESLVV

SEQ ID NO: 901834 - protein, 516 aa, Homo sapiens
MTSTPTQPIVIWKYKSFCRDRIADAFSPASVDNQLNAQLAAGNPGYNPYVECQDSVRTVRVVATKQGNAVTLGDYYQGRRITITGNADLTFDQTAWGDSGVYYCSVVSAQDLQGNNEAYAELIVLGRTSGVAELLPGFQAGPIEDWLFVVVVCLAAFLIFLLLGICWCQCCPHTCCCYVRCPCCPDKCCCPEALYAAGKAATSGVPSIYAPSTYAHLSPAKTPPPPAMIPMGPAYNGYPGGYPGDVDRSSSEVRSGYRIQASQQDDSMRVLYYMEKELANFDPSRPGPPSGRVERAMSEVTSLHEDDWRSRPSRGPALTPIRDEEWGGHSPRSPRGWDQEPAREQAGGGWRARRPRARSVDALDDLTPPSTAESGSRSPTSNGGRRSRAYMPPRSRSRDDLYDQDDSRDFPRSRDPHYDDFRSRERPPADPRSHHHRTRDPRDNGSRSGDLPYDGRLLEEAVRKKGSEERRRPHKEEEEEAYYPPAPPPYSETDSQASRERRLKKNLALSRESLVV

SEQ ID NO: 901835 - protein, 641 aa, Homo sapiens
SPLSPALGSHPCVPGPNHSPERAAGGVWLGGPRRVKHLSPPYLKACPLSTSFTLIKTSRMQQDGLGVGTRNGSGKGRSVHPSWPWCAPRPLRYFGRDARARRAQTAAMALLAGGLSRGLGSHPAAAGRDAVVFVWLLLSTWCTAPARAIQVTVSNPYHVVILFQPVTLPCTYQMTSTPTQPIVIWKYKSFCRDRIADAFSPASVDNQLNAQLAAGNPGYNPYVECQDSVRTVRVVATKQGNAVTLGDYYQGRRITITGNADLTFDQTAWGDSGVYYCSVVSAQDLQGNNEAYAELIVLVYAAGKAATSGVPSIYAPSTYAHLSPAKTPPPPAMIPMGPAYNGYPGGYPGDVDRSSSAGGQGSYVPLLRDTDSSVASEVRSGYRIQASQQDDSMRVLYYMEKELANFDPSRPGPPSGRVERAMSEVTSLHEDDWRSRPSRGPALTPIRDEEWGGHSPRSPRGWDQEPAREQAGGGWRARRPRARSVDALDDLTPPSTAESGSRSPTSNGGRRSRAYMPPRSRSRDDLYDQDDSRDFPRSRDPHYDDFRSRERPPADPRSHHHRTRDPRDNGSRSGDLPYDGRLLEEAVRKKGSEERRRPHKEEEEEAYYPPAPPPYSETDSQASRERRLKKNLALSRESLVV

SEQ ID NO: 901836 - protein, 306 aa, Homo sapiens
MGPAYNGYPGGYPGDVDRSSSAGGQGSYVPLLRDTDSSVASEVRSGYRIQASQQDDSMRVLYYMEKELANFDPSRPGPPSGRVERAMSEVTSLHEDDWRSRPSRGPALTPIRDEEWGGHSPRSPRGWDQEPAREQAGGGWRARRPRARSVDALDDLTPPSTAESGSRSPTSNGGRRSRAYMPPRSRSRDDLYDQDDSRDFPRSRDPHYDDFRSRERPPADPRSHHHRTRDPRDNGSRSGDLPYDGRLLEEAVRKKGSEERRRPHKEEEEEAYYPPAPPPYSETDSQASRERRLKKNLALSRESLVV

SEQ ID NO: 901837 - protein, 601 aa, Homo sapiens
SPLSPALGSHPCVPGPNHSPERAAGGVWLGGPRRVKHLSPPYLKACPLSTSFTLIKTSRMQQDGLGVGTRNGSGKGRSVHPSWPWCAPRPLRYFGRDARARRAQTAAMALLAGGLSRGLGSHPAAAGRDAVVFVWLLLSTWCTAPARAIQVTVSNPYHVVILFQPVTLPCTYQMTSTPTQPIVIWKYKSFCRDRIADAFSPASVDNQLNAQLAAGNPGYNPYVECQDSVRTVRVVATKQGNAVTLGDYYQGRRITITGMYAAGKAATSGVPSIYAPSTYAHLSPAKTPPPPAMIPMGPAYNGYPGGYPGDVDRSSSAGGQGSYVPLLRDTDSSVASEVRSGYRIQASQQDDSMRVLYYMEKELANFDPSRPGPPSGRVERAMSEVTSLHEDDWRSRPSRGPALTPIRDEEWGGHSPRSPRGWDQEPAREQAGGGWRARRPRARSVDALDDLTPPSTAESGSRSPTSNGGRRSRAYMPPRSRSRDDLYDQDDSRDFPRSRDPHYDDFRSRERPPADPRSHHHRTRDPRDNGSRSGDLPYDGRLLEEAVRKKGSEERRRPHKEEEEEAYYPPAPPPYSETDSQASRERRLKKNLALSRESLVV

SEQ ID NO: 901838 - protein, 690 aa, Homo sapiens; identical to SEQ ID NO: 901827

SEQ ID NO: 901839 - protein, 682 aa, Homo sapiens
SPLSPALGSHPCVPGPNHSPERAAGGVWLGGPRRVKHLSPPYLKACPLSTSFTLIKTSRMQQDGLGVGTRNGSGKGRSVHPSWPWCAPRPLRYFGRDARARRAQTAAMALLAGGLSRGLGSHPAAAGRDAVVFVWLLLSTWCTAPARAIQVTVSNPYHVVILFQPVTLPCTYQMTSTPTQPIVIWKYKSFCRDRIADAFSPASVDNQLNAQLAAGNPGYNPYVECQDSVRTVRVVATKQGNAVTLGDYYQGRRITITGNADLTFDQTAWGDSGVYYCSVVSAQDLQGNNEAYAELIVLDWLFVVVVCLAAFLIFLLLGICWCQCCPHTCCCYVRCPCCPDKCCCPEALYAAGKAATSGVPSIYAPSTYAHLSPAKTPPPPAMIPMGPAYNGYPGGYPGDVDRSSSAGGQGSYVPLLRDTDSSVASEVRSGYRIQASQQDDSMRVLYYMEKELANFDPSRPGPPSGRVERAMSEVTSLHEDDWRSRPSRGPALTPIRDEEWGGHSPRSPRGWDQEPAREQAGGGWRARRPRARSVDALDDLTPPSTADNGGRRSRAYMPPRSRSRDDLYDQDDSRDFPRSRDPHYDDFRSRERPPADPRSHHHRTRDPRDNGSRSGDLPYDGRLLEEAVRKKGSEERRRPHKEEEEEAYYPPAPPPYSETDSQASRERRLKKNLALSRESLVV

SEQ ID NO: 901840 - protein, 124 aa, Homo sapiens
DPHYDDFRSRERPPADPRSHHHRTRDPRDNGSRSGDLPYDGRLLEEAVRKKGSEERRRPHKEEEEEAYYPPAPPPYSETDSQASRERRLKKVRAALPGVQTVPGPPAGPRGSYPSFFLPCRTWP

SEQ ID NO: 901841 - protein, 613 aa, Homo sapiens
YRRNNLLFRSAVVRRSNTSPMGFLRPGSCSPVPADTAQTVGRRLSTGSSRPYSPSPLVGTIPEQFSQCCCGHPQGHDSRSRNSSGSPVPQAQSPQSLLSGARLQSAPTLTDIYQNKQKLRKQHSDPVCPSHTGAGYSYSPQPSRPGSLGTSPTKHLGSSPRSSDWFFKTPLPTIIGSPTKTTAPFKIPKTQASSNLLALVTRHGPAEEQSKDGNEPRECAHCLLVQGSERQRAEQQSKAVFGRSVSTGKLSDQQGKTPICRHQGSTDSLNTERPMDIAPAGACGGVLAPPAGTAASSKAVLFTVGSPPHSAAAPTCTHMFLRTRTTSVGPSNSGGSLCAMSGRVCVGSPPGPGFGSSPPGAEAAPSLRYVPYGASPPSLEGLITFEAPELPEETLMEREHTDTLRHLNVMLMFTECVLDLTAMRGGNPELCTSAVSLYQIQESVVVDQISQLSKDWGRVEQLVLYMKAAQLLAASLHLAKAQIKSGKLSPSTAVKQVVKNLNERYKFCITMCKKLTEKLNRFFSDKQRFIDEINSVTAEKLIYNCAVEMVQSAALDEMFQQTEDIVYRYHKAALLLEGLSRILQDPADIENVHKYKCSIERRLSALCHSTATV

SEQ ID NO: 901842 - protein, 613 aa, Homo sapiens; identical to SEQ ID NO: 901841

SEQ ID NO: 901843 - protein, 646 aa, Homo sapiens
YRRNNLLFRSAVVRRSNTSPMGFLRPGSCSPVPADTAQTVGRRLSTGSSRPYSPSPLVGTIPEQFSQCCCGHPQGHDSRSRNSSGSPVPQAQSPQSLLSGARLQSAPTLTDIYQNKQKLRKQHSDPVCPSHTGAGYSYSPQPSRPGSLGTSPTKHLGSSPRSSDWFFKTPLPTIIGSPTKTTAPFKIPKTQASSNLLALVTRHGPAEEQSKDGNEPRECAHCLLVQGSERQRAEQQSKAVFGRSVSTGKLSDQQGKTPICRHQGSTDSLNTERPMDIAPAGACGGVLAPPAGTAASSKAVLFTVGSPPHSAAAPTCTHMFLRTRTTSVGPSNSGGSLCAMSGRVCVGSPPGPGFGSSPPGAEAAPSLRYVPYGASPPSLEGLITFEAPELPEETLMEREHTDTLRHLNVMLMFTECVLDLTAMRGGNPELCTSAVSLYQIQESVVVDQISQLSKDWGRVEQLVLYMKAAQLLAASLHLAKAQIKSGKLSPSTAVKQVVKNLNERYKFCITMCKKLTEKLNRFFSDKQRFIDEINSVTAEKLIYNCAVEMVQSAALDEMFQQTEDIVYRYHKAALLLEGLSRILQDPADIENVHKSPQPCEQQAHPVDRWWEREEEGKEGRAFPFGAPMSPAGPICLVEGSKISRNR

SEQ ID NO: 901844 - protein, 586 aa, Homo sapiens
YRRNNLLFRSAVVRRSNTSPMGFLRPGSCSPVPADTAQTVGRRLSTGSSRPYSPSPLVGTIPEQFSQCCCGHPQGHDSRSRNSSGSPVPQAQSPQSLLSGARLQSAPTLTDIYQNKQKLRKQHSDPVCPSHTGAGYSYSPQPSRPGSLGTSPTKHLGSSPRSSDWFFKTPLPTIIGSPTKTTAPFKIPKTQASSNLLALVTRHGPAEEQSKDGNEPRECAHCLLVQGSERQRAEQQSKAVFGRSVSTGKLSDQQGKTPICRHQGSTDSLNTERPMDIGSPPHSAAAPTCTHMFLRTRTTSVGPSNSGGSLCAMSGRVCVGSPPGPGFGSSPPGAEAAPSLRYVPYGASPPSLEGLITFEAPELPEETLMEREHTDTLRHLNVMLMFTECVLDLTAMRGGNPELCTSAVSLYQIQESVVVDQISQLSKDWGRVEQLVLYMKAAQLLAASLHLAKAQIKSGKLSPSTAVKQVVKNLNERYKFCITMCKKLTEKLNRFFSDKQRFIDEINSVTAEKLIYNCAVEMVQSAALDEMFQQTEDIVYRYHKAALLLEGLSRILQDPADIENVHKYKCSIERRLSALCHSTATV

SEQ ID NO: 901845 - protein, 357 aa, Homo sapiens [sequence omitted]

SEQ ID NO: 901846 - protein, 111 aa, Homo sapiens
PATGMREESGGLAGSNLSWGRVFLVFLGRRGGSASWDQRLGGAAEFTDGFSGKDNIFTPMSNVKTPRSRCVVYWICYNFTVLKEDALILCKMGLVNEKDQSCQEKRHNDEI

SEQ ID NO: 901847 - protein, 357 aa, Homo sapiens [sequence omitted]

SEQ ID NO: 901848 - protein, 474 aa, Homo sapiens
PPTHNLSPRNTHKRNSQPRGRVFLDEEKSAGKTLTHAQTCGRPWCAQRRAGFWEPPVDKTDKPACLRSPLPENHPLAPPSVRGARPPRDPGGVAGCGGEEVAARAGTSVSEAPQNSQMDSVEKTTNRSEQKSRKFLKSLIRKQPQELLLVIGTGVSAAVAPGIPALCSWRSCIEAVIEAAEQLEVLHPGDVAEFRRKVTKDRDLLVVAHDLIRKMSPRTGDAKPSFFQDCLMEVFDDLEQHIRSPLVLQSILSLMDRGAMVLTTNYDNLLEAFGRRQNKPMESLDLKDKTKVLEWARGHMKYGVLHIHGLYTDPCGVVLDPSGYKDVTQDAEVMEVLQNLYRTKSFLFVGCGETLRDQIFQALFLYSVPNKVDLEHYMLVLKENEDHFFKHQADMLLHGIKVVSYGDCFDHFPGYVQDLATQICKQQSPDADRVDSTTLLGNACQDCAKRKLEENGIEVSKKRTQSDTDDAGGS

SEQ ID NO: 901849 - protein, 183 aa, Homo sapiens
MKYGVLHIHGLYTDPCGVVLDPSGYKDVTQDAEVMVRPVLISMEVLQNLYRTKSFLFVGCGETLRDQIFQALFLYSVPNKVDLEHYMLVLKENEDHFFKHQADMLLHGIKVVSYGDCFDHFPGYVQDLATQICKQQSPDADRVDSTTLLGNACQDCAKRKLEENGIEVSKKRTQSDTDDAGGS

SEQ ID NO: 901850 - protein, 175 aa, Homo sapiens
MKYGVLHIHGLYTDPCGVVLDPSGYKDVTQDAEVMEVLQNLYRTKSFLFVGCGETLRDQIFQALFLYSVPNKVDLEHYMLVLKENEDHFFKHQADMLLHGIKVVSYGDCFDHFPGYVQDLATQICKQQSPDADRVDSTTLLGNACQDCAKRKLEENGIEVSKKRTQSDTDDAGGS

SEQ ID NO: 901851 - protein, 73 aa, Homo sapiens
NACQDCAKRKLEENGIEVSKKRTQSDTGNACQDCAKRKLEENGIEVSKKRTQSDTGVCAILMLAGVLAWDSPL

SEQ ID NO: 901852 - protein, 432 aa, Homo sapiens
MDSVEKTTNRSEQKSRKFLKSLIRKQPQELLLVIGTGVSAAVAPGIPALCSWRSCIEAVIEAAEQLEVLHPGDVAEFRRKVTKDRDLLVVAHDLIRKMSPRTGDAKPSFFQDCLMEVFDDLEQHIRSPLVLQSILSLMDRGAMVLTTNYDNLLEAFGRRQNKPMESLDLKDKTKVLEWARGHMKYGVLHIHGLYTDPCGVVLDPSGYKDVTQDAEVMVRPVLISMEVLQNLYRTKSFLFVGCGETLRDQIFQALFLYSVPNKVDLEHYMLVLKENEDHFFKHQADMLLHGIKVVSYGDCFDHFPGYVQDLATQICKQQSPDADRVDSTTLLGNACQDCAKRKLEENGIEVSKKRTQSDTGIVSVLFVGSCLGSLLLAGIFRDPCCALMPRALWWEDGAYVLSGPESTGGLLSRDPDLSPQPDSNCPELLVPL

SEQ ID NO: 901853 - protein, 377 aa, Homo sapiens
MDSVEKTTNRSEQKSRKFLKSLIRKQPQELLLVIGTGVSAAVAPGIPALCSWRSCIEAVIEAAEQLEVLHPGDVAEFRRKVTKDRDLLVVAHDLIRKMSPRTGDAKPSFFQDCLMEVFDDLEQHIRSPLVLQSILSLMDRGAMVLTTNYDNLLEAFGRRQNKPMESLDLKDKTKVLEWARGHMKYGVLHIHGLYTDPCGVVLDPSGYKDVTQDAEVMVRPVLISMEVLQNLYRTKSFLFVGCGETLRDQIFQALFLYSVPNKVDLEHYMLVLKENEDHFFKHQADMLLHGIKVVSYGDCFDHFPGYVQDLATQICKQQSPDADRVDSTTLLGNACQDCAKRKLEENGIEVSKKRTQSDTGVCAILMLAGVLAWDSPL

SEQ ID NO: 901854 - protein, 357 aa, Homo sapiens [sequence omitted]

SEQ ID NO: 901855 - protein, 357 aa, Homo sapiens [sequence omitted]

SEQ ID NO: 901856 - protein, 175 aa, Homo sapiens; identical to SEQ ID NO: 901850

SEQ ID NO: 901857 - protein, 115 aa, Homo sapiens
RGLPLTGVHIAGRAYCLVDLAVEHWAGVFFNTCEICAPRRHHLHLQPRLSPPSHVSLGRSSWPLLYRKPWPVLHVGERSQAWGSQRNRQAYSSPYLQQALTVCLLKLPHPQSTKK

SEQ ID NO: 901858 - protein, 357 aa, Homo sapiens [sequence omitted]

SEQ ID NO: 901859 - protein, 223 aa, Homo sapiens
MDSVEKTTNRSEQKSRKFLKSLIRKQPQELLLVIGTGVSAAVAPGIPALCSWRSCIEAVIEAAEQLEVLHPGDVAEFRRKVTKDRDLLVVAHDLIRKMSPRTGDAKPSFFQDCLMEVFDDLEQHIRSPLVLQSILSLMDRGAMVLTTNYDNLLEAFGRRQNKPMESLDLKDKTKVWAGGAGGLWPAAEQAHGVPGLEGQDQGMGWGCGRSLAGGRTSPWSPWT

SEQ ID NO: 901860 - protein, 238 aa, Homo sapiens
HQPEKLIFESCGYEANYLGSMLIKDLRGTESTQDACAKMRKSTEHMKKIPTIILSITYKGVKFIDASNKAGTENSDNGNRLGQGVPEACLSLRIPEHGFPQQNVIAEHEIRNISCAAQDPEDLCTFAYITKDLQTSHHYCHVFSTVDVNLTYEIILTLGQAFEVAYQLALQAQKSRATGASAAEMIETKSSKPVPKPRVGVRKSALEPPDMDQDAQSHASVSWVVDPKPDSKRSLSTN

SEQ ID NO: 901861 - protein, 205 aa, Homo sapiens
HQPEKLIFESCGYEANYLGSMLIKDLRGTESTQDACAKMRKSTEHMKKIPTIILSITYKGVKFIDASNKNVIAEHEIRNISCAAQDPEDLCTFAYITKDLQTSHHYCHVFSTVDVNLTYEIILTLGQAFEVAYQLALQAQKSRATGASAAEMIETKSSKPVPKPRVGVRKSALEPPDMDQDAQSHASVSWVVDPKPDSKRSLSTN

SEQ ID NO: 901862 - protein, 205 aa, Homo sapiens; identical to SEQ ID NO: 901861

SEQ ID NO: 901863 - protein, 205 aa, Homo sapiens; identical to SEQ ID NO: 901861

SEQ ID NO: 901864 - protein, 205 aa, Homo sapiens; identical to SEQ ID NO: 901861

SEQ ID NO: 901865 - protein, 205 aa, Homo sapiens; identical to SEQ ID NO: 901861

SEQ ID NO: 901866 - protein, 1613 aa, Homo sapiens
MGAVLRSLLACSFCVLLRAAPLLLYANRRDLRLVDATNGKENATIVVGGLEDAAAVDFVFSHGLIYWSDVSEEAIKRTEFNKTESVQNVVVSGLLSPDGLACDWLGEKLYWTDSETNRIEVSNLDGSLRKVLFWQELDQPRAIALDPSSGFMYWTDWGEVPKIERAGMDGSSRFIIINSEIYWPNGLTLDYEEQKLYWADAKLNFIHKSNLDGTNRQAVVKGSLPHPFALTLFEDILYWTDWSTHSILACNKYTGEGLREIHSDIFSPMDIHAFSQQRQPNATNPCGIDNGGCSHLCLMSPVKPFYQCACPTGVKLLENGKTCKDGATELLLLARRTDLRRISLDTPDFTDIVLQLEDIRHAIAIDYDPVEGYIYWTDDEVRAIRRSFIDGSGSQFVVTAQIAHPDGIAVDWVARNLYWTDTGTDRIEVTRLNGTMRKILISEDLEEPRAIVLDPMVGYMYWTDWGEIPKIERAALDGSDRVVLVNTSLGWPNGLALDYDEGKIYWGDAKTDKIEVMNTDGTGRRVLVEDKIPHIFGFTLLGDYVYWTDWQRRSIERVHKRSAEREVIIDQLPDLMGLKATNVHRVIGSNPCAEENGGCSHLCLYRPQGLRCACPIGFELISDMKTCIVPEAFLLFSRRADIRRISLETNNNNVAIPLTGVKEASALDFDVTDNRIYWTDISLKTISRAFMNGSALEHVVEFGLDYPEGMAVDWLGKNLYWADTGTNRIEVSKLDGQHRQVLVWKDLDSPRALALDPAEGFMYWTEWGGKPKIDRAAMDGSERTTLVPNVGRANGLTIDYAKRRLYWTDLDTNLIESSNMLGLNREVIADDLPHPFGLTQYQDYIYWTDWSRRSIERANKTSGQNRTIIQGHLDYVMDILVFHSSRQSGWNECASSNGHCSHLCLAVPVGGFVCGCPAHYSLNADNRTCSAPTTFLLFSQKSAINRMVIDEQQSPDIILPIHSLRNVRAIDYDPLDKQLYWIDSRQNMIRKAQEDGSQGFTVVVSSVPSQNLEIQPYDLSIDIYSRYIYWTCEATNVINVTRLDGRSVGVVLKGEQDRPRAIVVNPEKGYMYFTNLQERSPKIERAALDGTEREVLFFSGLSKPIALALDSRLGKLFWADSDLRRIESSDLSGANRIVLEDSNILQPVGLTVFENWLYWIDKQQQMIEKIDMTGREGRTKVQARIAQLSDIHAVKELNLQEYRQHPCAQDNGGCSHICLVKGDGTTRCSCPMHLVLLQDELSCGEPPTCSPQQFTCFTGEIDCIPVAWRCDGFTECEDHSDELNCPVCSESQFQCASGQCIDGALRCNGDANCQDKSDEKNCEVLCLIDQFRCANGQCIGKHKKCDHNVDCSDKSDELDCYPTEEPAPQATNTVGSVIGVIVTIFVSGTVYFICQRMLCPRMKGDGETMTNDYVVHGPASVPLGYVPHPSSLSGSLPGMSRGKSMISSLSIMGGSSGPPYDRAHVTGASSSSSSSTKGTYFPAILNPPPSPATERSHYTMEFGYSSNSPSTHRSYSYRPYSYRHFAPPTTPCSTDVCDSDYAPSRRMTSVATAKGYTSDLNYDSEPVPPPPTPRSQYLSAEENYESCPPSPYTERSYSHHLYPPPPSPCTDSS

SEQ ID NO: 901867 - protein, 1022 aa, Homo sapiens
MGAVLRSLLACSFCVLLRAAPLLLYANRRDLRLVDATNGKENATIVVGGLEDAAAVDFVFSHGLIYWSDVSEEAIKRTEFNKTESVQNVVVSGLLSPDGLACDWLGEKLYWTDSETNRIEVSNLDGSLRKVLFWQELDQPRAIALDPSSGFMYWTDWGEVPKIERAGMDGSSRFIIINSEIYWPNGLTLDYEEQKLYWADAKLNFIHKSNLDGTNRQAVVKGSLPHPFALTLFEDILYWTDWSTHSILACNKYTGEGLREIHSDIFSPMDIHAFSQQRQPNATNPCGIDNGGCSHLCLMSPVKPFYQCACPTGVKLLENGKTCKDGATELLLLARRTDLRRISLDTPDFTDIVLQLEDIRHAIAIDYDPVEGYIYWTDDEVRAIRRSFIDGSGSQFVVTAQIAHPDGIAVDWVARNLYWTDTGTDRIEVTRLNGTMRKILISEDLEEPRAIVLDPMVGYMYWTDWGEIPKIERAALDGSDRVVLVNTSLGWPNGLALDYDEGKIYWGDAKTDKIEVMNTDGTGRRVLVEDKIPHIFGFTLLGDYVYWTDWQRRSIERVHKRSAEREVIIDQLPDLMGLKATNVHRVIGSNPCAEENGGCSHLCLYRPQGLRCACPIGFELISDMKTCIVPEAFLLFSRRADIRRISLETNNNNVAIPLTGVKEASALDFDVTDNRIYWTDISLKTISRAFMNGSALEHVVEFGLDYPEGMAVDWLGKNLYWADTGTNRIEVSKLDGQHRQVLVWKDLDSPRALALDPAEGFMYWTEWGGKPKIDRAAMDGSERTTLVPNVGRANGLTIDYAKRRLYWTDLDTNLIESSNMLGLNREVIADDLPHPFGLTQYQDYIYWTDWSRRSIERANKTSGQNRTIIQGHLDYVMDILVFHSSRQSGWNECASSNGHCSHLCLAVPVGGFVCGCPAHYSLNADNRTCSAPTTFLLFSQKSAINRMVIDEQQSPDIILPIHSLRNVRAIDYDPLDKQLYWIDSRQNMIRKAQEDGSQVIESLVQNSFLLTNNWTHQPLCFT

SEQ ID NO: 901868 - protein, 1022 aa, Homo sapiens; identical to SEQ ID NO: 901867

SEQ ID NO: 901869 - protein, 1022 aa, Homo sapiens; identical to SEQ ID NO: 901867

SEQ ID NO: 901870 - protein, 1533 aa, Homo sapiens
MGAVLRSLLACSFCVLLRAAPLLLYANRRDLRLVDATNGKENATIVVGGLEDAAAVDFVFSHGLIYWSDVSEEAIKRTEFNKTESVQNVVVSGLLSPDGLACDWLGEKLYWTDSETNRIEVSNLDGSLRKVLFWQELDQPRAIALDPSSGFMYWTDWGEVPKIERAGMDGSSRFIIINSEIYWPNGLTLDYEEQKLYWADAKLNFIHKSNLDGTNRQAVVKGSLPHPFALTLFEDILYWTDWSTHSILACNKYTGEGLREIHSDIFSPMDIHAFSQQRQPNATNPCGIDNGGCSHLCLMSPVKPFYQCACPTGVKLLENGKTCKDGATELLLLARRTDLRRISLDTPDFTDIVLQLEDIRHAIAIDYDPVEGYIYWTDDEVRAIRRSFIDGSGSQFVVTAQIAHPDGIAVDWVARNLYWTDTGTDRIEVTRLNGTMRKILISEDLEEPRAIVLDPMVGYMYWTDWGEIPKIERAALDGSDRVVLVNTSLGWPNGLALDYDEGKIYWGDAKTDKIEVMNTDGTGRRVLVEDKIPHIFGFTLLGDYVYWTDWQRRSIERVHKRSAEREVIIDQLPDLMGLKATNVHRVIGSNPCAEENGGCSHLCLYRPQGLRCACPIGFELISDMKTCIVPEAFLLFSRRADIRRISLETNNNNVAIPLTGVKEASALDFDVTDNRIYWTDISLKTISRAFMNGSALEHVVEFGLDYPEGMAVDWLGKNLYWADTGTNRIEVSKLDGQHRQVLVWKDLDSPRALALDPAEGFMYWTEWGGKPKIDRAAMDGSERTTLVPNVGRANGLTIDYAKRRLYWTDLDTNLIESSNMLGLNREVIADDLPHPFGLTQYQDYIYWTDWSRRSIERANKTSGQNRTIIQGHLDYVMDILVFHSSRQSGWNECASSNGHCSHLCLAVPVGGFVCGCPAHYSLNADNRTCSAPTTFLLFSQKSAINRMVIDEQQSPDIILPIHSLRNVRAIDYDPLDKQLYWIDSRQNMIRKAQEDGSQGFTVVVSSVPSQNLEIQPYDLSIDIYSRYIYWTCEATNVINVTRLDGRSVGVVLKGEQDRPRAIVVNPEKGYMYFTNLQERSPKIERAALDGTEREVLFFSGLSKPIALALDSRLGKLFWADSDLRRIESSDLSGANRIVLEDSNILQPVGLTVFENWLYWIDKQQQMIEKIDMTGREGRTKVQARIAQLSDIHAVKELNLQEYRQHPCAQDNGGCSHICLVKGDGTTRCSCPMHLVLLQDELSCGEPPTCSPQQFTCFTGEIDCIPVAWRCDGFTECEDHSDELNCPVCSESQFQCASGQCIDGALRCNGDANCQDKSDEKNCEVLCLIDQFRCANGQCIGKHKKCDHNVDCSDKSDELDCYPTEEPAPQATNTVGSVIGVIVTIFVSGTVYFICQRMLCPRMKGDGETMTNDYVVHGPASVPLGYVPHPSSLSGSLPGMSRGKSMISSLSIMGGSSGPPYDRAHVTGASSSSSSSTKGTYFPAILNPPPSPATERSHYTMEFGYSSNSPSTHRSYSYRPYSYRPFTFPLHSPA

SEQ ID NO: 901871 - protein, 283 aa, Homo sapiens [sequence omitted]

SEQ ID NO: 901872 - protein, 1022 aa, Homo sapiens; identical to SEQ ID NO: 901867

SEQ ID NO: 901873 - protein, 1022 aa, Homo sapiens; identical to SEQ ID NO: 901867

SEQ ID NO: 901874 - protein, 916 aa, Homo sapiens
RPPRLLASPTSGHPSPVREENARREDGGRPEEPPGLQLLCAPERFMYWTDWGEVPKIERAGMDGSSRFIIINSEIYWPNGLTLDYEEQKLYWADAKLNFIHKSNLDGTNRQAVVKGSLPHPFALTLFEDILYWTDWSTHSILACNKYTGEGLREIHSDIFSPMDIHAFSQQRQPNATNPCGIDNGGCSHLCLMSPVKPFYQCACPTGVKLLENGKTCKDGATELLLLARRTDLRRISLDTPDFTDIVLQLEDIRHAIAIDYDPVEGYIYWTDDEVRAIRRSFIDGSGSQFVVTAQIAHPDGIAVDWVARNLYWTDTGTDRIEVTRLNGTMRKILISEDLEEPRAIVLDPMVGYMYWTDWGEIPKIERAALDGSDRVVLVNTSLGWPNGLALDYDEGKIYWGDAKTDKIEVMNTDGTGRRVLVEDKIPHIFGFTLLGDYVYWTDWQRRSIERVHKRSAEREVIIDQLPDLMGLKATNVHRVIGSNPCAEENGGCSHLCLYRPQGLRCACPIGFELISDMKTCIVPEAFLLFSRRADIRRISLETNNNNVAIPLTGVKEASALDFDVTDNRIYWTDISLKTISRAFMNGSALEHVVEFGLDYPEGMAVDWLGKNLYWADTGTNRIEVSKLDGQHRQVLVWKDLDSPRALALDPAEGFMYWTEWGGKPKIDRAAMDGSERTTLVPNVGRANGLTIDYAKRRLYWTDLDTNLIESSNMLGLNREVIADDLPHPFGLTQYQDYIYWTDWSRRSIERANKTSGQNRTIIQGHLDYVMDILVFHSSRQSGWNECASSNGHCSHLCLAVPVGGFVCGCPAHYSLNADNRTCSAPTTFLLFSQKSAINRMVIDEQQSPDIILPIHSLRNVRAIDYDPLDKQLYWIDSRQNMIRKAQEDGSQVIESLVQNSFLLTNNWTHQPLCFT

SEQ ID NO: 901875 - protein, 1430 aa, Homo sapiens
MGAVLRSLLACSFCVLLRAAPLLLYANRRDLRLVDATNGKENATIVVGGLEDAAAVDFVFSHGLIYWSDVSEEAIKRTEFNKTESVQNVVVSGLLSPDGLACDWLGEKLYWTDSETNRIEVSNLDGSLRKVLFWQELDQPRAIALDPSSGFMYWTDWGEVPKIERAGMDGSSRFIIINSEIYWPNGLTLDYEEQKLYWADAKLNFIHKSNLDGTNRQAVVKGSLPHPFALTLFEDILYWTDWSTHSILACNKYTGEGLREIHSDIFSPMDIHAFSQQRQPNATNPCGIDNGGCSHLCLMSPVKPFYQCACPTGVKLLENGKTCKDGATELLLLARRTDLRRISLDTPDFTDIVLQLEDIRHAIAIDYDPVEGYIYWTDDEVRAIRRSFIDGSGSQFVVTAQIAHPDGIAVDWVARNLYWTDTGTDRIEVTRLNGTMRKILISEDLEEPRAIVLDPMVGYMYWTDWGEIPKIERAALDGSDRVVLVNTSLGWPNGLALDYDEGKIYWGDAKTDKIEVMNTDGTGRRVLVEDKIPHIFGFTLLGDYVYWTDWQRRSIERVHKRSAEREVIIDQLPDLMGLKATNVHRVIGSNPCAEENGGCSHLCLYRPQGLRCACPIGFELISDMKTCIVPEAFLLFSRRADIRRISLETNNNNVAIPLTGVKEASALDFDVTDNRIYWTDISLKTISRAFMNGSALEHVVEFGLDYPEGMAVDWLGKNLYWADTGTNRIEVSKLDGQHRQVLVWKDLDSPRALALDPAEGFMYWTEWGGKPKIDRAAMDGSERTTLVPNVGRANGLTIDYAKRRLYWTDLDTNLIESSNMLGLNREVIADDLPHPFGLTQYQDYIYWTDWSRRSIERANKTSGQNRTIIQGHLDYVMDILVFHSSRQSGWNECASSNGHCSHLCLAVPVGGFVCGCPAHYSLNADNRTCSAPTTFLLFSQKSAINRMVIDEQQSPDIILPIHSLRNVRAIDYDPLDKQLYWIDSRQNMIRKAQEDGSQGFTVVVSSVPSQNLEIQPYDLSIDIYSRYIYWTCEATNVINVTRLDGRSVGVVLKGEQDRPRAIVVNPEKGYMYFTNLQERSPKIERAALDGTEREVLFFSGLSKPIALALDSRLGKLFWADSDLRRIESSDLSGANRIVLEDSNILQPVGLTVFENWLYWIDKQQQMIEKIDMTGREGRTKVQARIAQLSDIHAVKELNLQEYRQHPCAQDNGGCSHICLVKGDGTTRCSCPMHLVLLQDELSCGEPPTCSPQQFTCFTGEIDCIPVAWRCDGFTECEDHSDELNCPVCSESQFQCASGQCIDGALRCNGDANCQDKSDEKNCEVLCLIDQFRCANGQCIGKHKKCDHNVDCSDKSDELDCYPTEEPAPQATNTVGSVIGVIVTIFVSGTVYFICQRMLCPRMKGDGANINVGPCNNRELTQGFDVVDAGS

SEQ ID NO: 901876 - protein, 94 aa, Homo sapiens
DFVFSHGLIYWSDVSEEAIKRTEFNKTESVQNVVVSGLLSPDGLACDWLGEKLYWTDSETNRIEVSNLDGSLRKVLFWQELDQPRAIALDPSSG

SEQ ID NO: 901877 - protein, 282 aa, Homo sapiens
MSDVEENNFEGRESRSQSKSPTGTPARVKSESRSGSRSPSRVSKHSESHSRSRSKSRSRSRRHSHRRYTRSRSHSHSHRRRSRSRSYTPEYRRRRSRSHSPMSNRRRHTGSRANPDPNTCLGVFGLSLYTTERDLREVFSRYGPLSGVNVVYDQRTGRSRGFAFVYFERIDDSKEAMERANGMELDGRRIRVDYSITKRAHTPTPGIYMGRPTHSGGGGGGGGGGGGGGGGRRRDSYYDRGYDRGYDRYEDYDYRYRRRSPSPYYSRYRSRSRSRSYSPRRY

SEQ ID NO: 901878 - protein, 181 aa, Homo sapiens
MSNRRRHTGSRANPDPNTCLGVFGLSLYTTERDLREVFSRYGPLSGVNVVYDQRTGRSRGFAFVYFERIDDSKEAMERANGMELDGRRIRVDYSITKRAHTPTPGIYMGRPTHSGGGGGGGGGGGGGGGGRRRDSYYDRGYDRGYDRYEDYDYRYRRRSPSPYYSRYRSRSRSRSYSPRRY

SEQ ID NO: 901879 - protein, 181 aa, Homo sapiens; identical to SEQ ID NO: 901878

SEQ ID NO: 901880 - protein, 118 aa, Homo sapiens
MSNRRRHTGSRAMERANGMELDGRRIRVDYSITKRAHTPTPGIYMGRPTHSGGGGGGGGGGGGGGGGRRRDSYYDRGYDRGYDRYEDYDYRYRRRSPSPYYSRYRSRSRSRSYSPRRY

SEQ ID NO: 901881 - protein, 181 aa, Homo sapiens; identical to SEQ ID NO: 901878

SEQ ID NO: 901882 - protein, 181 aa, Homo sapiens; identical to SEQ ID NO: 901878

SEQ ID NO: 901883 - protein, 181 aa, Homo sapiens; identical to SEQ ID NO: 901878

SEQ ID NO: 901884 - protein, 231 aa, Homo sapiens
MYFSQRSRSRRHSHRRYTRSRSHSHSHRRRSRSRSYTPEYRRRRSRSHSPMSNRRRHTGSRANPDPNTCLGVFGLSLYTTERDLREVFSRYGPLSGVNVVYDQRTGRSRGFAFVYFERIDDSKEAMERANGMELDGRRIRVDYSITKRAHTPTPGIYMGRPTHSGGGGGGGGGGGGGGGGRRRDSYYDRGYDRGYDRYEDYDYRYRRRSPSPYYSRYRSRSRSRSYSPRRY

SEQ ID NO: 901885 - protein, 106 aa, Homo sapiens
MERANGMELDGRRIRVDYSITKRAHTPTPGIYMGRPTHSGGGGGGGGGGGGGGGGRRRDSYYDRGYDRGYDRYEDYDYRYRRRSPSPYYSRYRSRSRSRSYSPRRY

SEQ ID NO: 901886 - protein, 178 aa, Homo sapiens
MSDVEENNFEGRESRSQSKSPTGTPARVKSESRSGSRSPSRVSKHSESHSRSRSKSRSRSRRHSHRRYTRSRSHSHSHRRRSRIFSRYGPLSGVNVVYDQRTGRSRGFAFVYFERIDDSKEAMERANGMELDGRRIRVDYSITKRAHTPTPGIYMGRPTHSGGGLVEEAAAVEVEVVA

SEQ ID NO: 901887 - protein, 74 aa, Homo sapiens
RRPPPLRRALRRPGDFWRRRRHFAGACDRVGVEWSGCGCRLFPLPHGPVSGLIRPSALEPRLVSYLVLGSASST

SEQ ID NO: 901888 - protein, 180 aa, Homo sapiens
MSNRRRHTGSRANPDPNTCLGVFGLSLYTTERDLREVFSRYGPLSGVNVVYDQRTGRSRGFAFVYFERIDDSKEAMERANGMELDGRRIRVDYSITKRAHTPTPGIYMGRPTHSGGGGGGGGGGGGGGGGRRRDSYYDRGYDRGYDRYEDYDYRYRRRSPSPYYSRYRSRSRSRSYSPSM

SEQ ID NO: 901889 - protein, 181 aa, Homo sapiens; identical to SEQ ID NO: 901878

SEQ ID NO: 901890 - protein, 113 aa, Homo sapiens
MSNRRRHTGSRANPDPNTCLGVFGLSLYTTERDLREVFSRYGPLSGVNVVYDQRTGRSRGFAFVYFERIDDSKEAMERANGMELDGRRIRVDYSITKRAHTPTPGIYMGRPTQ

SEQ ID NO: 901891 - protein, 85 aa, Homo sapiens
MSNRRRHTGSRANPDPNTCLGVFGLSLYTTERDLREVFSRYGPLSGVNVVYDQRTGRSRGFAFVYFERIDDSKEVNLSFICLIIV

SEQ ID NO: 901892 - protein, 267 aa, Homo sapiens
MSDVEENNFEGRESRSQSKSPTGTPARVKSESRSGSRSPSRVSKHSESHSRSRSKSRSHSHSHRRRSRSRSYTPEYRRRRSRSHSPMSNRRRHTGSRANPDPNTCLGVFGLSLYTTERDLREVFSRYGPLSGVNVVYDQRTGRSRGFAFVYFERIDDSKEAMERANGMELDGRRIRVDYSITKRAHTPTPGIYMGRPTHSGGGGGGGGGGGGGGGGRRRDSYYDRGYDRGYDRYEDYDYRYRRRSPSPYYSRYRSRSRSRSYSPRRY

SEQ ID NO: 901893 - protein, 232 aa, Homo sapiens
MSDVEENNFEGRESRSQSKSPTGTPARVKSESRSGSRSPSRVSKHSESHSRSRSKSRSRSRRHSHRRYTRSRSHSHSHRRRSRSRSYTPEYRRRRSRSHSPMSNRRRHTGSRANPDPNTCLGVFGLSLYTTERDLREVFSRYGPLSGVNVVYDQRTGRSRGFAFVYFERIDDSKEAMERANGMELDGRRIRVDYSITKRAHTPTPGIYMGRPTHSGGGLVEEAAAVEVEVVA

SEQ ID NO: 901894 - protein, 219 aa, Homo sapiens
RTGLTAVSHNGSYVYFPKIGDKNKVTIWDLAEGEEQDSLDTSSEIRCLEVAEQRKLLFTGLVSGVVLVFPLNSRQDVICIPPPEARKAINCMSLSKCEDRLAIAYDNIVLVLDITSGDPCPVIDGPRYTFYTQLPETLSSVAILTDYRVVYSMTNGDLFLYECATSKAFPLETHRSRVACVEVSHKEQLVVSGSEDALLCLWDLQARKWKFEMSYTVGG

SEQ ID NO: 901895 - protein, 40 aa, Homo sapiens
MKIRGPVWKNLEKAEDPGKGGRHADRTAPPEIVTHCIEIA

SEQ ID NO: 901896 - protein, 233 aa, Homo sapiens
MSQSNRELVVDFLSYKLSQKGYSWSQFSDVEENRTEAPEGTESEMETPSAINGNPSWHLADSPAVNGATGHSSSLDAREVIPMAAVKQALREAGDEFELRYRRAFSDLTSQLHITPGTAYQSFEQVVNELFRDGVNWGRIVAFFSFGGALCVESVDKEMQVLVSRIAAWMATYLNDHLEPWIQENGGWDTFVELYGNNAAAESRKGQERFNRWFLTGMTVAGVVLLGSLFSRK

SEQ ID NO: 901897 - protein, 233 aa, Homo sapiens; identical to SEQ ID NO: 901896

SEQ ID NO: 901898 - protein, 233 aa, Homo sapiens; identical to SEQ ID NO: 901896

SEQ ID NO: 901899 - protein, 233 aa, Homo sapiens; identical to SEQ ID NO: 901896

SEQ ID NO: 901900 - protein, 233 aa, Homo sapiens; identical to SEQ ID NO: 901896

SEQ ID NO: 901901 - protein, 233 aa, Homo sapiens; identical to SEQ ID NO: 901896

SEQ ID NO: 901902 - protein, 200 aa, Homo sapiens
MSQSNRELVVDFLSYKLSQKGYSWSQFSDVEENRTEAPEGTESEMETPSAINGNPSWHLADSPAVNGATGHSSSLDAREVIPMAAVKQALREAGDEFELRYRRAFSDLTSQLHITPGTAYQSFEQVVNELFRDGVNWGRIVAFFSFGGALCVESVDKEMQVLVSRIAAWMATYLNDHLEPWIQENGGWVPDASFRFWLHH

SEQ ID NO: 901903 - protein, 175 aa, Homo sapiens
MSQSNRELVVDFLSYKLSQKGYSWSQFSDVEENRTEAPEGTESEMETPSAINGNPSWHLADSPAVNGATGHSSSLDAREVIPMAAVKQALREAGDEFELRYRRAFSDLTSQLHITPGTAYQSFEQVGYFCGTLWEQCSSREPKGPGTLQPLVPDGHDCGRRGSAGLTLQSEMTRH

SEQ ID NO: 901904 - protein, 175 aa, Homo sapiens; identical to SEQ ID NO: 901903

SEQ ID NO: 901905 - protein, 233 aa, Homo sapiens; identical to SEQ ID NO: 901896

SEQ ID NO: 901906 - protein, 233 aa, Homo sapiens; identical to SEQ ID NO: 901896

SEQ ID NO: 901907 - protein, 233 aa, Homo sapiens; identical to SEQ ID NO: 901896

SEQ ID NO: 901908 - protein, 233 aa, Homo sapiens; identical to SEQ ID NO: 901896

SEQ ID NO: 901909 - protein, 233 aa, Homo sapiens; identical to SEQ ID NO: 901896

SEQ ID NO: 901910 - protein, 233 aa, Homo sapiens; identical to SEQ ID NO: 901896

SEQ ID NO: 901911 - protein, 233 aa, Homo sapiens; identical to SEQ ID NO: 901896

SEQ ID NO: 901912 - protein, 233 aa, Homo sapiens; identical to SEQ ID NO: 901896

SEQ ID NO: 901913 - protein, 233 aa, Homo sapiens; identical to SEQ ID NO: 901896

SEQ ID NO: 901914 - protein, 233 aa, Homo sapiens; identical to SEQ ID NO: 901896

SEQ ID NO: 901915 - protein, 233 aa, Homo sapiens; identical to SEQ ID NO: 901896

SEQ ID NO: 901916 - protein, 233 aa, Homo sapiens; identical to SEQ ID NO: 901896

SEQ ID NO: 901917 - protein, 233 aa, Homo sapiens; identical to SEQ ID NO: 901896

SEQ ID NO: 901918 - protein, 115 aa, Homo sapiens
MSHDFCHQTQRRNQRRARASPSSTMKLAVTLTLVTLALCCSSASAEICPSFQRVIETLLMDTPSSYEAAMELFSPDQDMREAGAQLKKLVDTLPQKPRESIIKLMEKIAQSSLCN

SEQ ID NO: 901919 - protein, 80 aa, Homo sapiens
LLSSVSTASAEICPSFQRVIETLLMDTPSSYEAAMELFSPDQDMREAGAQLKKLVDTLPQKPRESIIKLMEKIAQSSLCN

SEQ ID NO: 901920 - protein, 80 aa, Homo sapiens; identical to SEQ ID NO: 901919

SEQ ID NO: 901921 - protein, 115 aa, Homo sapiens; identical to SEQ ID NO: 901918

SEQ ID NO: 901922 - protein, 115 aa, Homo sapiens; identical to SEQ ID NO: 901918

SEQ ID NO: 901923 - protein, 114 aa, Homo sapiens
QEKRRDVQRRRNQRRARASPSSTMKLAVTLTLVTLALCCSSASAEICPSFQRVIETLLMDTPSSYEAAMELFSPDQDMREAGAQLKKLVDTLPQKPRESIIKLMEKIAQSSLCN

SEQ ID NO: 901924 - protein, 115 aa, Homo sapiens; identical to SEQ ID NO: 901918

SEQ ID NO: 901925 - protein, 317 aa, Homo sapiens
TIERYRTEDDGPELDYTLMRVCKQMIKRFCPEADSKTMLQCLKQNKNSELMDPKCKQMITKRQITQNTDYRLNPMLRKACKADIPKFCHGILTKAKDDSELEGQVISCLKLRYADQRLSSDCEDQIRIIIQESALDYRLDPQLQLHCSDEISSLCAEEAAAQEQTGQVEECLKVNLLKIKTELCKKEVLNMLKESKADIFVDPVLHTACALDIKHHCAAITPGRGRQMSCLMEALEDKRVRLQPECKKRLNDRIEMWSYAAKVAPADGFSDLAMQVMTSPSKNYILSVISGSICILFLIGLMCGRITKRVTRELKDR

SEQ ID NO: 901926 - protein, 243 aa, Homo sapiens [sequence omitted]

SEQ ID NO: 901927 - protein, 317 aa, Homo sapiens; identical to SEQ ID NO: 901925

SEQ ID NO: 901928 - protein, 143 aa, Homo sapiens
VRVSATPGLGLTHSDVIAKDISLLFQVAPVLHTACALDIKHHCAAITPGRGRQMSCLMEALEDKRVRLQPECKKRLNDRIEMWSYAAKVAPADGFSDLAMQVMTSPSKNYILSVISGSICILFLIGLMCGRITKRVTRELKDR

SEQ ID NO: 901929 - protein, 67 aa, Homo sapiens
CIDYEFGVTQAKVAPADGFSDLAMQVMTSPSKNYILSVISGSICILFLIGLMCGRITKRVTRELKDR

SEQ ID NO: 901930 - protein, 317 aa, Homo sapiens; identical to SEQ ID NO: 901925

SEQ ID NO: 901931 - protein, 198 aa, Homo sapiens
TIERYRTEDDGPELDYTLMRVCKQMIKRFCPEADSKTMLQCLKQNKNSELMDPKCKQMITKRQITQNTDYRLNPMLRKACKADIPKFCHGILTKAKDDSELEGQVISCLKLRYADQRLSSDCEDQIRIIIQESALDYRLDPQLQLHCSDEISSLCAEEAAAQEQTGVTAFVWQTWVYLPVDKSLSYQQNFRYFQNQLT

SEQ ID NO: 901932 - protein, 186 aa, Homo sapiens
TIERYRTEDDGPELDYTLMRVCKQMIKRFCPEADSKTMLQCLKQNKNSELMDPKCKQMITKRQITQNTDYRLNPMLRKACKADIPKFCHGILTKAKDDSELEGQVISCLKLRYADQRLSSDCEDQIRIIIQESALDYRLDPQLQLHCSDEVGFACKTGYAQSCSEKFPLEKSCLLSLPSAVNDLVN

SEQ ID NO: 901933 - protein, 62 aa, Homo sapiens
MQRLSSDCEDQIRIIIQESALDYRLDPQLQLHCSDEVGFACKTGYAQSCSEKFPLEKSCLLS

SEQ ID NO: 901934 - protein, 317 aa, Homo sapiens; identical to SEQ ID NO: 901925

SEQ ID NO: 901935 - protein, 317 aa, Homo sapiens; identical to SEQ ID NO: 901925

SEQ ID NO: 901936 - protein, 93 aa, Homo sapiens
EFSLFFHWGVFLKKPLRLQPECKKRLNDRIEMWSYAAKVAPADGFSDLAMQVMTSPSKNYILSVISGSICILFLIGLMCGRITKRVTRELKDR

SEQ ID NO: 901937 - protein, 276 aa, Homo sapiens
TIERYRTEDDGPELDYTLMRVCKQMIKRFCPEADSKTMLQCLKQNKNSELMDPKCKQMITKRQITQNTDYRLNPMLRKACKADIPKFCHGILTKAKDDSELEGQVISCLKLRYADQRLSSDCEDQIRIIIQESALDYRLDPQLQLHCSDEISSLCAEEAAAQEQTGQVEECLKVNLLKIKTELCKKEVLNMLKESKADIFVDPVLHTACALDIKHHCAAITPGRGRQMSCLMEALEDKRVRLQPECKKRLNDRIEMWSYAAKGLLPLFGKLGFTCL

SEQ ID NO: 901938 - protein, 341 aa, Homo sapiens
TIERYRTEDDGPELDYTLMRVCKQMIKRFCPEADSKTMLQCLKQNKNSELMDPKCKQMITKRQITQNTDYRLNPMLRKACKADIPKFCHGILTKAKDDSELEGQVISCLKLRYADQRLSSDCEDQIRIIIQESALDYRLDPQLQLHCSDEISSLCAEEAAAQEQTGQVEECLKVNLLKIKTELCKKEVLNMLKESKADIFVDPVLHTACALDIKHHCAAITPGRGRQMSCLMEALEDKRVRLQPECKKRLNDRIEMWSYAAKVAPADGFSDLAMQVMTSPSKNYILSVISGSICILFLIGLMCGRITKRVTRELKDRLQYRSETMAYKGLVWSQDVTGSPA

SEQ ID NO: 901939 - protein, 104 aa, Homo sapiens
TIERYRTEDDGPELDYTLMRVCKQMIKRFCPEADSKTMLQCLKQNKNSELMDPKCKQMITKRQITQNTGKILAWLSWPRGVSEKEFSGCRVTCSNSQGFVAWEF

SEQ ID NO: 901940 - protein, 146 aa, Homo sapiens
ASYSLHTPSPPTPPETTARYEAGWCQRQPFQGSGCVIAILGKRCSRSVAHLARANPFNTPHLQLVHDGLGDLRSSSPGPTGQPRRPRNLAAAAVEEYSCEFGSAKYYALCGFGGVLSCGLTHTACGSPGFSEMPYAGGPPKVQGHI

SEQ ID NO: 901941 - protein, 132 aa, Homo sapiens
WLVRAGCVIGTRRQPFQGSGCVIAILGKRCSRSVAHLARANPFNTPHLQLVHDGLGDLRSSSPGPTGQPRRPRNLAAAAVEEYSCEFGSAKYYALCGFGGVLSCGLTHTACGSPGFSEMPYAGGPPKVQGHI

SEQ ID NO: 901942 - protein, 76 aa, Homo sapiens
GRVGPDAWVDPRVNHFFEGGLPAPPTQCIYTRTRKGLKEKPFLNQGGGFAPLLLGDLRNQDYHLPPHGLKSSGPGF

SEQ ID NO: 901943 - protein, 113 aa, Homo sapiens
GCVIAILGKRCSRSVAHLARANPFNTPHLQLVHDGLGDLRSSSPGPTGQPRRPRNLAAAAVEEYSCEFGSAKYYALCGFGGVLSCGLTHTACGSPGFSEMPYAGGPPKVQGHI

SEQ ID NO: 901944 - protein, 141 aa, Homo sapiens
ASYSLHTPSPPTPPETTARYEAGWCQGSGCVIAILGKRCSRSVAHLARANPFNTPHLQLVHDGLGDLRSSSPGPTGQPRRPRNLAAAAVEEYSCEFGSAKYYALCGFGGVLSCGLTHTACGSPGFSEMPYAGGPPKVQGHI

SEQ ID NO: 901945 - protein, 122 aa, Homo sapiens
APYRGYVTWCTWLLSIGKRCSRSVAHLARANPFNTPHLQLVHDGLGDLRSSSPGPTGQPRRPRNLAAAAVEEYSCEFGSAKYYALCGFGGVLSCGLTHTACGSPGFSEMPYAGGPPKVQGHI

SEQ ID NO: 901946 - protein, 132 aa, Homo sapiens
NHRLGTRLGGAQRQPFQGSGCVIAILGKRCSRSVAHLARANPFNTPHLQLVHDGLGDLRSSSPGPTGQPRRPRNLAAAAVEEYSCEFGSAKYYALCGFGGVLSCGLTHTACGSPGFSEMPYAGGPPKVQGHI

SEQ ID NO: 901947 - protein, 146 aa, Homo sapiens; identical to SEQ ID NO: 901940

SEQ ID NO: 901948 - protein, 131 aa, Homo sapiens
RLGEAVVIGRGRQPFQGSGCVIAILGKRCSRSVAHLARANPFNTPHLQLVHDGLGDLRSSSPGPTGQPRRPRNLAAAAVEEYSCEFGSAKYYALCGFGGVLSCGLTHTACGSPGFSEMPYAGGPPKVQGHI

SEQ ID NO: 901949 - protein, 131 aa, Homo sapiens
RLVRPYFIGTRRQPFQGSGCVIAILGKRCSRSVAHLARANPFNTPHLQLVHDGLGDLRSSSPGPTGQPRRPRNLAAAAVEEYSCEFGSAKYYALCGFGGVLSCGLTHTACGSPGFSEMPYAGGPPKVQGHI

SEQ ID NO: 901950 - protein, 131 aa, Homo sapiens; identical to SEQ ID NO: 901949

SEQ ID NO: 901951 - protein, 131 aa, Homo sapiens; identical to SEQ ID NO: 901949

SEQ ID NO: 901952 - protein, 131 aa, Homo sapiens; identical to SEQ ID NO: 901949

SEQ ID NO: 901953 - protein, 131 aa, Homo sapiens; identical to SEQ ID NO: 901949

SEQ ID NO: 901954 - protein, 131 aa, Homo sapiens; identical to SEQ ID NO: 901949

SEQ ID NO: 901955 - protein, 131 aa, Homo sapiens; identical to SEQ ID NO: 901949

SEQ ID NO: 901956 - protein, 131 aa, Homo sapiens; identical to SEQ ID NO: 901949

SEQ ID NO: 901957 - protein, 131 aa, Homo sapiens; identical to SEQ ID NO: 901949

SEQ ID NO: 901958 - protein, 131 aa, Homo sapiens; identical to SEQ ID NO: 901949

SEQ ID NO: 901959 - protein, 128 aa, Homo sapiens
GGGKLMAEVRGLGGSGCVIAILGKRCSRSVAHLARANPFNTPHLQLVHDGLGDLRSSSPGPTGQPRRPRNLAAAAVEEYSCEFGSAKYYALCGFGGVLSCGLTHTACGSPGFSEMPYAGGPPKVQGHI

SEQ ID NO: 901960 - protein, 131 aa, Homo sapiens; identical to SEQ ID NO: 901949

SEQ ID NO: 901961 - protein, 115 aa, Homo sapiens
RLVRPYFIGTRRQPFQGSGCVIAILGKRCSRSVAHLARANPFNTPHLQLVHDGLGEWTPKSTRAYLTDSQFTLNTRMVFVVWLHTDGLRLSLGLLHAGDSAKVWLSTERLYTGLV

SEQ ID NO: 901962 - protein, 132 aa, Homo sapiens; identical to SEQ ID NO: 901941

SEQ ID NO: 901963 - protein, 141 aa, Homo sapiens; identical to SEQ ID NO: 901944

SEQ ID NO: 901964 - protein, 105 aa, Homo sapiens
MVSGTSAAAPQGPRASPAALATWQPPPWKVRSDPAQYSRVVYLWAAQPLRPGPGLEDRKDESSPLHRRTAPSCLPWGIGLFHHRRVSDPWPSLKGVEALRPCVPS

SEQ ID NO: 901965 - protein, 157 aa, Homo sapiens
LHQWATRTCSGALCASRRRRAKGTHLRTRRTSGLCEPRQPFQGSGCVIAILGKRCSRSVAHLARANPFNTPHLQLVHDGLGDLRSSSPGPTGQPRRPRNLAAAAVEEYSCEFGSAKYYALCGFGGVLSCGLTHTACGSPGFSEMPYAGGPPKVQGHI

SEQ ID NO: 901966 - protein, 131 aa, Homo sapiens; identical to SEQ ID NO: 901949

SEQ ID NO: 901967 - protein, 130 aa, Homo sapiens
MVEAVVIGRGRQPFQGSGCVIAILGKRCSRSVAHLARANPFNTPHLQLVHDGLGDLRSSSPGPTGQPRRPRNLAAAAVEEYSCEFGSAKYYALCGFGGVLSCGLTHTACGSPGFSEMPYAGGPPKVQGHI

SEQ ID NO: 901968 - protein, 113 aa, Homo sapiens; identical to SEQ ID NO: 901943

SEQ ID NO: 901969 - protein, 129 aa, Homo sapiens
SLIKLFPPPRQPFQGSGCVIAILGKRCSRSVAHLARANPFNTPHLQLVHDGLGDLRSSSPGPTGQPRRPRNLAAAAVEEYSCEFGSAKYYALCGFGGVLSCGLTHTACGSPGFSEMPYAGGPPKVQGHI

SEQ ID NO: 901970 - protein, 131 aa, Homo sapiens; identical to SEQ ID NO: 901949

SEQ ID NO: 901971 - protein, 132 aa, Homo sapiens; identical to SEQ ID NO: 901941

SEQ ID NO: 901972 - protein, 133 aa, Homo sapiens
RTRGSGRVGRPTRRQPFQGSGCVIAILGKRCSRSVAHLARANPFNTPHLQLVHDGLGDLRSSSPGPTGQPRRPRNLAAAAVEEYSCEFGSAKYYALCGFGGVLSCGLTHTACGSPGFSEMPYAGGPPKVQGHI

SEQ ID NO: 901973 - protein, 131 aa, Homo sapiens; identical to SEQ ID NO: 901949

SEQ ID NO: 901974 - protein, 131 aa, Homo sapiens; identical to SEQ ID NO: 901949

SEQ ID NO: 901975 - protein, 131 aa, Homo sapiens; identical to SEQ ID NO: 901949

SEQ ID NO: 901976 - protein, 131 aa, Homo sapiens; identical to SEQ ID NO: 901949

SEQ ID NO: 901977 - protein, 131 aa, Homo sapiens; identical to SEQ ID NO: 901949

SEQ ID NO: 901978 - protein, 131 aa, Homo sapiens; identical to SEQ ID NO: 901949

SEQ ID NO: 901979 - protein, 131 aa, Homo sapiens; identical to SEQ ID NO: 901949

SEQ ID NO: 901980 - protein, 131 aa, Homo sapiens; identical to SEQ ID NO: 901949

SEQ ID NO: 901981 - protein, 141 aa, Homo sapiens; identical to SEQ ID NO: 901944

SEQ ID NO: 901982 - protein, 113 aa, Homo sapiens; identical to SEQ ID NO: 901943

SEQ ID NO: 901983 - protein, 132 aa, Homo sapiens
RLVRPYFIGTRRQPFQGSGCVIAILGKRCSRSVAHLARANPFNTPHLQLVHDGLGDLRSSSPGPTGQPRRPRNLAAAAVEEQYSCDYGSGRFFILCGLGGIISCGTTHTALVPLDLVKCRMQVCFACWTRAY

SEQ ID NO: 901984 - protein, 93 aa, Homo sapiens
RTRGSGRVGRPTRLLRVRISKNPGQVLFAQNHFFEGGLPAPPTQCTYTRTRKGLKEKPFLTQGGGFAPLLLGDLRNQDYQLPPHGLKSSGPGF

SEQ ID NO: 901985 - protein, 132 aa, Homo sapiens; identical to SEQ ID NO: 901941

SEQ ID NO: 901986 - protein, 361 aa, Homo sapiens
MFSSVAHLARANPFNTPHLQLVHDGLGDLRSSSPGPTGQPRRPRNLAAAAVEEYSCEFGSAKYYALCGFGGVLSCGLTHTAVVPLDLVKCRMQVDPQKYKGIFNGFSVTLKEDGVRGLAKGWAPTFLGYSMQGLCKFGFYEVFKVLYSNMLGEENTYLWRTSLYLAASASAEFFADIALAPMEAAKVRIQTQPGYANTLRDAAPKMYKEEGLKAFYKGVAPLWMRQIPYTMMKFACFERTVEALYKFVVPKPRSECSKPEQLVVTFVAGYIAGVFCAIVSHPADSVVSVLNKEKGSSASLVLKRLGFKGVWKGLFARIIMIGTLTALQWFIYDSVKVYFRLPRPPPPEMPESLKKKLGLTQ

SEQ ID NO: 901987 - protein, 201 aa, Homo sapiens
MAGKSSLFKVILLGDGGVGKSSLMNRYVTNKFDTQLFHTIGVEFLNKDLEVDGHFVTMQIWDTAGQERFRSLRTPFYRGSDCCLLTFSVDDSQSFQNLSNWKKEFIYYADVKEPESFPFVILGNKIDISERQVSTEEAQAWCRDNGDYPYFETSAKDATNVAAAFEEAVRRVLATEDRSDHLIQTDTVNLHRKPKPSSSCC

SEQ ID NO: 901988 - protein, 201 aa, Homo sapiens; identical to SEQ ID NO: 901987

SEQ ID NO: 901989 - protein, 266 aa, Homo sapiens
SGPCCSLRAGREQLEREPGCATAAASCCAGPRPSLCPHCAQTGRPRAPGSSFVWPRGFLKLLRLTMAGKSSLFKVILLGDGGVGKSSLMNRYVTNKFDTQLFHTIGVEFLNKDLEVDGHFVTMQIWDTAGQERFRSLRTPFYRGSDCCLLTFSVDDSQSFQNLSNWKKEFIYYADVKEPESFPFVILGNKIDISERQVSTEEAQAWCRDNGDYPYFETSAKDATNVAAAFEEAVRRVLATEDRSDHLIQTDTVNLHRKPKPSSSCC

SEQ ID NO: 901990 - protein, 150 aa, Homo sapiens
MSGELSNRFQGGKAFGLLKARQERRLAEINREFLCDQKYSDEENLPEKLTAFKEKYMEFDLNNEGEIDLMSLKRMMEKLGVPKTHLEMKKMISEVTGGVSDTISYRDFVNMMLGKRSAVLKLVMMFEGKANESSPKPVGPPPERDIASLP

SEQ ID NO: 901991 - protein, 150 aa, Homo sapiens; identical to SEQ ID NO: 901990

SEQ ID NO: 901992 - protein, 111 aa, Homo sapiens
PSVPRHTQLAGARTRRLCLLLVPRRVREAWSRREPRARHVGRAQQQVPRREGVRLAQSPAGEEAGRDQPEDGVREQCRRAMRGSQEERKSSTEPTRRRAASQAAEEGSSVS

SEQ ID NO: 901993 - protein, 196 aa, Homo sapiens
PLGPAAHAASRSPDQAPVPPPRPSPRPRSLEPAGAPRSPCRASSATGSKAASLSPPGGKAFGLLKARQERRLAEINREFLCDQKYSDEENLPEKLTAFKEKYMEFDLNNEGEIDLMSLKRMMEKLGVPKTHLEMKKMISEVTGGVSDTISYRDFVNMMLGKRSAVLKLVMMFEGKANESSPKPVGPPPERDIASLP

SEQ ID NO: 901994 - protein, 150 aa, Homo sapiens; identical to SEQ ID NO: 901990

SEQ ID NO: 901995 - protein, 150 aa, Homo sapiens; identical to SEQ ID NO: 901990

SEQ ID NO: 901996 - protein, 150 aa, Homo sapiens; identical to SEQ ID NO: 901990

SEQ ID NO: 901997 - protein, 150 aa, Homo sapiens; identical to SEQ ID NO: 901990

SEQ ID NO: 901998 - protein, 173 aa, Homo sapiens
EFLCDQKYSDEENLPEKLTAFKGKLGRAALHLFLGEVGWPLILAHRTPQPHRTRLWPCLSRMPFFLEKAWRQGPPERWGEAPPPASLPLRAPSPLACSPVLALPLSLPSLPTGLRLVPVRRCPGPVTPGPRTQSALCEQALPLPLPSRASQEPLRRMDVCVTAVGQGGRVSAH

SEQ ID NO: 901999 - protein, 107 aa, Homo sapiens
MSGELSNRFQGGKAFGLLKARQERRLAEINREFLCDQKYSDEENLPEKLTAFKEKYMEFDLNNEGEIDLMSLKRMMEKLGSRTLTSLAKGSASWDFNHLLSERPNLM

SEQ ID NO: 902000 - protein, 132 aa, Homo sapiens
VFLDCLDVGSLLFSIRWLQDSHSVPSYRALGTSGFPLQEFLCDQKYSDEENLPEKLTAFKEKYMEFDLNNEGEIDLMSLKRMMEKLGVPKTHLEMKKMISEVTGVMMFEGKANESSPKPVGPPPERDIASLP

SEQ ID NO: 902001 - protein, 125 aa, Homo sapiens
MSGELSNRFQGGKAFGLLKARQERRLAEINREFLCDQKYSDEENLPEKLTAFKEKYMEFDLNNEGEIDLMSLKRMMEKLGVPKTHLEMKKMISEVTGVMMFEGKANESSPKPVGPPPERDIASLP

SEQ ID NO: 902002 - protein, 107 aa, Homo sapiens
MSGELSNRFQGGKAFGLLKARQERRLAEINREFLCDQKYSDEENLPEKLTAFKEKYMEFDLNNEGEIDLMSLKRMMEKLGVPKTHLEMKKMISEVTGEDTEGTRMGE

SEQ ID NO: 902003 - protein, 150 aa, Homo sapiens; identical to SEQ ID NO: 901990

SEQ ID NO: 902004 - protein, 964 aa, Homo sapiens
GLHSRSATSQSGCGGGRSWLCSSLKMAAQPPRGIRLSALCPKFLHTNSTSHTWPFSAVAELIDNAYDPDVNAKQIWIDKTVINDHICLTFTDNGNGMTSDKLHKMLSFGFSDKVTMNGHVPVGLYGNGFKSGSMRLGKDAIVFTKNGESMSVGLLSQTYLEVIKAEHVVVPIVAFNKHRQMINLAESKASLAAILEHSLFSTEQKLLAELDAIIGKKGTRIIIWNLRSYKNATEFDFEKDKYDIRIPEDLDEITGKKGYKKQERMDQIAPESDYSLRAYCSILYLKPRMQIILRGQKVKTQLVSKSLAYIERDVYRPKFLSKTVRITFGFNCRNKDHYGIMMYHRNRLIKAYEKVGCQLRANNMGVGVVGIIECNFLKPTHNKQDFDYTNEYRLTITALGEKLNDYWNEMKVKKNTEYPLNLPVEDIQKRPDQTWVQCDACLKWRKLPDGMDQLPEKWYCSNNPDPQFRNCEVPEEPEDEDLVHPTYEKTYKKTNKEKFRIRQPEMIPRINAELLFRPTALSTPSFSSPKESVPRRHLSEGTNSYATRLLNNHQVPPQSEPESNSLKRRLSTRSSILNAKNRRLSSQFENSVYKGDDDDEDVIILEENSTPKPAVDHDIDMKSEQSHVEQGGVQVEFVGDSEPCGQTGSTSTSSSRCDQGNTAATQTEVPSLVVKKEETVEDEIDVRNDAVILPSCVEAEAKIHETQETTDKSADDAGCQLQELRNQLLLVTEEKENYKRQCHMFTDQIKVLQQRILEMNDKYVKKETCHQSTETDAVFLLESINGKSESPDHMVSQYQQALEEIERLKKQCSALQHVKAECSQCSNNESKSEMDEMAVQLDDVFRQLDKCSIERDQYKSEVELLEMEKSQIRSQCEELKTEVEQLKSTNQQTATDVSTSSNIEESVNHMDGESLKLRSLRVNVGQLLAMIVPDLDLQQVNYDVDVVDEILGQVVEQMSEISST

SEQ ID NO: 902005 - protein, 868 aa, Homo sapiens
MTSDKLHKMLSFGFSDKVTMNGHVPVGLYGNGFKSGSMRLGKDAIVFTKNGESMSVGLLSQTYLEVIKAEHVVVPIVAFNKHRQMINLAESKASLAAILEHSLFSTEQKLLAELDAIIGKKGTRIIIWNLRSYKNATEFDFEKDKYDIRIPEDLDEITGKKGYKKQERMDQIAPESDYSLRAYCSILYLKPRMQIILRGQKVKTQLVSKSLAYIERDVYRPKFLSKTVRITFGFNCRNKDHYGIMMYHRNRLIKAYEKVGCQLRANNMGVGVVGIIECNFLKPTHNKQDFDYTNEYRLTITALGEKLNDYWNEMKVKKNTEYPLNLPVEDIQKRPDQTWVQCDACLKWRKLPDGMDQLPEKWYCSNNPDPQFRNCEVPEEPEDEDLVHPTYEKTYKKTNKEKFRIRQPEMIPRINAELLFRPTALSTPSFSSPKESVPRRHLSEGTNSYATRLLNNHQVPPQSEPESNSLKRRLSTRSSILNAKNRRLSSQFENSVYKGDDDDEDVIILEENSTPKPAVDHDIDMKSEQSHVEQGGVQVEFVGDSEPCGQTGSTSTSSSRCDQGNTAATQTEVPSLVVKKEETVEDEIDVRNDAVILPSCVEAEAKIHETQETTDKSADDAGCQLQELRNQLLLVTEEKENYKRQCHMFTDQIKVLQQRILEMNDKYVKKETCHQSTETDAVFLLESINGKSESPDHMVSQYQQALEEIERLKKQCSALQHVKAECSQCSNNESKSEMDEMAVQLDDVFRQLDKCSIERDQYKSEVELLEMEKSQIRSQCEELKTEVEQLKSTNQQTATDVSTSSNIEESVNHMDGESLKLRSLRVNVGQLLAMIVPDLDLQQVNYDVDVVDEILGQVVEQMSEISST

SEQ ID NO: 902006 - protein, 344 aa, Homo sapiens
MKSEQSHVEQGGVQVEFVGDSEPCGQTGSTSTSSSRCDQGNTAATQTEVPSLVVKKEETVEDEIDVRNDAVILPSCVEAEAKIHETQETTDKSADDAGCQLQELRNQLLLVTEEKENYKRQCHMFTDQIKVLQQRILEMNDKYVKKETCHQSTETDAVFLLESINGKSESPDHMVSQYQQALEEIERLKKQCSALQHVKAECSQCSNNESKSEMDEMAVQLDDVFRQLDKCSIERDQYKSEVELLEMEKSQIRSQCEELKTEVEQLKSTNQQTATDVSTSSNIEESVNHMDGESLKLRSLRVNVGQLLAMIVPDLDLQQVNYDVDVVDEILGQVVEQMSEISST

SEQ ID NO: 902007 - protein, 378 aa, Homo sapiens
GLHSRSATSQSGCGGGRSWLCSSLKMAAQPPRGIRLSALCPKFLHTNSTSHTWPFSAVAELIDNAYDPDVNAKQIWIDKTVINDHICLTFTDNGNGMTSDKLHKMLSFGFSDKVTMNGHVPVGLYGNGFKSGSMRLGKDAIVFTKNGESMSVGLLSQTYLEVIKAEHVVVPIVAFNKHRQMINLAESKASLAAILEHSLFSTEQKLLAELDAIIGKKGTRIIIWNLRSYKNATEFDFEKDKYDIRIPEDLDEITGKKGYKKQERMDQIAPESDYSLRAYCSILYLKPRMQIILRGQKVKTQLVSKSLAYIERDVYRPKFLTDDYLAESKASLAAILEHSLFSTEQKLLAELDAIIGKKGTRIIIWNLRSYKNATEFDF

SEQ ID NO: 902008 - protein, 612 aa, Homo sapiens
MIYFLRLTITALGEKLNDYWNEMKVKKNTEYPLNLPVEDIQKRPDQTWVQCDACLKWRKLPDGMDQLPEKWYCSNNPDPQFRYHRVVVPFLERRKVLFTVYEKALVTCYSYVIFLNRNCEVPEEPEDEDLVHPTYEKTYKKTNKEKFRIRQPEMIPRINAELLFRPTALSTPSFSSPKESVPRRHLSEGTNSYATRLLNNHQVPPQSEPESNSLKRRLSTRSSILNAKNRRLSSQFENSVYKGDDDDEDVIILEENSTPKPAVDHDIDMKSEQSHVEQGGVQVEFVGDSEPCGQTGSTSTSSSRCDQGNTAATQTEVPSLVVKKEETVEDEIDVRNDAVILPSCVEAEAKIHETQETTDKSADDAGCQLQELRNQLLLVTEEKENYKRQCHMFTDQIKVLQQRILEMNDKYVKKETCHQSTETDAVFLLESINGKSESPDHMVSQYQQALEEIERLKKQCSALQHVKAECSQCSNNESKSEMDEMAVQLDDVFRQLDKCSIERDQYKSEVELLEMEKSQIRSQCEELKTEVEQLKSTNQQTATDVSTSSNIEESVNHMDGESLKLRSLRVNVGQLLAMIVPDLDLQQVNYDVDVVDEILGQVVEQMSEISST

SEQ ID NO: 902009 - protein, 488 aa, Homo sapiens
GLHSRSATSQSGCGGGRSWLCSSLKMAAQPPRGIRLSALCPKFLHTNSTSHTWPFSAVAELIDNAYDPDVNAKQIWIDKTVINDHICLTFTDNGNGMTSDKLHKMLSFGFSDKVTMNGHVPVGLYGNGFKSGSMRLGKDAIVFTKNGESMSVGLLSQTYLEVIKAEHVVVPIVAFNKHRQMINLAESKASLAAILEHSLFSTEQKLLAELDAIIGKKGTRIIIWNLRSYKNATEFDFEKDKYDIRIPEDLDEITGKKGYKKQERMDQIAPESDYSLRAYCSILYLKPRMQIILRGQKVKTQLVSKSLAYIERDVYRPKFLSKTVRITFGFNCRNKDHYGIMMYHRNRLIKAYEKVGCQLRANNMGVGVVGIIECNFLKPTHNKQDFDYTNEYRLTITALGEKLNDYWNEMKVKKNTEYPLNLPVEDIQKRPDQTWVQCDACLKWRKLPDGMDQLPEKWYCSNNPDPQFRYHRVGSTLFGKTESTVHSV

SEQ ID NO: 902010 - protein, 228 aa, Homo sapiens
GLHSRSATSQSGCGGGRSWLCSSLKMAAQPPRGIRLSALCPKFLHTNSTSHTWPFSAVAELIDNAYDPDVNAKQIWIDKTVINDHICLTFTDNGNGMTSDKLHKMLSFGFSDKVTMNGHVPVGLYGNGFKSGSMRLGKDAIVFTKNGESMSVGLLSQTYLEVIKAEHVVVPIVAFNKHRQMINLAESKASLAAILEHSLFSTEQKLLAELDAIIGKKGTRIIIWNLRR

SEQ ID NO: 902011 - protein, 135 aa, Homo sapiens
MVTPHKKSMLGNGNYDVNVIMAALQTKGYEAVWWDKRRDVGVIALTNVMGFIMNLPSSLCWGPLKLPLKRQHWICVREVGGAYYNLDSKLKMPEWIGGESELRKFLKHHLRGKNCELLLVVPEEVEAHQSWRTDV

SEQ ID NO: 902012 - protein, 177 aa, Homo sapiens
MSCVPWKGDKAKSESLELPQAAPPQIYHEKQRRELCALHALNNVFQDSNAFTRDTLQEIFQRLSPNTMVTPHKKSMLGNGNYDVNVIMAALQTKGYEAVWWDKRRDVGVIALTNVMGFIMNLPSSLCWGPLKLPLKRQHWICVREVGGAYYNLDSKLKMPEWIGGESELSRAQGFSL

SEQ ID NO: 902013 - protein, 202 aa, Homo sapiens
MSCVPWKGDKAKSESLELPQAAPPQIYHEKQRRELCALHALNNVFQDSNAFTRDTLQEIFQRLSPNTMVTPHKKSMLGNGNYDVNVIMAALQTKGYEAVWWDKRRDVGVIALTNVMGFIMNLPSSLCWGPLKLPLKRQHWICVREVGGAYYNLDSKLKMPEWIGGESELRKFLKHHLRGKNCELLLVVPEEVEAHQSWRTDV

SEQ ID NO: 902014 - protein, 202 aa, Homo sapiens; identical to SEQ ID NO: 902013

SEQ ID NO: 902015 - protein, 202 aa, Homo sapiens; identical to SEQ ID NO: 902013

SEQ ID NO: 902016 - protein, 202 aa, Homo sapiens; identical to SEQ ID NO: 902013

SEQ ID NO: 902017 - protein, 202 aa, Homo sapiens; identical to SEQ ID NO: 902013

SEQ ID NO: 902018 - protein, 202 aa, Homo sapiens; identical to SEQ ID NO: 902013

SEQ ID NO: 902019 - protein, 182 aa, Homo sapiens
MSCVPWKGDKAKSESLELPQAAPPQIYHEKQRRELCALHALNNVFQDSNAFTRDTLQEIFQRLSPNTMVTPHKKSMLGNGNYDVNVIMAALQTKGYEAVWWDKRSLCWGPLKLPLKRQHWICVREVGGAYYNLDSKLKMPEWIGGESELRKFLKHHLRGKNCELLLVVPEEVEAHQSWRTDV

SEQ ID NO: 902020 - protein, 202 aa, Homo sapiens; identical to SEQ ID NO: 902013

SEQ ID NO: 902021 - protein, 202 aa, Homo sapiens; identical to SEQ ID NO: 902013

SEQ ID NO: 902022 - protein, 202 aa, Homo sapiens; identical to SEQ ID NO: 902013

SEQ ID NO: 902023 - protein, 202 aa, Homo sapiens; identical to SEQ ID NO: 902013

SEQ ID NO: 902024 - protein, 443 aa, Homo sapiens
HGVSARDVLESRTRKQHSEATNSSNRVFVYCAFLDFSSGEGVWSNHGCALTRGNLTYSVCRCTHLTNFAILMQVVPLEVNIGILIAVTRVISQISADNYKIHGDPSAFKLTAKAVAVLLPILGTSWVFGVLAVNGCAVVFQYMFATLNSLQGLFIFLFHCLLNSEVRAAFKHKTKVWSLTSSSARTSNAKPFHSDLMNGTRPGMASTKLSPLGQEQPLCPPRRPVSRVSREAANQARLRSEHTPPNRMKCPTFAHGPSPCCCLDMGVVARDSCLPCDSGCRSTLLSPAADAQASVGPPALHPTRGLSDFLGGFPGHSGLTVMVPLSLPSSLSIRPSEARTLGAGPAAPGGDVQPLCLGGAWGLRAKEVVQVPTHPQSGAGSWGCVGKSMRSPQCLNPLSGEFPTAGASRGVCLCRWCRRGPTCAVSSVGGPCPSRARAVGGSR

SEQ ID NO: 902025 - protein, 92 aa, Homo sapiens
IKVFGTADSKHRYYYGMGWGFPLLICIISLSFAMDSYGTSNNCWLSLASGAIWAFVAPALFVIVVNIGILIAVTRVISQISADPKHSAVPKH

SEQ ID NO: 902026 - protein, 380 aa, Homo sapiens
GFLCAVSTGGHQELLVNIGILIAVTRVISQISADNYKIHGDPSAFKLTAKAVAVLLPILGTSWVFGVLAVNGCAVVFQYMFATLNSLQGLFIFLFHCLLNSEVRAAFKHKTKVWSLTSSSARTSNAKPFHSDLMNGTRPGMASTKLSPLGQEQPLCPPRRPVSRVSREAANQARLRSEHTPPNRMKCPTFAHGPSPCCCLDMGVVARDSCLPCDSGCRSTLLSPAADAQASVGPPALHPTRGLSDFLGGFPGHSGLTVMVPLSLPSSLSIRPSEARTLGAGPAAPGGDVQPLCLGGAWGLRAKEVVQVPTHPQSGAGSWGCVGKSMRSPQCLNPLSGEFPTAGASRGVCLCRWCRRGPTCAVSSVGGPCPSRARAVGGSR

SEQ ID NO: 902027 - protein, 243 aa, Homo sapiens
SCCVAQFLTGHELVLIVPQSWGPLVLTVSCTGEDGINWSISDKDIEAQIANNRTPGRWTQRYYSANKNIICRNCDKRGHLSKNCPLPRKVRRCFLCSRRGHLLYSCPAPLCEYCPVPKMLDHSCLFRHSWDKQCDRCHMLGHYTDACTEIWRQYHLTTKPGPPKKPKTPSRPSALAYCYHCAQKGHYGHECPEREVYDPSPVSPFICYYDDKYEIQEREKRLKQKIKVKVSRKWGFQSIQVLL

SEQ ID NO: 902028 - protein, 252 aa, Homo sapiens
VKYLVSCSQLINIFIFQACTEIWRQYHLTTKPGPPKKPKTPSRPSALAYCYHCAQKGHYGHECPEREVYDPSPVSPFICYYDDKYEIQEREKRLKQKIKAFTSYSKKTWGLFPKKPIPRLPFIIKKGRQIEKSPNIDYQERAPLPSMLKKPTRVAPPTNTLQESTIKEHLHETTKLENLGKNATRDRAGQDHSVNVGLNDFLPKGAPRRPNSFFLGKFFTKPKKGLLKAPFHPVSITYNPTRSNDERQRSSQ

SEQ ID NO: 902029 - protein, 543 aa, Homo sapiens
MMFGGYETIEAYEDDLYRDESSSELSVDSEVEFQLYSQIHYAQDLDDVIREEEHEEKNSGNSESSSSKPNQKKLIVLSDSEVIQLSDGSEVITLSDEDSIYRCKGKNVRVQAQENAHGLSSSLQSNELVDKKCKSDIEKPKSEERSGVIREVMIIEVSSSEEEESTISEGDNVESWMLLGCEVDDKDDDILLNLVGCENSVTEGEDGINWSISDKDIEAQIANNRTPGRWTQRYYSANKNIICRNCDKRGHLSKNCPLPRKVRRCFLCSRRGHLLYSCPAPLCEYCPVPKMLDHSCLFRHSWDKQCDRCHMLGHYTDACTEIWRQYHLTTKPGPPKKPKTPSRPSALAYCYHCAQKGHYGHECPEREVYDPSPVSPFICYYDDKYEIQEREKRLKQKIKVLKKNGVIPEPSKLPYIKAANENPHHDIRKGRASWKSNRWPQENKETQKEMKNKNRNWEKHRKADRHREVDEDFPRGPKTYSSPGSFKTQKPSKPFHRSSHYHTSREDKSPKEGKRGKQKKKERCWEDDDNDNLFLIKQRKKKS

SEQ ID NO: 902030 - protein, 543 aa, Homo sapiens; identical to SEQ ID NO: 902029

SEQ ID NO: 902031 - protein, 543 aa, Homo sapiens; identical to SEQ ID NO: 902029

SEQ ID NO: 902032 - protein, 418 aa, Homo sapiens
MMFGGYETIEAYEDDLYRDESSSELSVDSEVEFQLYSQIHYAQDLDDVIREEEHEEKNSGNSESSSSKPNQKKLIVLSDSEVIQLSDGSEVITLSDEDSIYRCKGKNVRVQAQENAHGLSSSLQSNELVDKKCKSDIEKPKSEERSGVIREVMIIEVSSSEEEESTISEGDNVESWMLLGCEVDDKDDDILLNLVGCENSVTEGEDGINWSISDKDIEAQIANNRTPGRWTQRYYSANKNIICRNCDKRGHLSKNCPLPRKVRRCFLCSRRGHLLYSCPAPLCEYCPVPKMLDHSCLFRHSWDKQCDRCHMLGHYTDACTEIWRQYHLTTKPGPPKKPKTPSRPSALAYCYHCAQKGHYGHECPEREVYDPSPVSPFICYYDDKYEIQEREKRLKQKIKVPHGKATGGLKKIKKHKKK

SEQ ID NO: 902033 - protein, 563 aa, Homo sapiens
MMFGGYETIEAYEDDLYRDESSSELSVDSEVEFQLYSQIHYAQDLDDVIREEEHEEKNSGNSESSSSKPNQKKLIVLSDSEVIQLSDGSEVITLSDEDSIYRCKGKNVRVQAQENAHGLSSSLQSNELVDKKCKSDIEKPKSEERSGVIREVMIIEVSSSEEEESTISEGDNVESWMLLGPSVTNLKDKQIDEMIPSYEPYVGDELKPLLVNLLCGGLCLPLGALNEIARHLPKTDINLPNLRQLEHKKAARRYYSANKNIICRNCDKRGHLSKNCPLPRKVRRCFLCSRRGHLLYSCPAPLCEYCPVPKMLDHSCLFRHSWDKQCDRCHMLGHYTDACTEIWRQYHLTTKPGPPKKPKTPSRPSALAYCYHCAQKGHYGHECPEREVYDPSPVSPFICYYDDKYEIQEREKRLKQKIKVLKKNGVIPEPSKLPYIKAANENPHHDIRKGRASWKSNRWPQENKETQKEMKNKNRNWEKHRKADRHREVDEDFPRGPKTYSSPGSFKTQKPSKPFHRSSHYHTSREDKSPKEGKRGKQKKKERCWEDDDNDNLFLIKQRKKKS

SEQ ID NO: 902034 - protein, 253 aa, Homo sapiens
MLDHSCLFRHSWDKQCDRCHMLGHYTDACTEIWRQYHLTTKPGPPKKPKTPSRPSALAYCYHCAQKGHYGHECPEREVYDPSPVSPFICYYDDKYEIQEREKRLKQKIKVLKKNGVIPEPSKLPYIKAANENPHHDIRKGRASWKSNRWPQENKETQKEMKNKNRNWEKHRKADRHREVDEDFPRGPKTYSSPGSFKTQKPSKPFHRSSHYHTSREDKSPKEGKRGKQKKKERCWEDDDNDNLFLIKQRKKKS

SEQ ID NO: 902035 - protein, 385 aa, Homo sapiens
SCVVPGSAFPPGSARTRPPYLICPRPSPSLYAFGSRLVLPVRSCGREDGINWSISDKDIEAQIANNRTPGRWTQRYYSANKNIICRNCDKRGHLSKNCPLPRKVRRCFLCSRRGHLLYSCPAPLCEYCPVPKMLDHSCLFRHSWDKQCDRCHMLGHYTDACTEIWRQYHLTTKPGPPKKPKTPSRPSALAYCYHCAQKGHYGHECPEREVYDPSPVSPFICYYDDKYEIQEREKRLKQKIKVLKKNGVIPEPSKLPYIKAANENPHHDIRKGRASWKSNRWPQENKETQKEMKNKNRNWEKHRKADRHREVDEDFPRGPKTYSSPGSFKTQKPSKPFHRSSHYHTSREDKSPKEGKRGKQKKKERCWEDDDNDNLFLIKQRKKKS

SEQ ID NO: 902036 - protein, 253 aa, Homo sapiens; identical to SEQ ID NO: 902034

SEQ ID NO: 902037 - protein, 243 aa, Homo sapiens
VKYLVSCSQLINIFIFQACTEIWRQYHLTTKPGPPKKPKTPSRPSALAYCYHCAQKGHYGHECPEREVYDPSPVSPFICYYDDKYEIQEREKRLKQKIKVLKKNGVIPEPSKLPYIKAANENPHHDIRKGRASWKSNRWPQENKETQKEMKNKNRNWEKHRKADRHREVDEDFPRGPKTYSSPGSFKTQKPSKPFHRSSHYHTSREDKSPKEGKRGKQKKKERCWEDDDNDNLFLIKQRKKKS

SEQ ID NO: 902038 - protein, 217 aa, Homo sapiens [sequence omitted]

SEQ ID NO: 902039 - protein, 226 aa, Homo sapiens
FYIFASLSPYSGTKPGPPKKPKTPSRPSALAYCYHCAQKGHYGHECPEREVYDPSPVSPFICYYDDKYEIQEREKRLKQKIKVLKKNGVIPEPSKLPYIKAANENPHHDIRKGRASWKSNRWPQENKETQKEMKNKNRNWEKHRKADRHREVDEDFPRGPKTYSSPGSFKTQKPSKPFHRSSHYHTSREDKSPKEGKRGKQKKKERCWEDDDNDNLFLIKQRKKKS

SEQ ID NO: 902040 - protein, 211 aa, Homo sapiens
VKYLVSCSQLINIFIFQACTEIWRQYHLTECPEREVYDPSPVSPFICYYDDKYEIQEREKRLKQKIKVLKKNGVIPEPSKLPYIKAANENPHHDIRKGRASWKSNRWPQENKETQKEMKNKNRNWEKHRKADRHREVDEDFPRGPKTYSSPGSFKTQKPSKPFHRSSHYHTSREDKSPKEGKRGKQKKKERCWEDDDNDNLFLIKQRKKKS

SEQ ID NO: 902041 - protein, 363 aa, Homo sapiens
MMFGGYETIEAYEDDLYRDESSSELSVDSEVEFQLYSQIHYAQDLDDVIREEEHEEKNSGNSESSSSKPNQKKLIVLSDSEVIQLSDGSEVITLSDEDSIYRCKGKNVRVQAQENAHGLSSSLQSNELVDKKCKSDIEKPKSEERSGVIREVMIIEVSSSEEEESTISEGDNVESWMLLGCEVDDKDDDILLNLVGCENSVTEGEDGINWSISDKDIEAQIANNRTPGRWTQRYYSANKNIICRNCDKRGHLSKNCPLPRKVRRCFLCSRRGHLLYSCPAPLCEYCPVPKMLDHSCLFRHSWDKQCDRCHMLGHYTDACTEIWRQYHLTTKPGPPKKPKTPSRPSALAYCYHCAQKGHYGHPV

SEQ ID NO: 902042 - protein, 232 aa, Homo sapiens
MMFGGYETIEAYEDDLYRDESSSELSVDSEVEFQLYSQIHYAQDLDDVIREEEHEEKNSGNSESSSSKPNQKKLIVLSDSEVIQLSDGSEVITLSDEDSIYRCKGKNVRVQAQENAHGLSSSLQSNELVDKKCKSDIEKPKSEERSGVIREVMIIEVSSSEEEESTISEGDNVESWMLLGCEVDDKDDDILLNLVGCENSVTEESSSLLPVLQERTSPVFLSSPPLRILSCA

SEQ ID NO: 902043 - protein, 237 aa, Homo sapiens
MMFGGYETIEAYEDDLYRDESSSELSVDSEVEFQLYSQIHYAQDLDDVIREEEHEEKNSGNSESSSSKPNQKKLIVLSDSEVIQLSDGSEVITLSDEDSIYRCKGKNVRVQAQENAHGLSSSLQSNELVDKKCKSDIEKPKSEERSGVIREVMIIEVSSSEEEESTISEGDNVESWMLLGCEVDDKDDDILLNLVGCENSVTEGCQTPYLKDPVGTCGNNTYKNVAAKLVRVQWCYN

SEQ ID NO: 902044 - protein, 101 aa, Homo sapiens
RAVLSPEVPSLPGLRGRGLLTSFVLAPPRPSTRLVPGWCFLFAAAAVSMCVTDPRRPRLGTPAYPPSCPPGCGTSACPLAGLDVSRPPLTRGRAQLLEKMV

SEQ ID NO: 902045 - protein, 543 aa, Homo sapiens; identical to SEQ ID NO: 902029

SEQ ID NO: 902046 - protein, 503 aa, Homo sapiens
MMFGGYETIEAYEDDLYRDESSSELSVDSEVEFQLYSQIHYAQDLDDVIREEEHEEKNSGNSESSSSKPNQKKLIVLSDSEVIQLSDGSEVITLSDEDSIYRCKGKNVRVQAQENAHGLSSSLQSNELVDKKCKSDIEKPKSEERSGVIREVMIIEVSSSEEEESTISEGDNVESWMLLGCEVDDKDDDILLNLVGCENSVTEGEDGINWSISDKDIEAQIANNRTPGRWTQRYYSANKNIICRNCDKRGHLSKNCPLPRKVRRCFLCSRRGHLLYSCPAPLCEYCPVPKMLDHSCLFRHSWDKQCDRCHMLGHYTDACTEIWRQYHLTTKPGPPKKPKTPSRPSALAYCYHCAQKGHYGHECPEREVYDPSPVSPFICYYDDKYEIQEREKRLKQKIKVLKKNGVIPEPSKLPYIKAANENPHHDIRKGRASWKSNRWPQENKETQKEMKNKNRNWEKHRKADRHREVDEDFPRGPKTYSSPGSFKTQKPSKPFHRSSRATQ

SEQ ID NO: 902047 - protein, 517 aa, Homo sapiens
MMFGGYETIEAYEDDLYRDESSSELSVDSEVEFQLYSQIHYAQDLDDVIREEEHEEKNSGNSESSSSKPNQKKLIVLSDSEVIQLSDGSEVITLSDEDSIYRCKGKNVRVQAQENAHGLSSSLQSNELVDKKCKSDIEKPKSEERSGVIREVMIIEVSSSEEEESTISEGDNVESWMLLGCEVDDKDDDILLNLVGCENSVTEGEDGINWSISDKDIEAQIANNRTPGRWTQRYYSANKNIICRNCDKRGHLSKNCPLPRKVRRCFLCSRRGHLLYSCPAPLCEYCPVPKMLDHSCLFRHSWDKQCDRCHMLGHYTDACTEIWRQYHLTTKPGPPKKPKTPSRPSALAYCYHCAQKGHYGHECPEREVYDPSPVSPFICYYDDKYEIQEREKRLKQKIKVLKKNGVIPEPSKLPYIKAANENPHHDIRKGRASWKSNRWPQENKETQKEMKNKNRNWEKHRKADRHREVDEDFPRGPKTYSSPGSFKTQKPSKPFHRSSLVVHQYLTGGDPSRKSTC

SEQ ID NO: 902048 - protein, 232 aa, Homo sapiens; identical to SEQ ID NO: 902042

SEQ ID NO: 902049 - protein, 253 aa, Homo sapiens; identical to SEQ ID NO: 902034

SEQ ID NO: 902050 - protein, 394 aa, Homo sapiens
MWPKEQLFSKRPGEHYQGLPLLPRLECGGAILAQRNLLDSSNPPTSAPRVAGTTREDGINWSISDKDIEAQIANNRTPGRWTQRYYSANKNIICRNCDKRGHLSKNCPLPRKVRRCFLCSRRGHLLYSCPAPLCEYCPVPKMLDHSCLFRHSWDKQCDRCHMLGHYTDACTEIWRQYHLTTKPGPPKKPKTPSRPSALAYCYHCAQKGHYGHECPEREVYDPSPVSPFICYYDDKYEIQEREKRLKQKIKVLKKNGVIPEPSKLPYIKAANENPHHDIRKGRASWKSNRWPQENKETQKEMKNKNRNWEKHRKADRHREVDEDFPRGPKTYSSPGSFKTQKPSKPFHRSSHYHTSREDKSPKEGKRGKQKKKERCWEDDDNDNLFLIKQRKKKS

SEQ ID NO: 902051 - protein, 343 aa, Homo sapiens
MLKREDGINWSISDKDIEAQIANNRTPGRWTQRYYSANKNIICRNCDKRGHLSKNCPLPRKVRRCFLCSRRGHLLYSCPAPLCEYCPVPKMLDHSCLFRHSWDKQCDRCHMLGHYTDACTEIWRQYHLTTKPGPPKKPKTPSRPSALAYCYHCAQKGHYGHECPEREVYDPSPVSPFICYYDDKYEIQEREKRLKQKIKVLKKNGVIPEPSKLPYIKAANENPHHDIRKGRASWKSNRWPQENKETQKEMKNKNRNWEKHRKADRHREVDEDFPRGPKTYSSPGSFKTQKPSKPFHRSSHYHTSREDKSPKEGKRGKQKKKERCWEDDDNDNLFLIKQRKKKS

SEQ ID NO: 902052 - protein, 253 aa, Homo sapiens; identical to SEQ ID NO: 902034

SEQ ID NO: 902053 - protein, 398 aa, Homo sapiens
MMFGGYETIEAYEDDLYRDESSSELSVDSEVEFQLYSQIHYAQDLDDVIREEEHEEKNSGNSESSSSKPNQKKLIVLSDSEVIQLSDGSEVITLSDEDSIYRCKGKNVRVQAQENAHGLSSSLQSNELVDKKCKSDIEKPKSEERSGVIREVMIIEVSSSEEEESTISEGDNVESWMLLGCEVDDKDDDILLNLVGCENSVTEGEDGINWSISDKDIEAQIANNRTPGRWTQRYYSANKNIICRNCDKRGHLSKNCPLPRKVRRCFLCSRRGHLLYSCPAPLCEYCPVPKMLDHSCLFRHSWDKQCDRCHMLGHYTDADRHREVDEDFPRGPKTYSSPGSFKTQKPSKPFHRSSHYHTSREDKSPKEGKRGKQKKKERCWEDDDNDNLFLIKQRKKKS

SEQ ID NO: 902054 - protein, 230 aa, Homo sapiens
MVPAPLGSTYRLSWYRIAPRRRCERRRGTLQTIALAIAIMRAKGLYGHECPEREVYDPSPVSPFICYYDDKYEIQEREKRLKQKIKVLKKNGVIPEPSKLPYIKAANENPHHDIRKGRASWKSNRWPQENKETQKEMKNKNRNWEKHRKADRHREVDEDFPRGPKTYSSPGSFKTQKPSKPFHRSSHYHTSREDKSPKEGKRGKQKKKERCWEDDDNDNLFLIKQRKKKS

SEQ ID NO: 902055 - protein, 108 aa, Homo sapiens
MLDHSCLFRHSWDKQCDRCHMLGHYTDADRHREVDEDFPRGPKTYSSPGSFKTQKPSKPFHRSSHYHTSREDKSPKEGKRGKQKKKERCWEDDDNDNLFLIKQRKKKS

SEQ ID NO: 902056 - protein, 206 aa, Homo sapiens
MMFGGYETIEAYEDDLYRDESSSELSVDSEVEFQLYSQIHYAQDLDDVIREEEHEEKNSGNSESSSSKPNQKKLIVLSDSEVIQLSDGSEVITLSDEDSIYRCKGKNVRVQAQENAHGLSSSLQSNELVDKKCKSDIEKPKSEERSGVIREVMIIEVSSSEEEESTISEGDNVESWMLLGCEVDDKDDDILLNLVGCENSVTEGNT

SEQ ID NO: 902057 - protein, 539 aa, Homo sapiens
MANCQAVILSVEDDTGHRIIIEYLLEATRSPEVGMRQAAAIILNIYCSRSKADYTSHLRSLVSGLIRLFNDSSPVVLEESWDALNAITKKLDAGNQLALIEELHKEIRLIGNESKGEHVPGFCLPKKGVTSILPVLREGVLTGSPEQKEEAAKALGLVIRLTSADALRPSVVSITGPLIRILGDRFSWNVKAALLETLSLLLAKVGIALKPFLPQLQTTFTKALQDSNRGVRLKAADALGKLISIHIKVDPLFTELLNGIRAMEDPGVRDTMLQALRFVIQGAGAKVDAVIRKNIVSLLLSMLGHDEDNTRISSAGCLGELCAFLTEEELSAVLQQCLLADVSGIDWMVRHGRSLALSVAVNVAPGRLCAGRYSSDVQEMILSSATADRIPIAVSGVRGMGFLMRHHIETGGGQLPAKLSSLFVKCLQNPSSDIRLVAEKMIWWANKDPLPPLDPQAIKPILKALLDNTKDKNTVVRAYSDQAIVNLLKMRQGEEVFQSLSKILDVASLEVLNEVNRRSLKKLASQADSTEQVDDTILT

SEQ ID NO: 902058 - protein, 539 aa, Homo sapiens; identical to SEQ ID NO: 902057

SEQ ID NO: 902059 - protein, 192 aa, Homo sapiens
MVRHGRSLALSVAVNVAPGRLCAGRYSSDVQEMILSSATADRIPIAVSGVRGMGFLMRHHIETGGGQLPAKLSSLFVKCLQNPSSDIRLVAEKMIWWANKDPLPPLDPQAIKPILKALLDNTKDKNTVVRAYSDQAIVNLLKMRQGEEVFQSLSKILDVASLEVLNEVNRRSLKKLASQADSTEQVDDTILT

SEQ ID NO: 902060 - protein, 539 aa, Homo sapiens; identical to SEQ ID NO: 902057

SEQ ID NO: 902061 - protein, 493 aa, Homo sapiens
AAQIIGNMYSLTDQKDLAPYLPSVTPGLKASLLDPVPEVRTVSAKALGAMVKGMGESCFEDLLPWLMETLTYEQSSVDRSGAAQGLAEVMAGLGVEKLEKLMPEIVATASKVDIAPHVRDGYIMMFNYLPITFGDKFTPYVGPIIPCILKALADENEFVRDTALRAGQRVISMYAETAIALLLPQLEQGLFDDLWRIRFSSVQLLGDLLFHISGVTGKMTTETASEDDNFGTAQSNKAIITALGVERRNRVLAGLYMGRSDTQLVVRQASLHVWKIVVSNTPRTLREILPTLFGLLLGFLASTCADKRTIAARTLGDLVRKLGEKILPEIIPILEEGLRSQKSDERQGVCIGLSEIMKSTSRDAVLYFSESLVPTARKALCDPLEEVREAAAKTFEQLHSTIGHQALEDILPFLLKQLDDEEVSEFALDGLKQVMAIKSRVVLPYLVPKLTTPPVNTRVLAFLSSVAGDALTRHLGVILPAVMLALKEKLGTP

SEQ ID NO: 902062 - protein, 503 aa, Homo sapiens
SLRSWMLAFRASQALLQNHRAGVIEEADQARDQAPQVAGVSAFERDALNAITKKLDAGNQLALIEELHKEIRLIGNESKGEHVPGFCLPKKGVTSILPVLREGVLTGSPEQKEEAAKALGLVIRLTSADALRPSVVSITGPLIRILGDRFSWNVKAALLETLSLLLAKVGIALKPFLPQLQTTFTKALQDSNRGVRLKAADALGKLISIHIKVDPLFTELLNGIRAMEDPGVRDTMLQALRFVIQGAGAKVDAVIRKNIVSLLLSMLGHDEDNTRISSAGCLGELCAFLTEEELSAVLQQCLLADVSGIDWMVRHGRSLALSVAVNVAPGRLCAGRYSSDVQEMILSSATADRIPIAVSGVRGMGFLMRHHIETGGGQLPAKLSSLFVKCLQNPSSDIRLVAEKMIWWANKDPLPPLDPQAIKPILKALLDNTKDKNTVVRAYSDQAIVNLLKMRQGEEVFQSLSKILDVASLEVLNEVNRRSLKKLASQADSTEQVDDTILT

SEQ ID NO: 902063 - protein, 539 aa, Homo sapiens; identical to SEQ ID NO: 902057

SEQ ID NO: 902064 - protein, 380 aa, Homo sapiens
MANCQAVILSVEDDTGHRIIIEYLLEATRSPEVGMRQAAAIILNIYCSRSKADYTSHLRSLVSGLIRLFNDSSPVVLEESWDALNAITKKLDAGNQLALIEELHKEIRLIGNESKGEHVPGFCLPKKGVTSILPVLREGVLTGSPEQKEEAAKALGLVIRLTSADALRPSVVSITGPLIRILGDRFSWNVKAALLETLSLLLAKVGIALKPFLPQLQTTFTKALQDSNRGVRLKAADALGKLISIHIKVDPLFTELLNGIRAMEDPGVRDTMLQALRFVIQGAGAKVDAVIRKNIVSLLLSMLGHDEDNTRISSAGCLGELCAFLTEEELSAVLQQCLLADVSRLDWLFGPGGPGPPGPGFGPGRLGPGIIRGPRIPPAR

SEQ ID NO: 902065 - protein, 916 aa, Homo sapiens [sequence omitted]

SEQ ID NO: 902066 - protein, 834 aa, Homo sapiens
MSYTLDSLGNPSAYRRVTETRSSFSRVSGSPSSGFRSQSWSRGSPSTVSSSYKRSMLAPRLAYSSAMLSSAESSLDFSQSSSLLNGGSGPGGDYKLSRSNEKEQLQGLNDRFAGYIEKVHYLEQQNKEIEAEIQALRQKQASHAQLGDAYDQEIRELRATLEMVNHEKAQVQLDSDHLEEDIHRLKERFEEEARLRDDTEAAIRALRKDIEEASLVKVELDKKVQSLQDEVAFLRSNHEEEVADLLAQIQASHITVERKDYLKTDISTALKEIRSQLESHSDQNMHQAEEWFKCRYAKLTEAAEQNKEAIRSAKEEIAEYRRQLQSKSIELESVRGTKESLERQLSDIEERHNHDLSSYQDTIQQLENELRGTKWEMARHLREYQDLLNVKMALDIEIAAYRKLLEGEETRFSTFAGSITGPLYTHRPPITISSKIQKTKVEAPKLKVQHKFVEEIIEETKVEDEKSEMEEALTAITEELAVSMKEEKKEAAEEKEEEPEAEEEEVAAKKSPVKATAPEVKEEEGEKEEEEGQEEEEEEDEGAKSDQAEEGGSEKEGSSEKEEGEQEEGETEAEAEGEEAEAKEEKKVEEKSEEVATKEELVADAKVEKPEKAKSPVPKSPVEEKGKSPVPKSPVEEKGKSPVPKSPVEEKGKSPVPKSPVEEKGKSPVSKSPVEEKAKSPVPKSPVEEAKSKAEVGKGEQKEEGSDKGAKGSRKEDIAVNGEVEGKEEVEQETKEKGSGREEEKGVVTNGLDLSPADEKKGGDKSEEKVVVTKTVEKITSEGGDGATKYITKSVTVTQKVEEHEETFEEKLVSTKKVEKVTSHAIVKEVTQSD

SEQ ID NO: 902067 - protein, 722 aa, Homo sapiens
KRPPSLGTQTSPSCHHVKKNVASPSSMIISLGPLQPCRTESVKSLSFINYPVSAVPYNSIENGLIQDYRGKKNYIARAEFGTLESHSDQNMHQAEEWFKCRYAKLTEAAEQNKEAIRSAKEEIAEYRRQLQSKSIELESVRGTKESLERQLSDIEERHNHDLSSYQDTIQQLENELRGTKWEMARHLREYQDLLNVKMALDIEIAAYRKLLEGEETRFSTFAGSITGPLYTHRPPITISSKIQKTKVEAPKLKVQHKFVEEIIEETKVEDEKSEMEEALTAITEELAVSMKEEKKEAAEEKEEEPEAEEEEVAAKKSPVKATAPEVKEEEGEKEEEEGQEEEEEEDEGAKSDQAEEGGSEKEGSSEKEEGEQEEGETEAEAEGEEAEAKEEKKVEEKSEEVATKEELVADAKVEKPEKAKSPVPKSPVEEKGKSPVPKSPVEEKGKSPVPKSPVEEKGKSPVPKSPVEEKGKSPVSKSPVEEKAKSPVPKSPVEEAKSKAEVGKGEQKEEEEKEVKEAPKEEKVEKKEEKPKDVPEKKKAESPVKEEAVAEVVTITKSVKVHLEKETKEEGKPLQQEKEKEKAGGEGGSEEEGSDKGAKGSRKEDIAVNGEVEGKEEVEQETKEKGSGREEEKGVVTNGLDLSPADEKKGGDKSEEKVVVTKTVEKITSEGGDGATKYITKSVTVTQKVEEHEETFEEKLVSTKKVEKVTSHAIVKEVTQSD

SEQ ID NO: 902068 - protein, 632 aa, Homo sapiens
MHQAEEWFKCRYAKLTEAAEQNKEAIRSAKEEIAEYRRQLQSKSIELESVRGTKESLERQLSDIEERHNHDLSSYQDTIQQLENELRGTKWEMARHLREYQDLLNVKMALDIEIAAYRKLLEGEETRFSTFAGSITGPLYTHRPPITISSKIQKTKVEAPKLKVQHKFVEEIIEETKVEDEKSEMEEALTAITEELAVSMKEEKKEAAEEKEEEPEAEEEEVAAKKSPVKATAPEVKEEEGEKEEEEGQEEEEEEDEGAKSDQAEEGGSEKEGSSEKEEGEQEEGETEAEAEGEEAEAKEEKKVEEKSEEVATKEELVADAKVEKPEKAKSPVPKSPVEEKGKSPVPKSPVEEKGKSPVPKSPVEEKGKSPVPKSPVEEKGKSPVSKSPVEEKAKSPVPKSPVEEAKSKAEVGKGEQKEEEEKEVKEAPKEEKVEKKEEKPKDVPEKKKAESPVKEEAVAEVVTITKSVKVHLEKETKEEGKPLQQEKEKEKAGGEGGSEEEGSDKGAKGSRKEDIAVNGEVEGKEEVEQETKEKGSGREEEKGVVTNGLDLSPADEKKGGDKSEEKVVVTKTVEKITSEGGDGATKYITKSVTVTQKVEEHEETFEEKLVSTKKVEKVTSHAIVKEVTQSD

SEQ ID NO: 902069 - protein, 916 aa, Homo sapiens [sequence omitted]

SEQ ID NO: 902070 - protein, 916 aa, Homo sapiens [sequence omitted]

SEQ ID NO: 902071 - protein, 349 aa, Homo sapiens
MAVAVPPGRAAGSGWAWRPVARDALLARAFHSCTELRGRFYLVGGLLAGGAREPSSDTVVFDPARGQAVRLGARGSPPRSHHDAAPVDGRWLCVVGGWDGSRRLATVTALDTERGVWEAWTGTPGDCPPAGLSSHTCTRISDRELQVAGREGGIHTQRRYGSIYTLRLDPSARTYCYKQEGCHTASRSGHCAALLQTPGPHPGHQLLLFGGCNLAEPEVAGHWSHGKIKEEPPVAPHLMEQLARLVSSGQGSQKGPHGLRHHSCSVVGPFAVLFGGETLTRARDTICNDLYIYDTRTSPPLWFHFPCADRGMKRMGHRTCLWNDQLYLVGGFGEDGRTASPQVCILDFI

SEQ ID NO: 902072 - protein, 111 aa, Homo sapiens
MEQLARLVSSGQGSQKGPHGLRHHSCSVVGPFAVLFGGETLTRARDTICNDLYIYDTRTSPPLWFHFPCADRGMKRMGHRTCLWNDQLYLVGGFGEDGRTASPQVCILDFI

SEQ ID NO: 902073 - protein, 111 aa, Homo sapiens; identical to SEQ ID NO: 902072

SEQ ID NO: 902074 - protein, 302 aa, Homo sapiens
MAVAVPPGRAAGSGWAWRPVARDALLARAFHSCTELRGRFYLVGGLLAGGAREPSSDTVVFDPARGQAVRLGARGSPPRSHHDAAPVDGRWLCVVGGWDGSRRLATVTALDTERGVWEAWTGTPGDCPPAGLSSHTCTRISDRELQVAGREGGIHTQRRYGSIYTLRLDPSARTYCYKQEGCHTASRSGHCAALLQTPGPHPGHQLLLFGGCNLAEPEVAGHWSHGKIKEEPPVAPHLMEQLARLVSSGQGSQKGPHGLRHHSCSVVGPFAVLFGGETLTRARDTICNDLYIYDTRESQTNG

SEQ ID NO: 902075 - protein, 111 aa, Homo sapiens; identical to SEQ ID NO: 902072

SEQ ID NO: 902076 - protein, 111 aa, Homo sapiens; identical to SEQ ID NO: 902072

SEQ ID NO: 902077 - protein, 355 aa, Homo sapiens
MAVAVPPGRAAGSGWAWRPVARDALLARAFHSCTELRGRFYLVGGLLAGGAREPSSDTVVFDPARGQAVRLGARGSPPRSHHDAAPVDGRWLCVVGGWDGSRRLATVTALDTERGVWEAWTGTPGDCPPAGLSSHTCTRISDRELQVAGREGGIHTQRRYGSIYTLRLDPSARTYCYKQEGCHTASRSGHCAALLQTPGPHPGHQLLLFGGCNLAEPEVAGHWSHGKIKSFFLPKEEPPVAPHLMEQLARLVSSGQGSQKGPHGLRHHSCSVVGPFAVLFGGETLTRARDTICNDLYIYDTRTSPPLWFHFPCADRGMKRMGHRTCLWNDQLYLVGGFGEDGRTASPQVCILDFI

SEQ ID NO: 902078 - protein, 349 aa, Homo sapiens; identical to SEQ ID NO: 902071

SEQ ID NO: 902079 - protein, 118 aa, Homo sapiens
QEGAEASVRKDCDILDRELGPRGGGATSSPQLPLTHSPPSGPLQVWFKNRRAKCRQQQQSGSGTKSRPAKKKSSPVRESSGSESSGQFTPPAVSSSASSSSSASSSSANPAAAAAAGL

SEQ ID NO: 902080 - protein, 597 aa, Homo sapiens
MSYLKQPPYGMNGLGLAGPAMDLLHPSVGYPATPRKQRRERTTFTRSQLDVLEALFAKTRYPDIFMREEVALKINLPESRVQVWFKNRRAKCRQQQQSGSGTKSRPAKKKSSPVRESSGSESSGQFTPPAVSSSASSSSSASSSSANPAAAAAAGLGGNPVAAASSLSTPAASSIWSPASISPGSAPASVSVPEPLAAPSNTSCMQRSVAAGAATAAASYPMSYGQGGSYGQGYPTPSSSYFGGVDCSSYLAPMHSHHHPHQLSPMAPSSMAGHHHHHPHAHHPLSQSSGHHHHHHHHHHQGYGGSGLAFNSADCLDYKEPGAAAASSAWKLNFNSPDCLDYKDQAIMAVPGLVSPGMKEEKKRNYLRPPWSRSCCCCCTARLCLVFSKTEFSPPKKMSIACTAAPIFVPLAWGDVQTHPAPWMGGRCFGLAYTFYTGEMYYFPPSAPTKLLSLPFQSFWTAIKHLQPSEALRSDPLFEPNTLIYSFWTLESLTGVFLPIGAPAHYSKSKPLRVPPAQTAAPSAALDFAPRLPARASRRFFRPSGVRWGAPGLGPPEERVPSLPRTEPHPAPPCAGLVQASASAGTLYIVRSVPGTT

SEQ ID NO: 902081 - protein, 1483 aa, Homo sapiens
MPSEQKQLFCDEKQTTLKKDYDVKNEIVDRSAPKPKISGSIHYALKNVKIDLPKINIPNEVLLKHEVDKYRKLFQSKQQTARKSISIKTVSCVEECTLLHKSERAEEEGVKMSAKILNFSCLKCRDNTRYSPNDLQKHFQMWHHGELPSYPCEMCNFSANDFQVFKQHRRTHRSTLVKCDICNNESVYTLLNLTKHFTSTHCVNGNFQCEKCKFSTQDVGTFVQHIHRHNEIHYKCGKCHHVCFTKGELQKHLHIHSGTFPFTCQYCSYGATRREHLVRHVITLHKEHLYAKEKLEKDKYEKRMAKTSAGLKLILKRYKIGASRKTFWKRKKINSGSDRSIEKNTQVLKKMNKTQTKSEDQSHVVQEHLSEEKDERLHCENNDKAPESESEKPTPLSTGQGNRAEEGPNASSGFMKTAVLGPTLKNVMMKNNKLAVSPNYNATFMGFKMMDGKQHIVLKLVPIKQNVCSPGSQSGAAKDGTANLQPQTLDTNGFLTGVTTELNDTVYMKAATPFSCSSSILSGKASSEKEMTLISQRNNMLQTMDYEKSVSSLSATSELVTASVNLTTKFETRDNVDFWGNHLTQSHPEVLGTTIKSPDKVNCVAKPNAYNSGDMHNYCINYGNCELPVESSNQGSLPFHNYSKVNNSNKRRRFSGTAVYENPQRESSSSKTVVQQPISESFLSLVRQESSKPDSLLASISLLNDKDGTLKAKSEIEEQYVLEKGQNIDGQNLYSNENQNLECATEKSKWEDFSNVDSPMMPRITSVFSLQSQQASEFLPPEVNQLLQDVLKIKPDVKQDSSNTPNKGLPLHCDQSFQKHEREGKIVESSKDFKVQGIFPVPPGSVGINVPTNDLNLKFGKEKQVSSIPQDVRDSEKMPRISGFGTLLKTQSDAIITQQLVKDKLRATTQNLGSFYMQSPLLNSEQKKTIIVQTSKGFLIPLNITNKPGLPVIPGNALPLVNSQGIPASLFVNKKPGMVLTLNNGKLEGVSAVKTEGAPARGTVTKEPCKTPILKVEPNNNCLTPGLCSSIGSCLSMKSSSENTLPLKGPYILKPTSSVKAVLIPNMLSEQQSTKLNISDSVKQQNEIFPKPPLYTFLPDGKQAVFLKCVMPNKTELLKPKLVQNSTYQNIQPKKPEGTPQRILLKIFNPVLNVTAANNLSVSNSASSLQKDNVPSNQIIGGEQKEPESRDALPFLLDDLMPANEIVITSTATCPESSEEPICVSDCSESRVLRCKTNCRIERNFNRKKTSKKIFSKTKTHGSKDSETAFVSRNRNCKRKCRDSYQEPPRRKATLHRKCKEKAKPEDVRETFGFSRPRLSKDSIRTLRLFPFSSKQLVKCPRRNQPVVVLNHPDADAPEVVSVMKTIAKFNGHVLKVSLSKRTINALLKPVCYNPPKTTYDDFSKRHKTFKPVSSVKERFVLKLTLKKTSKNNYQIVKTTSENILKAKFNCWFCGRVFDNQDTWAGHGQRHLMEATRDWNMLE

SEQ ID NO: 902082 - protein, 1483 aa, Homo sapiens; identical to SEQ ID NO: 902081

SEQ ID NO: 902083 - protein, 1483 aa, Homo sapiens; identical to SEQ ID NO: 902081

SEQ ID NO: 902084 - protein, 1378 aa, Homo sapiens
MPSEQKQLFCDEKQTTLKKDYDVKNEIVDRSAPKPKISGSIHYALKNVKIDLPKINIPNEVLLKHEVDKYRKLFQSKQQTARKSISIKTVSCVEECTLLHKSERAEEEGVKMSAKILNFSCLKCRDNTRYSPNDLQKHFQMWHHGELPSYPCEMCNFSANDFQVFKQHRRTHRSTLVKCDICNNESVYTLLNLTKHFTSTHCVNGNFQCEKCKFSTQDVGTFVQHIHRHNEIHYKCGKCHHVCFTKGELQKHLHIHSGTFPFTCQYCSYGATRREHLVRHVITLHKEHLYAKEKLEKDKYEKRMAKTSAGLKLILKRYKIGASRKTFWKRKKINSGSDRSIEKNTQVLKKMNKTQTKSEDQSHVVQEHLSEEKDERLHCENNDKAPESESEKPTPLSTGQGNRAEEGPNASSGFMKTAVLGPTLKNVMMKNNKLAVSPNYNATFMGFKMMDGKQHIVLKLVPIKQNVCSPGSQSGAAKDGTANLQPQTLDTNGFLTGVTTELNDTVYMKAATPFSCSSSILSGKASSEKEMTLISQRNNMLQTMDYEKSVSSLSATSELVTASVNLTTKFETRDNVDFWGNHLTQSHPEVLGTTIKSPDKVNCVAKPNAYNSGDMHNYCINYGNCELPVESSNQGSLPFHNYSKVNNSNKRRRFSGTAVYENPQRESSSSKTVVQQPISESFLSLVRQESSKPDSLLASISLLNDKDGTLKAKSEIEEQYVLEKGQNIDGQNLYSNENQNLECATEKSKWEDFSNVDSPMMPRITSVFSLQSQQASEFLPPEVNQLLQDVLKIKPDVKQDSSNTPNKGLPLHCDQSFQKHEREGKIVESSKDFKVQGIFPVPPGSVGINVPTNDLNLKFGKEKQVSSIPQDVRDSEKMPRISGFGTLLKTQSDAIITQQLVKDKLRATTQNLGSFYMQSPLLNSEQKKTIIVQTSKGFLIPLNITNKPGLPVIPGNALPLVNSQGIPASLFVNKKPGMVLTLNNGKLEGVSAVKTEGAPARGTVTKEPCKTPILKVEPNNNCLTPGLCSSIGSCLSMKSSSENTLPLKGPYILKPTSSVKAVLIPNMLSEQQSTKLNISDSVKQQNEIFPKPPLYTFLPDGKQAVFLKCVMPNKTELLKPKLVQNSTYQNIQPKKPEGTPQRILLKIFNPVLNVTAANNLSVSNSASSLQKDNVPSNQIIGGEQKEPESRDALPFLLDDLMPANEIVITSTATCPESSEEPICVSDCSESRVLRCKTNCRIERNFNRKKTSKKIFSKTKTHGSKDSETAFVSRNRNCKRKCRDSYQEPPRRKATLHRKCKEKAKPEDVRETFGFSRPRLSKDSIRTLRLFPFSSKQLVKCPRRNQPVVVLNHPVAVCFRGSTLQHECKETREHSVTFT

SEQ ID NO: 902085 - protein, 1483 aa, Homo sapiens; identical to SEQ ID NO: 902081

SEQ ID NO: 902086 - protein, 1483 aa, Homo sapiens; identical to SEQ ID NO: 902081

SEQ ID NO: 902087 - protein, 1483 aa, Homo sapiens; identical to SEQ ID NO: 902081

SEQ ID NO: 902088 - protein, 549 aa, Homo sapiens
MLENYKNLATVGYQLFKPSLISWLEQEESRTVQRGDFQASEWKVQLKTKELALQQDVLGEPTSSGIQMIGSHNGGEVSDVKQCGDVSSEHSCLKTHVRTQNSENTFECYLYGVDFLTLHKKTSTGEQRSVFSQCGKAFSLNPDVVCQRTCTGEKAFDCSDSGKSFINHSHLQGHLRTHNGESLHEWKECGRGFIHSTDLAVRIQTHRSEKPYKCKECGKGFRYSAYLNIHMGTHTGDNPYECKECGKAFTRSCQLTQHRKTHTGEKPYKCKDCGRAFTVSSCLSQHMKIHVGEKPYECKECGIAFTRSSQLTEHLKTHTAKDPFECKICGKSFRNSSCLSDHFRIHTGIKPYKCKDCGKAFTQNSDLTKHARTHSGERPYECKECGKAFARSSRLSEHTRTHTGEKPFECVKCGKAFAISSNLSGHLRIHTGEKPFECLECGKAFTHSSSLNNHMRTHSAKKPFTCMECGKAFKFPTCVNLHMRIHTGEKPYKCKQCGKSFSYSNSFQLHERTHTGEKPYECKECGKAFSSSSSFRNHERRHADERLSA

SEQ ID NO: 902089 - protein, 830 aa, Homo sapiens
GRVFFFLVAFGLNTALARSDDGWEPAVEGVAKVPVCPRPPRGLLRETLPAPLASAGAARVLLAPPGSKSHSSCHCDGPGPGAVSGSVKQRVFVVRIRLTGPSSPQSPVPGESSSSRIPLTLDKENGGYLCPCRFLSCPGVILGVKERCFEAHSAISPVEMAATDLSYGLYRDPVCLQEKTEVERVVADCLTNCYQVCRKYILLQNIILASPGRHISFYTELSSELLKANKASSRTESLVEFPEGVEPVILDSVTFDDLAVDFTPEEWTLLDPTQRNLYRDVMLENYKNLATVGYQLFKPSLISWLEQEESRTVQRGDFQASEWKVQLKTKELALQQDVLGEPTSSGIQMIGSHNGGEVSDVKQCGDVSSEHSCLKTHVRTQNSENTFECYLYGVDFLTLHKKTSTGEQRSVFSQCGKAFSLNPDVVCQRTCTGEKAFDCSDSGKSFINHSHLQGHLRTHNGESLHEWKECGRGFIHSTDLAVRIQTHRSEKPYKCKECGKGFRYSAYLNIHMGTHTGDNPYECKECGKAFTRSCQLTQHRKTHTGEKPYKCKDCGRAFTVSSCLSQHMKIHVGEKPYECKECGIAFTRSSQLTEHLKTHTAKDPFECKICGKSFRNSSCLSDHFRIHTGIKPYKCKDCGKAFTQNSDLTKHARTHSGERPYECKECGKAFARSSRLSEHTRTHTGEKPFECVKCGKAFAISSNLSGHLRIHTGEKPFECLECGKAFTHSSSLNNHMRTHSAKKPFTCMECGKAFKFPTCVNLHMRIHTGEKPYKCKQCGKSFSYSNSFQLHERTHTGEKPYECKECGKAFSSSSSFRNHERRHADERLSA

SEQ ID NO: 902090 - protein, 498 aa, Homo sapiens
VPEHSCPGGATSSGIQMIGSHNGGEVSDVKQCGDVSSEHSCLKTHVRTQNSENTFECYLYGVDFLTLHKKTSTGEQRSVFSQCGKAFSLNPDVVCQRTCTGEKAFDCSDSGKSFINHSHLQGHLRTHNGESLHEWKECGRGFIHSTDLAVRIQTHRSEKPYKCKECGKGFRYSAYLNIHMGTHTGDNPYECKECGKAFTRSCQLTQHRKTHTGEKPYKCKDCGRAFTVSSCLSQHMKIHVGEKPYECKECGIAFTRSSQLTEHLKTHTAKDPFECKICGKSFRNSSCLSDHFRIHTGIKPYKCKDCGKAFTQNSDLTKHARTHSGERPYECKECGKAFARSSRLSEHTRTHTGEKPFECVKCGKAFAISSNLSGHLRIHTGEKPFECLECGKAFTHSSSLNNHMRTHSAKKPFTCMECGKAFKFPTCVNLHMRIHTGEKPYKCKQCGKSFSYSNSFQLHERTHTGEKPYECKECGKAFSSSSSFRNHERRHADERLSA

SEQ ID NO: 902091 - protein, 143 aa, Homo sapiens
ARVFFFLVAFGLNTALARSDDGWEPAVEGVAKVPVCPRPPRGLLRETLPAPLASAGAARVLLAPPGSKSHSSCHCDGPGPGAVSGSVKQRVFVVRIRLTVVLHPPNLPYLASPARRGLYLPTELQNGLLGRRNGGFEAMLRKE

SEQ ID NO: 902092 - protein, 549 aa, Homo sapiens; identical to SEQ ID NO: 902088

SEQ ID NO: 902093 - protein, 549 aa, Homo sapiens; identical to SEQ ID NO: 902088

SEQ ID NO: 902094 - protein, 227 aa, Homo sapiens
VGGASRLLLRISVDLMEAKTLGTVTPRKPVLSVSARKIKDNAADWHNLILKWETLNDAGFTTANNIANLKISLLNKDKIELDSSSPASKENEEKVCLEYNEELEKLCEELQATLDGLTKIQVKMEKLSSTTKGICELENYHYGEESKRPPLFHTWPTTHFYEVSHKLLEMYRKELLLKRTVAKELAHTGDPDLTLSYLSMWLHQPYVESDSRLHLESMLLETGHRAL

SEQ ID NO: 902095 - protein, 225 aa, Homo sapiens
VNRPRLLRISVDLMEAKTLGTVTPRKPVLSVSARKIKDNAADWHNLILKWETLNDAGFTTANNIANLKISLLNKDKIELDSSSPASKENEEKVCLEYNEELEKLCEELQATLDGLTKIQVKMEKLSSTTKGICELENYHYGEESKRPPLFHTWPTTHFYEVSHKLLEMYRKELLLKRTVAKELAHTGDPDLTLSYLSMWLHQPYVESDSRLHLESMLLETGHRAL

SEQ ID NO: 902096 - protein, 225 aa, Homo sapiens; identical to SEQ ID NO: 902095

SEQ ID NO: 902097 - protein, 156 aa, Homo sapiens
VNRPRLLRISVDLMEAKTLGTVTPRKPVLSVSARKIKDNAADWHNLILKWETLNDAGFTTANNIANLKISLLNKDKIELDSSSPASKENEEKVCLEYNEELEKLCEELQATLDGLTKIQVKMEKLSSTTKGICELENYHYMRFRISSWRCTGRSCS

SEQ ID NO: 902098 - protein, 119 aa, Homo sapiens
APARVVNSIGPFFPSVLLLILVFNQELLKCSSSQVDTMFLNHCHEGRFTFLSDEVSHKLLEMYRKELLLKRTVAKELAHTGDPDLTLSYLSMWLHQPYVESDSRLHLESMLLETGHRAL

SEQ ID NO: 902099 - protein, 225 aa, Homo sapiens; identical to SEQ ID NO: 902095

SEQ ID NO: 902100 - protein, 225 aa, Homo sapiens; identical to SEQ ID NO: 902095

SEQ ID NO: 902101 - protein, 225 aa, Homo sapiens; identical to SEQ ID NO: 902095

SEQ ID NO: 902102 - protein, 225 aa, Homo sapiens; identical to SEQ ID NO: 902095

SEQ ID NO: 902103 - protein, 307 aa, Homo sapiens
EAPHQPRFCPPAGHSRKMRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTHLVILGAILLCLGVALTFIFRLRKGRMMDVKKCGIQDTNSKKQSDTHLEET

SEQ ID NO: 902104 - protein, 262 aa, Homo sapiens
EAPHQPRFCPPAGHSRKMRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPGNILNVSIKICLTLSPST

SEQ ID NO: 902105 - protein, 307 aa, Homo sapiens; identical to SEQ ID NO: 902103

SEQ ID NO: 902106 - protein, 2319 aa, Homo sapiens
MLTMSVTLSPLRSQDLDPMATDASPMAINMTPTVEQGEGEEAMKDMDSDQQYEKPPPLHTGADWKIVLHLPEIETWLRMTSERVRDLTYSVQQDSDSKHVDVHLVQLKDICEDISDHVEQIHALLETEFSLKLLSYSVNVIVDIHAVQLLWHQLRVSVLVLRERILQGLQDANGNYTRQTDILQAFSEETKEGRLDSLTEVDDSGQLTIKCSQNYLSLDCGITAFELSDYSPSEDLLSGLGDMTSSQVKTKPFDSWSYSEMEKEFPELIRSVGLLTVAADSISTNGSEAVTEEVSQVSLSVDDKGGCEEDNASAVEEQPGLTLGVSSSSGEALTNAAQPSSETVQQESSSSSHHDAKNQQPVPCENATPKRTIRDCFNYNEDSPTQPTLPKRGLFLKEETFKNDLKGNGGKRQMVDLKPEMSRSTPSLVDPPDRSKLCLVLQSSYPNSPSAASQSYECLHKVGNGNLENTVKFHIKEISSSLGRLNDCYKEKSRLKKPHKTSEEVPPCRTPKRGTGSGKQAKNTKSSAVPNGELSYTSKAIEGPQTNSASTSSLEPCNQRSWNAKLQLQSETSSSPAFTQSSESSVGSDNIMSPVPLLSKHKSKKGQASSPSHVTRNGEVVEAWYGSDEYLALPSHLKQTEVLALKLENLTKLLPQKPRGETIQNIDDWELSEMNSDSEIYPTYHVKKKHTRLGRVSPSSSSDIASSLGESIESGPLSDILSDEESSMPLAGMKKYADEKSERASSSEKNESHSATKSALIQKLMQDIQHQDNYEAIWEKIEGFVNKLDEFIQWLNEAMETTENWTPPKAEMDDLKLYLETHLSFKLNVDSHCALKEAVEEEGHQLLELIASHKAGLKDMLRMIASQWKELQRQIKRQHSWILRALDTIKAEILATDVSVEDEEGTGSPKAEVQLCYLEAQRDAVEQMSLKLYSEQYTSSSKRKEEFADMSKVHSVGSNGLLDFDSEYQELWDWLIDMESLVMDSHDLMMSEEQQQHLYKRYSVEMSIRHLKKTELLSKVEALKKGGVLLPNDLLEKVDSINEKWELLGKTLGEKIQDTMAGHSGSSPRDLLSPESGSLVRQLEVRIKELKGWLRDTELFIFNSCLRQEKEGTMNTEKQLQYFKSLCREIKQRRRGVASILRLCQHLLDDRETCNLNADHQPMQLIIVNLERRWEAIVMQAVQWQTRLQKKMGKESETLNVIDPGLMDLNGMSEDALEWDEMDISNKLISLNEESNDLDQELQPVIPSLKLGETSNEDPGYDEEADNHGGSQYASNITAPSSPHIYQVYSLHNVELYEDNHMPFLKNNPKVTGMTQPNVLTKSLSKDSSFSSTKSLPDLLGGSNLVKPCACHGGDMSQNSGSESGIVSEGDTETTTNSEMCLLNAVDGSPSNLETEHLDPQMGDAVNVLKQKFTDEGESIKLPNSSQSSISPVGCVNGKVGDLNSITKHTPDCLGEELQGKHDVFTFYDYSYLQGSKLKLPMIMKQSQSEKAHVEDPLLRGFYFDKKSCKSKHQTTELQPDVPPHERILASASHEMDRISYKSGNIEKTFTGMQNAKQLSLLSHSSSIESLSPGGDLFGLGIFKNGSDSLQRSTSLESWLTSYKSNEDLFSCHSSGDISVSSGSVGELSKRTLDLLNRLENIQSPSEQKIKRSVSDITLQSSSQKMSFTGQMSLDIASSINEDSAASLTELSSSDELSLCSEDIVLHKNKIPESNASFRKRLTRSVADESDVNVSMIVNVSCTSACTDDEDDSDLLSSSTLTLTEEELCIKDEDDDSSIATDDEIYEDCTLMSGLDYIKNELQTWIRPKLSLTRDKKRCNVSDEMKGSKDISSSEMTNPSDTLNIETLLNGSVKRVSENNGNGKNSSHTHELGTKRENKKTIFKVNKDPYVADMENGNIEGIPERQKGKPNVTSKVSENLGSHGKEISESEHCKCKALMDSLDDSNTAGKEFVSQDVRHLPKKCPNHHHFENQSTASTPTEKSFSELALETRFNNRQDSDALKSSDDAPSMAGKSAGCCLALEQNGTEENASISNISCCNCEPDVFHQKDAEDCSVHNFVKEIIDMASTALKSKSQPENEVAAPTSLTQIKEKVLEHSHRPIQLRKGDFYSYLSLSSHDSDCGEVTNYIEEKSSTPLPLDTTDSGLDDKEDIECFFEACVEGDSDGEEPCFSSAPPNESAVPSEAAMPLQATACSSEFSDSSLSADDADTVALSSPSSQERAEVGKEVNGLPQTSSGCAENLEFTPSKLDSEKESSGKPGESGMPEEHNAASAKSKVQDLSLKANQPTDKAALHPSPKTLTCEENLLNLHEKRHRNMHR

SEQ ID NO: 902107 - protein, 1198 aa, Homo sapiens
MLQSLCREIKQRRRGVASILRLCQHLLDDRETCNLNADHQPMQLIIVNLERRWEAIVMQAVQWQTRLQKKMGKESETLNVIDPGLMDLNGMSEDALEWDEMDISNKLISLNEESNDLDQELQPVIPSLKLGETSNEDPGYDEEADNHGGSQYASNITAPSSPHIYQVYSLHNVELYEDNHMPFLKNNPKVTGMTQPNVLTKSLSKDSSFSSTKSLPDLLGGSNLVKPCACHGGDMSQNSGSESGIVSEGDTETTTNSEMCLLNAVDGSPSNLETEHLDPQMGDAVNVLKQKFTDEGESIKLPNSSQSSISPVGCVNGKVGDLNSITKHTPDCLGEELQGKHDVFTFYDYSYLQGSKLKLPMIMKQSQSEKAHVEDPLLRGFYFDKKSCKSKHQTTELQPDVPPHERILASASHEMDRISYKSGNIEKTFTGMQNAKQLSLLSHSSSIESLSPGGDLFGLGIFKNGSDSLQRSTSLESWLTSYKSNEDLFSCHSSGDISVSSGSVGELSKRTLDLLNRLENIQSPSEQKIKRSVSDITLQSSSQKMSFTGQMSLDIASSINEDSAASLTELSSSDELSLCSEDIVLHKNKIPESNASFRKRLTRSVADESDVNVSMIVNVSCTSACTDDEDDSDLLSSSTLTLTEEELCIKDEDDDSSIATDDEIYEDCTLMSGLDYIKNELQTWIRPKLSLTRDKKRCNVSDEMKGSKDISSSEMTNPSDTLNIETLLNGSVKRVSENNGNGKNSSHTHELGTKRENKKTIFKVNKDPYVADMENGNIEGIPERQKGKPNVTSKVSENLGSHGKEISESEHCKCKALMDSLDDSNTAGKEFVSQDVRHLPKKCPNHHHFENQSTASTPTEKSFSELALETRFNNRQDSDALKSSDDAPSMAGKSAGCCLALEQNGTEENASISNISCCNCEPDVFHQKDAEDCSVHNFVKEIIDMASTALKSKSQPENEVAAPTSLTQIKEKVLEHSHRPIQLRKGDFYSYLSLSSHDSDCGEVTNYIEEKSSTPLPLDTTDSGLDDKEDIECFFEACVEGDSDGEEPCFSSAPPNESAVPSEAAMPLQATACSSEFSDSSLSADDADTVALSSPSSQERAEVGKEVNGLPQTSSGCAENLEFTPSKLDSEKESSGKPGESGMPEEHNAASAKSKVQDLSLKANQPTDKAALHPSPKTLTCEENLLNLHEKRHRNMHR

SEQ ID NO: 902108 - protein, 1222 aa, Homo sapiens
MSVTLSPLRSQDLDPMATDASPMAINMTPTVEQGEGEEAMKDMDSDQQYEKPPPLHTGADWKIVLHLPEIETWLRMTSERVRDLTYSVQQDSDSKHVDVHLVQLKDICEDISDHVEQIHALLETEFSLKLLSYSVNVIVDIHAVQLLWHQLRVSVLVLRERILQGLQDANGNYTRQTDILQAFSEETKEGRLDSLTEVDDSGQLTIKCSQNYLSLDCGITAFELSDYSPSEDLLSGLGDMTSSQVKTKPFDSWSYSEMEKEFPELIRSVGLLTVAADSISTNGSEAVTEEVSQVSLSVDDKGGCEEDNASAVEEQPGLTLGVSSSSGEALTNAAQPSSETVQQESSSSSHHDAKNQQPVPCENATPKRTIRDCFNYNEDSPTQPTLPKRGLFLKEETFKNDLKGNGGKRQMVDLKPEMSRSTPSLVDPPDRSKLCLVLQSSYPNSPSAASQSYECLHKVGNGNLENTVKFHIKEISSSLGRLNDCYKEKSRLKKPHKTSEEVPPCRTPKRGTGSGKQAKNTKSSAVPNGELSYTSKAIEGPQTNSASTSSLEPCNQRSWNAKLQLQSETSSSPAFTQSSESSVGSDNIMSPVPLLSKHKSKKGQASSPSHVTRNGEVVEAWYGSDEYLALPSHLKQTEVLALKLENLTKLLPQKPRGETIQNIDDWELSEMNSDSEIYPTYHVKKKHTRLGRVSPSSSSDIASSLGESIESGPLSDILSDEESSMPLAGMKKYADEKSERASSSEKNESHSATKSALIQKLMQDIQHQDNYEAIWEKIEGFVNKLDEFIQWLNEAMETTENWTPPKAEMDDLKLYLETHLSFKLNVDSHCALKEAVEEEGHQLLELIASHKAGLKDMLRMIASQWKELQRQIKRQHSWILRALDTIKAEILATDVSVEDEEGTGSPKAEVQLCYLEAQRDAVEQMSLKLYSEQYTSSSKRKEEFADMSKVHSVGSNGLLDFDSEYQELWDWLIDMESLVMDSHDLMMSEEQQQHLYKRYSVEMSIRHLKKTELLSKVEALKKGGVLLPNDLLEKVDSINEKWELLGKTLGEKIQDTMAGHSGSSPRDLLSPESGSLVRQLEVRIKELKGWLRDTELFIFNSCLRQEKEGTMNTEKQLQYFKSLCREIKQRRRGVASILRLCQHLLDDRETCNLNADHQPMQLIIVNLERRWEAIVMQAVQWQTRLQKKMGKESVSDAFFKHNCLSFSQTKNNSFRLGNGVHA

SEQ ID NO: 902109 - protein, 108 aa, Homo sapiens
HSGNVVDSANRQGRIASRPGLASGSINVVTAVYYIDFSQAMKIISLKDTPGCNSGVASSSRPGLASGSITFVTAVYYIDFSQDENHLTERYAWLQLRGGLILPDHVCH

SEQ ID NO: 902110 - protein, 2319 aa, Homo sapiens; identical to SEQ ID NO: 902106

SEQ ID NO: 902111 - protein, 67 aa, Homo sapiens
KESSGKPGESGMPEEHNAASAKSKVQDLSLKANQPTDKAALHPSPKTLTCEENLLNLHEKRHRNMHR

SEQ ID NO: 902112 - protein, 1300 aa, Homo sapiens
MEFYESAYFIVLIPSIVITVIFLFFWLFMKETLYDEVLAKQKREQKLIPTKTDKKKAEKKKNKKKEIQNGNLHESDSESVPRDFKLSDALAVEDDQVAPVPLNVVETSSSVRERKKKEKKQKPVLEEQVIKESDASKIPGKKVEPVPVTKQPTPPSEAAASKKKPGQKKSKNGSDDQDKKVETLMVPSKRQEALPLHQETKQESGSGKKKASSKKQKTENVFVDEPLIHATTYIPLMDNADSSPVVDKREVIDLLKPDQVEGIQKSGTKKLKTETDKENAEVKFKDFLLSLKTMMFSEDEALCVVDLLKEKSGVIQDALKKSSKGELTTLIHQLQEKDKLLAAVKEDAAATKDRCKQLTQEMMTEKERSNVVITRMKDRIGTLEKEHNVFQNKIHVSYQETQQMQMKFQQVREQMEAEIAHLKQENGILRDAVSNTTNQLESKQSAELNKLRQDYARLVNELTEKTGKLQQEEVQKKNAEQAATQLKVQLQEAERRWEEVQSYIRKRTAEHEAAQQDLQSKFVAKENEVQSLHSKLTDTLVSKQQLEQRLMQLMESEQKRVNKEESLQMQVQDILEQNEALKAQIQQFHSQIAAQTSASVLAEELHKVIAEKDKQIKQTEDSLASERDRLTSKEEELKDIQNMNFLLKAEVQKLQALANEQAAAAHELEKMQQSVYVKDDKIRLLEEQLQHEISNKMEEFKILNDQNKALKSEVQKLQTLVSEQPNKDVVEQMEKCIQEKDEKLKTVEELLETGLIQVATKEEELNAIRTENSSLTKEVQDLKAKQNDQVSFASLVEELKKVIHEKDGKIKSVEELLEAELLKVANKEKTVQDLKQEIKALKEEIGNVQLEKAQQLSITSKVQELQNLLKGKEEQMNTMKAVLEEKEKDLANTGKWLQDLQEENESLKAHVQEVAQHNLKEASSASQFEELEIVLKEKENELKRLEAMLKERESDLSSKTQLLQDVQDENKLFKSQIEQLKQQNYQQASSFPPHEELLKVISEREKEISGLWNELDSLKDAVEHQRKKNNERQQQVEAVELEAKEVLKKLFPKVSVPSNLSYGEWLHGFEKKAKECMAGTSGSEEVKVLEHKLKEADEMHTLLQLECEKYKSVLAETEGILQKLQRSVEQEENKWKVKVDESHKTIKQMQSSFTSSEQELERLRSENKDIENLRREREHLEMELEKAEMERSTYVTEVRELKAQLNETLTKLRTEQNERQKVAGDLHKAQQSLELIQSKIVKAAGDTTVIENSDVSPETESSEKETMSVSLNQTVTQLQQLLQAVNQQLTKEKEHYQVLE

SEQ ID NO: 902113 - protein, 1357 aa, Homo sapiens
MEFYESAYFIVLIPSIVITVIFLFFWLFMKETLYDEVLAKQKREQKLIPTKTDKKKAEKKKNKKKEIQNGNLHESDSESVPRDFKLSDALAVEDDQVAPVPLNVVETSSSVRERKKKEKKQKPVLEEQVIKESDASKIPGKKVEPVPVTKQPTPPSEAAASKKKPGQKKSKNGSDDQDKKVETLMVPSKRQEALPLHQETKQESGSGKKKASSKKQKTENVFVDEPLIHATTYIPLMDNADSSPVVDKREVIDLLKPDQVEGIQKSGTKKLKTETDKENAEVKFKDFLLSLKTMMFSEDEALCVVDLLKEKSGVIQDALKKSSKGELTTLIHQLQEKDKLLAAVKEDAAATKDRCKQLTQEMMTEKERSNVVITRMKDRIGTLEKEHNVFQNKIHVSYQETQQMQMKFQQVREQMEAEIAHLKQENGILRDAVSNTTNQLESKQSAELNKLRQDYARLVNELTEKTGKLQQEEVQKKNAEQAATQLKVQLQEAERRWEEVQSYIRKRTAEHEAAQQDLQSKFVAKENEVQSLHSKLTDTLVSKQQLEQRLMQLMESEQKRVNKEESLQMQVQDILEQNEALKAQIQQFHSQIAAQTSASVLAEELHKVIAEKDKQIKQTEDSLASERDRLTSKEEELKDIQNMNFLLKAEVQKLQALANEQAAAAHELEKMQQSVYVKDDKIRLLEEQLQHEISNKMEEFKILNDQNKALKSEVQKLQTLVSEQPNKDVVEQMEKCIQEKDEKLKTVEELLETGLIQVATKEEELNAIRTENSSLTKEVQDLKAKQNDQVSFASLVEELKKVIHEKDGKIKSVEELLEAELLKVANKEKTVQDLKQEIKALKEEIGNVQLEKAQQLSITSKVQELQNLLKGKEEQMNTMKAVLEEKEKDLANTGKWLQDLQEENESLKAHVQEVAQHNLKEASSASQFEELEIVLKEKENELKRLEAMLKERESDLSSKTQLLQDVQDENKLFKSQIEQLKQQNYQQASSFPPHEELLKVISEREKEISGLWNELDSLKDAVEHQRKKNNDLREKNWEAMEALASTEKMLQDKVNKTSKERQQQVEAVELEAKEVLKKLFPKVSVPSNLSYGEWLHGFEKKAKECMAGTSGSEEVKVLEHKLKEADEMHTLLQLECEKYKSVLAETEGILQKLQRSVEQEENKWKVKVDESHKTIKQMQSSFTSSEQELERLRSENKDIENLRREREHLEMELEKAEMERSTYVTEVRELKDLLTELQKKLDDSYSEAVRQNEELNLLKAQLNETLTKLRTEQNERQKVAGDLHKAQQSLELIQSKIVKAAGDTTVIENSDVSPETESSEKETMSVSLNQTVTQLQQLLQAVNQQLTKEKEHYQVLE

SEQ ID NO: 902114 - protein, 122 aa, Homo sapiens
MFWFRISEREKEISGLWNELDSLKDAVEHQRKKNNDLREKNWEAMEALASTEKMLQDKVNKTSKERQQQVEAVELEAKEVLKKLFPKVSVPSNLSYGEWLHGFEKKAKECMAGTSGSEEVKV

SEQ ID NO: 902115 - protein, 1300 aa, Homo sapiens; identical to SEQ ID NO: 902112

SEQ ID NO: 902116 - protein, 1300 aa, Homo sapiens; identical to SEQ ID NO: 902112

SEQ ID NO: 902117 - protein, 1300 aa, Homo sapiens; identical to SEQ ID NO: 902112

SEQ ID NO: 902118 - protein, 1224 aa, Homo sapiens
MAGFSQVGQRSDALAVEDDQVAPVPLNVVETSSSVRERKKKEKKQKPVLEEQVIKESDASKIPGKKVEPVPVTKQPTPPSEAAASKKKPGQKKSKNGSDDQDKKVETLMVPSKRQEALPLHQETKQESGSGKKKASSKKQKTENVFVDEPLIHATTYIPLMDNADSSPVVDKREVIDLLKPDQVEGIQKSGTKKLKTETDKENAEVKFKDFLLSLKTMMFSEDEALCVVDLLKEKSGVIQDALKKSSKGELTTLIHQLQEKDKLLAAVKEDAAATKDRCKQLTQEMMTEKERSNVVITRMKDRIGTLEKEHNVFQNKIHVSYQETQQMQMKFQQVREQMEAEIAHLKQENGILRDAVSNTTNQLESKQSAELNKLRQDYARLVNELTEKTGKLQQEEVQKKNAEQAATQLKVQLQEAERRWEEVQSYIRKRTAEHEAAQQDLQSKFVAKENEVQSLHSKLTDTLVSKQQLEQRLMQLMESEQKRVNKEESLQMQVQDILEQNEALKAQIQQFHSQIAAQTSASVLAEELHKVIAEKDKQIKQTEDSLASERDRLTSKEEELKDIQNMNFLLKAEVQKLQALANEQAAAAHELEKMQQSVYVKDDKIRLLEEQLQHEISNKMEEFKILNDQNKALKSEVQKLQTLVSEQPNKDVVEQMEKCIQEKDEKLKTVEELLETGLIQVATKEEELNAIRTENSSLTKEVQDLKAKQNDQVSFASLVEELKKVIHEKDGKIKSVEELLEAELLKVANKEKTVQDLKQEIKALKEEIGNVQLEKAQQLSITSKVQELQNLLKGKEEQMNTMKAVLEEKEKDLANTGKWLQDLQEENESLKAHVQEVAQHNLKEASSASQFEELEIVLKEKENELKRLEAMLKERESDLSSKTQLLQDVQDENKLFKSQIEQLKQQNYQQASSFPPHEELLKVISEREKEISGLWNELDSLKDAVEHQRKKNNERQQQVEAVELEAKEVLKKLFPKVSVPSNLSYGEWLHGFEKKAKECMAGTSGSEEVKVLEHKLKEADEMHTLLQLECEKYKSVLAETEGILQKLQRSVEQEENKWKVKVDESHKTIKQMQSSFTSSEQELERLRSENKDIENLRREREHLEMELEKAEMERSTYVTEVRELKAQLNETLTKLRTEQNERQKVAGDLHKAQQSLELIQSKIVKAAGDTTVIENSDVSPETESSEKETMSVSLNQTVTQLQQLLQAVNQQLTKEKEHYQVLE

SEQ ID NO: 902119 - protein, 1270 aa, Homo sapiens
MEFYESAYFIVLIPSIVITVIFLFFWLFMKETLYDEVLAKQKREQKLIPTKTDKKKAEKKKNKKKEIQNGNLHESDSESVPRDFKLSDALAVEDDQVAPVPLNVVETSSSVRERKKKEKKQKPVLEEQVIKESDASKIPGKKVEPVPVTKQPTPPSEAAASKKKPGQKKSKNGSDDQDKKVETLMVPSKRQEALPLHQETKQESGSGKKKASSKKQKTENVFVDEPLIHATTYIPLMDNADSSPVVDKREVIDLLKPDQVEGIQKSGTKKLKTETDKENAEVKFKDFLLSLKTMMFSEDEALCVVDLLKEKSGVIQDALKKSSKGELTTLIHQLQEKDKLLAAVKEDAAATKDRCKQLTQEMMTEKERSNVVITRMKDRIGTLEKEHNVFQNKIHVSYQETQQMQMKFQQVREQMEAEIAHLKQENGILRDAVSNTTNQLESKQSAELNKLRQDYARLVNELTEKTGKLQQEEVQKKNAEQAATQLKVQLQEAERRWEEVQSYIRKRTAEHEAAQQDLQSKFVAKENEVQSLHSKLTDTLVSKQQLEQRLMQLMESEQKRVNKEESLQMQVQDILEQNEALKAQIQQFHSQIAAQTSASVLAEELHKVIAEKDKQIKQTEDSLASERDRLTSKEEELKDIQNMNFLLKAEVQKLQALANEQAAAAHELEKMQQSVYVKDDKIRLLEEQLQHEISNKMEEFKILNDQNKALKSEVQKLQTLVSEQPNKDVVEQMEKCIQEKDEKLKTVEELLETGLIQVATKEEELNAIRTENSSLTKEVQDLKAKQNDQVSFASLVEELKKVIHEKDGKIKSVEELLEAELLKVANKEKTVQDLKQEIKALKEEIGNVQLEKAQQLSITSKVQELQNLLKGKEEQMNTMKAVLEEKEKDLANTGKWLQDLQEENESLKAHVQEVAQHNLKEASSASQFEELEIVLKEKENELKRLEAMLKERESDLSSKTQLLQDVQDENKLFKSQIEQLKQQNYQQASSFPPHEELLKVISEREKEISGLWNELDSLKDAVEHQRKKNNSYGEWLHGFEKKAKECMAGTSGSEEVKVLEHKLKEADEMHTLLQLECEKYKSVLAETEGILQKLQRSVEQEENKWKVKVDESHKTIKQMQSSFTSSEQELERLRSENKDIENLRREREHLEMELEKAEMERSTYVTEVRELKAQLNETLTKLRTEQNERQKVAGDLHKAQQSLELIQSKIVKAAGDTTVIENSDVSPETESSEKETMSVSLNQTVTQLQQLLQAVNQQLTKEKEHYQVLE

SEQ ID NO: 902120 - protein, 1300 aa, Homo sapiens; identical to SEQ ID NO: 902112

SEQ ID NO: 902121 - protein, 1300 aa, Homo sapiens; identical to SEQ ID NO: 902112

SEQ ID NO: 902122 - protein, 656 aa, Homo sapiens
MDILVIRCCWGATLNKDATKAATAAADFTAKVWDAVSGDELMLAHKHIVKTVDFTQDSNYLLTGGQDKLLRIYDLNQPEAEPKEVVEQMEKCIQEKDEKLKTVEELLETGLIQVATKEEELNAIRTENSSLTKEVQDLKAKQNDQVSFASLVEELKKVIHEKDGKIKSVEELLEAELLKVANKEKTVQDLKQEIKALKEEIGNVQLEKAQQLSITSKVQELQNLLKGKEEQMNTMKAVLEEKEKDLANTGKWLQDLQEENESLKAHVQEVAQHNLKEASSASQFEELEIVLKEKENELKRLEAMLKERESDLSSKTQLLQDVQDENKLFKSQIEQLKQQNYQQASSFPPHEELLKVISEREKEISGLWNELDSLKDAVEHQRKKNNERQQQVEAVELEAKEVLKKLFPKVSVPSNLSYGEWLHGFEKKAKECMAGTSGSEEVKVLEHKLKEADEMHTLLQLECEKYKSVLAETEGILQKLQRSVEQEENKWKVKVDESHKTIKQMQSSFTSSEQELERLRSENKDIENLRREREHLEMELEKAEMERSTYVTEVRELKAQLNETLTKLRTEQNERQKVAGDLHKAQQSLELIQSKIVKAAGDTTVIENSDVSPETESSEKETMSVSLNQTVTQLQQLLQAVNQQLTKEKEHYQVLE

SEQ ID NO: 902123 - protein, 570 aa, Homo sapiens
RTRGSTHASGYRLLFLNSLIRMLWTNGKCIQEKDEKLKTVEELLETGLIQVATKEEELNAIRTENSSLTKEVQDLKAKQNDQVSFASLVEELKKVIHEKDGKIKSVEELLEAELLKVANKEKTVQLSITSKVQELQNLLKGKEEQMNTMKAVLEEKEKDLANTGKWLQDLQEENESLKAHVQEVAQHNLKEASSASQFEELEIVLKEKENELKRLEAMLKERESDLSSKTQLLQDVQDENKLFKSQIEQLKQQNYQQASSFPPHEELLKVISEREKEISGLWNELDSLKDAVEHQRKKNNERQQQVEAVELEAKEVLKKLFPKVSVPSNLSYGEWLHGFEKKAKECMAGTSGSEEVKVLEHKLKEADEMHTLLQLECEKYKSVLAETEGILQKLQRSVEQEENKWKVKVDESHKTIKQMQSSFTSSEQELERLRSENKDIENLRREREHLEMELEKAEMERSTYVTEVRELKAQLNETLTKLRTEQNERQKVAGDLHKAQQSLELIQSKIVKAAGDTTVIENSDVSPETESSEKETMSVSLNQTVTQLQQLLQAVNQQLTKEKEHYQVLE

SEQ ID NO: 902124 - protein, 284 aa, Homo sapiens
GGPPWEDWFFPSGKERQQQVEAVELEAKEVLKKLFPKVSVPSNLSYGEWLHGFEKKAKECMAGTSGSEEVKVLEHKLKEADEMHTLLQLECEKYKSVLAETEGILQKLQRSVEQEENKWKVKVDESHKTIKQMQSSFTSSEQELERLRSENKDIENLRREREHLEMELEKAEMERSTYVTEVRELKAQLNETLTKLRTEQNERQKVAGDLHKAQQSLELIQSKIVKAAGDTTVIENSDVSPETESSEKETMSVSLNQTVTQLQQLLQAVNQQLTKEKEHYQVLE

SEQ ID NO: 902125 - protein, 287 aa, Homo sapiens
DDHATLCAVNDSQTPSKERQQQVEAVELEAKEVLKKLFPKVSVPSNLSYGEWLHGFEKKAKECMAGTSGSEEVKVLEHKLKEADEMHTLLQLECEKYKSVLAETEGILQKLQRSVEQEENKWKVKVDESHKTIKQMQSSFTSSEQELERLRSENKDIENLRREREHLEMELEKAEMERSTYVTEVRELKAQLNETLTKLRTEQNERQKVAGDLHKAQQSLELIQSKIVKAAGDTTVIENSDVSPETESSEKETMSVSLNQTVTQLQQLLQAVNQQLTKEKEHYQVLE

SEQ ID NO: 902126 - protein, 292 aa, Homo sapiens
LFSFFMDQQASSFPPHEELLKVISEREKEISGLWNELDSLKDAVEHQRKKNNSYGEWLHGFEKKAKECMAGTSGSEEVKVLEHKLKEADEMHTLLQLECEKYKSVLAETEGILQKLQRSVEQEENKWKVKVDESHKTIKQMQSSFTSSEQELERLRSENKDIENLRREREHLEMELEKAEMERSTYVTEVRELKAQLNETLTKLRTEQNERQKVAGDLHKAQQSLELIQSKIVKAAGDTTVIENSDVSPETESSEKETMSVSLNQTVTQLQQLLQAVNQQLTKEKEHYQVLE

SEQ ID NO: 902127 - protein, 1310 aa, Homo sapiens
MEFYESAYFIVLIPSIVITVIFLFFWLFMKETLYDEVLAKQKREQKLIPTKTDKKKAEKKKNKKKEIQNGNLHESDSESVPRDFKLSDALAVEDDQVAPVPLNVVETSSSVRERKKKEKKQKPVLEEQVIKESDASKIPGKKVEPVPVTKQPTPPSEAAASKKKPGQKKSKNGSDDQDKKVETLMVPSKRQEALPLHQETKQESGSGKKKASSKKQKTENVFVDEPLIHATTYIPLMDNADSSPVVDKREVIDLLKPDQVEGIQKSGTKKLKTETDKENAEVKFKDFLLSLKTMMFSEDEALCVVDLLKEKSGVIQDALKKSSKGELTTLIHQLQEKDKLLAAVKEDAAATKDRCKQLTQEMMTEKERSNVVITRMKDRIGTLEKEHNVFQNKIHVSYQETQQMQMKFQQVREQMEAEIAHLKQENGILRDAVSNTTNQLESKQSAELNKLRQDYARLVNELTEKTGKLQQEEVQKKNAEQAATQLKVQLQEAERRWEEVQSYIRKRTAEHEAAQQDLQSKFVAKENEVQSLHSKLTDTLVSKQQLEQRLMQLMESEQKRVNKEESLQMQVQDILEQNEALKAQIQQFHSQIAAQTSASVLAEELHKVIAEKDKQIKQTEDSLASERDRLTSKEEELKDIQNMNFLLKAEVQKLQALANEQAAAAHELEKMQQSVYVKDDKIRLLEEQLQHEISNKMEEFKILNDQNKALKSEVQKLQTLVSEQPNKDVVEQMEKCIQEKDEKLKTVEELLETGLIQVATKEEELNAIRTENSSLTKEVQDLKAKQNDQVSFASLVEELKKVIHEKDGKIKSVEELLEAELLKVANKEKTVQDLKQEIKALKEEIGNVQLEKAQQLSITSKVQELQNLLKGKEEQMNTMKAVLEEKEKDLANTGKWLQDLQEENESLKAHVQEVAQHNLKEASSASQFEELEIVLKEKENELKRLEAMLKERESDLSSKTQLLQDVQDENKLFKSQIEQLKQQNYQQASSFPPHEELLKVISEREKEISGLWNELDSLKDAVEHQRKKNNERQQQVEAVELEAKEVLKKLFPKVSVPSNLSYGEWLHGFEKKAKECMAGTSGSEEVKVLEHKLKEADEMHTLLQLECEKYKSVLAETEGILQKLQRSVEQEENKWKVKVDESHKTIKQMQSSFTSSEQELERLRSENKDIENLRREREHLEMELEKAEMERSTYVTEVRELKAQLNETLTKLRTEQNERQKVAGDLHKAQQSLELIQSKIVKAAGDTTVIENSDVSPETESSEKETMSVSLNQTVTQLQQLLQAVNQQLTKEKEHYQVLDTMVGDAAAIL

SEQ ID NO: 902128 - protein, 246 aa, Homo sapiens
PGSKTMNQQPPSRELDDELNQFTIAAKKLKSLVIYLTKESKDRYMYNYKTLLKKITDNANKWKHIPCSWMGRTSIVKMTIPLKAIYKFNAILIGMQSSFTSSEQELERLRSENKDIENLRREREHLEMELEKAEMERSTYVTEVRELKAQLNETLTKLRTEQNERQKVAGDLHKAQQSLELIQSKIVKAAGDTTVIENSDVSPETESSEKETMSVSLNQTVTQLQQLLQAVNQQLTKEKEHYQVLE

SEQ ID NO: 902129 - protein, 1030 aa, Homo sapiens
MEFYESAYFIVLIPSIVITVIFLFFWLFMKETLYDEVLAKQKREQKLIPTKTDKKKAEKKKNKKKEIQNGNLHESDSESVPRDFKLSDALAVEDDQVAPVPLNVVETSSSVRERKKKEKKQKPVLEEQVIKESDASKIPGKKVEPVPVTKQPTPPSEAAASKKKPGQKKSKNGSDDQDKKVETLMVPSKRQEALPLHQETKQESGSGKKKASSKKQKTENVFVDEPLIHATTYIPLMDNADSSPVVDKREVIDLLKPDQVEGIQKSGTKKLKTETDKENAEVKFKDFLLSLKTMMFSEDEALCVVDLLKEKSGVIQDALKKSSKGELTTLIHQLQEKDKLLAAVKEDAAATKDRCKQLTQEMMTEKERSNVVITRMKDRIGTLEKEHNVFQNKIHVSYQETQQMQMKFQQVREQMEAEIAHLKQENGILRDAVSNTTNQLESKQSAELNKLRQDYARLVNELTEKTGKLQQEEVQKKNAEQAATQLKVQLQEAERRWEEVQSYIRKRTAEHEAAQQDLQSKFVAKENEVQSLHSKLTDTLVSKQQLEQRLMQLMESEQKRVNKEESLQMQVQDILEQNEALKAQIQQFHSQIAAQTSASVLAEELHKVIAEKDKQIKQTEDSLASERDRLTSKEEELKDIQNMNFLLKAEVQKLQALANEQAAAAHELEKMQQSVYVKDDKIRLLEEQLQHEISNKMEEFKILNDQNKALKSEVQKLQTLVSEQPNKDVVEQMEKCIQEKDEKLKTVEELLETGLIQVATKEEELNAIRTENSSLTKEVQDLKAKQNDQVSFASLVEELKKVIHEKDGKIKSVEELLEAELLKVANKEKTVQDLKQEIKALKEEIGNVQLEKAQQLSITSKVQELQNLLKGKEEQMNTMKAVLEEKEKDLANTGKWLQDLQEENESLKAHVQEVAQHNLKEASSASQFEELEIVLKEKENELKRLEAMLKERESDLSSKTQLLQDVQDENKLFKSQIEQLKQQNYQQASSFPPHEELLKVISEREKEISGLWNELDSLKDAVEHQRKKNN

SEQ ID NO: 902130 - protein, 1240 aa, Homo sapiens
MEFYESAYFIVLIPSIVITVIFLFFWLFMKETLYDEVLAKQKREQKLIPTKTDKKKAEKKKNKKKEIQNGNLHESDSESVPRDFKLSDALAVEDDQVAPVPLNVVETSSSVRERKKKEKKQKPVLEEQVIKESDASKIPGKKVEPVPVTKQPTPPSEAAASKKKPGQKKSKNGSDDQDKKVETLMVPSKRQEALPLHQETKQESGSGKKKASSKKQKTENVFVDEPLIHATTYIPLMDNADSSPVVDKREVIDLLKPDQVEGIQKSGTKKLKTETDKENAEVKFKDFLLSLKTMMFSEDEALCVVDLLKEKSGVIQDALKKSSKGELTTLIHQLQEKDKLLAAVKEDAAATKDRCKQLTQEMMTEKERSNVVITRMKDRIGTLEKEHNVFQNKIHVSYQETQQMQMKFQQVREQMEAEIAHLKQENGILRDAVSNTTNQLESKQSAELNKLRQDYARLVNELTEKTGKLQQEEVQKKNAEQAATQLKVQLQEAERRWEEVQSYIRKRTAEHEAAQQDLQSKFVAKENEVQSLHSKLTDTLVSKQQLEQRLMQLMESEQKRVNKEESLQMQVQDILEQNEALKAQIQQFHSQIAAQTSASVLAEELHKVIAEKDKQIKQTEDSLASERDRLTSKEEELKDIQNMNFLLKAEVQKLQALANEQAAAAHELEKMQQSVYVKDDKIRLLEEQLQHEISNKMEEFKILNDQNKALKSEVQKLQTLVSEQPNKDVVEQMEKCIQEKDEKLKTVEELLETGLIQVATKEEELNAIRTENSSLTKEVQDLKAKQNDQVSFASLVEELKKVIHEKDGKIKSVEELLEAELLKVANKEKTVQDLKQEIKALKEEIGNVQLEKAQQLSITSKVQELQNLLKGKEEQMNTMKAVLEEKEKDLANTGKWLQDLQEENESLKAHVQEVAQHNLKEASSASQFEELEIVLRRTGTCLDEVRTRLKRGAGTFSKPGGTVAHETLCGHGRVNKFTGPFPPEENVPSRENGRVKTRDDAKTPARAVPTDLVDYMMESMFFLYSWCHYSAHSTGAQTPHHTYDADNDPTSRHHRSRGDQSDGRTSHQRAAQGGKTTPVAQRRESETKTTNTRHRPHQATQRRAQQKAERTKPPTTRRPPSAKEAQSTTRAMRQTETTAHEGTGDGQEESEGTQTRGTEAEGTQRALGPRRAGERDTTENRRRKSTRDRADATAERATEDRADSHRQNDRETEAARTEEATERATQPSSEKRPTVRGATE

SEQ ID NO: 902131 - protein, 806 aa, Homo sapiens
MEFYESAYFIVLIPSIVITVIFLFFWLFMKETLYDEVLAKQKREQKLIPTKTDKKKAEKKKNKKKEIQNGNLHESDSESVPRDFKLSDALAVEDDQVAPVPLNVVETSSSVRERKKKEKKQKPVLEEQVIKESDASKIPGKKVEPVPVTKQPTPPSEAAASKKKPGQKKSKNGSDDQDKKVETLMVPSKRQEALPLHQETKQESGSGKKKASSKKQKTENVFVDEPLIHATTYIPLMDNADSSPVVDKREVIDLLKPDQVEGIQKSGTKKLKTETDKENAEVKFKDFLLSLKTMMFSEDEALCVVDLLKEKSGVIQDALKKSSKGELTTLIHQLQEKDKLLAAVKEDAAATKDRCKQLTQEMMTEKERSNVVITRMKDRIGTLEKEHNVFQNKIHVSYQETQQMQMKFQQVREQMEAEIAHLKQENGILRDAVSNTTNQLESKQSAELNKLRQDYARLVNELTEKTGKLQQEEVQKKNAEQAATQLKVQLQEAERRWEEVQSYIRKRTAEHEAAQQDLQSKFVAKENEVQSLHSKLTDTLVSKQQLEQRLMQLMESEQKRVNKEESLQMQVQDILEQNEALKAQIQQFHSQIAAQTSASVLAEELHKVIAEKDKQIKQTEDSLASERDRLTSKEEELKDIQNMNFLLKAEVQKLQALANEQAAAAHELEKMQQSVYVKDDKIRLLEEQLQHEISNKMEEFKILNDQNKALKSEVQKLQTLVSEQLIRMLWNNGAFRNDEKSTGTILNGLSGGYRRRIINQSLVKSIKHQRVAPLDNRSTGYRQPHTNRGNDRKIMRSRKRGTPRDI

SEQ ID NO: 902132 - protein, 612 aa, Homo sapiens
MEFYESAYFIVLIPSIVITVIFLFFWLFMKETLYDEVLAKQKREQKLIPTKTDKKKAEKKKNKKKEIQNGNLHESDSESVPRDFKLSDALAVEDDQVAPVPLNVVETSSSVRERKKKEKKQKPVLEEQVIKESDASKIPGKKVEPVPVTKQPTPPSEAAASKKKPGQKKSKNGSDDQDKKVETLMVPSKRQEALPLHQETKQESGSGKKKASSKKQKTENVFVDEPLIHATTYIPLMDNADSSPVVDKREVIDLLKPDQVEGIQKSGTKKLKTETDKENAEVKFKDFLLSLKTMMFSEDEALCVVDLLKEKSGVIQDALKKSSKGELTTLIHQLQEKDKLLAAVKEDAAATKDRCKQLTQEMMTEKERSNVVITRMKDRIGTLEKEHNVFQNKIHVSYQETQQMQMKFQQVREQMEAEIAHLKQENGILRDAVSNTTNQLESKQSAELNKLRQDYARLVNELTEKTGKLQQEEVQKKNAEQAATQLKVQLQEAERRWEEVQSYIRKRTAEHEAAQQDLQSKFVAKENEVQSLHSKLTDTLVSKQQLEQRLMQLMESEQKRVNKEESLQMQVQDILEQNEALKAQIQQFHSQIAAQTSASVLAKTPKGVTSSS

SEQ ID NO: 902133 - protein, 625 aa, Homo sapiens
MEFYESAYFIVLIPSIVITVIFLFFWLFMKETLYDEVLAKQKREQKLIPTKTDKKKAEKKKNKKKEIQNGNLHESDSESVPRDFKLSDALAVEDDQVAPVPLNVVETSSSVRERKKKEKKQKPVLEEQVIKESDASKIPGKKVEPVPVTKQPTPPSEAAASKKKPGQKKSKNGSDDQDKKVETLMVPSKRQEALPLHQETKQESGSGKKKASSKKQKTENVFVDEPLIHATTYIPLMDNADSSPVVDKREVIDLLKPDQVEGIQKSGTKKLKTETDKENAEVKFKDFLLSLKTMMFSEDEALCVVDLLKEKSGVIQDALKKSSKGELTTLIHQLQEKDKLLAAVKEDAAATKDRCKQLTQEMMTEKERSNVVITRMKDRIGTLEKEHNVFQNKIHVSYQETQQMQMKFQQVREQMEAEIAHLKQENGILRDAVSNTTNQLESKQSAELNKLRQDYARLVNELTEKTGKLQQEEVQKKNAEQAATQLKVQLQEAERRWEEVQSYIRKRTAEHEAAQQDLQSKFVAKENEVQSLHSKLTDTLVSKQQLEQRLMQLMESEQKRVNKEESLQMQVQDILEQNEALKAQIQQFHSQIAAQYLLLHVLARRNYDKVHCTINHVLEIRTWYL

SEQ ID NO: 902134 - protein, 580 aa, Homo sapiens
MEFYESAYFIVLIPSIVITVIFLFFWLFMKETLYDEVLAKQKREQKLIPTKTDKKKAEKKKNKKKEIQNGNLHESDSESVPRDFKLSDALAVEDDQVAPVPLNVVETSSSVRERKKKEKKQKPVLEEQVIKESDASKIPGKKVEPVPVTKQPTPPSEAAASKKKPGQKKSKNGSDDQDKKVETLMVPSKRQEALPLHQETKQESGSGKKKASSKKQKTENVFVDEPLIHATTYIPLMDNADSSPVVDKREVIDLLKPDQVEGIQKSGTKKLKTETDKENAEVKFKDFLLSLKTMMFSEDEALCVVDLLKEKSGVIQDALKKSSKGELTTLIHQLQEKDKLLAAVKEDAAATKDRCKQLTQEMMTEKERSNVVITRMKDRIGTLEKEHNVFQNKIHVSYQETQQMQMKFQQVREQMEAEIAHLKQENGILRDAVSNTTNQLESKQSAELNKLRQDYARLVNELTEKTGKLQQEEVQKKNAEQAATQLKVQLQEAERRWEEVQSYIRKRTAEHEAAQQDLQSKFVAKENEVQSLHSKLTDTLVSKQQLEQRLMQLMESEQKRVNKEESLQMQVQDILEQNST

SEQ ID NO: 902135 - protein, 172 aa, Homo sapiens
MEFYESAYFIVLIPSIVITVIFLFFWLFMKETLYDEVLAKQKREQKLIPTKTDKKKAEKKKNKKKEIQNGNLHESDSESVPRDFKLSDALAVEDDQVAPVPLNVVETSSSVRERKKKEKKQKPVLEEQVIKESDASKIPGKKVEPVPAVHPSPAPKPGFNKFTFISKKKKKK

SEQ ID NO: 902136 - protein, 1300 aa, Homo sapiens; identical to SEQ ID NO: 902112

SEQ ID NO: 902137 - protein, 83 aa, Homo sapiens
TTTKIRGRVDKAQQSLELIQSKIVKAAGDTTVIENSDVSPETESSEKETMSVSLNQTVTQLQQLLQAVNQQLTKEKEHYQVLE

SEQ ID NO: 902138 - protein, 1329 aa, Homo sapiens
MEFYESAYFIVLIPSIVITVIFLFFWLFMKETLYDEVLAKQKREQKLIPTKTDKKKAEKKKNKKKEIQNGNLHESDSESVPRDFKLSDALAVEDDQVAPVPLNVVETSSSVRERKKKEKKQKPVLEEQVIKESDASKIPGKKVEPVPVTKQPTPPSEAAASKKKPGQKKSKNGSDDQDKKVETLMVPSKRQEALPLHQETKQESGSGKKKASSKKQKTENVFVDEPLIHATTYIPLMDNADSSPVVDKREVIDLLKPDQVEGIQKSGTKKLKTETDKENAEVKFKDFLLSLKTMMFSEDEALCVVDLLKEKSGVIQDALKKSSKGELTTLIHQLQEKDKLLAAVKEDAAATKDRCKQLTQEMMTEKERSNVVITRMKDRIGTLEKEHNVFQNKIHVSYQETQQMQMKFQQVREQMEAEIAHLKQENGILRDAVSNTTNQLESKQSAELNKLRQDYARLVNELTEKTGKLQQEEVQKKNAEQAATQLKVQLQEAERRWEEVQSYIRKRTAEHEAAQQDLQSKFVAKENEVQSLHSKLTDTLVSKQQLEQRLMQLMESEQKRVNKEESLQMQVQDILEQNEALKAQIQQFHSQIAAQTSASVLAEELHKVIAEKDKQIKQTEDSLASERDRLTSKEEELKDIQNMNFLLKAEVQKLQALANEQAAAAHELEKMQQSVYVKDDKIRLLEEQLQHEISNKMEEFKILNDQNKALKSEVQKLQTLVSEQPNKDVVEQMEKCIQEKDEKLKTVEELLETGLIQVATKEEELNAIRTENSSLTKEVQDLKAKQNDQVSFASLVEELKKVIHEKDGKIKSVEELLEAELLKVANKEKTVQDLKQEIKALKEEIGNVQLEKAQQLSITSKVQELQNLLKGKEEQMNTMKAVLEEKEKDLANTGKWLQDLQEENESLKAHVQEVAQHNLKEASSASQFEELEIVLKEKENELKRLEAMLKERESDLSSKTQLLQDVQDENKLFKSQIEQLKQQNYQQASSFPPHEELLKVISEREKEISGLWNELDSLKDAVEHQRKKNNDLREKNWEAMEALASTEKMLQDKVNKTSKERQQQVEAVELEAKEVLKKLFPKVSVPSNLSYGEWLHGFEKKAKECMAGTSGSEEVKVLEHKLKEADEMHTLLQLECEKYKSVLAETEGILQKLQRSVEQEENKWKVKVDESHKTIKQMQSSFTSSEQELERLRSENKDIENLRREREHLEMELEKAEMERSTYVTEVRELKAQLNETLTKLRTEQNERQKVAGDLHKAQQSLELIQSKIVKAAGDTTVIENSDVSPETESSEKETMSVSLNQTVTQLQQLLQAVNQQLTKEKEHYQVLE

SEQ ID NO: 902139 - protein, 1300 aa, Homo sapiens; identical to SEQ ID NO: 902112

SEQ ID NO: 902140 - protein, 1272 aa, Homo sapiens [sequence omitted]

SEQ ID NO: 902141 - protein, 1328 aa, Homo sapiens
MEFYESAYFIVLIPSIVITVIFLFFWLFMKETLYDEVLAKQKREQKLIPTKTDKKKAEKKKNKKKEIQNGNLHESDSESVPRDFKLSDALAVEDDQVAPVPLNVVETSSSVRERKKKEKKQKPVLEEQVIKESDASKIPGKKVEPVPVTKQPTPPSEAAASKKKPGQKKSKNGSDDQDKKVETLMVPSKRQEALPLHQETKQESGSGKKKASSKKQKTENVFVDEPLIHATTYIPLMDNADSSPVVDKREVIDLLKPDQVEGIQKSGTKKLKTETDKENAEVKFKDFLLSLKTMMFSEDEALCVVDLLKEKSGVIQDALKKSSKGELTTLIHQLQEKDKLLAAVKEDAAATKDRCKQLTQEMMTEKERSNVVITRMKDRIGTLEKEHNVFQNKIHVSYQETQQMQMKFQQVREQMEAEIAHLKQENGILRDAVSNTTNQLESKQSAELNKLRQDYARLVNELTEKTGKLQQEEVQKKNAEQAATQLKVQLQEAERRWEEVQSYIRKRTAEHEAAQQDLQSKFVAKENEVQSLHSKLTDTLVSKQQLEQRLMQLMESEQKRVNKEESLQMQVQDILEQNEALKAQIQQFHSQIAAQTSASVLAEELHKVIAEKDKQIKQTEDSLASERDRLTSKEEELKDIQNMNFLLKAEVQKLQALANEQAAAAHELEKMQQSVYVKDDKIRLLEEQLQHEISNKMEEFKILNDQNKALKSEVQKLQTLVSEQPNKDVVEQMEKCIQEKDEKLKTVEELLETGLIQVATKEEELNAIRTENSSLTKEVQDLKAKQNDQVSFASLVEELKKVIHEKDGKIKSVEELLEAELLKVANKEKTVQDLKQEIKALKEEIGNVQLEKAQQLSITSKVQELQNLLKGKEEQMNTMKAVLEEKEKDLANTGKWLQDLQEENESLKAHVQEVAQHNLKEASSASQFEELEIVLKEKENELKRLEAMLKERESDLSSKTQLLQDVQDENKLFKSQIEQLKQQNYQQASSFPPHEELLKVISEREKEISGLWNELDSLKDAVEHQRKKNNERQQQVEAVELEAKEVLKKLFPKVSVPSNLSYGEWLHGFEKKAKECMAGTSGSEEVKVLEHKLKEADEMHTLLQLECEKYKSVLAETEGILQKLQRSVEQEENKWKVKVDESHKTIKQMQSSFTSSEQELERLRSENKDIENLRREREHLEMELEKAEMERSTYVTEVRELKDLLTELQKKLDDSYSEAVRQNEELNLLKAQLNETLTKLRTEQNERQKVAGDLHKAQQSLELIQSKIVKAAGDTTVIENSDVSPETESSEKETMSVSLNQTVTQLQQLLQAVNQQLTKEKEHYQVLE

SEQ ID NO: 902142 - protein, 997 aa, Homo sapiens
AVSVGPGVTSGVNVNILSGMGNGTISSSAAVSSVPNAAAGMTGGWFQVSSNNQQLTQEMMTEKERSNVVITRMKDRIGTLEKEHNVFQNKIHVSYQETQQMQMKFQQVREQMEAEIAHLKQENGILRDAVSNTTNQLESKQSAELNKLRQDYARLVNELTEKTGKLQQEEVQKKNAEQAATQLKVQLQEAERRWEEVQSYIRKRTAEHEAAQQDLQSKFVAKENEVQSLHSKLTDTLVSKQQLEQRLMQLMESEQKRVNKEESLQMQVQDILEQNEALKAQIQQFHSQIAAQTSASVLAEELHKVIAEKDKQIKQTEDSLASERDRLTSKEEELKDIQNMNFLLKAEVQKLQALANEQAAAAHELEKMQQSVYVKDDKIRLLEEQLQHEISNKMEEFKILNDQNKALKSEVQKLQTLVSEQPNKDVVEQMEKCIQEKDEKLKTVEELLETGLIQVATKEEELNAIRTENSSLTKEVQDLKAKQNDQVSFASLVEELKKVIHEKDGKIKSVEELLEAELLKVANKEKTVQDLKQEIKALKEEIGNVQLEKAQQLSITSKVQELQNLLKGKEEQMNTMKAVLEEKEKDLANTGKWLQDLQEENESLKAHVQEVAQHNLKEASSASQFEELEIVLKEKENELKRLEAMLKERESDLSSKTQLLQDVQDENKLFKSQIEQLKQQNYQQASSFPPHEELLKVISEREKEISGLWNELDSLKDAVEHQRKKNNERQQQVEAVELEAKEVLKKLFPKVSVPSNLSYGEWLHGFEKKAKECMAGTSGSEEVKVLEHKLKEADEMHTLLQLECEKYKSVLAETEGILQKLQRSVEQEENKWKVKVDESHKTIKQMQSSFTSSEQELERLRSENKDIENLRREREHLEMELEKAEMERSTYVTEVRELKAQLNETLTKLRTEQNERQKVAGDLHKAQQSLELIQSKIVKAAGDTTVIENSDVSPETESSEKETMSVSLNQTVTQLQQLLQAVNQQLTKEKEHYQVLE

SEQ ID NO: 902143 - protein, 1300 aa, Homo sapiens; identical to SEQ ID NO: 902112

SEQ ID NO: 902144 - protein, 1300 aa, Homo sapiens; identical to SEQ ID NO: 902112

SEQ ID NO: 902145 - protein, 1307 aa, Homo sapiens
MEFYESAYFIVLIPSIVITVIFLFFWLFMKETLYDEVLAKQKREQKLIPTKTDKKKAEKKKNKKKEIQNGNLHESDSESVPRDFKLSDALAVEDDQVAPVPLNVVETSSSVRERKKKEKKQKPVLEEQVIKESDASKIPGKKVEPVPVTKQPTPPSEAAASKKKPGQKKSKNGSDDQDKKVETLMVPSKRQEALPLHQETKQESGSGKKKASSKKQKTENVFVDEPLIHATTYIPLMDNADSSPVVDKREVIDLLKPDQVEGIQKSGTKKLKTETDKENAEVKFKDFLLSLKTMMFSEDEALCVVDLLKEKSGVIQDALKKSSKGELTTLIHQLQEKDKLLAAVKEDAAATKDRCKQLTQEMMTEKERSNVVITRMKDRIGTLEKEHNVFQNKIHVSYQETQQMQMKFQQVREQMEAEIAHLKQENGILRDAVSNTTNQLESKQSAELNKLRQDYARLVNELTEKTGKLQQEEVQKKNAEQAATQLKVQLQEAERRWEEVQSYIRKRTAEHEAAQQDLQSKFVAKENEVQSLHSKLTDTLVSKQQLEQRLMQLMESEQKRVNKEESLQMQVQDILEQNEALKAQIQQFHSQIAAQTSASVLAEELHKVIAEKDKQIKQTEDSLASERDRLTSKEEELKDIQNMNFLLKAEVQKLQALANEQAAAAHELEKMQQSVYVKDDKIRLLEEQLQHEISNKMEEFKILNDQNKALKSEVQKLQTLVSEQPNKDVVEQMEKCIQEKDEKLKTVEELLETGLIQVATKEEELNAIRTENSSLTKEVQDLKAKQNDQVSFASLVEELKKVIHEKDGKIKSVEELLEAELLKVANKEKTVQDLKQEIKALKEEIGNVQLEKAQQLSITSKVQELQNLLKGKEEQMNTMKAVLEEKEKDLANTGKWLQDLQEENESLKAHVQEVAQHNLKEASSASQFEELEIVLKEKENELKRLEAMLKERESDLSSKTQLLQDVQDENKLFKSQIEQLKQQNYQQASSFPPHEELLKVISEREKEISGLWNELDSLKDAVEHQRKKNNERQQQVEAVELEAKEVLKKLFPKVSVPSNLSYGEWLHGFEKKAKECMAGTSGSEEVKVLEHKLKEADEMHTLLQLECEKYKSVLAETEGILQKLQRSVEQEENKWKVKVDESHKTIKQMQSSFTSSEQELERLRSENKDIENLRREREHLEMELEKAEMERSTYVTEVRELKAQLNETLTKLRTEQNERQKVAGDLHKAQQSLELIQSKIVKAAGDTTVIENSDVSPETESSEKETMSVSLNQTVTQLQQLLQAVNQQLTKEKEHYQVLGAFCLTLE

SEQ ID NO: 902146 - protein, 1300 aa, Homo sapiens; identical to SEQ ID NO: 902112

SEQ ID NO: 902147 - protein, 265 aa, Homo sapiens
TSYIGRSTISAYTVPFPKVSVPSNMSYGEWLHGFEKKAKECMAGTSGSEEVKVLEHKLKEADEMHTLLQLECEKYKSVLAETEGILQKLQRSVEQEENKWKVKVDESHKTIKQMQSSFTSSEQELERLRSENKDIENLRREREHLEMELEKAEMERSTYVTEVRELKAQLNETLTKLRTEQNERQKVAGDLHKAQQSLELIQSKIVKAAGDTTVIENSDVSPETESSEKETMSVSLNQTVTQLQQLLQAVNQQLTKEKEHYQVLE

SEQ ID NO: 902148 - protein, 1267 aa, Homo sapiens
MEFYESAYFIVLIPSIVITVIFLFFWLFMKETLYDEVLAKQKREQKLIPTKTDKKKAEKKKNKKKEIQNGNLHESDSESVPRDFKLSDALAVEDDQVAPVPLNVVETSSSVRERKKKEKKQKPVLEEQVIKESDASKIPGKKVEPVPVTKQPTPPSEAAASKKKPGQKKSKNGSDDQDKKVETLMVPSKRQEALPLHQETKQESGSGKKKASSKKQKTENVFVDEPLIHATTYIPLMDNADSSPVVDKREVIDLLKPDQVEGIQKSGTKKLKTETDKENAEVKFKDFLLSLKTMMFSEDEALCVVDLLKEKSGVIQDALKKSSKGELTTLIHQLQEKDKLLAAVKEDAAATKDRCKQLTQEMMTEKERSNVVITRMKDRIGTLEKEHNVFQNKIHVSYQETQQMQMKFQQVREQMEAEIAHLKQENGILRDAVSNTTNQLESKQSAELNKLRQDYARLVNELTEKTGKLQQEEVQKKNAEQAATQLKVQLQEAERRWEEVQSYIRKRTAEHEAAQQDLQSKFVAKENEVQSLHSKLTDTLVSKQQLEQRLMQLMESEQKRVNKEESLQMQVQDILEQNEALKAQIQQFHSQIAAQTSASVLAEELHKVIAEKDKQIKQTEDSLASERDRLTSKEEELKDIQNMNFLLKAEVQKLQALANEQAAAAHELEKMQQSVYVKDDKIRLLEEQLQHEISNKMEEFKILNDQNKALKSEVQKLQTLVSEQPNKDVVEQMEKCIQEKDEKLKTVEELLETGLIQVATKEEELNAIRTENSSLTKEVQDLKAKQNDQVSFASLVEELKKVIHEKDGKIKSVEELLEAELLKVANKEKTVQDLKQEIKALKEEIGNVQLEKAQQLSITSKVQELQNLLKGKEEQMNTMKAVLEEKEKDLANTGKWLQDLQEENESLKAHVQEVAQHNLKEASSASQFEELEIVLKEKENELKRLEAMLKERESDLSSKTQLLQDVQDENKLFKSQIEQLKQQNYQQASSFPPHEELLKVISEREKEISGLWNELDSLKDAVEHQRKKNNERQQQVEAVELEAKEVLKKLFPKVSVPSNLSYGEWLHGFEKKAKECMAGTSGSEEVKVLEHKLKEADEMHTLLQLECEKYKSVLAETEGILQKLQRSVEQEENKWKVKVDESHKTIKQMQSSFTSSEQELERLRSENKDIENLRREREHLEMELEKAEMERSTYVTEVRELKDLLTELQKKLDDSYSEAVRQNEELNLLKAQLNETLTKLRTEQNERQKVAGDLHKAHSHWSYPSKC

SEQ ID NO: 902149 - protein, 1044 aa, Homo sapiens
MEFYESAYFIVLIPSIVITVIFLFFWLFMKETLYDEVLAKQKREQKLIPTKTDKKKAEKKKNKKKEIQNGNLHESDSESVPRDFKLSDALAVEDDQVAPVPLNVVETSSSVRERKKKEKKQKPVLEEQVIKESDASKIPGKKVEPVPVTKQPTPPSEAAASKKKPGQKKSKNGSDDQDKKVETLMVPSKRQEALPLHQETKQESGSGKKKASSKKQKTENVFVDEPLIHATTYIPLMDNADSSPVVDKREVIDLLKPDQVEGIQKSGTKKLKTETDKENAEVKFKDFLLSLKTMMFSEDEALCVVDLLKEKSGVIQDALKKSSKGELTTLIHQLQEKDKLLAAVKEDAAATKDRCKQLTQEMMTEKERSNVVITRMKDRIGTLEKEHNVFQNKIHVSYQETQQMQMKFQQVREQMEAEIAHLKQENGILRDAVSNTTNQLESKQSAELNKLRQDYARLVNELTEKTGKLQQEEVQKKNAEQAATQLKVQLQEAERRWEEVQSYIRKRTAEHEAAQQDLQSKFVAKENEVQSLHSKLTDTLVSKQQLEQRLMQLMESEQKRVNKEESLQMQVQDILEQNEALKAQIQQFHSQIAAQTSASVLAEELHKVIAEKDKQIKQTEDSLASERDRLTSKEEELKDIQNMNFLLKAEVQKLQALANEQAAAAHELEKMQQSVYVKDDKIRLLEEQLQHEISNKMEEFKILNDQNKALKSEVQKLQTLVSEQPNKDVVEQMEKCIQEKDEKLKTVEELLETGLIQVATKEEELNAIRTENSSLTKEVQDLKAKQNDQVSFASLVEELKKVIHEKDGKIKSVEELLEAELLKVANKEKTVQDLKQEIKALKEEIGNVQLEKAQQLSITSKVQELQNLLKGKEEQMNTMKAVLEEKEKDLANTGKWLQDLQEENESLKAHVQEVAQHNLKEASSASQFEELEIVLKEKENELKRLEAMLKERESDLSSKTQLLQDVQDENKLFKSQIEQLKQQNYQQASSFPPHEELLKVISEREKEISGLWNELDSLKDAVEHQRKKNNEGMVMQQQQQRWRH

SEQ ID NO: 902150 - protein, 802 aa, Homo sapiens
MEFYESAYFIVLIPSIVITVIFLFFWLFMKETLYDEVLAKQKREQKLIPTKTDKKKAEKKKNKKKEIQNGNLHESDSESVPRDFKLSDALAVEDDQVAPVPLNVVETSSSVRERKKKEKKQKPVLEEQVIKESDASKIPGKKVEPVPVTKQPTPPSEAAASKKKPGQKKSKNGSDDQDKKVETLMVPSKRQEALPLHQETKQESGSGKKKASSKKQKTENVFVDEPLIHATTYIPLMDNADSSPVVDKREVIDLLKPDQVEGIQKSGTKKLKTETDKENAEVKFKDFLLSLKTMMFSEDEALCVVDLLKEKSGVIQDALKKSSKGELTTLIHQLQEKDKLLAAVKEDAAATKDRCKQLTQEMMTEKERSNVVITRMKDRIGTLEKEHNVFQNKIHVSYQETQQMQMKFQQVREQMEAEIAHLKQENGILRDAVSNTTNQLESKQSAELNKLRQDYARLVNELTEKTGKLQQEEVQKKNAEQAATQLKVQLQEAERRWEEVQSYIRKRTAEHEAAQQDLQSKFVAKENEVQSLHSKLTDTLVSKQQLEQRLMQLMESEQKRVNKEESLQMQVQDILEQNEALKAQIQQFHSQIAAQTSASVLAEELHKVIAEKDKQIKQTEDSLASERDRLTSKEEELKDIQNMNFLLKAEVQKLQALANEQAAAAHELEKMQQSVYVKDDKIRLLEEQLQHEISNKMEEFKILNDQNKALKSEVQKLQTLVSEQPNKDVVEQMEKCIQEKDEKLKTVEELLETGLIQVATKEEELNAIRTENSSLTKEVQDLKAKQNDQVSFASLVEELKKV

SEQ ID NO: 902151 - protein, 736 aa, Homo sapiens
MEFYESAYFIVLIPSIVITVIFLFFWLFMKETLYDEVLAKQKREQKLIPTKTDKKKAEKKKNKKKEIQNGNLHESDSESVPRDFKLSDALAVEDDQVAPVPLNVVETSSSVRERKKKEKKQKPVLEEQVIKESDASKIPGKKVEPVPVTKQPTPPSEAAASKKKPGQKKSKNGSDDQDKKVETLMVPSKRQEALPLHQETKQESGSGKKKASSKKQKTENVFVDEPLIHATTYIPLMDNADSSPVVDKREVIDLLKPDQVEGIQKSGTKKLKTETDKENAEVKFKDFLLSLKTMMFSEDEALCVVDLLKEKSGVIQDALKKSSKGELTTLIHQLQEKDKLLAAVKEDAAATKDRCKQLTQEMMTEKERSNVVITRMKDRIGTLEKEHNVFQNKIHVSYQETQQMQMKFQQVREQMEAEIAHLKQENGILRDAVSNTTNQLESKQSAELNKLRQDYARLVNELTEKTGKLQQEEVQKKNAEQAATQLKVQLQEAERRWEEVQSYIRKRTAEHEAAQQDLQSKFVAKENEVQSLHSKLTDTLVSKQQLEQRLMQLMESEQKRVNKEESLQMQVQDILEQNEALKAQIQQFHSQIAAQTSASVLAEELHKVIAEKDKQIKQTEDSLASERDRLTSKEEELKDIQNMNFLLKAEVQKLQALANEQAAAAHELEKMQQSVYVKDDKIRLLEEQLQHEISNKMEEFKILNDQNKALKSEVQKLQTLVSEQPNKDVVDKWKMH

SEQ ID NO: 902152 - protein, 585 aa, Homo sapiens
MEFYESAYFIVLIPSIVITVIFLFFWLFMKETLYDEVLAKQKREQKLIPTKTDKKKAEKKKNKKKEIQNGNLHESDSESVPRDFKLSDALAVEDDQVAPVPLNVVETSSSVRERKKKEKKQKPVLEEQVIKESDASKIPGKKVEPVPVTKQPTPPSEAAASKKKPGQKKSKNGSDDQDKKVETLMVPSKRQEALPLHQETKQESGSGKKKASSKKQKTENVFVDEPLIHATTYIPLMDNADSSPVVDKREVIDLLKPDQVEGIQKSGTKKLKTETDKENAEVKFKDFLLSLKTMMFSEDEALCVVDLLKEKSGVIQDALKKSSKGELTTLIHQLQEKDKLLAAVKEDAAATKDRCKQLTQEMMTEKERSNVVITRMKDRIGTLEKEHNVFQNKIHVSYQETQQMQMKFQQVREQMEAEIAHLKQENGILRDAVSNTTNQLESKQSAELNKLRQDYARLVNELTEKTGKLQQEEVQKKNAEQAATQLKVQLQEAERRWEEVQSYIRKRTAEHEAAQQDLQSKFVAKENEVQSLHSKLTDTLVSKQQLEQRLMQLMESEQKRVNKEESLQMQVQDILEQNEGRLERI

SEQ ID NO: 902153 - protein, 454 aa, Homo sapiens
MEFYESAYFIVLIPSIVITVIFLFFWLFMKETLYDEVLAKQKREQKLIPTKTDKKKAEKKKNKKKEIQNGNLHESDSESVPRDFKLSDALAVEDDQVAPVPLNVVETSSSVRERKKKEKKQKPVLEEQVIKESDASKIPGKKVEPVPVTKQPTPPSEAAASKKKPGQKKSKNGSDDQDKKVETLMVPSKRQEALPLHQETKQESGSGKKKASSKKQKTENVFVDEPLIHATTYIPLMDNADSSPVVDKREVIDLLKPDQVEGIQKSGTKKLKTETDKENAEVKFKDFLLSLKTMMFSEDEALCVVDLLKEKSGVIQDALKKSSKGELTTLIHQLQEKDKLLAAVKEDAAATKDRCKQLTQEMMTEKERSNVVITRMKDRIGTLEKEQKLIPTKTDKKKAEKKKNKKKEIQNGNLHESDSESVPRDFKLSDALAVEDDQVAPVPLNVVETSSSVR

SEQ ID NO: 902154 - protein, 250 aa, Homo sapiens
MGSQHSAAARPSSCRRKQEDDRDGLLAEREQEEAIAQFPYVEFTGRDSITCLTCQGTGYIPTEQVNELVALIPHSDQRLRPQRTKQYVLLSILLCLLASGLVVFFLFPHSVLVDDDGIKVVKVTFNKQDSLVILTIMATLKIRNSNFYTVAVTSLSSQIQYMNTVVSTYVTTNVSLIPPRSEQLVNFTGKAEMGGPFSYVYFFCTVPEILVHNIVIFMRTSVKISYIGLMTQSSLETHHYVDCGGNSTAI

SEQ ID NO: 902155 - protein, 250 aa, Homo sapiens; identical to SEQ ID NO: 902154

SEQ ID NO: 902156 - protein, 250 aa, Homo sapiens; identical to SEQ ID NO: 902154

SEQ ID NO: 902157 - protein, 250 aa, Homo sapiens; identical to SEQ ID NO: 902154

SEQ ID NO: 902158 - protein, 250 aa, Homo sapiens; identical to SEQ ID NO: 902154

SEQ ID NO: 902159 - protein, 171 aa, Homo sapiens
MVEVEDMMVTNEGGNLAVVTMVVVFFLFPHSVLVDDDGIKVVKVTFNKQDSLVILTIMATLKIRNSNFYTVAVTSLSSQIQYMNTVVSTYVTTNVSLIPPRSEQLVNFTGKAEMGGPFSYVYFFCTVPEILVHNIVIFMRTSVKISYIGLMTQSSLETHHYVDCGGNSTAI

SEQ ID NO: 902160 - protein, 196 aa, Homo sapiens
MGSQHSAAARPSSCRRKQEDDRDGLLAEREQEEAIAQFPYVEFTGRDSITCLTCQGTGYIPTEQVNELVALIPHSDQRLRPQRTKQYVLLSILLCLLASGLVVFFLFPHSVLVDDDGIKVVKVTFNKQDSLVILTIMATLKIRNSNFYTVAVTSLSSQIQYMNTVVSTYVTTNVSLIPPRSEQLVCCSFRNLAPQA

SEQ ID NO: 902161 - protein, 152 aa, Homo sapiens
MGSQHSAAARPSSCRRKQEDDRDGLLAEREQEEAIAQFPYVEFTGRDSITCLTCQGTGYIPTEQVNELVALIPHSDQRLRPQRTKQYVLLSILLCLLASGLVVFFLFPHSVLVDDDGIKVVKVTFNKQDSLVILTIMPDSVHEHSGQYICDY

SEQ ID NO: 902162 - protein, 267 aa, Homo sapiens
MGSQHSAAARPSSCRRKQEDDRDGLLAEREQEEAIAQFPYVEFTGRDSITCLTCQGTGYIPTEQVNELVALIPHSDQRLRPQRTKQYVLLSILLCLLASGLVVFFLFPHSVLVDDDGIKVVKVTFNKQDSLVILTIMATLKIRNSNFYTVAVTSLSSQIQYMNTVVSTYVTTNVSLIPPRSEQLVNFTGKAEMGGPFSYVYSKDTVLSVCALYWRKGIQSHTPLIGAWSCLRSQLLAYRFPGFGCLEIYLKNVLLLCVYLKNVLFDM

SEQ ID NO: 902163 - protein, 198 aa, Homo sapiens
MGSQHSAAARPSSCRRKQEDDRDGLLAEREQEEAIAQFPYVEFTGRDSITCLTCQGTGYIPTEQVNELVALIPHSDQRLRPQRTKQYVLLSILLCLLASGLVVFFLFPHSVLVDDDGIKVVKVTFNKQDSLVILTIMATLKIRNSNFYTVAVTSLSSQIQYMNTVVNFTGKAEMGGPFSYVYSGPTPTWCKQRRNWFT

SEQ ID NO: 902164 - protein, 88 aa, Homo sapiens
TSSNSAEGSSTSVSLTVSGSVGLSQVLDLPPRGVSRGGIGSLNSQQTSSCHLGGNTSLWYHLCFSEPAESVPSLCPANSWHSIKICRI

SEQ ID NO: 902165 - protein, 214 aa, Homo sapiens
MGSQHSAAARPSSCRRKQEDDRDGLLAEREQEEAIAQFPYVEFTGRDSITCLTCQGTGYIPTEQVNELVALIPHSDQRLRPQRTKQYVLLSILLCLLASGLVVFFLFPHSVLVDDDGIKVVKVTFNKQDSLVILTIMATLKIRNSNFYTVAVTSLSSQIQYMNTVVSTYVTTNVSLIPPRSEQLVNFTGKAEMGGPFSYVYFLLDGYPEILGTT

SEQ ID NO: 902166 - protein, 114 aa, Homo sapiens
QGSRLPGALCRPLPEPREPDSCDIGKASGAAKSARASARPRSPGGLGIWRLRAECVPLRRPKRLVSPQAGRWSGERPERSCREFVPCRSATLAFAPAWATLVGSEHRFLPRGVT

SEQ ID NO: 902167 - protein, 231 aa, Homo sapiens
MGSQHSAAARPSSCRRKQEDDRDGLLAEREQEEAIAQFPYVEFTGRDSITCLTCQGTGYIPTEQVNELVALIPHSDQRLRPQRTKQYVLLSILLCLLASGLVVFFLFPHSVLVDDDGIKVVKVTFNKQDSLVILTIMATLKIRNSNFYTVAVTSLSSQIQYMNTVVNFTGKAEMGGPFSYVYFFCTVPEILVHNIVIFMRTSVKISYIGLMTQSSLETHHYVDCGGNSTAI

SEQ ID NO: 902168 - protein, 231 aa, Homo sapiens; identical to SEQ ID NO: 902167

SEQ ID NO: 902169 - protein, 173 aa, Homo sapiens [sequence omitted]

SEQ ID NO: 902170 - protein, 196 aa, Homo sapiens; identical to SEQ ID NO: 902160

SEQ ID NO: 902171 - protein, 152 aa, Homo sapiens; identical to SEQ ID NO: 902161

SEQ ID NO: 902172 - protein, 230 aa, Homo sapiens
MGSQHSAAARPSSCRRKQEDDRDGLLAEREQEEAIAQFPYVEFTGRDSITCLTCQGTGYIPTEQVNELVALIPHSDQRLRPQRTKQYVLLSILLCLLASGLVVFFLFPHSVLVDDDGIKVVKVTFNKQDSLVILTIMATLKIRNSNFYTVAVTSLSSQIQYMNTVVNFTGKAEMGGPFSYVYFFCTVPEILVHNIVIFMRACRREHSICSQGLSSGPTPTWCKQRRNWFT

SEQ ID NO: 902173 - protein, 267 aa, Homo sapiens; identical to SEQ ID NO: 902162

SEQ ID NO: 902174 - protein, 109 aa, Homo sapiens
MTGTVCWLNESRKKPLLSSHMWNSPGEIASPVSRARGQATFQQVNFTGKAEMGGPFSYVYFFCTVPEILVHNIVIFMRTSVKISYIGLMTQSSLETHHYVDCGGNSTAI

SEQ ID NO: 902175 - protein, 110 aa, Homo sapiens
MCCVICSKQYVLLSILLCLLASGLVVFFLFPHSVLVDDDGIKVVKVTFNKQDSLVILTIMVSLRVSFPGLCTCQAGTQDTYTCFLTCPDVGHPENQELQLLHGGSDQPVQ

SEQ ID NO: 902176 - protein, 766 aa, Homo sapiens
MFLPEDKSYNGGGIGSSNRIMDFLEEPIPGVGTYDDFNTIDWVREKSRDRDRHREITNKSKESTWALIHSVSDAFSGWLLMLLIGLLSGSLAGLIDISAHWMTDLKEGICTGGFWFNHEHCCWNSEHVTFEERDKCPEWNSWSQLIISTDEGAFAYIVNYFMYVLWALLFAFLAVSLVKVFAPYACGSGIPEIKTILSGFIIRGYLGKWTLVIKTITLVLAVSSGLSLGKEGPLVHVACCCGNILCHCFNKYRKNEAKRREVLSAAAAAGVSVAFGAPIGGVLFSLEEVSYYFPLKTLWRSFFAALVAAFTLRSINPFGNSRLVLFYVEFHTPWHLFELVPFILLGIFGGLWGALFIRTNIAWCRKRKTTQLGKYPVIEVLVVTAITAILAFPNEYTRMSTSELISELFNDCGLLDSSKLCDYENRFNTSKGGELPDRPAGVGVYSAMWQLALTLILKIVITIFTFGMKIPSGLFIPSMAVGAIAGRLLGVGMEQLAYYHQEWTVFNSWCSQGADCITPGLYAMVGAAACLGGVTRMTVSLVVIMFELTGGLEYIVPLMAAAMTSKWVADALGREGIYDAHIRLNGYPFLEAKEEFAHKTLAMDVMKPRRNDPLLTVLTQDSMTVEDVETIISETTYSGFPVVVSRESQRLVGFVLRRDLIISIENARKKQDGVVSTSIIYFTEHSPPLPPYTPPTLKLRNILDLSPFTVTDLTPMEIVVDIFRKLGLRQCLVTHNGRLLGIITKKDVLKHIAQMANQDPDSILFN

SEQ ID NO: 902177 - protein, 496 aa, Homo sapiens
MGTQKVTPALIFAITVATIGSFQFGYNTGVINAPEKIIKEFINKTLTDKGNAPPSEVLLTSLWSLSVAIFSVGGMIGSFSVGLFVNRFGRRNSMLIVNLLAVTGGCFMGLCKVAKSVEMLILGRLVIGLFCGLCTGFVPMYIGEISPTALRGAFGTLNQLGIVVGILVAQIFGLEFILGSEELWPLLLGFTILPAILQSAALPFCPESPRFLLINRKEEENAKQILQRLWGTQDVSQDIQEMKDESARMSQEKQVTVLELFRVSSYRQPIIISIVLQLSQQLSGINAVFYYSTGIFKDAGVQEPIYATIGAGVVNTIFTVVSLFLVERAGRRTLHMIGLGGMAFCSTLMTVSLLLKDNYNGMSFVCIGAILVFVAFFEIGPGPIPWFIVAELFSQGPRPAAMAVAGCSNWTSNFLVGLLFPSAAHYLGAYVFIIFTGFLITFLAFTFFKVPETRGRTFEDITRAFEGQAHGADRSGKDGVMEMNSIEPAKETTTNV

SEQ ID NO: 902178 - protein, 496 aa, Homo sapiens; identical to SEQ ID NO: 902177

SEQ ID NO: 902179 - protein, 172 aa, Homo sapiens
MGTQKVTPALIFAITVATIGSFQFGYNTGVINAPEKIIKEFINKTLTDKGNAPPSEVLLTSLWSLSVAIFSVGGMIGSFSVGLFVNRFGRRNSMLIVNLLAVTGGCFMGLCKVAKSVEMLILGRLVIGLFCGLCTGFVPMYIGEISPTALRGAFGTLNQLGIVVGILVAQVL

SEQ ID NO: 902180 - protein, 403 aa, Homo sapiens [sequence omitted]

SEQ ID NO: 902181 - protein, 255 aa, Homo sapiens
MKDESARMSQEKQVTVLELFRVSSYRQPIIISIVLQLSQQLSGINAVFYYSTGIFKDAGVQEPIYATIGAGVVNTIFTVVSLFLVERAGRRTLHMIGLGGMAFCSTLMTVSLLLKDNYNGMSFVCIGAILVFVAFFEIGPGPIPWFIVAELFSQGPRPAAMAVAGCSNWTSNFLVGLLFPSAAHYLGAYVFIIFTGFLITFLAFTFFKVPETRGRTFEDITRAFEGQAHGADRSGKDGVMEMNSIEPAKETTTNV

SEQ ID NO: 902182 - protein, 161 aa, Homo sapiens [sequence omitted]

SEQ ID NO: 902183 - protein, 496 aa, Homo sapiens; identical to SEQ ID NO: 902177

SEQ ID NO: 902184 - protein, 103 aa, Homo sapiens
PTRPDPRRPRVRPTRPRTRGSPTRPLFPSAAHYLGAYVFIIFTGFLITFLAFTFFKVPETRGRTFEDITRAFEGQAHGADRSGKDGVMEMNSIEPAKETTTNV

SEQ ID NO: 902185 - protein, 453 aa, Homo sapiens
MGTQKVTPALIFAITVATIGSFQFGYNTGVINAPEKIIKEFINKTLTDKGNAPPSEVLLTSLWSLSVAIFSVGGMIGSFSVGLFVNRFGRRNSMLIVNLLAVTGGCFMGLCKVAKSVEMLILGRLVIGLFCGLCTGFVPMYIGEISPTALRGAFGTLNQLGIVVGILVAQIFGLEFILGSEELWPLLLGFTILPAILQSAALPFCPESPRFLLINRKEEENAKQILQRLWGTQDVSQDIQEMKDESARMSQEKQVTVLELFRVSSYRQPIIISIVLQLSQQLSGINAVFYYSTGIFKDAGVQEPIYATIGAGVVNTIFTVVSLFLVERAGRRTLHMIGLGGMAFCSTLMTVSLLLKDNYNGMSFVCIGAILVFVAFFEIGPGPIPWFIVAWSNFKEGSTDPMPGSAPQPAYACSGLEGSSPSGHHWLRAHLSSSPRAETQGQWVVEWGLRRGG

SEQ ID NO: 902186 - protein, 496 aa, Homo sapiens; identical to SEQ ID NO: 902177

SEQ ID NO: 902187 - protein, 496 aa, Homo sapiens; identical to SEQ ID NO: 902177

SEQ ID NO: 902188 - protein, 255 aa, Homo sapiens; identical to SEQ ID NO: 902181

SEQ ID NO: 902189 - protein, 496 aa, Homo sapiens; identical to SEQ ID NO: 902177

SEQ ID NO: 902190 - protein, 496 aa, Homo sapiens; identical to SEQ ID NO: 902177

SEQ ID NO: 902191 - protein, 292 aa, Homo sapiens
MGTQKVTPALIFAITVATIGSFQFGYNTGVINAPEKIIKEFINKTLTDKGNAPPSEVLLTSLWSLSVAIFSVGGMIGSFSVGLFVNRFGRRNSMLIVNLLAVTGGCFMGLCKVAKSVEMLILGRLVIGLFCGLCTGFVPMYIGEISPTALRGAFGTLNQLGIVVGILVAQIFGLEFILGSEELWPLLLGFTILPAILQSAALPFCPESPRFLLINRKEEENAKQILQRLWGTQDVSQDIQEMKDESARMSQEKQVTVLELFRVSSYRQPIIISIVLQLSQQLSGINAVSVIL

SEQ ID NO: 902192 - protein, 191 aa, Homo sapiens [sequence omitted]

SEQ ID NO: 902193 - protein, 852 aa, Homo sapiens
MCSRQERIQKDIDVVIQKSRAEKDCLFADFRYSDSTFTFTYVGGPRSVSYSVHVSEDYPDNTYVSSSENDEDVLVTTEPIPVIFHRIATELRKTNDINCCLSIKSKLQKENGEESRQNSTVEEDSEGDNDSEEFYYGGQVNYDGELHKHPQLEADLSAVREIYGPHAVSLREYGAIDDVDIDLHIDVSFLDEEIAVAWEVIRTEPIIVRLHCSLTQYLNGPVPTVDVFQISTKERFGLGHQLKKIMQTFVTQQWKQSKEKSNCLHNKKLSEKKVKSPLHLFSTLRRSPSYPPPGCGKSKSKLKSEQDGISKTHKLLRRTCSSTVKTDDVCVTKSHRTFGRSLSSDPRAEQAMTAIKSHKLLNRPCPAAVKSEECLTLKSHRLLTRSCSGDPRCEHNTNLKPHKLLSRSYSSNLRMEELYGLKNHKLLSKSYSSAPKSSKTELFKEPNAEGRRLSLTSGLIGILTPSSSSSSQLAPNGAKCIPVRDRGFLVQTIEFAEQRIPVLNEYCVVCDEPHVFQNGPMLRPTVCERELCVFAFQTLGVMNEAADEIATGAQVVDLLVSMCRSALESPRKVVIFEPYPSVVDPNDPQMLAFNPRKKNYDRVMKALDSITSIREMTQAPYLEIKKQMDKQDPLAHPLLQWVISSNRSHIVKLPVNRQLKFMHTPHQFLLLSSPPAKESNFRAAKKLFGSTFAFHGSHIENWHSILRNGLVVASNTRLQLHGAMYGSGIYLSPMSSISFGYSGMNKKQKVSAKDEPASSSKSSNTSQSQKKGQQSQFLQSRNLKCIALCEVITSSDLHKHGEIWVVPNTDHVCTRFFFVYEDGQVGDANINTQEGGIHKEILRVIGNQTATG

SEQ ID NO: 902194 - protein, 742 aa, Homo sapiens
MQQESRQNSTVEEDSEGDNDSEEFYYGGQVNYDGELHKHPQLEADLSAVREIYGPHAVSLREYGAIDDVDIDLHIDVSFLDEEIAVAWEVIRTEPIIVRLHCSLTQYLNGPVPTVDVFQISTKERFGLGHQLKKIMQTFVTQQWKQSKEKSNCLHNKKLSEKKVKSPLHLFSTLRRSPSYPPPGCGKSKSKLKSEQDGISKTHKLLRRTCSSTVKTDDVCVTKSHRTFGRSLSSDPRAEQAMTAIKSHKLLNRPCPAAVKSEECLTLKSHRLLTRSCSGDPRCEHNTNLKPHKLLSRSYSSNLRMEELYGLKNHKLLSKSYSSAPKSSKTELFKEPNAEGRRLSLTSGLIGILTPSSSSSSQLAPNGAKCIPVRDRGFLVQTIEFAEQRIPVLNEYCVVCDEPHVFQNGPMLRPTVCERELCVFAFQTLGVMNEAADEIATGAQVVDLLVSMCRSALESPRKVVIFEPYPSVVDPNDPQMLAFNPRKKNYDRVMKALDSITSIREMTQAPYLEIKKQMDKQDPLAHPLLQWVISSNRSHIVKLPVNRQLKFMHTPHQFLLLSSPPAKESNFRAAKKLFGSTFAFHGSHIENWHSILRNGLVVASNTRLQLHGAMYGSGIYLSPMSSISFGYSGMNKKQKVSAKDEPASSSKSSNTSQSQKKGQQSQFLQSRNLKCIALCEVITSSDLHKHGEIWVVPNTDHVCTRFFFVYEDGQVGDANINTQEGGIHKEILRVIGNQTATG

SEQ ID NO: 902195 - protein, 373 aa, Homo sapiens
SSTMKGHSKKINCGLTVTLVYESADGPSSGTESPDIFIFPAFKTPTVCERELCVFAFQTLGVMNEAADEIATGAQVVDLLVSMCRSALESPRKVVIFEPYPSVVDPNDPQMLAFNPRKKNYDRVMKALDSITSIREMTQAPYLEIKKQMDKQDPLAHPLLQWVISSNRSHIVKLPVNRQLKFMHTPHQFLLLSSPPAKESNFRAAKKLFGSTFAFHGSHIENWHSILRNGLVVASNTRLQLHGAMYGSGIYLSPMSSISFGYSGMNKKQKVSAKDEPASSSKSSNTSQSQKKGQQSQFLQSRNLKCIALCEVITSSDLHKHGEIWVVPNTDHVCTRFFFVYEDGQVGDANINTQEGGIHKEILRVIGNQTATG

SEQ ID NO: 902196 - protein, 769 aa, Homo sapiens
MCSRQERIQKDIDVVIQKSRAEKDCLFADFRYSDSTFTFTYVGGPRSVSYSVHVSEDYPDNTYVSSSENDEDVLVTTEPIPVIFHRIATELRKTNDINCCLSIKSKLQKENGEESRQNSTVEEDSEGDNDSEEFYYGGQVNYDGELHKHPQLEADLSAVREIYGPHAVSLREYGAIDDVDIDLHIDVSFLDEEIAVAWEVIRTEPIIVRLHCSLTQYLNGPVPTVDVFQISTKERFGLGHQLKKIMQTFVTQQWKQSKEKSNCLHNKKLSEKKVKSPLHLFSTLRRSPSYPPPGCGKSKSKLKSEQDGISKTHKLLRRTCSSTVKTDDVCVTKSHRTFGRSLSSDPRAEQAMTAIKSHKLLNRPCPAAVKSEECLTLKSHRLLTRSCSGDPRCEHNTNLKPHKLLSRSYSSNLRMEELYGLKNHKLLSKSYSSAPKSSKTELFKEPNAEGRRLSLTSGLIGILTPSSSSSSQLAPNGAKCIPVRDRGFLVQTIEFAEQRIPVLNEYCVVCDEPHVFQNGPMLRPTVCERELCVFAFQTLGVMNEAADEIATGAQVVDLLVSMCRSALESPRKVVIFEPYPSVVDPNDPQMLAFNPRKKNYDRVMKALDSITSIREMTQAPYLEIKKQMDKQDPLAHPLLQWVISSNRSHIVKLPVNRQLKFMHTPHQFLLLSSPPAKESNFRAAKKLFGSTFAFHGSHIENWHSILRNGLVVASNTRLQLHGAMYGSGIYLSPMSSISFGYSGMNKKQKVSAKDEPASSSKSSNTSQVL

SEQ ID NO: 902197 - protein, 267 aa, Homo sapiens
MCSRQERIQKDIDVVIQKSRAEKDCLFADFRYSDSTFTFTYVGGPRSVSYSVHVSEDYPDNTYVSSSENDEDVLVTTEPIPVIFHRIATELRKTNDINCCLSIKSKLQKENGEESRQNSTVEEDSEGDNDSEEFYYGGQVNYDGELHKHPQLEADLSAVREIYGPHAVSLREYGAIDDVDIDLHIDVSFLDEEIAVAWEVIRTEPIIVRLHCSLTQYLNGPVYPTQYMYAEDYPDNTYVSSSENDEDVLVTTEPIPVIFHRIAKTPK

SEQ ID NO: 902198 - protein, 85 aa, Homo sapiens
PTTTKFAAASINCCLSIKSKLQKENGEESRQNSTVEEDSEGDNDSEEFYYGGQVNYDGELHKHPQLEADLSAVREIYGPHAVSLR

SEQ ID NO: 902199 - protein, 847 aa, Homo sapiens
MRIQKDIDVVIQKSRAEKDCLFADFRYSDSTFTFTYVGGPRSVSYSVHVSEDYPDNTYVSSSENDEDVLVTTEPIPVIFHRIATELRKTNDINCCLSIKSKLQKENGEESRQNSTVEEDSEGDNDSEEFYYGGQVNYDGELHKHPQLEADLSAVREIYGPHAVSLREYGAIDDVDIDLHIDVSFLDEEIAVAWEVIRTEPIIVRLHCSLTQYLNGPVPTVDVFQISTKERFGLGHQLKKIMQTFVTQQWKQSKEKSNCLHNKKLSEKKVKSPLHLFSTLRRSPSYPPPGCGKSKSKLKSEQDGISKTHKLLRRTCSSTVKTDDVCVTKSHRTFGRSLSSDPRAEQAMTAIKSHKLLNRPCPAAVKSEECLTLKSHRLLTRSCSGDPRCEHNTNLKPHKLLSRSYSSNLRMEELYGLKNHKLLSKSYSSAPKSSKTELFKEPNAEGRRLSLTSGLIGILTPSSSSSSQLAPNGAKCIPVRDRGFLVQTIEFAEQRIPVLNEYCVVCDEPHVFQNGPMLRPTVCERELCVFAFQTLGVMNEAADEIATGAQVVDLLVSMCRSALESPRKVVIFEPYPSVVDPNDPQMLAFNPRKKNYDRVMKALDSITSIREMTQAPYLEIKKQMDKQDPLAHPLLQWVISSNRSHIVKLPVNRQLKFMHTPHQFLLLSSPPAKESNFRAAKKLFGSTFAFHGSHIENWHSILRNGLVVASNTRLQLHGAMYGSGIYLSPMSSISFGYSGMNKKQKVSAKDEPASSSKSSNTSQSQKKGQQSQFLQSRNLKCIALCEVITSSDLHKHGEIWVVPNTDHVCTRFFFVYEDGQVGDANINTQEGGIHKEILRVIGNQTATG

SEQ ID NO: 902200 - protein, 291 aa, Homo sapiens [sequence omitted]

SEQ ID NO: 902201 - protein, 789 aa, Homo sapiens
MCSRQERIQKDIDVVIQKSRAEKDCLFADFRYSDSTFTFTYVGGPRSVSYSVHVSEDYPDNTYVSSSENDEDVLVTTEPIPVIFHRIATELRKTNDINCCLSIKSKLQKENGEESRQNSTVEEDSEGDNDSEEFYYGGQVNYDGELHKHPQLEADLSAVREIYGPHAVSLREYGAIDDVDIDLHIDVSFLDEEIAVAWEVIRTEPIIVRLHCSLTQYLNGPVPTVDVFQISTKERFGLGHQLKKIMQTFVTQQWKQSKEKSNCLHNKKLSEKKVKSPLHLFSTLRRSPSYPPPGCGKSKSKLKSEQDGISKTHKLLRRTCSSTVKTDDVCVTKSHRTFGRSLSSDPRAEQAMTAIKSHKLLNRPCPAAVKSEECLTLKSHRLLTRSCSGDPRCEHNTNLKPHKLLSRSYSSNLRMEELYGLKNHKLLSKSYSSAPKSSKTELFKEPNAEGRRLSLTSGLIGILTPSSSSSSQLAPNGAKCIPVRDRGFLVQTIEFAEQRIPVLNEYCVVCDEPHVFQNGPMLRPTVCERELCVFAFQTLGVMNEAADEIATGAQVVDLLVSMCRSALESPRKVVIFEPYPSVVDPNDPQMLAFNPRKKNYDRVMKALDSITSIREMTQAPYLEIKKQMDKQDPLAHPLLQWVISSNRSHIVKLPVNRQLKFMHTPHQFLLLSSPPAKESNFRAAKKLFGSTFAFHGSHIENWHSILRNGLVVASNTRLQLHGAMYGSGIYLSPMSSISFGYSGMTRNRSVTKDAPASSSNTPIHHSHSDRSSQADTPTAELKASGTELD

SEQ ID NO: 902202 - protein, 820 aa, Homo sapiens
MAGELADKKDRDASPSKEERKRSRTPDRERDRDRDRKSSPSKDRKRHRSRDRRRGGSRSRSRSRSKSAERERRHKERERDKERDRNKKDRDRDKDGHRRDKDRKRSSLSPGRGKDFKSRKDRDSKKDEEDEHGDKKPKAQPLSLEELLAKKKAEEEAEAKPKFLSKAEREAEALKRRQQEVEERQRMLEEERKKRKQFQDLGRKMLEDPQERERRERRERMERETNGNEDEEGRQKIREEKDKSKELHAIKERYLGGIKKRRRTRHLNDRKFVFEWDASEDTSIDYNPLYKERHQVQLLGRGFIAGIDLKQQKREQSRFYGDLMEKRRTLEEKEQEEARLRKLRKKEAKQRWDDRHWSQKKLDEMTDRDWRIFREDYSITTKGGKIPNPIRSWKDSSLPPHILEVIDKCGYKEPTPIQRQAIPIGLQNRDIIGVAETGSGKTAAFLIPLLVWITTLPKIDRIEESDQGPYAIILAPTRELAQQIEEETIKFGKPLGIRTVAVIGGISREDQGFRLRMGCEIVIATPGRLIDVLENRYLVLSRCTYVVLDEADRMIDMGFEPDVQKILEHMPVSNQKPDTDEAEDPEKMLANFESGKHKYRQTVMFTATMPPAVERLARSYLRRPAVVYIGSAGKPHERVEQKVFLMSESEKRKKLLAILEQGFDPPIIIFVNQKKGCDVLAKSLEKMGYNACTLHGGKGQEQREFALSNLKAGAKDILVATDVAGRGIDIQDVSMVVNYDMAKNIEDYIHRIGRTGRAGKSGVAITFLTKEDSAVFYELKQAILESPVSSCPPELANHPDAQHKPGTILTKKRREETIFA

SEQ ID NO: 902203 - protein, 820 aa, Homo sapiens; identical to SEQ ID NO: 902202

SEQ ID NO: 902204 - protein, 820 aa, Homo sapiens; identical to SEQ ID NO: 902202

SEQ ID NO: 902205 - protein, 799 aa, Homo sapiens
RLRKLRLGSEELVVRKSSPSKDRKRHRSRDRRRGGSRSRSRSRSKSAERERRHKERERDKERDRNKKDRDRDKDGHRRDKDRKRSSLSPGRGKDFKSRKDRDSKKDEEDEHGDKKPKAQPLSLEELLAKKKAEEEAEAKPKFLSKAEREAEALKRRQQEVEERQRMLEEERKKRKQFQDLGRKMLEDPQERERRERRERMERETNGNEDEEGRQKIREEKDKSKELHAIKERYLGGIKKRRRTRHLNDRKFVFEWDASEDTSIDYNPLYKERHQVQLLGRGFIAGIDLKQQKREQSRFYGDLMEKRRTLEEKEQEEARLRKLRKKEAKQRWDDRHWSQKKLDEMTDRDWRIFREDYSITTKGGKIPNPIRSWKDSSLPPHILEVIDKCGYKEPTPIQRQAIPIGLQNRDIIGVAETGSGKTAAFLIPLLVWITTLPKIDRIEESDQGPYAIILAPTRELAQQIEEETIKFGKPLGIRTVAVIGGISREDQGFRLRMGCEIVIATPGRLIDVLENRYLVLSRCTYVVLDEADRMIDMGFEPDVQKILEHMPVSNQKPDTDEAEDPEKMLANFESGKHKYRQTVMFTATMPPAVERLARSYLRRPAVVYIGSAGKPHERVEQKVFLMSESEKRKKLLAILEQGFDPPIIIFVNQKKGCDVLAKSLEKMGYNACTLHGGKGQEQREFALSNLKAGAKDILVATDVAGRGIDIQDVSMVVNYDMAKNIEDYIHRIGRTGRAGKSGVAITFLTKEDSAVFYELKQAILESPVSSCPPELANHPDAQHKPGTILTKKRREETIFA

SEQ ID NO: 902206 - protein, 820 aa, Homo sapiens; identical to SEQ ID NO: 902202

SEQ ID NO: 902207 - protein, 304 aa, Homo sapiens
MGCEIVIATPGRLIDVLENRYLVLSRCTYVVLDEADRMIDMGFEPDVQKILEHMPVSNQKPDTDEAEDPEKMLANFESGKHKYRQTVMFTATMPPAVERLARSYLRRPAVVYIGSAGKPHERVEQKVFLMSESEKRKKLLAILEQGFDPPIIIFVNQKKGCDVLAKSLEKMGYNACTLHGGKGQEQREFALSNLKAGAKDILVATDVAGRGIDIQDVSMVVNYDMAKNIEDYIHRIGRTGRAGKSGVAITFLTKEDSAVFYELKQAILESPVSSCPPELANHPDAQHKPGTILTKKRREETIFA

SEQ ID NO: 902208 - protein, 823 aa, Homo sapiens
MAGELADKKDRDASPSKEERKRSRTPDRERDRDRDRKSSPSKDRKRHRSRDRRRGGSRSRSRSRSKSAERERRHKERERDKERDRNKKDRDRDKDGHRRDKDRKRSSLSPGRGKDFKSRKDRDSKKDEEDEHGDKKPKAQPLSLEELLAKKKAEEEAEAKPKFLSKAEREAEALKRRQQEVEERQRMLEEERKKRKQFQDLGRKMLEDPQERERRERRERMERETNGNEDEEGRQKIREEKDKSKELHAIKERYLGGIKKRRRTRHLNDRKFVFEWDASEDTSIDYNPLYKERHQVQLLGRGFIAGIDLKQQKREQSRFYGDLMEKRRTLEEKEQEEARLRKLRKKEAKQRWDDRHWSQKKLDEMTDRDWRIFREDYSITTKGGKIPNPIRSWKDSSLPPHILEVIDKCGYKEPTPIQRQAIPIGLQNRDIIGVAETGSGKTAAFLIPLLVWITTLPKIDRIEESDQGPYAIILAPTRELAQQIEEETIKFGKPLGIRTVAVIGGISREDQGFRLRMGCEIVIATPGRLIDVLENRYLVLSRCTYVVLDEADRMIDMGFEPDVQKILEHMPVSNQKPDTDEAEDPEKMLANFESGKHKYRQTVMFTATMPPAVERLARSYLRRPAVVYIGSAGKPHERVEQKVFLMSESEKRKKLLAILEQGFDPPIIIFVNQKKGCDVLAKSLEKMGYNACTLHGGKGQEQREFALSNLKAGAKDILVATDVAGRGIDIQDVSMVVNYDMAKNIEDYIHRIGRTGRAGKSGVAITFLTKEDSAVFYELKQAILESPVSSCPPELANHPDAQLNRNLAAGWDLLWHRLDCVTA

SEQ ID NO: 902209 - protein, 211 aa, Homo sapiens
MAGELADKKDRDASPSKEERKRSRTPDRERDRDRDRKSSPSKDRKRHRSRDRRRGGSRSRSRSRSKSAERERRHKERERDKERDRNKKDRDRDKDGHRRDKDRKRSSLSPGRGKDFKSRKDRDSKKDEEDEHGDKKPKAQPLSLEELLAKKKAEEEAEAKPKFLSKAEREAEALKRRQQEVEERQRMLEEERKKRKHFLSPRTSQPPRCPA

SEQ ID NO: 902210 - protein, 525 aa, Homo sapiens
MAGELADKKDRDASPSKEERKRSRTPDRERDRDRDRKSSPSKDRKRHRSRDRRRGGSRSRSRSRSKSAERERRHKERERDKERDRNKKDRDRDKDGHRRDKDRKRSSLSPGRGKDFKSRKDRDSKKDEEDEHGDKKPKAQPLSLEELLAKKKAEEEAEAKPKFLSKAEREAEALKRRQQEVEERQRMLEEERKKRKQFQDLGRKMLEDPQERERRERRERMERETNGNEDEEGRQKIREEKDKSKELHAIKERYLGGIKKRRRTRHLNDRKFVFEWDASEDTSIDYNPLYKERHQVQLLGRGFIAGIDLKQQKREQSRFYGDLMEKRRTLEEKEQEEARLRKLRKKEAKQRWDDRHWSQKKLDEMTDRDWRIFREDYSITTKGGKIPNPIRSWKDSSLPPHILEVIDKCGYKEPTPIQRQAIPIGLQNRDIIGVAETGSGKTAAFLIPLLVWITTLPKIDRIEESDQGPYAIILAPTRELAQQIEEETIKFGKPLGIRTVAVIGGISREDQGFRLRMGCEVCFSI

SEQ ID NO: 902211 - protein, 335 aa, Homo sapiens
MAGELADKKDRDASPSKEERKRSRTPDRERDRDRDRKSSPSKDRKRHRSRDRRRGGSRSRSRSRSKSAERERRHKERERDKERDRNKKDRDRDKDGHRRDKDRKRSSLSPGRGKDFKSRKDRDSKKDEEDEHGDKKPKAQPLSLEELLAKKKAEEEAEAKPKFLSKAEREAEALKRRQQEVEERQRMLEEERKKRKQFQDLGRKMLEDPQERERRERRERMERETNGNEDEEGRQKIREEKDKSKELHAIKERYLGGIKKRRRTRHLNDRKFVFEWDASEDTSIDYNPLYKERHQVQLLGRGFIAGIDLKQQKREQSRFYGDLMEKRVHGGTELI

SEQ ID NO: 902212 - protein, 229 aa, Homo sapiens
MAGELADKKDRDASPSKEERKRSRTPDRERDRDRDRKSSPSKDRKRHRSRDRRRGGSRSRSRSRSKSAERERRHKERERDKERDRNKKDRDRDKDGHRRDKDRKRSSLSPGRGKDFKSRKDRDSKKDEEDEHGDKKPKAQPLSLEELLAKKKAEEEAEAKPKFLSKAEREAEALKRRQQEVEERQRMLEEERKKRKQFQDLGRKMLVDPQERARRGRRERIDNRDTPVN

SEQ ID NO: 902213 - protein, 31 aa, Homo sapiens
MTDRDWRIFREDYSITTKGGKIPNPIRSWKD

SEQ ID NO: 902214 - protein, 799 aa, Homo sapiens
LRQGKLRLGARPGGRKSSPSKDRKRHRSRDRRRGGSRSRSRSRSKSAERERRHKERERDKERDRNKKDRDRDKDGHRRDKDRKRSSLSPGRGKDFKSRKDRDSKKDEEDEHGDKKPKAQPLSLEELLAKKKAEEEAEAKPKFLSKAEREAEALKRRQQEVEERQRMLEEERKKRKQFQDLGRKMLEDPQERERRERRERMERETNGNEDEEGRQKIREEKDKSKELHAIKERYLGGIKKRRRTRHLNDRKFVFEWDASEDTSIDYNPLYKERHQVQLLGRGFIAGIDLKQQKREQSRFYGDLMEKRRTLEEKEQEEARLRKLRKKEAKQRWDDRHWSQKKLDEMTDRDWRIFREDYSITTKGGKIPNPIRSWKDSSLPPHILEVIDKCGYKEPTPIQRQAIPIGLQNRDIIGVAETGSGKTAAFLIPLLVWITTLPKIDRIEESDQGPYAIILAPTRELAQQIEEETIKFGKPLGIRTVAVIGGISREDQGFRLRMGCEIVIATPGRLIDVLENRYLVLSRCTYVVLDEADRMIDMGFEPDVQKILEHMPVSNQKPDTDEAEDPEKMLANFESGKHKYRQTVMFTATMPPAVERLARSYLRRPAVVYIGSAGKPHERVEQKVFLMSESEKRKKLLAILEQGFDPPIIIFVNQKKGCDVLAKSLEKMGYNACTLHGGKGQEQREFALSNLKAGAKDILVATDVAGRGIDIQDVSMVVNYDMAKNIEDYIHRIGRTGRAGKSGVAITFLTKEDSAVFYELKQAILESPVSSCPPELANHPDAQHKPGTILTKKRREETIFA

SEQ ID NO: 902215 - protein, 915 aa, Homo sapiens
MAGELADKKDRDASPSKEERKRSRTPDRERDRDRDRKSSPSKDRKRHRSRDRRRGGSRSRSRSRSKSAERERRHKERERDKERDRNKKDRDRDKDGHRRDKDRKRSSLSPGRGKDFKSRKDRDSKKDEEDEHGDKKPKAQPLSLEELLAKKKAEEEAEAKPKFLSKAEREAEALKRRQQEVEERQRMLEEERKKRKQFQDLGRKMLGLLFYPVSAPRWKRKEWDEIQCLLGEKKPVHSGVWKGEGWWEFMRKHFSVRSPFTPYHKSTPFFLHLGFLVWIPSIPSPLFFHELFCSFAFFGAAEDPQERERRERRERMERETNGNEDEEGRQKIREEKDKSKELHAIKERYLGGIKKRRRTRHLNDRKFVFEWDASEDTSIDYNPLYKERHQVQLLGRGFIAGIDLKQQKREQSRFYGDLMEKRRTLEEKEQEEARLRKLRKKEAKQRWDDRHWSQKKLDEMTDRDWRIFREDYSITTKGGKIPNPIRSWKDSSLPPHILEVIDKCGYKEPTPIQRQAIPIGLQNRDIIGVAETGSGKTAAFLIPLLVWITTLPKIDRIEESDQGPYAIILAPTRELAQQIEEETIKFGKPLGIRTVAVIGGISREDQGFRLRMGCEIVIATPGRLIDVLENRYLVLSRCTYVVLDEADRMIDMGFEPDVQKILEHMPVSNQKPDTDEAEDPEKMLANFESGKHKYRQTVMFTATMPPAVERLARSYLRRPAVVYIGSAGKPHERVEQKVFLMSESEKRKKLLAILEQGFDPPIIIFVNQKKGCDVLAKSLEKMGYNACTLHGGKGQEQREFALSNLKAGAKDILVATDVAGRGIDIQDVSMVVNYDMAKNIEDYIHRIGRTGRAGKSGVAITFLTKEDSAVFYELKQAILESPVSSCPPELANHPDAQHKPGTILTKKRREETIFA

SEQ ID NO: 902216 - protein, 820 aa, Homo sapiens; identical to SEQ ID NO: 902202

SEQ ID NO: 902217 - protein, 314 aa, Homo sapiens
GTCWAINDYTATPQIVIATPGRLIDVLENRYLVLSRCTYVVLDEADRMIDMGFEPDVQKILEHMPVSNQKPDTDEAEDPEKMLANFESGKHKYRQTVMFTATMPPAVERLARSYLRRPAVVYIGSAGKPHERVEQKVFLMSESEKRKKLLAILEQGFDPPIIIFVNQKKGCDVLAKSLEKMGYNACTLHGGKGQEQREFALSNLKAGAKDILVATDVAGRGIDIQDVSMVVNYDMAKNIEDYIHRIGRTGRAGKSGVAITFLTKEDSAVFYELKQAILESPVSSCPPELANHPDAQHKPGTILTKKRREETIFA

SEQ ID NO: 902218 - protein, 823 aa, Homo sapiens; identical to SEQ ID NO: 902208

SEQ ID NO: 902219 - protein, 697 aa, Homo sapiens
MAGELADKKDRDASPSKEERKRSRTPDRERDRDRDRKSSPSKDRKRHRSRDRRRGGSRSRSRSRSKSAERERRHKERERDKERDRNKKDRDRDKDGHRRDKDRKRSSLSPGRGKDFKSRKDRDSKKDEEDEHGDKKPKAQPLSLEELLAKKKAEEEAEAKPKFLSKAEREAEALKRRQQEVEERQRMLEEERKKRKQFQDLGRKMLEDPQERERRERRERMERETNGNEDEEGRQKIREEKDKSKELHAIKERYLGGIKKRRRTRHLNDRKFVFEWDASEDTSIDYNPLYKERHQVQLLGRGFIAGIDLKQQKREQSRFYGDLMEKRRTLEEKEQEEARLRKLRKKEAKQRWDDRHWSQKKLDEMTDRDWRIFREDYSITTKGGKIPNPIRSWKDSSLPPHILEVIDKCGYKEPTPIQRQAIPIGLQNRDIIGVAETGSGKTAAFLIPLLVWITTLPKIDRIEESDQGPYAIILAPTRELAQQIEEETIKFGKPLGIRTVAVIGGISREDQGFRLRMGCEIVIATPGRLIDVLENRYLVLSRCTYVVLDEADRMIDMGFEPDVQKILEHMPVSNQKPDTDEAEDPEKMLANFESGKHKYRQTVMFTATMPPAVERLARSYLRRPAVVYIGSAGKPHERVEQKVFLMSESEKRKKLLAILEQGFDPPIIIFVNQKKGCDVLAKSLEKMGVCLAGENKV

SEQ ID NO: 902220 - protein, 684 aa, Homo sapiens
MAGELADKKDRDASPSKEERKRSRTPDRERDRDRDRKSSPSKDRKRHRSRDRRRGGSRSRSRSRSKSAERERRHKERERDKERDRNKKDRDRDKDGHRRDKDRKRSSLSPGRGKDFKSRKDRDSKKDEEDEHGDKKPKAQPLSLEELLAKKKAEEEAEAKPKFLSKAEREAEALKRRQQEVEERQRMLEEERKKRKQFQDLGRKMLEDPQERERRERRERMERETNGNEDEEGRQKIREEKDKSKELHAIKERYLGGIKKRRRTRHLNDRKFVFEWDASEDTSIDYNPLYKERHQVQLLGRGFIAGIDLKQQKREQSRFYGDLMEKRRTLEEKEQEEARLRKLRKKEAKQRWDDRHWSQKKLDEMTDRDWRIFREDYSITTKGGKIPNPIRSWKDSSLPPHILEVIDKCGYKEPTPIQRQAIPIGLQNRDIIGVAETGSGKTAAFLIPLLVWITTLPKIDRLECSGVILAYSNRCLPGSYPPTSASQVAVDYRIEESDQGPYAIILAPTRELAQQIEEETIKFGKPLGIRTVAVIGGISREDQGFRLRMGCEIVIATPGRLIDVLENRYLVLSRCTYVVLDEADRMIDMGFEPDVQKILEHMPVSNQKPDTDEAEDPEKMLANFESGKHKYRQTVMFTATMAQGGSVGQEYLRELAGGTWVRREPSGVDKSSPWGAKGERGGLG

SEQ ID NO: 902221 - protein, 90 aa, Homo sapiens
ERETNGNEDEEGRQKIREEKDKSKELHAIKVQALAPSSLLSHTKMRFSYLAIVISACENWASKLMCFVFCPWVGALPGWHQKAAPNETSQ

SEQ ID NO: 902222 - protein, 160 aa, Homo sapiens
MDKLKKVLSGQDTEDRSGLSEVVEASSLSWSTRIKGFIACFAIGILCSLLGTVLLWVPRKGLHLFAVFYTFGNIASIGSTIFLMGPVKQLKRMFEPTRLIATIMVLLCFALTLCSAFWWHNKGLALIFCILQSLALTWYSLSFIPFARDAVKKCFAVCLA

SEQ ID NO: 902223 - protein, 107 aa, Homo sapiens
RWAGAWAGRAAVGAWAAGRLPSTRKSRQLSERNRLPLRSWSWWGLGRNGQAEEGAERAGHGGPERPVRDKPCQSHYHSSSYEQARPILLPLFSSHLQLVLFAPWQGC

SEQ ID NO: 902224 - protein, 108 aa, Homo sapiens
MDKLKKVLSGQDTEDRSGLSEVVEASSLSWSTRIKGFIACFAIGILCSLLGTVLLWVPRKGLHLFAVFYTFGNIASIGSCVLHLPCVLPFGGITRDLHLSSAFCSLWH

SEQ ID NO: 902225 - protein, 160 aa, Homo sapiens; identical to SEQ ID NO: 902222

SEQ ID NO: 902226 - protein, 756 aa, Homo sapiens
GRGPAARALLGGGCCDGEAAAEPEPRSLSHLRHLGPGPHRAGAAKAMSVPSSLSQSAINANSHGGPALSLPLPLHAAHNQLLNAKLQATAVGPKDLRSAMGEGGGPEPGPANAKWLKEGQNQLRRAATAHRDQNRNVTLTLAEEASQEPEMAPLGPKGLIHLYSELELSAHNAANRGLRGPGLIISTQEQGPDEGEEKAAGEAEEEEEDDDDEEEEEDLSSPPGLPEPLESVEAPPRPQALTDGPREHSKSASLLFGMRNSAASDEDSSWATLSQGSPSYGSPEDTDSFWNPNAFETDSDLPAGWMRVQDTSGTYYWHIPTGTTQWEPPGRASPSQGSSPQEESQLTWTGFAHGEGFEDGEFWKDEPSDEAPMELGLKEPEEGTLTFPAQSLSPEPLPQEEEKLPPRNTNPGIKCFAVRSLGWVEMTEEELAPGRSSVAVNNCIRQLSYHKNNLHDPMSGGWGEGKDLLLQLEDETLKLVEPQSQALLHAQPIISIRVWGVGRDSGRERDFAYVARDKLTQMLKCHVFRCEAPAKNIATSLHEICSKIMAERRNARCLVNGLSLDHSKLVDVPFQVEFPAPKNELVQKFQVYYLGNVPVAKPVGVDVINGALESVLSSSSREQWTPSHVSVAPATLTILHQQTEAVLGECRVRFLSFLAVGRDVHTFAFIMAAGPASFCCHMFWCEPNAASLSEAVQAACMLRYQKCLDARSQASTSCLPAPPAESVARRVGWTVRRGVQSLWGSLKPKRLGAHTP

SEQ ID NO: 902227 - protein, 311 aa, Homo sapiens
GRGPAARALLGGGCCDGEAAAEPEPRSLSHLRHLGPGPHRAGAAKAMSVPSSLSQSAINANSHGGPALSLPLPLHAAHNQLLNAKLQATAVGPKDLRSAMGEGGGPEPGPANAKWLKEGQNQLRRAATAHRDQNRNVTLTLAEEASQEPEMAPLGPKGLIHLYSELELSAHNAANRGLRGPGLIISTQEQGPDEGEEKAAGEAEEEEEDDDDEEEEEDLSSPPGLPEPLESVEAPPRPQALTDGPREHSKSASLLFGMRNSAASDEDSSWATLSQGSLRSHTTFSSEPSFRRSTAADDEVRPHDYYGLPRT

SEQ ID NO: 902228 - protein, 887 aa, Homo sapiens
GRGPAARALLGGGCCDGEAAAEPEPRSLSHLRHLGPGPHRAGAAKAMSVPSSLSQSAINANSHGGPALSLPLPLHAAHNQLLNAKLQATAVGPKDLRSAMGEGGGPEPGPANAKWLKEGQNQLRRAATAHRDQNRNVTLTLAEEASQEPEMAPLGPKGLIHLYSELELSAHNAANRGLRGPGLIISTQEQGPDEGEEKAAGEAEEEEEDDDDEEEEEDLSSPPGLPEPLESVEAPPRPQALTDGPREHSKSASLLFGMRNSAASDEDSSWATLSQGSPSYGSPEDTDSFWNPNAFETDSDLPAGWMRVQDTSGTYYWHIPTGTTQWEPPGRASPSQGSSPQEESQLTWTGFAHGEGFEDGEFWKDEPSDEAPMELGLKEPEEGTLTFPAQSLSPEPLPQEEEKLPPRNTNPGIKCFAVRSLGWVEMTEEELAPGRSSVAVNNCIRQLSYHKNNLHDPMSGGWGEGKDLLLQLEDETLKLVEPQSQALLHAQPIISIRVWGVGRDSGRERWERAWDSRVGVHPASESSSLTLLFASLVLLDPERGTMPIFPLLHLDQMPGSTQAPLFCPAPSPPAMLHHYPPPQHACLSTPPPQEGSTYGGPAVGRSPGGAVMGREDVGGVGTRLSTGWYWETLRCPFPNRDFAYVARDKLTQMLKCHVFRCEAPAKNIATSLHEICSKIMAERRNARCLVNGLSLDHSKLVDVPFQVEFPAPKNELVQKFQVYYLGNVPVAKPVGVDVINGALESVLSSSSREQWTPSHVSVAPATLTILHQQTEAVLGECRVRFLSFLAVGRDVHTFAFIMAAGPASFCCHMFWCEPNAASLSEAVQAACMLRYQKCLDARSQASTSCLPAPPAESVARRVGWTVRRGVQSLWGSLKPKRLGAHTP

SEQ ID NO: 902229 - protein, 512 aa, Homo sapiens
RVPPGNPSPRGRGAAQPPPFGLQPRPRVSRRGCGTRALRGAQDSFWNPNAFETDSDLPAGWMRVQDTSGTYYWHIPTGTTQWEPPGRASPSQGSSPQEESQLTWTGFAHGEGFEDGEFWKDEPSDEAPMELGLKEPEEGTLTFPAQSLSPEPLPQEEEKLPPRNTNPGIKCFAVRSLGWVEMTEEELAPGRSSVAVNNCIRQLSYHKNNLHDPMSGGWGEGKDLLLQLEDETLKLVEPQSQALLHAQPIISIRVWGVGRDSGRERDFAYVARDKLTQMLKCHVFRCEAPAKNIATSLHEICSKIMAERRNARCLVNGLSLDHSKLVDVPFQVEFPAPKNELVQKFQVYYLGNVPVAKPVGVDVINGALESVLSSSSREQWTPSHVSVAPATLTILHQQTEAVLGECRVRFLSFLAVGRDVHTFAFIMAAGPASFCCHMFWCEPNAASLSEAVQAACMLRYQKCLDARSQASTSCLPAPPAESVARRVGWTVRRGVQSLWGSLKPKRLGAHTP

SEQ ID NO: 902230 - protein, 487 aa, Homo sapiens
MFSQDFFLAIILQDSSADSFWNPNAFETDSDLPAGWMRVQDTSGTYYWHIPTGTTQWEPPGRASPSQGSSPQEESQLTWTGFAHGEGFEDGEFWKDEPSDEAPMELGLKEPEEGTLTFPAQSLSPEPLPQEEEKLPPRNTNPGIKCFAVRSLGWVEMTEEELAPGRSSVAVNNCIRQLSYHKNNLHDPMSGGWGEGKDLLLQLEDETLKLVEPQSQALLHAQPIISIRVWGVGRDSGRERDFAYVARDKLTQMLKCHVFRCEAPAKNIATSLHEICSKIMAERRNARCLVNGLSLDHSKLVDVPFQVEFPAPKNELVQKFQVYYLGNVPVAKPVGVDVINGALESVLSSSSREQWTPSHVSVAPATLTILHQQTEAVLGECRVRFLSFLAVGRDVHTFAFIMAAGPASFCCHMFWCEPNAASLSEAVQAACMLRYQKCLDARSQASTSCLPAPPAESVARRVGWTVRRGVQSLWGSLKPKRLGAHTP

SEQ ID NO: 902231 - protein, 306 aa, Homo sapiens
APCLTTTSRKGAPILHGADQHLEDETLKLVEPQSQALLHAQPIISIRVWGVGRDSGRERDFAYVARDKLTQMLKCHVFRCEAPAKNIATSLHEICSKIMAERRNARCLVNGLSLDHSKLVDVPFQVEFPAPKNELVQKFQVYYLGNVPVAKPVGVDVINGALESVLSSSSREQWTPSHVSVAPATLTILHQQTEAVLGECRVRFLSFLAVGRDVHTFAFIMAAGPASFCCHMFWCEPNAASLSEAVQAACMLRYQKCLDARSQASTSCLPAPPAESVARRVGWTVRRGVQSLWGSLKPKRLGAHTP

SEQ ID NO: 902232 - protein, 190 aa, Homo sapiens [sequence omitted]

SEQ ID NO: 902233 - protein, 573 aa, Homo sapiens
GRGPAARALLGGGCCDGEAAAEPEPRSLSHLRHLGPGPHRAGAAKAMSVPSSLSQSAINANSHGGPALSLPLPLHAAHNQLLNAKLQATAVGPKDLRSAMGEGGGPEPGPANAKWLKEGQNQLRRAATAHRDQNRNVTLTLAEEASQEPEMAPLGPKGLIHLYSELELSAHNAANRGLRGPGLIISTQEQGPDEGEEKAAGEAEEEEEDDDDEEEEEDLSSPPGLPEPLESVEAPPRPQALTDGPREHSKSASLLFGMRNSAASDEDSSWATLSQGSPSYGSPEDTDSFWNPNAFETDSDLPAGWMRVQDTSGTYYWHIPTGTTQWEPPGRASPSQGSSPQEESQLTWTGFAHGEGFEDGEFWKDEPSDEAPMELGLKEPEEGTLTFPAQSLSPEPLPQEEEKLPPRNTNPGIKCFAVRSLGWVEMTEEELAPGRSSVAVNNCIRQLSYHKNNLHDPMSGGWGEGKDLLLQLEDETLKLVEPQSQALLHAQPIISIRVWGVGRDSGRERDFAYVARDKLTQMLKCHVFRCEAPAKNIATSLHEICSKIMAERRNARCLGINFTHSTCYDQDFR

SEQ ID NO: 902234 - protein, 757 aa, Homo sapiens
RVPPGNPSPRGRGAAQPPPFGLQPRPRVSRRGCGTRALRGAQGAAKAMSVPSSLSQSAINANSHGGPALSLPLPLHAAHNQLLNAKLQATAVGPKDLRSAMGEGGGPEPGPANAKWLKEGQNQLRRAATAHRDQNRNVTLTLAEEASQEPEMAPLGPKGLIHLYSELELSAHNAANRGLRGPGLIISTQEQGPDEGEEKAAGEAEEEEEDDDDEEEEEDLSSPPGLPEPLESVEAPPRPQALTDGPREHSKSASLLFGMRNSAASDEDSSWATLSQGSPSYGSPEDTDSFWNPNAFETDSDLPAGWMRVQDTSGTYYWHIPTGTTQWEPPGRASPSQGSSPQEESQLTWTGFAHGEGFEDGEFWKDEPSDEAPMELGLKEPEEGTLTFPAQSLSPEPLPQEEEKLPPRNTNPGIKCFAVRSLGWVEMTEEELAPGRSSVAVNNCIRQLSYHKNNLHDPMSGGWGEGKDLLLQLEDETLKLVEPQSQALLHAQPIISIRVWGVGRDSGRERDFAYVARDKLTQMLKCHVFRCEAPAKNIATSLHEICSKIMAERRNARCLVNGLSLDHSKLVDVPFQVEFPAPKNELVQKFQVYYLGNVPVAKPVGVDVINGALESVLSSSSREQWTPSHVSVAPATLTILHQQTEAVLGECRVRFLSFLAVGRDVHTFAFIMAAGPASFCCHMFWCEPNAASLSEAVQAACMLRYQKCLDARSQASTSCLPAPPAESVARRVGWTVRRGVQSLWGSLKPKRLGAHTP

SEQ ID NO: 902235 - protein, 496 aa, Homo sapiens
SGVWALPAGPGAAVAEETLQPSWALADSFWNPNAFETDSDLPAGWMRVQDTSGTYYWHIPTGTTQWEPPGRASPSQGSSPQEESQLTWTGFAHGEGFEDGEFWKDEPSDEAPMELGLKEPEEGTLTFPAQSLSPEPLPQEEEKLPPRNTNPGIKCFAVRSLGWVEMTEEELAPGRSSVAVNNCIRQLSYHKNNLHDPMSGGWGEGKDLLLQLEDETLKLVEPQSQALLHAQPIISIRVWGVGRDSGRERDFAYVARDKLTQMLKCHVFRCEAPAKNIATSLHEICSKIMAERRNARCLVNGLSLDHSKLVDVPFQVEFPAPKNELVQKFQVYYLGNVPVAKPVGVDVINGALESVLSSSSREQWTPSHVSVAPATLTILHQQTEAVLGECRVRFLSFLAVGRDVHTFAFIMAAGPASFCCHMFWCEPNAASLSEAVQAACMLRYQKCLDARSQASTSCLPAPPAESVARRVGWTVRRGVQSLWGSLKPKRLGAHTP

SEQ ID NO: 902236 - protein, 511 aa, Homo sapiens
GRGPAARALLGGGCCDGEAAAEPEPRSLSHLRHLGPGPHRADSFWNPNAFETDSDLPAGWMRVQDTSGTYYWHIPTGTTQWEPPGRASPSQGSSPQEESQLTWTGFAHGEGFEDGEFWKDEPSDEAPMELGLKEPEEGTLTFPAQSLSPEPLPQEEEKLPPRNTNPGIKCFAVRSLGWVEMTEEELAPGRSSVAVNNCIRQLSYHKNNLHDPMSGGWGEGKDLLLQLEDETLKLVEPQSQALLHAQPIISIRVWGVGRDSGRERDFAYVARDKLTQMLKCHVFRCEAPAKNIATSLHEICSKIMAERRNARCLVNGLSLDHSKLVDVPFQVEFPAPKNELVQKFQVYYLGNVPVAKPVGVDVINGALESVLSSSSREQWTPSHVSVAPATLTILHQQTEAVLGECRVRFLSFLAVGRDVHTFAFIMAAGPASFCCHMFWCEPNAASLSEAVQAACMLRYQKCLDARSQASTSCLPAPPAESVARRVGWTVRRGVQSLWGSLKPKRLGAHTP

SEQ ID NO: 902237 - protein, 478 aa, Homo sapiens
QGCMTQMRDSFWNPNAFETDSDLPAGWMRVQDTSGTYYWHIPTGTTQWEPPGRASPSQGSSPQEESQLTWTGFAHGEGFEDGEFWKDEPSDEAPMELGLKEPEEGTLTFPAQSLSPEPLPQEEEKLPPRNTNPGIKCFAVRSLGWVEMTEEELAPGRSSVAVNNCIRQLSYHKNNLHDPMSGGWGEGKDLLLQLEDETLKLVEPQSQALLHAQPIISIRVWGVGRDSGRERDFAYVARDKLTQMLKCHVFRCEAPAKNIATSLHEICSKIMAERRNARCLVNGLSLDHSKLVDVPFQVEFPAPKNELVQKFQVYYLGNVPVAKPVGVDVINGALESVLSSSSREQWTPSHVSVAPATLTILHQQTEAVLGECRVRFLSFLAVGRDVHTFAFIMAAGPASFCCHMFWCEPNAASLSEAVQAACMLRYQKCLDARSQASTSCLPAPPAESVARRVGWTVRRGVQSLWGSLKPKRLGAHTP

SEQ ID NO: 902238 - protein, 725 aa, Homo sapiens
GRGPAARALLGGGCCDGEAAAEPEPRSLSHLRHLGPGPHRAGAAKAMSVPSSLSQSAINANSHGGPALSLPLPLHAAHNQLLNAKLQATAVGPKDLRSAMGEGGGPEPGPANAKWLKEGQNQLRRAATAHRDQNRNVTLTLAEEASQEPEMAPLGPKGLIHLYSELELSAHNAANRGLRGPGLIISTQEQGPDEGEEKAAGEAEEEEEDDDDEEEEEDLSSPPGLPEPLESVEAPPRPQALTDGPREHSKSASLLFGMRNSAASDEDSSWATLSQGSPSYGSPEDTDSFWNPNAFETDSDLPAGWMRVQDTSGTYYWHIPTGTTQWEPPGRASPSQGSSPQEESQLTWTGFAHGEGFEDGEFWKDEPSDEAPMELGLKEPEEGTLTFPAQSLSPEPLPQEEEKLPPRNTNPGIKCFAVRSLGWVEMTEEELAPGRSSVAVNNCIRQLSYHKNNLHDPMSGGWGEGKDLLLQLEDETLKLVEPQSQALLHAQPIISIRVWGVGRDSGRERDFAYVARDKLTQMLKCHVFRCEAPAKNIATSLHEICSKIMAERRNARCLVNGLSLDHSKLVDVPFQVEFPAPKNELVQKFQVYYLGNVPVAKPVGVDVINGALESVLSSSSREQWTPSHVSVAPATLTILHQQTEAVLGECRVRFLSFLAVGRDVHTFAFIMAAGPASFCCHMFWCEPNAASLSEAVQAACMLRYQKCLDARSQASKAVVGRVLTV

SEQ ID NO: 902239 - protein, 367 aa, Homo sapiens
GRGPAARALLGGGCCDGEAAAEPEPRSLSHLRHLGPGPHRAGAAKAMSVPSSLSQSAINANSHGGPALSLPLPLHAAHNQLLNAKLQATAVGPKDLRSAMGEGGGPEPGPANAKWLKEGQNQLRRAATAHRDQNRNVTLTLAEEASQEPEMAPLGPKGLIHLYSELELSAHNAANRGLRGPGLIISTQEQGPDEGEEKAAGEAEEEEEDDDDEEEEEDLSSPPGLPEPLESVEAPPRPQALTDGPREHSKSASLLFGMRNSAASDEDSSWATLSQGSPSYGSPEDTDSFWNPNAFETDSDLPAGWMRVQDTSGTYYWHIPTGTTQWEPPGRASPSQGSSPQEESQLTWTGFAHGEGFEDGEFWKGEI

SEQ ID NO: 902240 - protein, 577 aa, Homo sapiens
MLGFPPGRPQLPVQLRPQTRMATALRDPASVPIATEVLFKLTQGSVTFEDVAVYFSWEEWDLLDEAQKHLYFDVMLENFALTSSLGCWCGVEHEETPSEQRISGERVPQFRTSKEGSSSQNADSCEICCLVLRDILHLAEHQGTNCGQKLHTCGKQFYISANLQQHQRQHITEAPFRSYVDTASFTQSCIVHVSEKPFTCREIRKDFLANMRFLHQDATQTGEKPNNSNKCAVAFYSGKSHHNWGKCSKAFSHIDTLVQDQRILTREGLFECSKCGKACTRRCNLIQHQKVHSEERPYECNECGKFFTYYSSFIIHQRVHTGERPYACPECGKSFSQIYSLNSHRKVHTGERPYECGECGKSFSQRSNLMQHRRVHTGERPYECSECGKSFSQNFSLIYHQRVHTGERPHECNECGKSFSRSSSLIHHRRLHTGERPYECSKCGKSFKQSSSFSSHRKVHTGERPYVCGECGKSFSHSSNLKNHQRVHTGERPVECSECSKSFSCKSNLIKHLRVHTGERPYECSECGKSFSQSSSLIQHRRVHTGKRPYQCSQCGKSFGCKSVLIQHQRVHIGEKP

SEQ ID NO: 902241 - protein, 629 aa, Homo sapiens
MLGFPPGRPQLPVQLRPQTRMATALRDPASVPIATEVLFKLTQGSVTFEDVAVYFSWEEWDLLDEAQKHLYFDVMLENFALTSSLGLISSWSHVVAQLGLGEVPSVLHRMFMTPASARWDQRGPGLHEWHLGKGMSSGCWCGVEHEETPSEQRISGERVPQFRTSKEGSSSQNADSCEICCLVLRDILHLAEHQGTNCGQKLHTCGKQFYISANLQQHQRQHITEAPFRSYVDTASFTQSCIVHVSEKPFTCREIRKDFLANMRFLHQDATQTGEKPNNSNKCAVAFYSGKSHHNWGKCSKAFSHIDTLVQDQRILTREGLFECSKCGKACTRRCNLIQHQKVHSEERPYECNECGKFFTYYSSFIIHQRVHTGERPYACPECGKSFSQIYSLNSHRKVHTGERPYECGECGKSFSQRSNLMQHRRVHTGERPYECSECGKSFSQNFSLIYHQRVHTGERPHECNECGKSFSRSSSLIHHRRLHTGERPYECSKCGKSFKQSSSFSSHRKVHTGERPYVCGECGKSFSHSSNLKNHQRVHTGERPVECSECSKSFSCKSNLIKHLRVHTGERPYECSECGKSFSQSSSLIQHRRVHTGKRPYQCSQCGKSFGCKSVLIQHQRVHIGEKP

SEQ ID NO: 902242 - protein, 564 aa, Homo sapiens
MLGFPPGRPQLPVQLRPQTRMATALRDPASGSVTFEDVAVYFSWEEWDLLDEAQKHLYFDVMLENFALTSSLGCWCGVEHEETPSEQRISGERVPQFRTSKEGSSSQNADSCEICCLVLRDILHLAEHQGTNCGQKLHTCGKQFYISANLQQHQRQHITEAPFRSYVDTASFTQSCIVHVSEKPFTCREIRKDFLANMRFLHQDATQTGEKPNNSNKCAVAFYSGKSHHNWGKCSKAFSHIDTLVQDQRILTREGLFECSKCGKACTRRCNLIQHQKVHSEERPYECNECGKFFTYYSSFIIHQRVHTGERPYACPECGKSFSQIYSLNSHRKVHTGERPYECGECGKSFSQRSNLMQHRRVHTGERPYECSECGKSFSQNFSLIYHQRVHTGERPHECNECGKSFSRSSSLIHHRRLHTGERPYECSKCGKSFKQSSSFSSHRKVHTGERPYVCGECGKSFSHSSNLKNHQRVHTGERPVECSECSKSFSCKSNLIKHLRVHTGERPYECSECGKSFSQSSSLIQHRRVHTGKRPYQCSQCGKSFGCKSVLIQHQRVHIGEKP

SEQ ID NO: 902243 - protein, 628 aa, Homo sapiens
MRTLRQREVEYFSKATQLVRGSTKDRGAQVPIATEVLFKLTQGSVTFEDVAVYFSWEEWDLLDEAQKHLYFDVMLENFALTSSLGLISSWSHVVAQLGLGEVPSVLHRMFMTPASARWDQRGPGLHEWHLGKGMSSGCWCGVEHEETPSEQRISGERVPQFRTSKEGSSSQNADSCEICCLVLRDILHLAEHQGTNCGQKLHTCGKQFYISANLQQHQRQHITEAPFRSYVDTASFTQSCIVHVSEKPFTCREIRKDFLANMRFLHQDATQTGEKPNNSNKCAVAFYSGKSHHNWGKCSKAFSHIDTLVQDQRILTREGLFECSKCGKACTRRCNLIQHQKVHSEERPYECNECGKFFTYYSSFIIHQRVHTGERPYACPECGKSFSQIYSLNSHRKVHTGERPYECGECGKSFSQRSNLMQHRRVHTGERPYECSECGKSFSQNFSLIYHQRVHTGERPHECNECGKSFSRSSSLIHHRRLHTGERPYECSKCGKSFKQSSSFSSHRKVHTGERPYVCGECGKSFSHSSNLKNHQRVHTGERPVECSECSKSFSCKSNLIKHLRVHTGERPYECSECGKSFSQSSSLIQHRRVHTGKRPYQCSQCGKSFGCKSVLIQHQRVHIGEKP

SEQ ID NO: 902244 - protein, 333 aa, Homo sapiens
MSGDEMIFDPTMSKKKKKKKKPFMLDEEGDTQTEETQPSETKEVEPEPTEDKDLEADEEDTRKKDASDDLDDLNFFNQKKKKKKTKKIFDIDEAEEGVKDLKIESDVQEPTEPEDDLDIMLGNKKKKKKNVKFPDEDEILEKDEALEDEDNKKDDGISFSNQTGPAWAGSERDYTYEELLNRVFNIMREKNPDMVAGEKRKFVMKPPQVVRVGTKKTSFVNFTDICKLLHRQPKHLLAFLLAELGTSGSIDGNNQLVIKGRFQQKQIENVLRRYIKEYVTCHTCRSPDTILQKDTRLYFLQCETCHSRCSVASIKTGFQAVTGKRAQLRAKAN

SEQ ID NO: 902245 - protein, 333 aa, Homo sapiens; identical to SEQ ID NO: 902244

SEQ ID NO: 902246 - protein, 166 aa, Homo sapiens
MTLGETMLRDDATMILSFFNPARRKTTGRRLIFDIDEAEEGVKDLKIESDVQEPTEPEDDLDIMLGNKKKKKKNVKFPDEDEILEKDEALEDEDNKKDDGISFSNQTGPAWAGSERDYTYEELLNRVFNIMRGRSQAARGNEKEKDGTTDSGIKLEPVPGLPGALP

SEQ ID NO: 902247 - protein, 328 aa, Homo sapiens
MIFDPTMSKKKKKKKKPFMLDEEGDTQTEETQPSETKEVEPEPTEDKDLEADEEDTRKKDASDDLDDLNFFNQKKKKKKTKKIFDIDEAEEGVKDLKIESDVQEPTEPEDDLDIMLGNKKKKKKNVKFPDEDEILEKDEALEDEDNKKDDGISFSNQTGPAWAGSERDYTYEELLNRVFNIMREKNPDMVAGEKRKFVMKPPQVVRVGTKKTSFVNFTDICKLLHRQPKHLLAFLLAELGTSGSIDGNNQLVIKGRFQQKQIENVLRRYIKEYVTCHTCRSPDTILQKDTRLYFLQCETCHSRCSVASIKTGFQAVTGKRAQLRAKAN

SEQ ID NO: 902248 - protein, 303 aa, Homo sapiens
MPPKSLRPSETKEVEPEPTEDKDLEADEEDTRKKDASDDLDDLNFFNQKKKKKKTKKIFDIDEAEEGVKDLKIESDVQEPTEPEDDLDIMLGNKKKKKKNVKFPDEDEILEKDEALEDEDNKKDDGISFSNQTGPAWAGSERDYTYEELLNRVFNIMREKNPDMVAGEKRKFVMKPPQVVRVGTKKTSFVNFTDICKLLHRQPKHLLAFLLAELGTSGSIDGNNQLVIKGRFQQKQIENVLRRYIKEYVTCHTCRSPDTILQKDTRLYFLQCETCHSRCSVASIKTGFQAVTGKRAQLRAKAN

SEQ ID NO: 902249 - protein, 214 aa, Homo sapiens [sequence omitted]

SEQ ID NO: 902250 - protein, 333 aa, Homo sapiens; identical to SEQ ID NO: 902244

SEQ ID NO: 902251 - protein, 262 aa, Homo sapiens
RVSPYQIINLDTSDIQFLEDAGNNVEVDESLFQEMDDLELENDETVQTTLKFTTVKNTQMKLPFMKYSPRKDEALEDEDNKKDDGISFSNQTGPAWAGSERDYTYEELLNRVFNIMREKNPDMVAGEKRKFVMKPPQVVRVGTKKTSFVNFTDICKLLHRQPKHLLAFLLAELGTSGSIDGNNQLVIKGRFQQKQIENVLRRYIKEYVTCHTCRSPDTILQKDTRLYFLQCETCHSRCSVASIKTGFQAVTGKRAQLRAKAN

SEQ ID NO: 902252 - protein, 147 aa, Homo sapiens
MREKNPDMVAGEKRKFVMKPPQVVRVGTKKTSFVNFTDICKLLHRQPKHLLAFLLAELGTSGSIDGNNQLVIKGRFQQKQIENVLRRYIKEYVTCHTCRSPDTILQKDTRLYFLQCETCHSRCSVASIKTGFQAVTGKRAQLRAKAN

SEQ ID NO: 902253 - protein, 333 aa, Homo sapiens; identical to SEQ ID NO: 902244

SEQ ID NO: 902254 - protein, 280 aa, Homo sapiens
MSGDEMIFDPTMSKKKKKKKKPFMLDEEGDTQTEETQPSETKEVEPEPTEDKDLEADEEDTRKKDASDDLDDLNFFNQKKKKKKTKKIFDIDEAEEGVKDLKIESDVQEPTEPEDDLDIMLGNKKKKKKNVKFPDEDEILEKDEALEDEDNKKDDGISFSNQTGPAWAGSERDYTYEELLNRVFNIMREKNPDMVAGEKRKFVMKPPQVVRVGTKKTSFVNFTDICKLLHRQPKHLLAFLLAELGTSYRWYNQLSRKIHRTDEMLGNYRIALPSVRTSEK

SEQ ID NO: 902255 - protein, 67 aa, Homo sapiens
VILCVALFAEEYVTCHTCRSPDTILQKDTRLYFLQCETCHSRCSVASIKTGFQAVTGKRAQLRAKAN

SEQ ID NO: 902256 - protein, 309 aa, Homo sapiens
GTREEDTRKKDASPSETKEVEPEPTEDKDLEADEEDTRKKDASDDLDDLNFFNQKKKKKKTKKIFDIDEAEEGVKDLKIESDVQEPTEPEDDLDIMLGNKKKKKKNVKFPDEDEILEKDEALEDEDNKKDDGISFSNQTGPAWAGSERDYTYEELLNRVFNIMREKNPDMVAGEKRKFVMKPPQVVRVGTKKTSFVNFTDICKLLHRQPKHLLAFLLAELGTSGSIDGNNQLVIKGRFQQKQIENVLRRYIKEYVTCHTCRSPDTILQKDTRLYFLQCETCHSRCSVASIKTGFQAVTGKRAQLRAKAN

SEQ ID NO: 902257 - protein, 131 aa, Homo sapiens
FLVPTRTTCGGFMTTSFVNLTDICKLLHRQPKHLLAFLLAELGTSGSIDGNNQLVIKGRFQQKQIENVLRRYIKEYVTCHTCRSPDTILQKDTRLYFLQCETCHSRCSVASIKTGFQAVTGKRAQLRAKAN

SEQ ID NO: 902258 - protein, 328 aa, Homo sapiens; identical to SEQ ID NO: 902247

SEQ ID NO: 902259 - protein, 341 aa, Homo sapiens
MSGDEMIFDPTMSKKKKKKKKPFMLDEEGDTQTEETQPSETKEVEPEPTEDKDLEADEEDTRKKDASDDLDDLNFFNQKKKKKKTKKIFDIDEAEEGVKVVLLSCVKDLKIESDVQEPTEPEDDLDIMLGNKKKKKKNVKFPDEDEILEKDEALEDEDNKKDDGISFSNQTGPAWAGSERDYTYEELLNRVFNIMREKNPDMVAGEKRKFVMKPPQVVRVGTKKTSFVNFTDICKLLHRQPKHLLAFLLAELGTSGSIDGNNQLVIKGRFQQKQIENVLRRYIKEYVTCHTCRSPDTILQKDTRLYFLQCETCHSRCSVASIKTGFQAVTGKRAQLRAKAN

SEQ ID NO: 902260 - protein, 249 aa, Homo sapiens
LKKVKRILRLKVMFKVILWFSWFLNITFNLKILDIMLGNKKKKKKNVKFPDEDEILEKDEALEDEDNKKDDGISFSNQTGPAWAGSERDYTYEELLNRVFNIMREKNPDMVAGEKRKFVMKPPQVVRVGTKKTSFVNFTDICKLLHRQPKHLLAFLLAELGTSGSIDGNNQLVIKGRFQQKQIENVLRRYIKEYVTCHTCRSPDTILQKDTRLYFLQCETCHSRCSVASIKTGFQAVTGKRAQLRAKAN

SEQ ID NO: 902261 - protein, 333 aa, Homo sapiens; identical to SEQ ID NO: 902244

SEQ ID NO: 902262 - protein, 314 aa, Homo sapiens
MSGDEMIFDPTMSKKKKKKKKPFMLDEEGDTQTEETQPSETKEVEPEPTEDKDLEADEEDTRKKDASDDLDDLNFFNQKKKKKKTKKIFDIDEAEEGVKDLKIESDVQEPTEPEDDLDIMLGNKKKKKKNVKFPDEDEILEKDEALEDEDNKKDDGISFSNQTGPAWAGSERDYTYEELLNRVFNIMREKNPDMVAGEKRKFVMKPPQVVRVGTKKTSFVNFTDICKLGSIDGNNQLVIKGRFQQKQIENVLRRYIKEYVTCHTCRSPDTILQKDTRLYFLQCETCHSRCSVASIKTGFQAVTGKRAQLRAKAN

SEQ ID NO: 902263 - protein, 333 aa, Homo sapiens; identical to SEQ ID NO: 902244

SEQ ID NO: 902264 - protein, 291 aa, Homo sapiens
MSGDEMIFDPTMSKKKKKKKKPFMLDEEGDTQTEETQPSETKEVEPEPTEDKDLEADEEDTRKKDASDDLDDLNFFNQKKKKKKTKKIFDIDEAEEGVKDLKIESDVQEPTEPEDDLDIMLGNKKKKKKNVKFPDEDEILEKDEALEDEDNKKDDGISFSNQTGPAWAGSERDYTYEELLNRVFNIMREKNPDMVAGEKRKFVMKPPQVVRVGTKKTSFVNFTDICKLLHRQPKHLLAFLLAELGTSFIEITAYKFKVYNPGESHSDVRLSRKTELFFLFCLLNLHPWTPP

SEQ ID NO: 902265 - protein, 310 aa, Homo sapiens
MRPLQIVPSRLISQLYCGLKPPASTRNQICLKMARPSSSMADFRKFFAKAKHIVIISGAGVSAESGVPTFRGAGGYWRKWQAQDLATPLAFAHNPSRVWEFYHYRREVMGSKEPNAGHRAIAECETRLGKQGRRVVVITQNIDELHRKAGTKNLLEIHGSLFKTRCTSCGVVAENYKSPICPALSGKGAPEPGTQDASIPVEKLPRCEEAGCGGLLRPHVVWFGENLDPAILEEVDRELAHCDLCLVVGTSSVVYPAAMFAPQVAARGVPVAEFNTETTPATNRFRFHFQGPCGTTLPEALACHENETVS

SEQ ID NO: 902266 - protein, 299 aa, Homo sapiens
MRPLQIVPSRLISQLYCGLKPPASTRNQICLKMARPSSSMADFRKFFAKAKHIVIISGAGVSAESGVPTFRGAGGYWRKWQAQDLATPLAFAHNPSRVWEFYHYRREVMGSKEPNAGHRAIAECETRLGKQGRRVVVITQNIDELHRKAGTKNLLEIHGSLFKTRCTSCGVVAENYKSPICPALSGKGAPEPGTQDASIPVEKLPRCEEAGCGGLLRPHVVWFGENLDPAILEEVDRELAHCDLCLVVGTSSVVYPAAMFAPQVAARGVPVAEFNTETTPATNRFSHLISISSLIIIKN

SEQ ID NO: 902267 - protein, 223 aa, Homo sapiens
MRPLQIVPSRLISQLYCGLKPPASTRNQICLKMARPSSSMADFRKFFAKAKHIVIISGAGVSAESGVPTFRGAGGYWRKWQAQDLATPLAFAHNPSRVWEFYHYRREVMGSKEPNAGHRAIAECETRLGKQGRRVVVITQNIDELHRKAGTKNLLEIHGSLFKTRCTSCGVVAENYKSPICPALSGKGAPEPGTQDASIPVEKLPRDEVSPCWPGWSRALDLR

SEQ ID NO: 902268 - protein, 253 aa, Homo sapiens
MRPLQIVPSRLISQLYCGLKPPASTRNQICLKMARPSSSMADFRKFFAKAKHIVIISGAGVSAESGVPTFRGAGGYWRKWQAQDLATPLAFAHNPSRVWEFYHYRREVMGSKEPNAGHRAIAECETRLGKQGRRVVVITQNIDELHRKAGTKNLLEIHGSLFKTRCTSCGVVAENYKSPICPALSGKGAPEPGTQDASIPVEKLPRCEEAGCGGLLRPHVVWFGENLDPAILEEVDRELAHCDLCLVVGHALP

SEQ ID NO: 902269 - protein, 206 aa, Homo sapiens
MRPLQIVPSRLISQLYCGLKPPASTRNQICLKMARPSSSMADFRKFFAKAKHIVIISGAGVSAESGVPTFRGAGGYWRKWQAQDLATPLAFAHNPSRVWEFYHYRREVMGSKEPNAGHRAIAECETRLGKQGRRVVVITQNIDELHRKAGTKNLLEIHGSLFKTRCTSCGVVAENYKSPICPALSGKGAPEPGTQDASIPVEKLPR

SEQ ID NO: 902270 - protein, 167 aa, Homo sapiens
MRPLQIVPSRLISQLYCGLKPPASTRNQICLKMARPSSSMADFRKFFAKAKHIVIISGAGVSAESGVPTFRGAGGYWRKWQAQNIPSWPFAVRALPSHWLRKSLALEDKELFDCLRWRFALVAQAGVQWRDLGSLQPLPPRFSCLSLPSSWDYRHAPPHPANFCIFQ

SEQ ID NO: 902271 - protein, 310 aa, Homo sapiens; identical to SEQ ID NO: 902265

SEQ ID NO: 902272 - protein, 202 aa, Homo sapiens
MGSKEPNAGHRAIAECETRLGKQGRRVVVITQNIDELHRKAGTKNLLEIHGSLFKTRCTSCGVVAENYKSPICPALSGKGAPEPGTQDASIPVEKLPRCEEAGCGGLLRPHVVWFGENLDPAILEEVDRELAHCDLCLVVGTSSVVYPAAMFAPQVAARGVPVAEFNTETTPATNRFRFHFQGPCGTTLPEALACHENETVS

SEQ ID NO: 902273 - protein, 223 aa, Homo sapiens; identical to SEQ ID NO: 902267

SEQ ID NO: 902274 - protein, 107 aa, Homo sapiens
YFSFVPLCFPSLYVLWFLAHNVLHVSTCCPRCRGRVFISSARIALPVFYVPSLLIVVSSVLTYFFCVPPIFGAPSCVCFFVCLPPFFFFSFFFFFFFFFFLGECFNA

SEQ ID NO: 902275 - protein, 724 aa, Homo sapiens
KAGACLQRAGHLHEATRPHGAAAAAADPGGGGGARSQPGGPGVPAPVDARLGRSPWAGAEAARGGGARGRGRGRGPEAAAQEEAEEVGRSGPGRRAAQRRSPGLAMLLASAVVVWEWLNEHGRWRPYSPAVSHHIEAVVRAGPRAGGSVVLGQVDSRLAPYIIDLQSMNQFRQDTGTLRPVRRNYYDPSSAPGKGVVWEWENDNGSWTPYDMEVGITIQHAYEKQHPWIDLTSIGFSYVIDFNTMGQINRQTQRQRRVRRRLDLIYPMVTGTLPKAQSWPVSPGPATSPPMSPCSCPQCVLVMSVKAAVVNGSTGPLQLPVTRKNMPPPGVVKLPPLPGSGAKPLDSTGTIRGPLKTAPSQVIRRQASSMPTGTTMGSPASPPGPNSKTGRVALATLNRTNLQRLAIAQSRVLIASGVPTVPVKNLNGSSPVNPALAGITGILMSAAGLPVCLTRPPKLVLHPPPVSKSEIKSIPGVSNTSRKTTKKQAKKGKTPEEVLKKYLQKVRHPPDEDCTICMERLTAPSGYKGPQPTVKPDLVGKLSRCGHVYHIYCLVAMYNNGNKDGSLQCPTCKTIYGVKTGTQPPGKMEYHLIPHSLPGHPDCKTIRIIYSIPPGIQGPEHPNPGKSFSARGFPRHCYLPDSEKGRKVLKLLLVAWDRRLIFAIGTSSTTGESDTVIWNEVHHKTEFGSNLTGHGYPDANYLDNVLAELAAQGISEDSTAQEKD

SEQ ID NO: 902276 - protein, 142 aa, Homo sapiens
MQLGTRTSSLGPHSLPGHPDCKTIRIIYSIPPGIQGPEHPNPGKSFSARGFPRHCYLPDSEKGRKVLKLLLVAWDRRLIFAIGTSSTTGESDTVIWNEVHHKTEFGSNLTGHGYPDANYLDNVLAELAAQGISEDSTAQEKD

SEQ ID NO: 902277 - protein, 724 aa, Homo sapiens; identical to SEQ ID NO: 902275

SEQ ID NO: 902278 - protein, 724 aa, Homo sapiens; identical to SEQ ID NO: 902275

SEQ ID NO: 902279 - protein, 261 aa, Homo sapiens
MTPCVGSCPRELVPSSGTGASLTYPSAWSMGPVVEFTSYYFGESRNSLGDWAGREKLRSITHQGAFCSPGPSSLVPFGTGWESYYQNCFPIWLLLALAPQDGSLQCPTCKTIYGVKTGTQPPGKMEYHLIPHSLPGHPDCKTIRIIYSIPPGIQGPEHPNPGKSFSARGFPRHCYLPDSEKGRKVLKLLLVAWDRRLIFAIGTSSTTGESDTVIWNEVHHKTEFGSNLTGHGYPDANYLDNVLAELAAQGISEDSTAQEKD

SEQ ID NO: 902280 - protein, 724 aa, Homo sapiens; identical to SEQ ID NO: 902275

SEQ ID NO: 902281 - protein, 74 aa, Homo sapiens
PVSKSEIKSIPGVSNTSRKTTKKQAKKGTSLLSRGVLRVKDLAVSPESASTSKGHSHGFTLCASISASVSGPNQ

SEQ ID NO: 902282 - protein, 60 aa, Homo sapiens
KVVQGHLIDCLLLCHPVEDRSRGCCFNATTRREAEGLCRARVLREGVTSTLAVLQADSSL

SEQ ID NO: 902283 - protein, 229 aa, Homo sapiens
GIPPPGRSMGRFRGGLRCIKYLLLGFNLLFWLAGSAVIAFGLWFRFGGAIKELSSEDKSPEYFYVGLYVLVGAGALMMAVGFFGCCGAMRESQCVLGSFFTCLLVIFAAEVTTGVFAFIGKGVAIRHVQTMYEEAYNDYLKDRGKGNGTLITFHSTFQCCGKESSEQVQPTCPKELLGHKNCIDEIETIISVKLQLIGIVGIGIAGLTIFGMIFSMVLCCAIRNSRDVI

SEQ ID NO: 902284 - protein, 201 aa, Homo sapiens
GIPPPGRSMGRFRGGLRCIKYLLLGFNLLFWLAGSAVIAFGLWFRFGGAIKELSSEDKSPEYFYVGLYVLVGAGALMMAVGFFGCCGAMRESQCVLGSFFTCLLVIFAAEVTTGVFAFIGKGVAIRHVQTMYEEAYNDYLKDRGKGNGTLITFHSTFQCCGKESSEQVQPTCPKELLGHKIFGMIFSMVLCCAIRNSRDVI

SEQ ID NO: 902285 - protein, 229 aa, Homo sapiens; identical to SEQ ID NO: 902283

SEQ ID NO: 902286 - protein, 246 aa, Homo sapiens
VTTAAARGLGAMEEEMHTDAKIRAENGTGSSPRGPGCSLRHFACEQNLLSRPDGSASFLQGDTSVLAGVYGPAEVKVSKEIFNKATLEVILRPKIGLPGVAEKSRERLIRNTCEAVVLGTLHPRTSITVVLQVVSDAGSLLACCLNAACMALVDAGVPMRALFCGVACALDSDGTLVLDPTSKQEKEARAVLTFALDSVERKLLMSSTKGLYSDTELQQCLAAAQAASQHVFRFYRESLQRRYSKS

SEQ ID NO: 902287 - protein, 246 aa, Homo sapiens; identical to SEQ ID NO: 902286

SEQ ID NO: 902288 - protein, 208 aa, Homo sapiens
VTTAAARGLGAMEEEMHTDAKIRAENGTGSSPRGPGCSLRHFACEQNLLSRPDGSASFLQGVAEKSRERLIRNTCEAVVLGTLHPRTSITVVLQVVSDAGSLLACCLNAACMALVDAGVPMRALFCGVACALDSDGTLVLDPTSKQEKEARAVLTFALDSVERKLLMSSTKGLYSDTELQQCLAAAQAASQHVFRFYRESLQRRYSKS

SEQ ID NO: 902289 - protein, 142 aa, Homo sapiens
VTTAAARGLGAMEEEMHTDAKIRAENGTGSSPRGPGCSLRHFACEQNLLSRPDGSASFLQGDTSVLAGVYGPAEVKVSKEIFNKATLEVILRPKIGLPAAWHWWMQVCPCGLSSVGSPAPWTLMGPSCWILHPSKKRRPGQS

SEQ ID NO: 902290 - protein, 109 aa, Homo sapiens
VTTAAARGLGAMEEEMHTDAKIRAENGTGSSPRGPGCSLRHFACEQNLLSRPDGSASFLQGDTSVLAGVYGPAEVKVSKEIFNKATLEVILRPKIGLPAQPCLSDPWAP

SEQ ID NO: 902291 - protein, 241 aa, Homo sapiens
KALQWAGVGLAFRGRRFDHENGTGSSPRGPGCSLRHFACEQNLLSRPDGSASFLQGDTSVLAGVYGPAEVKVSKEIFNKATLEVILRPKIGLPGVAEKSRERLIRNTCEAVVLGTLHPRTSITVVLQVVSDAGSLLACCLNAACMALVDAGVPMRALFCGVACALDSDGTLVLDPTSKQEKEARAVLTFALDSVERKLLMSSTKGLYSDTELQQCLAAAQAASQHVFRFYRESLQRRYSKS

SEQ ID NO: 902292 - protein, 268 aa, Homo sapiens
VTTAAARGLGAMEEEMHTDAKIRAENGTGSSPRGPGCSLRHFACEQNLLSRPDGSASFLQGDTSVLAGVYGPAEVKVSKEIFNKATLEVILRPKIGLPAGVSGWQSGLAFFPLESSIIPAGVAEKSRERLIRNTCEAVVLGTLHPRTSITVVLQVVSDAGSLLACCLNAACMALVDAGVPMRALFCGVACALDSDGTLVLDPTSKQEKEARAVLTFALDSVERKLLMSSTKGLYSDTELQQCLAAAQAASQHVFRFYRESLQRRYSKS

SEQ ID NO: 902293 - protein, 246 aa, Homo sapiens; identical to SEQ ID NO: 902286

SEQ ID NO: 902294 - protein, 82 aa, Homo sapiens
AELCGRVAVVGAVEAAATLRPRLLMEAGPHPRPGHCCKPGGRLDMNHGFVHHIRRNQIARYRPALRRRRHHSWPGLARPDSP

SEQ ID NO: 902295 - protein, 190 aa, Homo sapiens
AELCGRVAVVGAVEAAATLRPRLLMEAGPHPRPGHCCKPGGRLDMNHGFVHHIRRNQIARDDYDKKVKQAAKEKVRRRHTPAPTRPRKPDLQVYLPRHRDVSAHPRNPDYEESGESSSSGGSELEPSGHQLFCLEYEADSGEVTSVIVYQGDDPGKVSEKVSAHTPLDPPMREALKLRIQEEIAKRQSQH

SEQ ID NO: 902296 - protein, 182 aa, Homo sapiens
AELCGRVAVVGAVEAAATLRPRLLMEAGPHPRPGHCCKPGGRLDMNHGFVHHIRRNQIARDDYDKKVKQAAKEKVRRRHTPAPTRPRKPDLQVYLPRHRGSAHLVSFRNLHLSAPKSPLNDSHQELGRLISPQLSIAVRVSGSQQEVYLPVCPTVLYFSKVLRYLAKRKSGTAMSDQHIIAE

SEQ ID NO: 902297 - protein, 99 aa, Homo sapiens
FLLWFILPDVSAHPRNPDYEESGESSSSGGSELEPSGHQLFCLEYEADSGEVTSVIVYQGDDPGKVSEKVSAHTPLDPPMREALKLRIQEEIAKRQSQH

SEQ ID NO: 902298 - protein, 151 aa, Homo sapiens
AELCGRVAVVGAVEAAATLRPRLLMEAGPHPRPGHCCKPGGRLDMNHGFVHHIRRNQIARDDYDKKVKQAAKEKVRRRHTPAPTRPRKPDLQVYLPRHRGEAARPACLQPARSSCNALPFSIGKNHFLLLRFSSSRLFPEPPPQRSQISAE

SEQ ID NO: 902299 - protein, 82 aa, Homo sapiens; identical to SEQ ID NO: 902294

SEQ ID NO: 902300 - protein, 190 aa, Homo sapiens; identical to SEQ ID NO: 902295

SEQ ID NO: 902301 - protein, 432 aa, Homo sapiens
MQPMSFGWDHSLHKRKRLPPVKRSLVYYLKNREVRLQNETSYSRVLHGYAAQQLPSLLKEREFHLGTLNKVFASQWLNHRQVVCGTKCNTLFVVDVQTSQITKIPILKDREPGGVTQQGCGIHAIELNPSRTLLATGGDNPNSLAIYRLPTLDPVCVGDDGHKDWIFSIAWISDTMAVSGSRDGSMGLWEVTDDVLTKSDARHNVSRVPVYAHITHKALKDIPKEDTNPDNCKVRALAFNNKNKELGAVSLDGYFHLWKAENTLSKLLSTKLPYCRENVCLAYGSEWSVYAVGSQAHVSFLDPRQPSYNVKSVCSRERGSGIRSVSFYEHIITVGTGQGSLLFYDIRAQRFLEERLSACYGSKPRLAGENLKLTTGKGWLNHDETWRNYFSDIDFFPNAVYTHCYDSSGTKLFVAGGPLPSGLHGNYAGLWS

SEQ ID NO: 902302 - protein, 428 aa, Homo sapiens
MFGWDHSLHKRKRLPPVKRSLVYYLKNREVRLQNETSYSRVLHGYAAQQLPSLLKEREFHLGTLNKVFASQWLNHRQVVCGTKCNTLFVVDVQTSQITKIPILKDREPGGVTQQGCGIHAIELNPSRTLLATGGDNPNSLAIYRLPTLDPVCVGDDGHKDWIFSIAWISDTMAVSGSRDGSMGLWEVTDDVLTKSDARHNVSRVPVYAHITHKALKDIPKEDTNPDNCKVRALAFNNKNKELGAVSLDGYFHLWKAENTLSKLLSTKLPYCRENVCLAYGSEWSVYAVGSQAHVSFLDPRQPSYNVKSVCSRERGSGIRSVSFYEHIITVGTGQGSLLFYDIRAQRFLEERLSACYGSKPRLAGENLKLTTGKGWLNHDETWRNYFSDIDFFPNAVYTHCYDSSGTKLFVAGGPLPSGLHGNYAGLWS

SEQ ID NO: 902303 - protein, 257 aa, Homo sapiens
MAVSGSRDGSMGLWEVTDDVLTKSDARHNVSRVPVYAHITHKALKDIPKEDTNPDNCKVRALAFNNKNKELGAVSLDGYFHLWKAENTLSKLLSTKLPYCRENVCLAYGSEWSVYAVGSQAHVSFLDPRQPSYNVKSVCSRERGSGIRSVSFYEHIITVGTGQGSLLFYDIRAQRFLEERLSACYGSKPRLAGENLKLTTGKGWLNHDETWRNYFSDIDFFPNAVYTHCYDSSGTKLFVAGGPLPSGLHGNYAGLWS

SEQ ID NO: 902304 - protein, 453 aa, Homo sapiens
MARKVVSRKRKAPASPGAGSDAQGPQFGWDHSLHKRKRLPPVKRSLVYYLKNREVRLQNETSYSRVLHGYAAQQLPSLLKEREFHLGTLNKVFASQWLNHRQVVCGTKCNTLFVVDVQTSQITKIPILKDREPGGVTQQGCGIHAIELNPSRTLLATGGDNPNSLAIYRLPTLDPVCVGDDGHKDWIFSIAWISDTMAVSGSRDGSMGLWEVTDDVLTKSDARHNVSRVPVYAHITHKALKDIPKEDTNPDNCKVRALAFNNKNKELGAVSLDGYFHLWKAENTLSKLLSTKLPYCRENVCLAYGSEWSVYAVGSQAHVSFLDPRQPSYNVKSVCSRERGSGIRSVSFYEHIITVGTGQGSLLFYDIRAQRFLEERLSACYGSKPRLAGENLKLTTGKGWLNHDETWRNYFSDIDFFPNAVYTHCYDSSGTKLFVAGGPLPSGLHGNYAGLWS

SEQ ID NO: 902305 - protein, 453 aa, Homo sapiens; identical to SEQ ID NO: 902304

SEQ ID NO: 902306 - protein, 194 aa, Homo sapiens [sequence omitted]

SEQ ID NO: 902307 - protein, 453 aa, Homo sapiens; identical to SEQ ID NO: 902304

SEQ ID NO: 902308 - protein, 425 aa, Homo sapiens
MRPRAHKRKRLPPVKRSLVYYLKNREVRLQNETSYSRVLHGYAAQQLPSLLKEREFHLGTLNKVFASQWLNHRQVVCGTKCNTLFVVDVQTSQITKIPILKDREPGGVTQQGCGIHAIELNPSRTLLATGGDNPNSLAIYRLPTLDPVCVGDDGHKDWIFSIAWISDTMAVSGSRDGSMGLWEVTDDVLTKSDARHNVSRVPVYAHITHKALKDIPKEDTNPDNCKVRALAFNNKNKELGAVSLDGYFHLWKAENTLSKLLSTKLPYCRENVCLAYGSEWSVYAVGSQAHVSFLDPRQPSYNVKSVCSRERGSGIRSVSFYEHIITVGTGQGSLLFYDIRAQRFLEERLSACYGSKPRLAGENLKLTTGKGWLNHDETWRNYFSDIDFFPNAVYTHCYDSSGTKLFVAGGPLPSGLHGNYAGLWS

SEQ ID NO: 902309 - protein, 343 aa, Homo sapiens
MARKVVSRKRKAPASPGAGSDAQGPQFGWDHSLHKRKRLPPVKRSLVYYLKNREVRLQNETSYSRVLHGYAAQQLPSLLKEREFHLGTLNKVFASQWLNHRQVVCGTKCNTLFVVDVQTSQITKIPILKDREPGGVTQQGCGIHAIELNPSRTLLATGGDNPNSLAIYRLPTLDPVCVGDDGHKDWIFSIAWISDTMAVSGSRDGSMGLWEVTDDVLTKSDARHNVSRVPVYAHITHKALKDIPKEDTNPDNCKVRALAFNNKNKELGAVSLDGYFHLWKAENTLSKLLSTKLPYCRENVCLAYGSEWSVYAVGSQAHVSFLDPRQPSYNVKSVCSRERGSES

SEQ ID NO: 902310 - protein, 175 aa, Homo sapiens
MVISLLYFQLLSTKLPYCRENVCLAYGSEWSVYAVGSQAHVSFLDPRQPSYNVKSVCSRERGSGIRSVSFYEHIITVGTGQGSLLFYDIRAQRFLEERLSACYGSKPRLAGENLKLTTGKGWLNHDETWRNYFSDIDFFPNAVYTHCYDSSGTKLFVAGGPLPSGLHGNYAGLWS

SEQ ID NO: 902311 - protein, 382 aa, Homo sapiens
MGPTSVPLVKAHRSSVSDYVNYDIIVRHYNYTGKLNISADKENSIKLTSVVFILICCFIILENIFVLLTIWKTKKFHRPMYYFIGNLALSDLLAGVAYTANLLLSGATTYKLTPAQWFLREGSMFVALSASVFSLLAIAIERYITMLKMKLHNGSNNFRLFLLISACWVISLILGGLPIMGWNCISALSSCSTVLPLYHKHYILFCTTVFTLLLLSIVILYCRIYSLVRTRSRRLTFRKNISKASRSSEKSLALLKTVIIVLSVFIACWAPLFILLLLDVGCKVKTCDILFRAEYFLVLAVLNSGTNPIIYTLTNKEMRRAFIRIMSCCKCPSGDSAGKFKRPIIAGMEFSRSKSDNSSHPQKDEGDNPETIMSSGNVNSSS

SEQ ID NO: 902312 - protein, 441 aa, Homo sapiens
MAIRRLRFPRPSPAKEKLHKKPGSLIEPPLKPVKALSPRPLAFVWSSATPASWGHRVGTMGPTSVPLVKAHRSSVSDYVNYDIIVRHYNYTGKLNISADKENSIKLTSVVFILICCFIILENIFVLLTIWKTKKFHRPMYYFIGNLALSDLLAGVAYTANLLLSGATTYKLTPAQWFLREGSMFVALSASVFSLLAIAIERYITMLKMKLHNGSNNFRLFLLISACWVISLILGGLPIMGWNCISALSSCSTVLPLYHKHYILFCTTVFTLLLLSIVILYCRIYSLVRTRSRRLTFRKNISKASRSSEKSLALLKTVIIVLSVFIACWAPLFILLLLDVGCKVKTCDILFRAEYFLVLAVLNSGTNPIIYTLTNKEMRRAFIRIMSCCKCPSGDSAGKFKRPIIAGMEFSRSKSDNSSHPQKDEGDNPETIMSSGNVNSSS

SEQ ID NO: 902313 - protein, 382 aa, Homo sapiens; identical to SEQ ID NO: 902311

SEQ ID NO: 902314 - protein, 382 aa, Homo sapiens; identical to SEQ ID NO: 902311

SEQ ID NO: 902315 - protein, 474 aa, Homo sapiens
MAAASVSAASGSHLSNSFAEPSRSNGSMVRHSSSPYVVYPSDKPFLNSDLRRSPSKPTLAYPESNSRAIFSALKNLQDKIRRLELERIQAEESVKTLSRETIEYKKVLDEQIQERENSKNEESKHNQELTSQLLAAENKCNLLEKQLEYMRNMIKHAEMERTSVLEKQVSLERERQHDQTHVQSQLEKLDLLEQEYNKLTTMQALAEKKMQELEAKLHEEEQERKRMQAKAAELQTGLETNRLIFEDKATPCVPNARRIKKKKSKPPEKSTSPSHAVVANVQLVLHLMKQHSKALCNDRVINSIPLAKQVSSRGGKSKKLSVTPPSSNGINEELSEVLQTLQDEFGQMSFDHQQLAKLIQESPTVELKDKLECELEALVGRMEAKANQITKVRKYQAQLEKQKLEKQKKELKATKKTLDEERNSSSRSGITGTTNKKDFMKLRPGEKRRKNLQLLKDMQSIQNSLQSSSLCWDY

SEQ ID NO: 902316 - protein, 500 aa, Homo sapiens
MAAASVSAASGSHLSNSFAEPSRSNGSMVRHSSSPYVVYPSDKPFLNSDLRRSPSKPTLAYPESNSRAIFSALKNLQDKIRRLELERIQAEESVKTLSRETIEYKKVLDEQIQERENSKNEESKHNQELTSQLLAAENKCNLLEKQLEYMRNMIKHAEMERTSVLEKQVSLERERQHDQTHVQSQLEKLDLLEQEYNKLTTMQALAEKKMQELEAKLHEEEQERKRMQAKAAELQTGLETNRLIFEDKATPCVPNARRIKKKKSKPPEKKSSRNYFGAQPHYRLCLGDMPFVAGKSTSPSHAVVANVQLVLHLMKQHSKALCNDRVINSIPLAKQVSSRGGKSKKLSVTPPSSNGINEELSEVLQTLQDEFGQMSFDHQQLAKLIQESPTVELKDKLECELEALVGRMEAKANQITKVRKYQAQLEKQKLEKQKKELKATKKTLDEERNSSSRSGITGTTNKKDFMKLRPGEKRRKNLQLLKDMQSIQNSLQSSSLCWDY

SEQ ID NO: 902317 - protein, 500 aa, Homo sapiens; identical to SEQ ID NO: 902316

SEQ ID NO: 902318 - protein, 500 aa, Homo sapiens; identical to SEQ ID NO: 902316

SEQ ID NO: 902319 - protein, 438 aa, Homo sapiens
MAAASVSAASGSHLSNSFAEPSRSNGSMVRHSSSPYVVYPSDKPFLNSDLRRSPSKPTLAYPESNSRAIFSALKNLQDKIRRLELERIQAEESVKTLSRETIEYKKVLDEQIQERENSKNEESKHNQELTSQLLAAENKCNLLEKQLEYMRNMIKHAEMERTSVLEKQVSLERERQHDQTHVQSQLEKLDLLEQEYNKLTTMQALAEKKMQELEAKLHEEEQERKRMQAKAAESTSPSHAVVANVQLVLHLMKQHSKALCNDRVINSIPLAKQVSSRGGKSKKLSVTPPSSNGINEELSEVLQTLQDEFGQMSFDHQQLAKLIQESPTVELKDKLECELEALVGRMEAKANQITKVRKYQAQLEKQKLEKQKKELKATKKTLDEERNSSSRSGITGTTNKKDFMKLRPGEKRRKNLQLLKDMQSIQNSLQSSSLCWDY

SEQ ID NO: 902320 - protein, 348 aa, Homo sapiens
MIKHAEMERTSVLEKQVSLERERQHDQTHVQSQLEKLDLLEQEYNKLTTMQALAEKKMQELEAKLHEEEQERKRMQAKAAELQTGLETNRLIFEDKATPCVPNARRIKKKKSKPPEKKSSRNYFGAQPHYRLCLGDMPFVAGKSTSPSHAVVANVQLVLHLMKQHSKALCNDRVINSIPLAKQVSSRGGKSKKLSVTPPSSNGINEELSEVLQTLQDEFGQMSFDHQQLAKLIQESPTVELKDKLECELEALVGRMEAKANQITKVRKYQAQLEKQKLEKQKKELKATKKTLDEERNSSSRSGITGTTNKKDFMKLRPGEKRRKNLQLLKDMQSIQNSLQSSSLCWDY

SEQ ID NO: 902321 - protein, 388 aa, Homo sapiens
WQKQKVEAEEGIKSYQERLLMKKETAAAVLESQVGDYMRNMIKHAEMERTSVLEKQVSLERERQHDQTHVQSQLEKLDLLEQEYNKLTTMQALAEKKMQELEAKLHEEEQERKRMQAKAAELQTGLETNRLIFEDKATPCVPNARRIKKKKSKPPEKKSSRNYFGAQPHYRLCLGDMPFVAGKSTSPSHAVVANVQLVLHLMKQHSKALCNDRVINSIPLAKQVSSRGGKSKKLSVTPPSSNGINEELSEVLQTLQDEFGQMSFDHQQLAKLIQESPTVELKDKLECELEALVGRMEAKANQITKVRKYQAQLEKQKLEKQKKELKATKKTLDEERNSSSRSGITGTTNKKDFMKLRPGEKRRKNLQLLKDMQSIQNSLQSSSLCWDY

SEQ ID NO: 902322 - protein, 270 aa, Homo sapiens
MAAASVSAASGSHLSNSFAEPSRSNGSMVRHSSSPYVVYPSDKPFLNSDLRRSPSKPTLAYPESNSRAIFSALKNLQDKIRRLELERIQAEESVKTLSRETIEYKKVLDEQIQERENSKNEESKHNQELTSQLLAAENKCNLLEKQLEYMRNMIKHAEMERTSVLEKQVSLERERQHDQTHVQSQLEKLDLLEQEYNKLTTMQALAEKKMQELEAKLHEEEQERKRMQAKAAELQTGLETNRLIFEDKATPCVPNARRIKKKKSKPPEKV

SEQ ID NO: 902323 - protein, 270 aa, Homo sapiens; identical to SEQ ID NO: 902322

SEQ ID NO: 902324 - protein, 329 aa, Homo sapiens
MAAASVSAASGSHLSNSFAEPSRSNGSMVRHSSSPYVVYPSDKPFLNSDLRRSPSKPTLAYPESNSRAIFSALKNLQDKIRRLELERIQAEESVKTLSRETIEYKKVLDEQIQERENSKNEESKHNQELTSQLLAAENKCNLLEKQLEYMRNMIKHAEMERTSVLEKQVSLERERQHDQTHVQSQLEKLDLLEQEYNKLTTMQALAEKKMQELEAKLHEEEQERKRMQAKAAELQTGLETNRLIFEDKATPCVPNARRIKKKKSKPPEKKSSRNYFGAQPHYRLCLGDMPFVAGKIFFFFFFFTIRPSAGYPFFWEWGGQPAAGRGGSS

SEQ ID NO: 902325 - protein, 500 aa, Homo sapiens; identical to SEQ ID NO: 902316

SEQ ID NO: 902326 - protein, 270 aa, Homo sapiens; identical to SEQ ID NO: 902322

SEQ ID NO: 902327 - protein, 491 aa, Homo sapiens
MLTRIDNSFAEPSRSNGSMVRHSSSPYVVYPSDKPFLNSDLRRSPSKPTLAYPESNSRAIFSALKNLQDKIRRLELERIQAEESVKTLSRETIEYKKVLDEQIQERENSKNEESKHNQELTSQLLAAENKCNLLEKQLEYMRNMIKHAEMERTSVLEKQVSLERERQHDQTHVQSQLEKLDLLEQEYNKLTTMQALAEKKMQELEAKLHEEEQERKRMQAKAAELQTGLETNRLIFEDKATPCVPNARRIKKKKSKPPEKKSSRNYFGAQPHYRLCLGDMPFVAGKSTSPSHAVVANVQLVLHLMKQHSKALCNDRVINSIPLAKQVSSRGGKSKKLSVTPPSSNGINEELSEVLQTLQDEFGQMSFDHQQLAKLIQESPTVELKDKLECELEALVGRMEAKANQITKVRKYQAQLEKQKLEKQKKELKATKKTLDEERNSSSRSGITGTTNKKDFMKLRPGEKRRKNLQLLKDMQSIQNSLQSSSLCWDY

SEQ ID NO: 902328 - protein, 212 aa, Homo sapiens [sequence omitted]

SEQ ID NO: 902329 - protein, 187 aa, Homo sapiens [sequence omitted]

SEQ ID NO: 902330 - protein, 270 aa, Homo sapiens; identical to SEQ ID NO: 902322

SEQ ID NO: 902331 - protein, 224 aa, Homo sapiens [sequence omitted]

SEQ ID NO: 902332 - protein, 258 aa, Homo sapiens
PNKPFLQIYREGRGNECDYRKLEEMHQRFLVSERSKDDLQLRLTRAENRIKQLETDSSEEISRYQEMIQKLQNVLESERENCGLVSEQRLKLQQENKQLRKETESLRKIALEAQKKAKVKISTMEHEFSIKERGFEVQLREMEDSNRNSIVELRHLLATQQKAANRWKEETKKLTESAEIRINNLKSELSRQKLHTQELLSQLEMANEKVAENEKLILEHQEKANRLQRRLSQAEERAASASQQLQCALQCREEKQPP

SEQ ID NO: 902333 - protein, 268 aa, Homo sapiens
PNKPFLQIYREGRGNECDYRKLEEMHQRFLVSERSKDDLQLRLTRAENRIKQLETDSSEEISRYQEMIQKLQNVLESERENCGLVSEQRLKLQQENKQLRKETESLRKIALEAQKKAKVKISTMEHEFSIKERGFEVQLREMEDSNRNSIVELRHLLATQQKAANRWKEETKKLTESAEIRINNLKSELSRQKLHTQELLSQLEMANEKVAENEKLILEHQEKANRLQRRLSQAEERAASASQQVGSILLSLDNKQFKDKFFRSSQGT

SEQ ID NO: 902334 - protein, 258 aa, Homo sapiens; identical to SEQ ID NO: 902332

SEQ ID NO: 902335 - protein, 167 aa, Homo sapiens
APAAASATINKWYFMFSSVDSHILKKFSEISTMEHEFSIKERGFEVQLREMEDSNRNSIVELRHLLATQQKAANRWKEETKKLTESAEIRINNLKSELSRQKLHTQELLSQLEMANEKVAENEKLILEHQEKANRLQRRLSQAEERAASASQQLQCALQCREEKQPP

SEQ ID NO: 902336 - protein, 68 aa, Homo sapiens
MGFRLGTCGDESDQVELGSGKRSLSHWHLEACPRFLGRLADTLEPWGATGKLSWIGPYRGYLTRVVSS

SEQ ID NO: 902337 - protein, 125 aa, Homo sapiens
RTCWCDGRSKWTCDEKWYQRMLTRTGLLVIEFLQYAEYLLSSSRMAVEAVAQIVIGCRYSKRCPYSCWLTTEYPGHYGEEMDMISYNYDYYIRGATTTFSAVERDRQWKFIMCRMTEYDCEFANV

SEQ ID NO: 902338 - protein, 212 aa, Homo sapiens
RVTLFAKIPGSMDLSLLWVLLPLVTMAWGQYGDYGYPYQQYHDYSDDGWVNLNRQGFSYQCPQGQVIVAVRSIFSKKEGSDRQWNYACMPTPQSLGEPTECWWEEINRAGMEWYQTCSNNGLVAGFQSRYFESVLDREWQFYCCRYSKRCPYSCWLTTEYPGHYGEEMDMISYNYDYYIRGATTTFSAVERDRQWKFIMCRMTEYDCEFANV

SEQ ID NO: 902339 - protein, 212 aa, Homo sapiens; identical to SEQ ID NO: 902338

SEQ ID NO: 902340 - protein, 213 aa, Homo sapiens
RVTLFAKIPGSMDLSLLWVLLPLVTMAWGQYGDYGYPYQQYHDYSDDGWVNLNRQGFSYQCPQGQVIVAVRSIFSKKEGSDRQWNYACMPTPQSLGEPTECWWEEINRAGMEWYQTCSNNGLVAGFQSRYFESVLDREWQFYCCRYSKRCPYSCWLTTEYPGHYGEEMDMISYNYDYYIRGATTTFSAVERDRQWKSYRQSRDGPELDSLPRS

SEQ ID NO: 902341 - protein, 1078 aa, Homo sapiens
SNRNRSYENRCPLLARDPLCSKGKNCILADEMGLGKTIQSITFLSEIFLRGIHGPFLIIAPLSTITNWEREFRTWTEMNAIVYHGSQISRQMIQQYEMVYRDAQGNPLSGVFKFHVVITTFEMILADCPELKKIHWSCVIIDEAHRLKNRNCKLLEGLKLMALEHKVLLTGTPLQNSVEELFSLLNFLEPSQFPSETAFLEEFGDLKTEEQVKKLQSILKPMMLRRLKDDVEKNLAPKQETIIEVELTNIQKKYYRAILEKNFSFLTKGANQHNMPNLINTMMELRKCCNHPYLINGAEEKILEDFRKTHSPDAPDFQLQAMIQAAGKLVLIDKLLPKLIAGGHKVLIFSQMVRCLDILEDYLIQRRYTYERIDGRVRGNLRQAAIDRFCKPDSDRFVFLLCTRAGGLGINLTAADTCIIFDSDWNPQNDLQAQARCHRIGQSKAVKVYRLITRNSYEREMFDKASLKLGLDKAVLQDINRKGGTNGVQQLSKMEVEDLLRKGAYGALMDEEDEGSKFCEEDIDQILQRRTHTITIQSEGKGSTFAKASFVASGNRTDISLDDPNFWQKWAKIAELDTEAKNEKESLVIDRPRVRKQTKHYNSFEEDELMEFSELDSDSDERPTRSRRLNDKARRYLRAECFRVEKNLLIFGWGRWKDILTHGRFKWHLNEKDMEMICRALLVYCVKHYKGDEKIKSFIWELITPTKDGQAQTLQNHSGLSAPVPRGRKGKKTKNQLLIPELKDADWLATCNPEVVLHDDGYKKHLKQHCNKVLLRVRMLYYLKAEILGEAAEKAFEGSPARELDVPLPDIDYMEIPVDWWDAEADKSLLIGVFKHGYERYNAMRADPALCFLEKVGMPDEKSLSAEQGVTDGTSDIPERGNTDKEDNAEDKVDGLQKQTESSSDGGDGVFSEKKDDSRAAQDGSDPDKSPWPVSSALTARLRRLVTVYQRCNRKELCRPEILGPGNQGYWVQEEMFRRTSEMDLINKEAQKRWTRREQADFYRTVSSFGVVYDQEKKTFDWTQFRIISRLDKKSDESLEQYFYSFVAMCRNVCRLPTWKDGGPPDTTIYVRVSLQGV

SEQ ID NO: 902342 - protein, 834 aa, Homo sapiens
RIVTVRTRIAVLSLLEKNFSFLTKGANQHNMPNLINTMMELRKCCNHPYLINGAEEKILEDFRKTHSPDAPDFQLQAMIQAAGKLVLIDKLLPKLIAGGHKVLIFSQMVRCLDILEDYLIQRRYTYERIDGRVRGNLRQAAIDRFCKPDSDRFVFLLCTRAGGLGINLTAADTCIIFDSDWNPQNDLQAQARCHRIGQSKAVKVYRLITRNSYEREMFDKASLKLGLDKAVLQDINRKGGTNGVQQLSKMEVEDLLRKGAYGALMDEEDEGSKFCEEDIDQILQRRTHTITIQSEGKGSTFAKASFVASGNRTDISLDDPNFWQKWAKIAELDTEAKNEKESLVIDRPRVRKQTKHYNSFEEDELMEFSELDSDSDERPTRSRRLNDKARRYLRAECFRVEKNLLIFGWGRWKDILTHGRFKWHLNEKDMEMICRALLVYCVKHYKGDEKIKSFIWELITPTKDGQAQTLQNHSGLSAPVPRGRKGKKTKNQLLIPELKDADWLATCNPEVVLHDDGYKKHLKQHCNKVLLRVRMLYYLKAEILGEAAEKAFEGSPARELDVPLPDIDYMEIPVDWWDAEADKSLLIGVFKHGYERYNAMRADPALCFLEKVGMPDEKSLSAEQGVTDGTSDIPERGNTDKEDNAEDKVDGLQKQTESSSDGGDGVFSEKKDDSRAAQDGSDPDKSPWPVSSALTARLRRLVTVYQRCNRKELCRPEILGPGNQGYWVQEEMFRRTSEMDLINKEAQKRWTRREQADFYRTVSSFGVVYDQEKKTFDWTQFRIISRLDKKSDESLEQYFYSFVAMCRNVCRLPTWKDGGPPDTTIYVRVSLQGV

SEQ ID NO: 902343 - protein, 807 aa, Homo sapiens
SNRNRSYENRCPLLARDPLCSKGKNCILADEMGLGKTIQSITFLSEIFLRGIHGPFLIIAPLSTITNWEREFRTWTEMNAIVYHGSQISRQMIQQYEMVYRDAQGNPLSGVFKFHVVITTFEMILADCPELKKIHWSCVIIDEAHRLKNRNCKLLEGLKLMALEHKVLLTGTPLQNSVEELFSLLNFLEPSQFPSETAFLEEFGDLKTEEQTKDLLEDKAHIFSQVVFVVLTSTMSGIIVNSKWFKVKKLQSILKPMMLRRLKDDVEKNLAPKQETIIEVELTNIQKKYYRAILEKNFSFLTKGANQHNMPNLINTMMELRKCCNHPYLINGAEEKILEDFRKTHSPDAPDFQLQAMIQAAGKLVLIDKLLPKLIAGGHKVLIFSQMVRCLDILEDYLIQRRYTYERIDGRVRGNLRQAAIDRFCKPDSDRFVFLLCTRAGGLGINLTAADTCIIFDSDWNPQNDLQAQARCHRIGQSKAVKVYRLITRNSYEREMFDKASLKLGLDKAVLQDINRKGGTNGVQQLSKMEVEDLLRKGAYGALMDEEDEGSKFCEEDIDQILQRRTHTITIQSEGKGSTFAKASFVASGNRTDISLDDPNFWQKWAKIAELDTEAKNEKESLVIDRPRVRKQTKHYNSFEEDELMEFSELDSDSDERPTRSRRLNDKARRYLRAECFRVEKNLLIFGWGRWKDILTHGRFKWHLNEKDMEMICRALLVYCVKHYKGDEKIKSFIWELITPTKDGQAQTLQNHSGLSAPVPRGRKGKKTKNQLLIPELKDADWLATCNPEVVLHDDGYKKHLKQHCNK

SEQ ID NO: 902344 - protein, 471 aa, Homo sapiens
SNRNRSYENRCPLLARDPLCSKGKNCILADEMGLGKTIQSITFLSEIFLRGIHGPFLIIAPLSTITNWEREFRTWTEMNAIVYHGSQISRQMIQQYEMVYRDAQGNPLSGVFKFHVVITTFEMILADCPELKKIHWSCVIIDEAHRLKNRNCKLLEGLKLMALEHKVLLTGTPLQNSVEELFSLLNFLEPSQFPSETAFLEEFGDLKTEEQTKDLLEDKAHIFSQVVFVVLTSTMSGIIVNSKWFKVKKLQSILKPMMLRRLKDDVEKNLAPKQETIIEVELTNIQKKYYRAILEKNFSFLTKGANQHNMPNLINTMMELRKCCNHPYLINGAEEKILEDFRKTHSPDAPDFQLQAMIQAAGKLVLIDKLLPKLIAGGHKVLIFSQMVRCLDILEDYLIQRRYTYERIDGRVRGNLRQAAIDRFCKPDSDRFVFLLCTRAGGLGINLTAAEFHHTGGRKERTAILVRTGSH

SEQ ID NO: 902345 - protein, 496 aa, Homo sapiens
SNRNRSYENRCPLLARDPLCSKGKNCILADEMGLGKTIQSITFLSEIFLRGIHGPFLIIAPLSTITNWEREFRTWTEMNAIVYHGSQISRQMIQQYEMVYRDAQGNPLSGVFKFHVVITTFEMILADCPELKKIHWSCVIIDEAHRLKNRNCKLLEGLKLMALEHKVLLTGTPLQNSVEELFSLLNFLEPSQFPSETAFLEEFGDLKTEEQTKDLLEDKAHIFSQVVFVVLTSTMSGIIVNSKWFKVKKLQSILKPMMLRRLKDDVEKNLAPKQETIIEVELTNIQKKYYRAILEKNFSFLTKGANQHNMPNLINTMMELRKCCNHPYLINGAEEKILEDFRKTHSPDAPDFQLQAMIQAAGKLVLIDKLLPKLIAGGHKVLIFSQMVRCLDILEDYLIQRRYTYERIDGRVRGNLRQAAIDRFCKPDSDRFVFLLCTRAGGLGINLTAADTCIIFDSDWNPQNDLQVTTRMIAVYLSCPGSQNIMIGPGLATEHP

SEQ ID NO: 902346 - protein, 496 aa, Homo sapiens; identical to SEQ ID NO: 902345

SEQ ID NO: 902347 - protein, 300 aa, Homo sapiens
MLYYLKAEILGEAAEKAFEGSPARELDVPLPDIDYMEIPVDWWDAEADKSLLIGVFKHGYERYNAMRADPALCFLEKVGMPDEKSLSAEQGVTDGTSDIPERGNTDKEDNAEDKVDGLQKQTESSSDGGDGVFSEKKDDSRAAQDGSDPDKSPWPVSSALTARLRRLVTVYQRCNRKELCRPEILGPGNQGYWVQEEMFRRTSEMDLINKEAQKRWTRREQADFYRTVSSFGVVYDQEKKTFDWTQFRIISRLDKKSDESLEQYFYSFVAMCRNVCRLPTWKDGGPPDTTIYVRVSLQGV

SEQ ID NO: 902348 - protein, 1113 aa, Homo sapiens
SNRNRSYENRCPLLARDPLCSKGKNCILADEMGLGKTIQSITFLSEIFLRGIHGPFLIIAPLSTITNWEREFRTWTEMNAIVYHGSQISRQMIQQYEMVYRDAQGNPLSGVFKFHVVITTFEMILADCPELKKIHWSCVIIDEAHRLKNRNCKLLEGLKLMALEHKVLLTGTPLQNSVEELFSLLNFLEPSQFPSETAFLEEFGDLKTEEQTKDLLEDKAHIFSQVVFVVLTSTMSGIIVNSKWFKVKKLQSILKPMMLRRLKDDVEKNLAPKQETIIEVELTNIQKKYYRAILEKNFSFLTKGANQHNMPNLINTMMELRKCCNHPYLINGAEEKILEDFRKTHSPDAPDFQLQAMIQAAGKLVLIDKLLPKLIAGGHKVLIFSQMVRCLDILEDYLIQRRYTYERIDGRVRGNLRQAAIDRFCKPDSDRFVFLLCTRAGGLGINLTAADTCIIFDSDWNPQNDLQAQARCHRIGQSKAVKVYRLITRNSYEREMFDKASLKLGLDKAVLQDINRKGGTNGVQQLSKMEVEDLLRKGAYGALMDEEDEGSKFCEEDIDQILQRRTHTITIQSEGKGSTFAKASFVASGNRTDISLDDPNFWQKWAKIAELDTEAKNEKESLVIDRPRVRKQTKHYNSFEEDELMEFSELDSDSDERPTRSRRLNDKARRYLRAECFRVEKNLLIFGWGRWKDILTHGRFKWHLNEKDMEMICRALLVYCVKHYKGDEKIKSFIWELITPTKDGQAQTLQNHSGLSAPVPRGRKGKKTKNQLLIPELKDADWLATCNPEVVLHDDGYKKHLKQHCNKVLLRVRMLYYLKAEILGEAAEKAFEGSPARELDVPLPDIDYMEIPVDWWDAEADKSLLIGVFKHGYERYNAMRADPALCFLEKVGMPDEKSLSAEQGVTDGTSDIPERGNTDKEDNAEDKVDGLQKQTESSSDGGDGVFSEKKDDSRAAQDGSDPDKSPWPVSSALTARLRRLVTVYQRCNRKELCRPEILGPGNQGYWVQEEMFRRTSEMDLINKEAQKRWTRREQADFYRTVSSFGVVYDQEKKTFDWTQFRIISRLDKKSDESLEQYFYSFVAMCRNVCRLPTWKDGGPPDTTIYVRVSLQGV

SEQ ID NO: 902349 - protein, 1184 aa, Homo sapiens
SNRNRSYENRCPLLARDPLCSKGKNCILADEMGLGKTIQSITFLSEIFLRGIHGPFLIIAPLSTITNWEREFRTWTEMNAIVYHGSQISRQMIQQYEMVYRDAQGNPLSGVFKFHVVITTFEMILADCPELKKIHWSCVIIDEAHRLKNRNCKLLEGLKLMALEHKVLLTGTPLQNSVEELFSLLNFLEPSQFPSETAFLEEFGDLKTEEQTKDLLEDKAHIFSQVVFVVLTSTMSGIIVNSKWFKVKKLQSILKPMMLRRLKDDVEKNLAPKQETIIEVELTNIQKKYYRAILEKNFSFLTKGANQHNMPNLINTMMELRKCCNHPYLINGAEEKILEDFRKTHSPDAPDFQLQAMIQAAGKLVLIDKLLPKLIAGGHKVLIFSQMVRCLDILEDYLIQRRYTYERIDGRVRGNLRQAAIDRFCKPDSDRFVFLLCTRAGGLGINLTAADTCIIFDSDWNPQNDLQAQARCHRIGQSKAVKVYRLITRNSYEREMFDKASLKLGLDKAVLQDINRKGGTNGVQQLSKMEVEDLLRKGAYGALMDEEDEGSKFCEEDIDQILQRRTHTITIQSEGKGSTFAKASFVASGNRTDISLDDPNFWQKWAKIAELDTEAKNEKESLVIDRPRVRKQTKHYNSFEEDELMEFSELDSDSDERPTRSRRLNDKARRYLRAECFRVEKNLLIFGWGRWKDILTHGRFKWHLNEKDMEMICRALLVYCVKHYKGDEKIKSFIWELITPTKDGQAQTLQNHSGLSAPVPRGRKGKKTKNQLLIPELKDADWLATCNPEVVLHDDGYKKHLKQHCNKVLLRVRMLYYLKAEILGEAAEKAFEGSPARELDVPLPDIDYMEIPVDWWDAEADKSLLIGVFKHGYERYNAMRADPALCFLEKVGMPDEKSLSAEQGVTDGTSDIPERGNTDKEDNAEDKVDGLQKQTESSSDGGDGVFSEKKDDSRAAQDGSDPDKSPWPVSSALTARLRRLVTVYQRCNRKELCRPEILGPGNQGYWVQEEMFRRTSEMDLINKEAQKRWTRREQADFYRTVSSFGVVYDQEKKTFDWTQFRIISRLDKKSDESLEQYFYSFVAMCRNVCRLPTWKDGGPPDTTIYVEPITEERAARTLYRIELLRKVREQVLKCPQLHERLQLCRPSLYLPVWWECGKHDRDLLIGTAKHGLNRTDCYIMNDPQ

SEQ ID NO: 902350 - protein, 837 aa, Homo sapiens
SNRNRSYENRCPLLARDPLCSKGKNCILADEMGLGKTIQSITFLSEIFLRGIHGPFLIIAPLSTITNWEREFRTWTEMNAIVYHGSQISRQMIQQYEMVYRDAQGNPLSGVFKFHVVITTFEMILADCPELKKIHWSCVIIDEAHRLKNRNCKLLEGLKLMALEHKVLLTGTPLQNSVEELFSLLNFLEPSQFPSETAFLEEFGDLKTEEQTKDLLEDKAHIFSQVVFVVLTSTMSGIIVNSKWFKVKKLQSILKPMMLRRLKDDVEKNLAPKQETIIEVELTNIQKKYYRAILEKNFSFLTKGANQHNMPNLINTMMELRKCCNHPYLINGAEEKILEDFRKTHSPDAPDFQLQAMIQAAGKLVLIDKLLPKLIAGGHKVLIFSQMVRCLDILEDYLIQRRYTYERIDGRVRGNLRQAAIDRFCKPDSDRFVFLLCTRAGGLGINLTAADTCIIFDSDWNPQNDLQAQARCHRIGQSKAVKVYRLITRNSYEREMFDKASLKLGLDKAVLQDINRKGGTNGVQQLSKMEVEDLLRKGAYGALMDEEDEGSKFCEEDIDQILQRRTHTITIQSEGKGSTFAKASFVASGNRTDISLDDPNFWQKWAKIAELDTEAKNEKESLVIDRPRVRKQTKHYNSFEEDELMEFSELDSDSDERPTRSRRLNDKARRYLRAECFRVEKNLLIFGWGRWKDILTHGRFKWHLNEKDMEMICRALLVYCVKHYKGDEKIKSFIWELITPTKDGQAQTLQNHSGLSAPVPRGRKGKKTKNQLLIPELKDADWLATCNPEVVLHDDGYKKHLKQHCNKVLLRVRMLYYLKAEILGEAAEKAFEGSPAR

SEQ ID NO: 902351 - protein, 1048 aa, Homo sapiens
SNRNRSYENRCPLLARDPLCSKGKNCILADEMGLGKTIQSITFLSEIFLRGIHGPFLIIAPLSTITNWEREFRTWTEMNAIVYHGSQISRQMIQQYEMVYRDAQGNPLSGVFKFHVVITTFEMILADCPELKKIHWSCVIIDEAHRLKNRNCKLLEGLKLMALEHKVLLTGTPLQNSVEELFSLLNFLEPSQFPSETAFLEEFGDLKTEEQTKDLLEDKAHIFSQVVFVVLTSTMSGIIVNSKWFKVKKLQSILKPMMLRRLKDDVEKNLAPKQETIIEVELTNIQKKYYRAILEKNFSFLTKGANQHNMPNLINTMMELRKCCNHPYLINGAEEKILEDFRKTHSPDAPDFQLQAMIQAAGKLVLIDKLLPKLIAGGHKVLIFSQMVRCLDILEDYLIQRRLRPECHRIGQSKAVKVYRLITRNSYEREMFDKASLKLGLDKAVLQDINRKGGTNGVQQLSKMEVEDLLRKGAYGALMDEEDEGSKFCEEDIDQILQRRTHTITIQSEGKGSTFAKASFVASGNRTDISLDDPNFWQKWAKIAELDTEAKNEKESLVIDRPRVRKQTKHYNSFEEDELMEFSELDSDSDERPTRSRRLNDKARRYLRAECFRVEKNLLIFGWGRWKDILTHGRFKWHLNEKDMEMICRALLVYCVKHYKGDEKIKSFIWELITPTKDGQAQTLQNHSGLSAPVPRGRKGKKTKNQLLIPELKDADWLATCNPEVVLHDDGYKKHLKQHCNKVLLRVRMLYYLKAEILGEAAEKAFEGSPARELDVPLPDIDYMEIPVDWWDAEADKSLLIGVFKHGYERYNAMRADPALCFLEKVGMPDEKSLSAEQGVTDGTSDIPERGNTDKEDNAEDKVDGLQKQTESSSDGGDGVFSEKKDDSRAAQDGSDPDKSPWPVSSALTARLRRLVTVYQRCNRKELCRPEILGPGNQGYWVQEEMFRRTSEMDLINKEAQKRWTRREQADFYRTVSSFGVVYDQEKKTFDWTQFRIISRLDKKSDESLEQYFYSFVAMCRNVCRLPTWKDGGPPDTTIYVRVSLQGV

SEQ ID NO: 902352 - protein, 469 aa, Homo sapiens
MEFSELDSDSDERPTRSRRLNDKARRYLRAECFRVEKNLLIFGWGRWKDILTHGRFKWHLNEKDMEMICRALLVYCVKHYKGDEKIKSFIWELITPTKDGQAQTLQNHSGLSAPVPRGRKGKKTKNQLLIPELKDADWLATCNPEVVLHDDGYKKHLKQHCNKVLLRVRMLYYLKAEILGEAAEKAFEGSPARELDVPLPDIDYMEIPVDWWDAEADKSLLIGVFKHGYERYNAMRADPALCFLEKVGMPDEKSLSAEQGVTDGTSDIPERGNTDKEDNAEDKVDGLQKQTESSSDGGDGVFSEKKDDSRAAQDGSDPDKSPWPVSSALTARLRRLVTVYQRCNRKELCRPEILGPGNQGYWVQEEMFRRTSEMDLINKEAQKRWTRREQADFYRTVSSFGVVYDQEKKTFDWTQFRIISRLDKKSDESLEQYFYSFVAMCRNVCRLPTWKDGGPPDTTIYVRVSLQGV

SEQ ID NO: 902353 - protein, 174 aa, Homo sapiens
MFRRTSEMDLINKEAQKRWTRREQADFYRTVSSFGVVYDQEKKTFDWTQFRIISRLDKKSDESLEQYFYSFVAMCRNVCRLPTWKDGGPPDTTIYVEPITEERAARTLYRIELLRKVREQVLKCPQLHERLQLCRPSLYLPVWWECGKHDRDLLIGTAKHGLNRTDCYIMNDPQ

SEQ ID NO: 902354 - protein, 624 aa, Homo sapiens
MENSDSNDKGSGDQSAAQRRSQMDRLDREEAFYQFVNNLSEEDYRLMRDNNLLGTPGESTEEELLRRLQQIKEGPPPQNSDENRGGDSSDDVSNGDSIIDWLNSVRQTGNTTRSGQRGNQSWRAVSRTNPNSGDFRFSLEINVNRNNGSQNSENENEPSARRSSGENVENNSQRQVENPRSESTSARPSRSERNSTEALTEVPPTRGQRRARSRSPDHRRTRARAERSRSPLHPMSEIPRRSHHSISSQTFEHPLVNETEGSSRTRHHVTLRQQISGPELLSRGLFAASGTRNASQGAGSSDTAASGESTGSGQRPPTIVLDLQVRRVRPGEYRQRDSIASRTRSRSQTPNNTVTYESERGGFRRTFSRSERAGVRTYVSTIRIPIRRILNTGLSETTSVAIQTMLRQIMTGFGELSYFMYSDSDSEPTGSVSNRNMERAESRSGRGGSGGGSSSGSSSSSSSSSSSSSSSSSSSSPSSSSGGESSETSSDLFEGSNEGSSSSGSSGARREGRHRAPVTFDESGSLPFLSLAQFFLLNEDDDDQPRGLTKEQIDNLAMRSFGENDALKTCSVCITEYTEGNKLRKLPCSHEYHVHCIDRWLSENSTCPICRRAVLASGNRESVV

SEQ ID NO: 902355 - protein, 624 aa, Homo sapiens; identical to SEQ ID NO: 902354

SEQ ID NO: 902356 - protein, 624 aa, Homo sapiens; identical to SEQ ID NO: 902354

SEQ ID NO: 902357 - protein, 390 aa, Homo sapiens [sequence omitted]

SEQ ID NO: 902358 - protein, 624 aa, Homo sapiens; identical to SEQ ID NO: 902354

SEQ ID NO: 902359 - protein, 624 aa, Homo sapiens; identical to SEQ ID NO: 902354

SEQ ID NO: 902360 - protein, 632 aa, Homo sapiens
MENSDSNDKGSGDQSAAQRRSQMDRLDREEAFYQFVNNLSEEDYRLMRDNNLLGTPGESTEEELLRRLQQIKEGPPPQNSDENRGGDSSDDVSNGDSIIDWLNSVRQTGNTTRSGQRGNQSWRAVSRTNPNSGDFRFSLEINVNRNNGSQNSENENEPSARRSSGENVENNSQRQVENPRSESTSARPSRSERNSTEALTEVPPTRGQRRARSRSPDHRRTRARAERSRSPLHPMSEIPRRSHHSISSQTFEHPLVNETEGSSRTRHHVTLRQQISGPELLSRGLFAASGTRNASQGAGSSDTAASGESTGSGQRPPTIVLDLQVRRVRPGEYRQRDSIASRTRSRSQTPNNTVTYESERGGFRRTFSRSERAGVRTYVSTIRIPIRRILNTGLSETTSVAIQTMLRQIMTGFGELSYFMYSDSDSEPTGSVSNRNMERAESRSGRGGSGGGSSSGSSSSSSSSSSSSSSSSSSSSPSSSSGGESSETSSDLFEGSNEGSSSSGSSGARREGRHRAPVTFDESGSLPFLSLAQFFLLNEDDDDQPRGLTKEQIDNLAMRSFGENDALKTCSVCITEYTEGNKLRKLPCSHEYHVHCIDRWLSENSTCPICRRAVLASGNRGVWNLTLHMLLY

SEQ ID NO: 902361 - protein, 453 aa, Homo sapiens
MRIPVDASTSRRFTPPSTALSPGKMSEALPLGAPDAGAALAGKLRSGDRSMVEVLADHPGELVRTDSPNFLCSVLPTHWRCNKTLPIAFKVVALGDVPDGTLVTVMAGNDENYSAELRNATAAMKNQVARFNDLRFVGRSGRGKSFTLTITVFTNPPQVATYHRAIKITVDGPREPRRHRQKLDDQTKPGSLSFSERLSELEQLRRTAMRVSPHHPAPTPNPRASLNHSTAFNPQPQSQMQDTRQIQPSPPWSYDQSYQYLGSIASPSVHPATPISPGRASGMTTLSAELSSRLSTAPDLTAFSDPRQFPALPSISDPRMHYPGAFTYSPTPVTSGIGIGMSAMGSATRYHTYLPPPYPGSSQAQGGPFQASSPSYHLYYGASAGSYQFSMVGGERSPPRILPPCTNASTGSALLNPSLPNQSDVVEAEGSHSNSPTNMAPSARLEEAVWRPY

SEQ ID NO: 902362 - protein, 250 aa, Homo sapiens
MRIPVDASTSRRFTPPSTALSPGKMSEALPLGAPDAGAALAGKLRSGDRSMVEVLADHPGELVRTDSPNFLCSVLPTHWRCNKTLPIAFKVVALGDVPDGTLVTVMAGNDENYSAELRNATAAMKNQVARFNDLRFVGRSGRGKSFTLTITVFTNPPQVATYHRAIKITVDGPREPRRHRQKLDDQTKPGSLSFSERLSELEQLRRTAMRVSPHHPAPTPNPRASLNHSTAFNPQPQSQMQEEDTAPWRC

SEQ ID NO: 902363 - protein, 348 aa, Homo sapiens
MAGNDENYSAELRNATAAMKNQVARFNDLRFVGRSGRGKSFTLTITVFTNPPQVATYHRAIKITVDGPREPRRHRQKLDDQTKPGSLSFSERLSELEQLRRTAMRVSPHHPAPTPNPRASLNHSTAFNPQPQSQMQDTRQIQPSPPWSYDQSYQYLGSIASPSVHPATPISPGRASGMTTLSAELSSRLSTAPDLTAFSDPRQFPALPSISDPRMHYPGAFTYSPTPVTSGIGIGMSAMGSATRYHTYLPPPYPGSSQAQGGPFQASSPSYHLYYGASAGSYQFSMVGGERSPPRILPPCTNASTGSALLNPSLPNQSDVVEAEGSHSNSPTNMAPSARLEEAVWRPY

SEQ ID NO: 902364 - protein, 453 aa, Homo sapiens; identical to SEQ ID NO: 902361

SEQ ID NO: 902365 - protein, 88 aa, Homo sapiens
VGRSGRGKSFTLTITVFTNPPQVATYHRAIKITVDGPREPRSKCIHLGLVHPPGWYTLQAGILRDHVSDSLGSTFPPGGCQAPVKPKS

SEQ ID NO: 902366 - protein, 389 aa, Homo sapiens
MRIPVDASTSRRFTPPSTALSPGKMSEALPLGAPDAGAALAGKLRSGDRSMVEVLADHPGELVRTDSPNFLCSVLPTHWRCNKTLPIAFKVVALGDVPDGTLVTVMAGNDENYSAELRNATAAMKNQVARFNDLRFVGRSGRGKSFTLTITVFTNPPQVATYHRAIKITVDGPREPRNTRQIQPSPPWSYDQSYQYLGSIASPSVHPATPISPGRASGMTTLSAELSSRLSTAPDLTAFSDPRQFPALPSISDPRMHYPGAFTYSPTPVTSGIGIGMSAMGSATRYHTYLPPPYPGSSQAQGGPFQASSPSYHLYYGASAGSYQFSMVGGERSPPRILPPCTNASTGSALLNPSLPNQSDVVEAEGSHSNSPTNMAPSARLEEAVWRPY

SEQ ID NO: 902367 - protein, 480 aa, Homo sapiens
MASDSIFESFPSYPQCFMRECILGMNPSRDVHDASTSRRFTPPSTALSPGKMSEALPLGAPDAGAALAGKLRSGDRSMVEVLADHPGELVRTDSPNFLCSVLPTHWRCNKTLPIAFKVVALGDVPDGTLVTVMAGNDENYSAELRNATAAMKNQVARFNDLRFVGRSGRGKSFTLTITVFTNPPQVATYHRAIKITVDGPREPRRHRQKLDDQTKPGSLSFSERLSELEQLRRTAMRVSPHHPAPTPNPRASLNHSTAFNPQPQSQMQDTRQIQPSPPWSYDQSYQYLGSIASPSVHPATPISPGRASGMTTLSAELSSRLSTAPDLTAFSDPRQFPALPSISDPRMHYPGAFTYSPTPVTSGIGIGMSAMGSATRYHTYLPPPYPGSSQAQGGPFQASSPSYHLYYGASAGSYQFSMVGGERSPPRILPPCTNASTGSALLNPSLPNQSDVVEAEGSHSNSPTNMAPSARLEEAVWRPY

SEQ ID NO: 902368 - protein, 134 aa, Homo sapiens
MHYPGAFTYSPTPVTSGIGIGMSAMGSATRYHTYLPPPYPGSSQAQGGPFQASSPSYHLYYGASAGSYQFSMVGGERSPPRILPPCTNASTGSALLNPSLPNQSDVVEAEGSHSNSPTNMAPSARLEEAVWRPY

SEQ ID NO: 902369 - protein, 480 aa, Homo sapiens; identical to SEQ ID NO: 902367

SEQ ID NO: 902370 - protein, 480 aa, Homo sapiens; identical to SEQ ID NO: 902367

SEQ ID NO: 902371 - protein, 480 aa, Homo sapiens; identical to SEQ ID NO: 902367

SEQ ID NO: 902372 - protein, 480 aa, Homo sapiens; identical to SEQ ID NO: 902367

SEQ ID NO: 902373 - protein, 182 aa, Homo sapiens
MRIPVDASTSRRFTPPSTALSPGKMSEALPLGAPDAGAALAGKLRSGDRSMVEVLADHPGELVRTDSPNFLCSVLPTHWRCNKTLPIAFKVVALGDVPDGTLVTVMAGNDENYSAELRNATAAMKNQVARFNDLRFVGRSGRGKSFTLTITVFTNPPQVATYHRAIKITVDGPREPRTASKL

SEQ ID NO: 902374 - protein, 307 aa, Homo sapiens
MRIPVDASTSRRFTPPSTALSPGKMSEALPLGAPDAGAALAGKLRSGDRSMVEVLADHPGELVRTDSPNFLCSVLPTHWRCNKTLPIAFKVVALGDVPDGTLVTVMAGNDENYSAELRNATAAMKNQVARFNDLRFVGRSGRGKSFTLTITVFTNPPQVATYHRAIKITVDGPREPRRHRQKLDDQTKPGSLSFSERLSELEQLRRTAMRVSPHHPAPTPNPRASLNHSTAFNPQPQSQMQDTRQIQPSPPWSYDQSYQYLGSIASPSVHPATPISPGRASGMTTLSAELSSRLSNSCDYFRFHQMP

SEQ ID NO: 902375 - protein, 480 aa, Homo sapiens; identical to SEQ ID NO: 902367

SEQ ID NO: 902376 - protein, 529 aa, Homo sapiens
MRIPVDASTSRRFTPPSTALSPGKMSEALPLGAPDAGAALAGKLRSGDRSMVEVLADHPGELVRTDSPNFLCSVLPTHWRCNKTLPIAFKVVALGDVPDGTLVTVMAGNDENYSAELRNATAAMKNQVARFNDLRFVGRSGRGKSFTLTITVFTNPPQVATYHRAIKITVDGPREPRRHRQKLDDQTKPGSLSFSERLSELEQLRRTAMRVSPHHPAPTPNPRASLNHSTAFNPQPQSQMQDTRQIQPSPPWSYDQSYQYLGSIASPSVHPATPISPGRASGMTTLSAELSSRLSTAPDLTAFSDPRQFPALPSISDPRMHYPGAFTYSPTPVTSGIGIGMSAMGSATRYHTYLPPPYPGSSQAQGGPFQASSPSYHLYYGASAGSYQFSMVGGERSPPRILPPCTNASTGSALLNPSLPNQSDVVEAEGSHSNSPTNMGAGLLFATSPPGSRALGPATVLGPRAPDGQDLAVGQARAASCPRSPRRRRLLAPRPSRRCPRRRTSRVSAGPSTQGTRWKANRKIPGGKL

SEQ ID NO: 902377 - protein, 257 aa, Homo sapiens
MRIPVDASTSRRFTPPSTALSPGKMSEALPLGAPDAGAALAGKLRSGDRSMVEVLADHPGELVRTDSPNFLCSVLPTHWRCNKTLPIAFKVVALGDVPDGTLVTVMAGNDENYSAELRNATAAMKNQVARFNDLRFVGRSGRGKSFTLTITVFTNPPQVATYHRAIKITVDGPREPRRHRQKLDDQTKPGSLSFSERLSELEQLRRTAMRVSPHHPAPTPNPRASLNHSTAFNPQPQSQMQDTRQIQPSPPWSYDQS

SEQ ID NO: 902378 - protein, 480 aa, Homo sapiens; identical to SEQ ID NO: 902367

SEQ ID NO: 902379 - protein, 480 aa, Homo sapiens; identical to SEQ ID NO: 902367

SEQ ID NO: 902380 - protein, 171 aa, Homo sapiens [sequence omitted]

SEQ ID NO: 902381 - protein, 202 aa, Homo sapiens
CLAGQTPRRIPRILDNVVHPATPISPGRASGMTTLSAELSSRLSTAPDLTAFSDPRQFPALPSISDPRMHYPGAFTYSPTPVTSGIGIGMSAMGSATRYHTYLPPPYPGSSQAQGGPFQASSPSYHLYYGASAGSYQFSMVGGERSPPRILPPCTNASTGSALLNPSLPNQSDVVEAEGSHSNSPTNMAPSARLEEAVWRPY

SEQ ID NO: 902382 - protein, 480 aa, Homo sapiens; identical to SEQ ID NO: 902367

SEQ ID NO: 902383 - protein, 246 aa, Homo sapiens
MRIPVDASTSRRFTPPSTALSPGKMSEALPLGAPDAGAALAGKLRSGDRSMVEVLADHPGELVRTDSPNFLCSVLPTHWRCNKTLPIAFKVVALGDVPDGTLVTVMAGNDENYSAELRNATAAMKNQVARFNDLRFVGRSGRGKSFTLTITVFTNPPQVATYHRAIKITVDGPREPRRHRQKLDDQTKPGSLSFSERLSELEQLRRTAMRVSPHHPAPTPNPRASLNHSTAFNPQPQSQMQAHLSP

SEQ ID NO: 902384 - protein, 182 aa, Homo sapiens [sequence omitted]

SEQ ID NO: 902385 - protein, 365 aa, Homo sapiens
MASDSIFESFPSYPQCFMRECILGMNPSRDVHDASTSRRFTPPSTALSPGKMSEALPLGAPDAGAALAGKLRSGDRSMVEVLADHPGELVRTDSPNFLCSVLPTHWRCNKTLPIAFKVVALGDVPDGTLVTVMAGNDENYSAELRNATAAMKNQVARFNDLRFVGRSGRGKSFTLTITVFTNPPQVATYHRAIKITVDGPREPRRHRQKLDDQTKPGSLSFSERLSELEQLRRTAMRVSPHHPAPTPNPRASLNHSTAFNPQPQSQMQEIMDAANFEQFLQERIKVNGKAGNLGGGVVTIERSKSKITVTSEVPFSKRYLKYLTKKYLKKNNLRDWLRVVANSKESYELRYFQINQDEEEEEDED

SEQ ID NO: 902386 - protein, 519 aa, Homo sapiens
HPPPPSRRRLVPPGRTRSSVGSRENKNNRPRRRRHPNVASGAWGRGAECSERTGAAATRRGARAPWGRRAPAARGSPGAAASAPAASAASASRAARLGNEEQDAASVGPGPNGCGHLGAEEPSAAASGMDQCVTVERELEKVLHKFSGYGQLCERGLEELIDYTGGLKHEILQSHGQDAELSGTLSLVLTQCCKRIKDTVQKLASDHKDIHSSVSRVGKAIDKNFDSDISSVGIDGCWQADSQRLLNEVMVEHFFRQGMLDVAEELCQESGLSVDPSQKEPFVELNRILEALKVRVLRPALEWAVSNREMLIAQNSSLEFKLHRLYFISLLMGGTTNQREALQYAKNFQPFALNHQKDIQVLMGSLVYLRQGIENSPYVHLLDANQWADICDIFTRDACALLGLSVESPLSVSFSAGCVALPALINIKAVIEQRQCTGVWNQKDELPIEVDLGKKCWYHSIFACPILRQQTTDNNPPMKLVCGHIISRDALNKMFNGSKLKCPYCPMEQSPGDAKQIFF

SEQ ID NO: 902387 - protein, 519 aa, Homo sapiens; identical to SEQ ID NO: 902386

SEQ ID NO: 902388 - protein, 226 aa, Homo sapiens
HPPPPSRRRLVPPGRTRSSVGSRENKNNRPRRRRHPNVASGAWGRGAECSERTGAAATRRGARAPWGRRAPAARGSPGAAASAPAASAASASRAARLGNEEQDAASVGPGPNGCGHLGAEEPSAAASGMDQCVTVERELEKVLHKFSGYGQLCERGLEELIDYTGGLKHEILQSHGQDAELSGTLSLVLTQCCKRIKDTVQKLASDHKDIHSSVSRVGKAIDKDSL

SEQ ID NO: 902389 - protein, 270 aa, Homo sapiens
MVEHFFRQGMLDVAEELCQESGLSVDPSQKEPFVELNRILEALKVRVLRPALEWAVSNREMLIAQNSSLEFKLHRLYFISLLMGGTTNQREALQYAKNFQPFALNHQKDIQVLMGSLVYLRQGIENSPYVHLLDANQWADICDIFTRDACALLGLSVESPLSVSFSAGCVALPALINIKAVIEQRQCTGVWNQKDELPIEVDLGKKCWYHSIFACPILRQQTTDNNPPMKLVCGHIISRDALNKMFNGSKLKCPYCPMEQSPGDAKQIFF

SEQ ID NO: 902390 - protein, 270 aa, Homo sapiens; identical to SEQ ID NO: 902389

SEQ ID NO: 902391 - protein, 260 aa, Homo sapiens
MNDMNHEVMSLIWSEDLRVQDVRRLLQSAHPVRVNVVQYPELSDHEFIEEKENRLLQLCQRTMALPVGRGMFTLFSYHPVPTEPLPIPKLNLTGRAPPRNTTVDLNSGNIDVPPNMTSWASFHNGVAAGLKIAPASQIDSAWIVYNKPKHAELANEYAGFLMALGLNGHLTKLATLNIHDYLTKGHEMTSIGLLLGVSAAKLGTMDMSITRLLSIRIPALLPPTSTELDVPHNVQVAAVVGIGLVYQGTAHRHTAEVLLG

SEQ ID NO: 902392 - protein, 316 aa, Homo sapiens
MNDMNHEVMSLIWSEDLRVQDVRRLLQSAHPVRVNVVQYPELSDHEFIEEKENRLLQLCQRTMALPVGRGMFTLFSYHPVPTEPLPIPKLNLTGRAPPRNTTVDLNSGNIDVPPNMTSWASFHNGVAAGLKIAPASQIDSAWIVYNKPKHAELANEYAGFLMALGLNGHLTKLATLNIHDYLTKGHEMTSIGLLLGVSAAALLPPTSTELDVPHNVQVAAVVGIGLVYQGTAHRHTAEVLLAEIGRPPGPEMEYCTDRESYSLAAGLALGMVCLGHGSNLIGMSDLNVPEQLYQYMVGGRRRFQTGMHREKHKSPS

SEQ ID NO: 902393 - protein, 226 aa, Homo sapiens; identical to SEQ ID NO: 902388

SEQ ID NO: 902394 - protein, 519 aa, Homo sapiens; identical to SEQ ID NO: 902386

SEQ ID NO: 902395 - protein, 519 aa, Homo sapiens; identical to SEQ ID NO: 902386

SEQ ID NO: 902396 - protein, 519 aa, Homo sapiens; identical to SEQ ID NO: 902386

SEQ ID NO: 902397 - protein, 260 aa, Homo sapiens; identical to SEQ ID NO: 902391

SEQ ID NO: 902398 - protein, 411 aa, Homo sapiens
GICERSRLVVLSIALYILGDESLVSDESSQYLTRITIAPQKLQVEQEENRFSFRHSTSVSSLAERLVVWMTNVGFTLRDLETLPFGIALPIRDAIYHCREQPASDWPEAVCLLIGRQDLSKQACEGNLPKGKSVLSSDVPSGTETEEEDDGMNDMNHEVMSLIWSEDLRVQDVRRLLQSAHPVRVNVVQYPELSDHEFIEEKENRLLQLCQRTMALPVGRGMFTLFSYHPVPTEPLPIPKLNLTGRAPPRNTTVDLNSGNIDVPPNMTSWASFHNGVAAGLKIAPASQIDSAWIVYNKPKHAELANEYAGFLMALGLNGHLTKLATLNIHDYLTKGHEMTSIGLLLGVSAAKLGTMDMSITRLLSIRIPALLPPTSTELDVPHNVQVAAVVGIGLVYQGTAHRHTAEVLLG

SEQ ID NO: 902399 - protein, 145 aa, Homo sapiens
MTSWASFHNGVAAGLKIAPASQIDSAWIVYNKPKHAELANEYAGFLMALGLNGHLTKLATLNIHDYLTKGHEMTSIGLLLGVSAAKLGTMDMSITRLLSIRIPALLPPTSTELDVPHNVQVAAVVGIGLVYQGTAHRHTAEVLLG

SEQ ID NO: 902400 - protein, 648 aa, Homo sapiens
MEMEQEKMTMNKELSPDAAAYCCSACHGDETWSYNHPIRGRAKSRSLSASPALGSTKEFRRTRSLHGPCPVTTFGPKACVLQNPQTIIATPLSLASQLLPSPAVSHSGQGGVTGQVHVLPQPSDQGVLSGPRAARGQTAPQEEAVTQEEVEALVCGHTQRWVPGPVYDAAAGGSGWAQLSLRAGMGVGQATGHIQDPASQRLTWNKSPKSVLVIKKMRDASLLQPFKELCTHLMEARGAGGKGAWGAHGVGGASIHITAPRVGSAGGMSRLALCFQENMIVYVEKKVLEDPAIASDESFGAVKKKFCTFREDYDDISNQIDFIICLGGDGTLLYASSLFQGSVPPVMAFHLGSLGFLTPFSFENFQSQVTQVIEGNAAVVLRSRLKVRVVKELRGKKTAVHNGLGENGSQAAGLDMDVGKQAMQYQVLNEVVIDRGPSSYLSNVDVYLDGHLITTVQGDGVIVSTPTGSTAYAAAAGASMIHPNVPAIMITPICPHSLSFRPIVVPAGVELKIMLSPEARNTAWVSFDGRKRQEIRHGDSISITTSCYPLPSICVRDPVSDWFESLAQCLHWNVRKKQAHFEGGGGGGGGGLGQAPIQARILPLPSKRPLGTDQSACVCDRLSQWHGHFLSVAGLEPGSAFCPDQLFF

SEQ ID NO: 902401 - protein, 253 aa, Homo sapiens
SGRARRIAARRRRRRGPGGHGATGGQGAKGQVATAGGGAAAGPAGSVRHVDAPAGARGSERHQCFSDRSSHFLTMEMEQEKMTMNKELSPDAAAYCCSACHGDETWSYNHPIRGRAKSRSLSASPALGSTKEFRRTRSLHGPCPVTTFGPKACVLQNPQTIMHIQDPASQRLTWNKSPKSVLVIKKMRDASLLQPFKELCTHLMEENMIVYVEKKVLEDPAIASDESFGAVKKKEKFLVPFSKERIIETFPQF

SEQ ID NO: 902402 - protein, 501 aa, Homo sapiens
MEQEKMTMNKELSPDAAAYCCSACHGDETWSYNHPIRGRAKSRSLSASPALGSTKEFRRTRSLHGPCPVTTFGPKACVLQNPQTIMHIQDPASQRLTWNKSPKSVLVIKKMRDASLLQPFKELCTHLMEENMIVYVEKKVLEDPAIASDESFGAVKKKFCTFREDYDDISNQIDFIICLGGDGTLLYASSLFQGSVPPVMAFHLGSLGFLTPFSFENFQSQVTQVIEGNAAVVLRSRLKVRVVKELRGKKTAVHNGLGENGSQAAGLDMDVGKQAMQYQVLNEVVIDRGPSSYLSNVDVYLDGHLITTVQGDGVIVSTPTGSTAYAAAAGASMIHPNVPAIMITPICPHSLSFRPIVVPAGVELKIMLSPEARNTAWVSFDGRKRQEIRHGDSISITTSCYPLPSICVRDPVSDWFESLAQCLHWNVRKKQAHFEGGGGGGGGGLGQAPIQARILPLPSKRPLGTDQSACVCDRLSQWHGHFLSVAGLEPGSAFCPDQLFF

SEQ ID NO: 902403 - protein, 381 aa, Homo sapiens
MSRLALCFQENMIVYVEKKVLEDPAIASDESFGAVKKKFCTFREDYDDISNQIDFIICLGGDGTLLYASSLFQGSVPPVMAFHLGSLGFLTPFSFENFQSQVTQVIEGNAAVVLRSRLKVRVVKELRGKKTAVHNGLGENGSQAAGLDMDVGKQAMQYQVLNEVVIDRGPSSYLSNVDVYLDGHLITTVQGDGVIVSTPTGSTAYAAAAGASMIHPNVPAIMITPICPHSLSFRPIVVPAGVELKIMLSPEARNTAWVSFDGRKRQEIRHGDSISITTSCYPLPSICVRDPVSDWFESLAQCLHWNVRKKQAHFEGGGGGGGGGLGQAPIQARILPLPSKRPLGTDQSACVCDRLSQWHGHFLSVAGLEPGSAFCPDQLFF

SEQ ID NO: 902404 - protein, 795 aa, Homo sapiens
MEQEKMTMNKELSPDAAAYCCSACHGDETWSYNHPIRGRAKSRSLSASPALGSTKEFRRTRSLHGPCPVTTFGPKACVLQNPQTIIATPLSLASQLLPSPAVSHSGQGGVTGQVHVLPQPSDQGVLSGPRAARGQTAPQEEAVTQEEVEALVCGHTQRWVPGPVYDAAAGGSGWAQLSLRAGMGVGQATGHIQDPASQRLTWNKSPKSVLVIKKMRDASLLQPFKELCTHLMEARGAGGKGAWGAHGVGGASIHITAPGDHGNHLKCWATAACLELGTEWGSAGCLGLCVPPWQAPDWVTNNELVGSWPGGREVRDQGATSDWAFLLCLLFRRAGVGVAAPRKATPEITALVNSWREPPPPSHLLKVLLPPGALVMKFQRETWGGGHAGHDARSLTTAPVSREPPCRRVGSAGGMSRLALCFQENMIVYVEKKVLEDPAIASDESFGAVKKKFCTFREDYDDISNQIDFIICLGGDGTLLYASSLFQGSVPPVMAFHLGSLGFLTPFSFENFQSQVTQVIEGNAAVVLRSRLKVRVVKELRGKKTAVHNGLGENGSQAAGLDMDVGKQAMQYQVLNEVVIDRGPSSYLSNVDVYLDGHLITTVQGDGVIVSTPTGSTAYAAAAGASMIHPNVPAIMITPICPHSLSFRPIVVPAGVELKIMLSPEARNTAWVSFDGRKRQEIRHGDSISITTSCYPLPSICVRDPVSDWFESLAQCLHWNVRKKQAHFEGGGGGGGGGLGQAPIQARILPLPSKRPLGTDQSACVCDRLSQWHGHFLSVAGLEPGSAFCPDQLFF

SEQ ID NO: 902405 - protein, 503 aa, Homo sapiens
MEMEQEKMTMNKELSPDAAAYCCSACHGDETWSYNHPIRGRAKSRSLSASPALGSTKEFRRTRSLHGPCPVTTFGPKACVLQNPQTIMHIQDPASQRLTWNKSPKSVLVIKKMRDASLLQPFKELCTHLMEENMIVYVEKKVLEDPAIASDESFGAVKKKFCTFREDYDDISNQIDFIICLGGDGTLLYASSLFQGSVPPVMAFHLGSLGFLTPFSFENFQSQVTQVIEGNAAVVLRSRLKVRVVKELRGKKTAVHNGLGENGSQAAGLDMDVGKQAMQYQVLNEVVIDRGPSSYLSNVDVYLDGHLITTVQGDGVIVSTPTGSTAYAAAAGASMIHPNVPAIMITPICPHSLSFRPIVVPAGVELKIMLSPEARNTAWVSFDGRKRQEIRHGDSISITTSCYPLPSICVRDPVSDWFESLAQCLHWNVRKKQAHFEGGGGGGGGGLGQAPIQARILPLPSKRPLGTDQSACVCDRLSQWHGHFLSVAGLEPGSAFCPDQLFF

SEQ ID NO: 902406 - protein, 205 aa, Homo sapiens
MEMEQEKMTMNKELSPDAAAYCCSACHGDETWSYNHPIRGRAKSRSLSASPALGSTKEFRRTRSLHGPCPVTTFGPKACVLQNPQTIMHIQDPASQRLTWNKSPKSVLVIKKMRDASLLQPFKELCTHLMEENMIVYVEKKVLEDPAIASDESFGAVKKKFCTFREDYDDISNQIDFIICLGGDGTLLYASSLFQGTQLLFSGVG

SEQ ID NO: 902407 - protein, 512 aa, Homo sapiens
MEMEQEKMTMNKELSPDAAAYCCSACHGDETWSYNHPIRGRAKSRSLSASPALGSTKEFRRTRSLHGPCPVTTFGPKACVLQNPQTIMHIQDPASQRLTWNKSPKSVLVIKKMRDASLLQPFKELCTHLMEENMIVYVEKKVLEDPAIASDESFGAVKKKFCTFREDYDDISNQIDFIICLGGDGTLLYASSLFQGSVPPVMAFHLGSLGFLTPFSFENFQSQVTQVIEGNAAVVLRSRLKVRVVKELRGKKTAVHNGLGENGSQAAGLDMDVGKQAMQYQVLNEVVIDRGPSSYLSNVDVYLDGHLITTVQGDGVIVSTPTGSTAYAAAAGASMIHPNVPAIMITPICPHSLSFRPIVVPAGVELKVRANDTPFPIMLSPEARNTAWVSFDGRKRQEIRHGDSISITTSCYPLPSICVRDPVSDWFESLAQCLHWNVRKKQAHFEGGGGGGGGGLGQAPIQARILPLPSKRPLGTDQSACVCDRLSQWHGHFLSVAGLEPGSAFCPDQLFF

SEQ ID NO: 902408 - protein, 319 aa, Homo sapiens [sequence omitted]

SEQ ID NO: 902409 - protein, 466 aa, Homo sapiens
MEMEQEKMTMNKELSPDAAAYCCSACHGDETWSYNHPIRGRAKSRSLSASPALGSTKEFRRTRSLHGPCPVTTFGPKACVLQNPQTIMHIQDPASQRLTWNKSPKSVLVIKKMRDASLLQPFKELCTHLMEENMIVYVEKKVLEDPAIASDESFGAVKKKFCTFREDYDDISNQIDFIICLGGDGTLLYASSLFQGSVPPVMAFHLGSLGFLTPFSFENFQSQVTQVIEGNAAVVLRSRLKVRVVKELRGKKTAVHNGLGENGSQAAGLDMDVGKQAMQYQVLNEVVIDRGPSSYLSNVDVYLDGHLITTVQGDGVIVSTPTGSTAYAAAAGASMIHPNVPAIMITPICPHSLSFRPIVVPAGVELKIMLSPEARNTAWVSFDGRKRQEIRHGDSISITTSCYPLPSICVRDPVSDWFESLAQCLHWNVRKKQAHFEGGGGGGGGGQTNLRVSVTACLSGTATSFL

SEQ ID NO: 902410 - protein, 503 aa, Homo sapiens; identical to SEQ ID NO: 902405

SEQ ID NO: 902411 - protein, 503 aa, Homo sapiens; identical to SEQ ID NO: 902405

SEQ ID NO: 902412 - protein, 507 aa, Homo sapiens
MEMEQEKMTMNKELSPDAAAYCCSACHGDETWSYNHPIRGRAKSRSLSASPALGSTKEFRRTRSLHGPCPVTTFGPKACVLQNPQTIMHIQDPASQRLTWNKSPKSVLVIKKMRDASLLQPFKELCTHLMEENMIVYVEKKVLEDPAIASDESFGAVKKKFCTFREDYDDISNQIDFIICLGGDGTLLYASSLFQGSVPPVMAFHLGSLGFLTPFSFENFQSQVTQVIEGNAAVVLRSRLKVRVVKELRGKKTAVHNGLGENGSQAAGLDMDVGKQAMQYQVLNEVVIDRGPSSYLSNVDVYLDGHLITTVQGDGVIVSTPTGSTAYAAAAGASMIHPNVPAIMITPICPHSLSFRPIVVPAGVELKIMLSPEARNTAWVSFDGRKRQEIRHGDSISITTSCYPLPSICVRDPVSDWFESLAQCLHWNVRKKQAHFEGGGGGGGGGLGQAPIQARILPLPSKRPLGTDQSACVCDRLSQWHGHFLSVAGLEPGSAFCPDQLNVDFCF

SEQ ID NO: 902413 - protein, 117 aa, Homo sapiens
WGGGHAGHDARSLTTAPVSREPPCRRVGSAGGMSRLALCFQENMIVYVEKKVLEDPAIASDESFGAVKKKFCTFREGGLSAALSLVSPAQFPAPLEASGTVALVIGVCALRHRGATV

SEQ ID NO: 902414 - protein, 577 aa, Homo sapiens
SGRARRIAARRRRRRGPGGHGATGGQGAKGQVATAGGGAAAGPAGSVRHVDAPAGARGSERHQCFSDRSSHFLTMEMEQEKMTMNKELSPDAAAYCCSACHGDETWSYNHPIRGRAKSRSLSASPALGSTKEFRRTRSLHGPCPVTTFGPKACVLQNPQTIMHIQDPASQRLTWNKSPKSVLVIKKMRDASLLQPFKELCTHLMEENMIVYVEKKVLEDPAIASDESFGAVKKKFCTFREDYDDISNQIDFIICLGGDGTLLYASSLFQGSVPPVMAFHLGSLGFLTPFSFENFQSQVTQVIEGNAAVVLRSRLKVRVVKELRGKKTAVHNGLGENGSQAAGLDMDVGKQAMQYQVLNEVVIDRGPSSYLSNVDVYLDGHLITTVQGDGVIVSTPTGSTAYAAAAGASMIHPNVPAIMITPICPHSLSFRPIVVPAGVELKIMLSPEARNTAWVSFDGRKRQEIRHGDSISITTSCYPLPSICVRDPVSDWFESLAQCLHWNVRKKQAHFEGGGGGGGGGLGQAPIQARILPLPSKRPLGTDQSACVCDRLSQWHGHFLSVAGLEPGSAFCPDQLFF

SEQ ID NO: 902415 - protein, 503 aa, Homo sapiens; identical to SEQ ID NO: 902405

SEQ ID NO: 902416 - protein, 370 aa, Homo sapiens
MIVYVEKKVLEDPAIASDESFGAVKKKFCTFREDYDDISNQIDFIICLGGDGTLLYASSLFQGSVPPVMAFHLGSLGFLTPFSFENFQSQVTQVIEGNAAVVLRSRLKVRVVKELRGKKTAVHNGLGENGSQAAGLDMDVGKQAMQYQVLNEVVIDRGPSSYLSNVDVYLDGHLITTVQGDGVIVSTPTGSTAYAAAAGASMIHPNVPAIMITPICPHSLSFRPIVVPAGVELKIMLSPEARNTAWVSFDGRKRQEIRHGDSISITTSCYPLPSICVRDPVSDWFESLAQCLHWNVRKKQAHFEGGGGGGGGGLGQAPIQARILPLPSKRPLGTDQSACVCDRLSQWHGHFLSVAGLEPGSAFCPDQLFF

SEQ ID NO: 902417 - protein, 322 aa, Homo sapiens
MEQEKMTMNKELSPDAAAYCCSACHGDETWSYNHPIRGRAKSRSLSASPALGSTKEFRRTRSLHGPCPVTTFGPKACVLQNPQTIMHIQDPASQRLTWNKSPKSVLVIKKMRDASLLQPFKELCTHLMEENMIVYVEKKVLEDPAIASDESFGAVKKKFCTFREDYDDISNQIDFIICLGGDGTLLYASSLFQGSVPPVMAFHLGSLGFLTPFSFENFQSQVTQVIEGNAAVVLRSRLKVRVVKELRGKKTAVHNGLGENGSQAAGLDMDVGKQAMQYQVLNEVVIDRGPSSYLSNVDVYLDGHLITTVQGDGKARSTVLGP

SEQ ID NO: 902418 - protein, 390 aa, Homo sapiens
MEMEQEKMTMNKELSPDAAAYCCSACHGDETWSYNHPIRGRAKSRSLSASPALGSTKEFRRTRSLHGPCPVTTFGPKACVLQNPQTIMHIQDPASQRLTWNKSPKSVLVIKKMRDASLLQPFKELCTHLMEENMIVYVEKKVLEDPAIASDESFGAVKKKFCTFREDYDDISNQIDFIICLGGDGTLLYASSLFQGSVPPVMAFHLGSLGFLTPFSFENFQSQVTQVIEGNAAVVLRSRLKVRVVKELRGKKTAVHNGLGENGSQAAGLDMDVGKQAMQYQVLNEVVIDRGPSSYLSNVDVYLDGHLITTVQGDGVIVSTPTGSTAYAAAAGASMIHPNVPAIMITPICPHSLSFRPIVVPAGVELKVRANDTPFPVCESFDPVQHKAGT

SEQ ID NO: 902419 - protein, 390 aa, Homo sapiens
MEMEQEKMTMNKELSPDAAAYCCSACHGDETWSYNHPIRGRAKSRSLSASPALGSTKEFRRTRSLHGPCPVTTFGPKACVLQNPQTIMHIQDPASQRLTWNKSPKSVLVIKKMRDASLLQPFKELCTHLMEENMIVYVEKKVLEDPAIASDESFGAVKKKFCTFREDYDDISNQIDFIICLGGDGTLLYASSLFQGSVPPVMAFHLGSLGFLTPFSFENFQSQVTQVIEGNAAVVLRSRLKVRVVKELRGKKTAVHNGLGENGSQAAGLDMDVGKQAMQYQVLNEVVIDRGPSSYLSNVDVYLDGHLITTVQGDGVIVSTPTGSTAYAAAAGASMIHPNVPAIMITPICPHSLSFRPIVVPAGVELKHQHHYLMLPAPLHLCAGPRERLV

SEQ ID NO: 902420 - protein, 205 aa, Homo sapiens; identical to SEQ ID NO: 902406

SEQ ID NO: 902421 - protein, 503 aa, Homo sapiens; identical to SEQ ID NO: 902405

SEQ ID NO: 902422 - protein, 503 aa, Homo sapiens; identical to SEQ ID NO: 902405

SEQ ID NO: 902423 - protein, 151 aa, Homo sapiens
PPGPAVALSRHPVLAVSLAPHRASPPLPGALPALPGPGRATPLSLASQLLPSPAVSHSGQGGVTGQVHVLPQPSDQGVLSGPRAARGQTAPQEEAVGLWGSLEGHAAFSAPPWEHAPSGLCVSGIITSRFPSPLWRGRASHASELPSSLIV

SEQ ID NO: 902424 - protein, 772 aa, Homo sapiens
MLSLKKYLTEGLLQFTILLSLIGVRVDVDTYLTSQLPPLREIILGPSSAYTQTQFHNLRNTLDGYGIHPKSIDLDNYFTARRLLSQVRALDRFQVPTTEVNAWLVHRDPEGSVSGSQPNSGLALESSSGLQDVTGPDNGVRESETEQGFGEDLEDLGAVAPPVSGDLTKEDIDLIDILWRQDIDLGAGREVFDYSHRQKEQDVEKELRDGGEQDTWAGEGAEALARNLLVDGETGESFPAQVPSGEDQTALSLEECLRLLEATCPFGENAEFPADISSITEAVPSESEPPALQNNLLSPLLTGTESPFDLEQQWQDLMSIMEMQAMEVNTSASEILYSAPPGDPLSTNYSLAPNTPINQNVSLHQASLGGCSQDFLLFSPEVESLPVASSSTLLPLAPSNSTSLNSTFGSTNLTGLFFPPQLNGTANDTAGPELPDPLGGLLDEAMLDEISLMDLAIEEGFNPVQASQLEEEFDSDSGLSLDSSHSPSSLSSSEGSSSSSSSSSSSSSSASSSASSSFSEEGAVGYSSDSETLDLEEAEGAVGYQPEYSKFCRMSYQDPAQLSCLPYLEHVGHNHTYNMAPSALDSADLPPPSALKKGSKEKQADFLDKQMSRDEHRARAMKIPFTNDKIINLPVEEFNELLSKYQLSEAQLSLIRDIRRRGKNKMAAQNCRKRKLDTILNLERDVEDLQRDKARLLREKVEFLRSLRQMKQKVQSLYQEVFGRLRDENGRPYSPSQYALQYAGDGSVLLIPRTMADQQARRQERKPKDRRK

SEQ ID NO: 902425 - protein, 742 aa, Homo sapiens
MLSLKKYLTEGLLQFTILLSLIGVRVDVDTYLTSQLPPLREIILGPSSAYTQTQFHNLRNTLDGYGIHPKSIDLDNYFTARRLLSQVRALDRFQVPTTEVNAWLVHRDPEGSVSGSQPNSGLALESSSGLQDVTGPDNGVRESETEQGFGEDLEDLGAVAPPVSGDLTKEDIDLIDILWRQDIDLGAGREVFDYSHRQKEQDVEKELRDGGEQDTWAGEGAEALARNLLVDGETGESFPAQFPADISSITEAVPSESEPPALQNNLLSPLLTGTESPFDLEQQWQDLMSIMEMQAMEVNTSASEILYSAPPGDPLSTNYSLAPNTPINQNVSLHQASLGGCSQDFLLFSPEVESLPVASSSTLLPLAPSNSTSLNSTFGSTNLTGLFFPPQLNGTANDTAGPELPDPLGGLLDEAMLDEISLMDLAIEEGFNPVQASQLEEEFDSDSGLSLDSSHSPSSLSSSEGSSSSSSSSSSSSSSASSSASSSFSEEGAVGYSSDSETLDLEEAEGAVGYQPEYSKFCRMSYQDPAQLSCLPYLEHVGHNHTYNMAPSALDSADLPPPSALKKGSKEKQADFLDKQMSRDEHRARAMKIPFTNDKIINLPVEEFNELLSKYQLSEAQLSLIRDIRRRGKNKMAAQNCRKRKLDTILNLERDVEDLQRDKARLLREKVEFLRSLRQMKQKVQSLYQEVFGRLRDENGRPYSPSQYALQYAGDGSVLLIPRTMADQQARRQERKPKDRRK

SEQ ID NO: 902426 - protein, 761 aa, Homo sapiens
MLSLKKYLTEGLLQFTILLSLIGVRVDVDTYLTSQLPPLREIILGPSSAYTQTQFHNLRNTLDGYGIHPKSIDLDNYFTARRLLSQVRALDRFQVPTTEVNAWLVHRDPEGSVSGSQPNSGLALESSSGLQDVTGPDNGVRESETEQGFGEDLEDLGAVAPPVSGDLTKEDIDLGAGREVFDYSHRQKEQDVEKELRDGGEQDTWAGEGAEALARNLLVDGETGESFPAQVPSGEDQTALSLEECLRLLEATCPFGENAEFPADISSITEAVPSESEPPALQNNLLSPLLTGTESPFDLEQQWQDLMSIMEMQAMEVNTSASEILYSAPPGDPLSTNYSLAPNTPINQNVSLHQASLGGCSQDFLLFSPEVESLPVASSSTLLPLAPSNSTSLNSTFGSTNLTGLFFPPQLNGTANDTAGPELPDPLGGLLDEAMLDEISLMDLAIEEGFNPVQASQLEEEFDSDSGLSLDSSHSPSSLSSSEGSSSSSSSSSSSSSSASSSASSSFSEEGAVGYSSDSETLDLEEAEGAVGYQPEYSKFCRMSYQDPAQLSCLPYLEHVGHNHTYNMAPSALDSADLPPPSALKKGSKEKQADFLDKQMSRDEHRARAMKIPFTNDKIINLPVEEFNELLSKYQLSEAQLSLIRDIRRRGKNKMAAQNCRKRKLDTILNLERDVEDLQRDKARLLREKVEFLRSLRQMKQKVQSLYQEVFGRLRDENGRPYSPSQYALQYAGDGSVLLIPRTMADQQARRQERKPKDRRK

SEQ ID NO: 902427 - protein, 621 aa, Homo sapiens
MLSLKKYLTEGLLQFTILLSLIGVRVDVDTYLTSQLPPLREIILGPSSAYTQTQFHNLRNTLDGYGIHPKSIDLDNYFTARRLLSQVRALDRFQVPTTEVNAWLVHRDPEGSVSGSQPNSGLALESSSGLQDVTGPDNGVRESETEQGFGEDLEDLGAVAPPVSGDLTKEDIDLIDILWRQDIDLGAGREVFDYSHRQKEQDVEKELRDGGEQDTWAGEGAEALARNLLVDGETGESFPAQFPADISSITEAVPSESEPPALQNNLLSPLLTGTESPFDLEQQWQDLMSIMEMQAMEVNTSASEILYSAPPGDPLSTNYSLAPNTPINQNVSLHQASLGGCSQDFLLFSPEVESLPVASSSTLLPLAPSNSTSLNSTFGSTNLTGLFFPPQLNGTANDTAGPELPDPLGGLLDEAMLDEISLMDLAIEEGFNPVQASQLEEEFDSDSGLSLDSSHSPSSLSSSEGSSSSSSSSSSSSSSASSSASSSFSEEGAVGYSSDSETLDLEEAEGAVGYQPEYSKFCRMSYQDPAQLSCLPYLEHVGHNHTYNMAPSALDSADLPPPSALKKGSKEKQADFLDKQMSRDEHRARAMKIPFTNDKIINLPVEELCGAKADRGEGMDL

SEQ ID NO: 902428 - protein, 270 aa, Homo sapiens
EQLRVRYSYGGGTATGEVQLRVRYSSDSETLDLEEAEGAVGYQPEYSKFCRMSYQDPAQLSCLPYLEHVGHNHTYNMAPSALDSADLPPPSALKKGSKEKQADFLDKQMSRDEHRARAMKIPFTNDKIINLPVEEFNELLSKYQLSEAQLSLIRDIRRRGKNKMAAQNCRKRKLDTILNLERDVEDLQRDKARLLREKVEFLRSLRQMKQKVQSLYQEVFGRLRDENGRPYSPSQYALQYAGDGSVLLIPRTMADQQARRQERKPKDRRK

SEQ ID NO: 902429 - protein, 742 aa, Homo sapiens; identical to SEQ ID NO: 902425

SEQ ID NO: 902430 - protein, 742 aa, Homo sapiens; identical to SEQ ID NO: 902425

SEQ ID NO: 902431 - protein, 742 aa, Homo sapiens; identical to SEQ ID NO: 902425

SEQ ID NO: 902432 - protein, 772 aa, Homo sapiens; identical to SEQ ID NO: 902424

SEQ ID NO: 902433 - protein, 772 aa, Homo sapiens; identical to SEQ ID NO: 902424

SEQ ID NO: 902434 - protein, 742 aa, Homo sapiens; identical to SEQ ID NO: 902425

SEQ ID NO: 902435 - protein, 742 aa, Homo sapiens; identical to SEQ ID NO: 902425

SEQ ID NO: 902436 - protein, 742 aa, Homo sapiens; identical to SEQ ID NO: 902425

SEQ ID NO: 902437 - protein, 772 aa, Homo sapiens; identical to SEQ ID NO: 902424

SEQ ID NO: 902438 - protein, 742 aa, Homo sapiens; identical to SEQ ID NO: 902425

SEQ ID NO: 902439 - protein, 601 aa, Homo sapiens
MLSLKKYLTEGLLQFTILLSLIGVRVDVDTYLTSQLPPLREIILGPSSAYTQTQFHNLRNTLDGYGIHPKSIDLDNYFTARRLLSQVRALDRFQVPTTEVNAWLVHRDPEGSVSGSQPNSGLALESSSGLQDVTGPDNGVRESETEQGFGEDLEDLGAVAPPVSGDLTKEDIDLIDILWRQDIDLGAGREVFDYSHRQKEQDVEKELRDGGEQDTWAGEGAEALARNLLVDGETGESFPAQFPADISSITEAVPSESEPPALQNNLLSPLLTGTESPFDLEQQWQDLMSIMEMQAMEVNTSASEILYSAPPGDPLSTNYSLAPNTPINQNVSLHQASLGGCSQDFLLFSPEVESLPVASSSTLLPLAPSNSTSLNSTFGSTNLTGLFFPPQLNGTANDTAGPELPDPLGGLLDEAMLDEISLMDLAIEEGFNPVQASQLEEEFDSDSGLSLDSSHSPSSLSSSEGSSSSSSSSSSSSSSASSSASSSFSEEGAVGYSSDSETLDLEEAEGAVGYQPEYSKFCRMSYQDPAQLSCLPYLEHVGHNHTYNMAPSALDSADLPPPSALKKGSKEKQADFLDKQMSRDEHRARAMKIPFTNDKIK

SEQ ID NO: 902440 - protein, 84 aa, Homo sapiens
MLSLKKYLTEGLLQFTILLSLIGVRVDVDTYLTSQLPPLREIILGPSSAYTQTQFHNLRNTLDGYGIHPKSIDPDQLTGSSRST

SEQ ID NO: 902441 - protein, 772 aa, Homo sapiens; identical to SEQ ID NO: 902424

SEQ ID NO: 902442 - protein, 548 aa, Homo sapiens
MLSLKKYLTEGLLQFTILLSLIGVRVDVDTYLTSQLPPLREIILGPSSAYTQTQFHNLRNTLDGYGIHPKSIDLDNYFTARRLLSQVRALDRFQVPTTEVNAWLVHRDPEGSVSGSQPNSGLALESSSGLQDVTGPDNGVRESETEQGFGEDLEDLGAVAPPVSGDLTKEDIDLIDILWRQDIDLGAGREVFDYSHRQKEQDVEKELRDGGEQDTWAGEGAEALARNLLVDGETGESFPAQFPADISSITEAVPSESEPPALQNNLLSPLLTGTESPFDLEQQWQDLMSIMEMQAMEVNTSASEILYSAPPGDPLSTNYSLAPNTPINQNVSLHQASLGGCSQDFLLFSPEVESLPVASSSTLLPLAPSNSTSLNSTFGSTNLTGLFFPPQLNGTANDTAGPELPDPLGGLLDEAMLDEISLMDLAIEEGFNPVQASQLEEEFDSDSGLSLDSSHSPSSLSSSEGSSSSSSSSSSSSSSASSSASSSFSEEGAVGYSSDSETLDLEEAEGAVGYQPEYSKFCRMSYQDPVSRPATTQCPQERQQGEAG

SEQ ID NO: 902443 - protein, 299 aa, Homo sapiens
YYLIQIVSSSEAGEQLCSSLLVHSSSSSSSSSSSSSASSSASSSFSEEGAVGYSSDSETLDLEEAEGAVGYQPEYSKFCRMSYQDPAQLSCLPYLEHVGHNHTYNMAPSALDSADLPPPSALKKGSKEKQADFLDKQMSRDEHRARAMKIPFTNDKIINLPVEEFNELLSKYQLSEAQLSLIRDIRRRGKNKMAAQNCRKRKLDTILNLERDVEDLQRDKARLLREKVEFLRSLRQMKQKVQSLYQEVFGRLRDENGRPYSPSQYALQYAGDGSVLLIPRTMADQQARRQERKPKDRRK

SEQ ID NO: 902444 - protein, 742 aa, Homo sapiens; identical to SEQ ID NO: 902425

SEQ ID NO: 902445 - protein, 742 aa, Homo sapiens; identical to SEQ ID NO: 902425

SEQ ID NO: 902446 - protein, 77 aa, Homo sapiens
CYARNYWESRSELMCLVLASVLVVRGHVTRAECACMWSAGVCDSLDKHVSLETPLVSVEEAGHSDPRRKACSSSQRK

SEQ ID NO: 902447 - protein, 742 aa, Homo sapiens; identical to SEQ ID NO: 902425

SEQ ID NO: 902448 - protein, 742 aa, Homo sapiens; identical to SEQ ID NO: 902425

SEQ ID NO: 902449 - protein, 742 aa, Homo sapiens; identical to SEQ ID NO: 902425

SEQ ID NO: 902450 - protein, 772 aa, Homo sapiens; identical to SEQ ID NO: 902424

SEQ ID NO: 902451 - protein, 742 aa, Homo sapiens; identical to SEQ ID NO: 902425

SEQ ID NO: 902452 - protein, 298 aa, Homo sapiens
MLSLKKYLTEGLLQFTILLSLIGVRVDVDTYLTSQLPPLREIILGPSSAYTQTQFHNLRNTLDGYGIHPKSIDLDNYFTARRLLSQVRALDRFQVPTTEVNAWLVHRDPEGSVSGSQPNSGLALESSSGLQDVTGPDNGVRESETEQGFGEDLEDLGAVAPPVSGDLTKEDIDLIDILWRQDIDLGAGREVFDYSHRQKEQDVEKELRDGGEQDTWAGEGAEALARNLLVDGETGESFPAQFPADISSITEAVPSESEPPALQNNLLSPLLTGTESPFDLEQQWQDLMSIMEMQAGVQ

SEQ ID NO: 902453 - protein, 55 aa, Homo sapiens
MNSEVPMNSEVPMNSEVPMNSEVPMNSEVPMNSEPRYFIGTISSRGPCITDIIRV

SEQ ID NO: 902454 - protein, 481 aa, Homo sapiens
EKWPGLCRQRRPGAERDRALAEACRHGPAPPPPPVTRAARAVSVMALAGAPAGGPCAPALEALLGAGALRLLDSSQIVIISAAQDASAPPAPTGPAAPAAGPCDPDLLLFATPQAPRPTPSAPRPALGRPPVKRRLDLETDHQYLAESSGPARGRGRHPGKGVKSPGEKSRYETSLNLTTKRFLELLSHSADGVVDLNWAAEVLKVQKRRIYDITNVLEGIQLIAKKSKNHIQWLGSHTTVGVGGRLEGLTQDLRQLQESEQQLDHLMNICTTQLRLLSEDTDSQRLAYVTCQDLRSIADPAEQMVMVIKAPPETQLQAVDSSENFQISLKSKQGPIDVFLCPEETVGGISPGKTPSQEVTSEEENRATDSATIVSPPPSSPPSSLTTDPSQSLLSLEQEPLLSRMGSLRAPVDEDRLSPLVAADSLLEHVREDFSGLLPEEFISLSPPHEALDYHFGLEEGEGIRDLFDCDFGDLTPLDF

SEQ ID NO: 902455 - protein, 281 aa, Homo sapiens
LLSAEGVVENWDAEVLKVQKRRYKKVLGIKLIEKKSKNIKWLGKTKKASADGYEGLKQDLRKMKAKKWKMNICTSNGCSQRTLTESLAYVTCQDLRSIADPAEQMVMVIKAPPETQLQAVDSSENFQISLKSKQGPIDVFLCPEETVGGISPGKTPSQEVTSEEENRATDSATIVSPPPSSPPSSLTTDPSQSLLSLEQEPLLSRMGSLRAPVDEDRLSPLVAADSLLEHVREDFSGLLPEEFISLSPPHEALDYHFGLEEGEGIRDLFDCDFGDLTPLDF

SEQ ID NO: 902456 - protein, 523 aa, Homo sapiens
EKWPGLCRQRRPGAERDRALAEACRHGPAPPPPPVTRAARAVSVMALAGAPAGGPCAPALEALLGAGALRLLDSSQIVIISAAQDASAPPAPTGPAAPAAGPCDPDLLLFATPQAPRPTPSAPRPALGRPPVKRRLDLETDHQYLAESSGPARGRGRHPGKGVKSPGEKSRYETSLNLTTKRFLELLSHSADGVVDLNWAAEVLKVQKRRIYDITNVLEGIQLIAKKSKNHIQWLGSHTTVGVGGRLEGLTQDLRQLQESEQQLDHLMNICTTQLRLLSEDTDSQRLAYVTCQDLRSIADPAEQMVMVIKAPPETQLQAVDSSENFQISLKSKQGPIDVFLCPEETVGGISPGKTPSQEVTSEEENRATDSATIVSPPPSSPPSSLTTDPSQSLLSLEQGGVMGRWVGWGRAPLLGGGQARQPLPSSLLGHPRPVMLPVSPEPLLSRMGSLRAPVDEDRLSPLVAADSLLEHVREDFSGLLPEEFISLSPPHEALDYHFGLEEGEGIRDLFDCDFGDLTPLDF

SEQ ID NO: 902457 - protein, 481 aa, Homo sapiens; identical to SEQ ID NO: 902454

SEQ ID NO: 902458 - protein, 475 aa, Homo sapiens
VKVAGTLQAAAAGGGAGSSPRRGLPPWARAAAAACHPGRAGRERHGLGRGPCGRPMRAGAGGPARGRRRCGCSTPRRSSSSPPRRTPAPRRLPPAPRHPDLLLFATPQAPRPTPSAPRPALGRPPVKRRLDLETDHQYLAESSGPARGRGRHPGKGVKSPGEKSRYETSLNLTTKRFLELLSHSADGVVDLNWAAEVLKVQKRRIYDITNVLEGIQLIAKKSKNHIQWLGSHTTVGVGGRLEGLTQDLRQLQESEQQLDHLMNICTTQLRLLSEDTDSQRLAYVTCQDLRSIADPAEQMVMVIKAPPETQLQAVDSSENFQISLKSKQGPIDVFLCPEETVGGISPGKTPSQEVTSEEENRATDSATIVSPPPSSPPSSLTTDPSQSLLSLEQEPLLSRMGSLRAPVDEDRLSPLVAADSLLEHVREDFSGLLPEEFISLSPPHEALDYHFGLEEGEGIRDLFDCDFGDLTPLDF

SEQ ID NO: 902459 - protein, 523 aa, Homo sapiens; identical to SEQ ID NO: 902456

SEQ ID NO: 902460 - protein, 481 aa, Homo sapiens; identical to SEQ ID NO: 902454

SEQ ID NO: 902461 - protein, 1121 aa, Homo sapiens
MSLENEDKRARTRSKALRGPPETTAADLSCPTPGCTGSGHVRGKYSRHRSLQSCPLAKKRKLEGAEAEHLVSKRKSHPLKLALDEGYGVDSDGSEDTEVKDASVSDESEGTLEGAEAETSGQDEIHRPETAEGRSPVKSHFGSNPIGSATASSKGSYSSYQGIIATSLLNLGQIAEETLVEEDLGQAAKPGPGIVHLLQEAAEGAASEEGEKGLFIQPEDAEEVVEVTTERSQDLCPQSLEDAASEESSKQKGILSHEEEDEEEEEEEEEEEEDEEEEEEEEEEEEEEEEEEEEEEEEEEEEEEEEAAPDVIFQEDTSHTSAQKAPELRGPESPSPKPEYSVIVEVRSDDDKDEDTHSRKSTVTDESEMQDMMTRGNLGLLEQAIALKAEQVRTVCEPGCPPAEQSQLGLGEPGKAAKPLDTVRKSYYSKDPSRAEKREIKCPTPGCDGTGHVTGLYPHHRSLSGCPHKDRIPPEILAMHENVLKCPTPGCTGQGHVNSNRNTHRSLSGCPIAAAEKLAKSHEKQQPQTGDPSKSSSNSDRILRPMCFVKQLEVPPYGSYRPNVAPATPRANLAKELEKFSKVTFDYASFDAQVFGKRMLAPKIQTSETSPKAFQCFDYSQDAEAAHMAATAILNLSTRCWEMPENLSTKPQDLPSKSVDIEVDENGTLDLSMHKHRKRENAFPSSSSCSSSPGVKSPDASQRHSSTSAPSSSMTSPQSSQASRQDEWDRPLDYTKPSRLREEEPEESEPAAHSFASSEADDQEVSEENFEERKYPGEVTLTNFKLKFLSKDIKKELLTCPTPGCDGSGHITGNYASHRSLSGCPLADKSLRNLMAAHSADLKCPTPGCDGSGHITGNYASHRSLSGCPRAKKSGVKVAPTKDDKEDPELMKCPVPGCVGLGHISGKYASHRSASGCPLAARRQKEGSLNGSSFSWKSLKNEGPTCPTPGCDGSGHANGSFLTHRSLSGCPRATFAGKKGKLSGDEVLSPKFKTSDVLENDEEIKQLNQEIRDLNESNSEMEAAMVQLQSQISSMEKNLKNIEEENKLIEEQNEALFLELSGLSQALIQSLANIRLPHMEPICEQNFDAYVSTLTDMYSNQDPENKDLLESIKQAVRGIQV

SEQ ID NO: 902462 - protein, 421 aa, Homo sapiens
RRRGGGGGGGGGCLRRPRLERRCSAADTRGTRPRSCRWQPRRSEPVGRPSLEYCLSVILNMGGAVSAGEDNDELIDNLKEAQYIRTELVEQAFRAIDRADYYLEEFKENAYKDLAWKHGNIHLSAPCIYSEVMEALDLQPGLSFLNLGSGTGYLSSMVGLILGPFGVNHGVELHSDVIEYAKQKLDFFIRTSDSFDKFDFCEPSFVTGNCLEISPDCSQYDRVYCGAGVQKEHEEYMKNLLKVGGILVMPLEEKLTKITRTGPSAWETKKILAVSFAPLIQPCHSESGKSRLVQLPPVAVRSLQDLARIAIRGTIKKIIHQETVSKNGNGLKNTPRFKRRRVRRRRMETIVFLDKEVFASRISNPSDDNSCEDLEEERREEEEKTPPETKPDPPVNFLRQKVLSLPLPDPLKYYLLYYREK

SEQ ID NO: 902463 - protein, 1595 aa, Homo sapiens
MSLENEDKRARTRSKALRGPPETTAADLSCPTPGCTGSGHVRGKYSRHRSLQSCPLAKKRKLEGAEAEHLVSKRKSHPLKLALDEGYGVDSDGSEDTEVKDASVSDESEGTLEGAEAETSGQDEIHRPETAEGRSPVKSHFGSNPIGSATASSKGSYSSYQGIIATSLLNLGQIAEETLVEEDLGQAAKPGPGIVHLLQEAAEGAASEEGEKGLFIQPEDAEEVVEVTTERSQDLCPQSLEDAASEESSKQKGILSHEEEDEEEEEEEEEEEEDEEEEEEEEEEEEEEEEEEEEEEEEEEEEEEEEAAPDVIFQEDTSHTSAQKAPELRGPESPSPKPEYSVIVEVRSDDDKDEDTHSRKSTVTDESEMQDMMTRGNLGLLEQAIALKAEQVRTVCEPGCPPAEQSQLGLGEPGKAAKPLDTVRKSYYSKDPSRAEKREIKCPTPGCDGTGHVTGLYPHHRSLSGCPHKDRIPPEILAMHENVLKCPTPGCTGQGHVNSNRNTHRSLSGCPIAAAEKLAKSHEKQQPQTGDPSKSSSNSDRILRPMCFVKQLEVPPYGSYRPNVAPATPRANLAKELEKFSKVTFDYASFDAQVFGKRMLAPKIQTSETSPKAFQCFDYSQDAEAAHMAATAILNLSTRCWEMPENLSTKPQDLPSKSVDIEVDENGTLDLSMHKHRKRENAFPSSSSCSSSPGVKSPDASQRHSSTSAPSSSMTSPQSSQASRQDEWDRPLDYTKPSRLREEEPEESEPAAHSFASSEADDQEVSEENFEERKYPGEVTLTNFKLKFLSKDIKKELLTCPTPGCDGSGHITGNYASHRSLSGCPLADKSLRNLMAAHSADLKCPTPGCDGSGHITGNYASHRSLSGCPRAKKSGVKVAPTKDDKEDPELMKCPVPGCVGLGHISGKYASHRSASGCPLAARRQKEGSLNGSSFSWKSLKNEGPTCPTPGCDGSGHANGSFLTHRSLSGCPRATFAGKKGKLSGDEVLSPKFKTSDVLENDEEIKQLNQEIRDLNESNSEMEAAMVQLQSQISSMEKNLKNIEEENKLIEEQNEALFLELSGLSQALIQSLANIRLSAHGANMRTEFRCLCEHPHRHVLQPGPGEQGPPGEHQAGCEGHPGLGRVVPRSVPAHHTVYLPRPAPHRGDAQLTVTSRLGPGVAAGGFIQRDGWKLAAPTRLPPGLGRGGPICVHRGTEELQSDLFLFSERNLKSSSKSPVEAHGQGSQYCLSVILNMGGAVSAGEDNDELIDNLKEAQYIRTELVEQAFRAIDRADYYLEEFKENAYKDLAWKHGNIHLSAPCIYSEVMEALDLQPGLSFLNLGSGTGYLSSMVGLILGPFGVNHGVELHSDVIEYAKQKLDFFIRTSDSFDKFDFCEPSFVTGNCLEISPDCSQYDRVYCGAGVQKEHEEYMKNLLKVGGILVMPLEEKLTKITRTGPSAWETKKILAVSFAPLIQPCHSESGKSRLVQLPPVAVRSLQDLARIAIRGTIKKIIHQETVSKNGNGLKNTPRFKRRRVRRRRMETIVFLDKEVFASRISNPSDDNSCEDLEEERREEEEKTPPETKPDPPVNFLRQKVLSLPLPDPLKYYLLYYREK

SEQ ID NO: 902464 - protein, 1324 aa, Homo sapiens
MSLENEDKRARTRSKALRGPPETTAADLSCPTPGCTGSGHVRGKYSRHRSLQSCPLAKKRKLEGAEAEHLVSKRKSHPLKLALDEGYGVDSDGSEDTEVKDASVSDESEGTLEGAEAETSGQDEIHRPETAEDPSRAEKREIKCPTPGCDGTGHVTGLYPHHRSLSGCPHKDRIPPEILAMHENVLKCPTPGCTGQGHVNSNRNTHRSLSGCPIAAAEKLAKSHEKQQPQTGDPSKSSSNSDRILRPMCFVKQLEVPPYGSYRPNVAPATPRANLAKELEKFSKVTFDYASFDAQVFGKRMLAPKIQTSETSPKAFQSKPFPKASSPRHSPSSSYVRSTSSSSAGFDYSQDAEAAHMAATAILNLSTRCWEMPENLSTKPQDLPSKSVDIEVDENGTLDLSMHKHRKRENAFPSSSSCSSSPGVKSPDASQRHSSTSAPSSSMTSPQSSQASRQDEWDRPLDYTKPSRLREEEPEESEPAAHSFASSEADDQEVSEENFEERKYPGEVTLTNFKLKFLSKDIKKELLTCPTPGCDGSGHITGNYASHRSLSGCPLADKSLRNLMAAHSADLKCPTPGCDGSGHITGNYASHRSLSGCPRAKKSGVKVAPTKDDKEDPELMKCPVPGCVGLGHISGKYASHRSASGCPLAARRQKEGSLNGSSFSWKSLKNEGPTCPTPGCDGSGHANGSFLTHRSLSGCPRATFAGKKGKLSGDEVLSPKFKTSDVLENDEEIKQLNQEIRDLNESNSEMEAAMVQLQSQISSMEKNLKNIEEENKLIEEQNEALFLELSGLSQALIQSLANIRLSAHGANMRTEFRCLCEHPHRHVLQPGPGEQGPPGEHQAGCEGHPGLGRVVPRSVPAHHTVYLPRPAPHRGDAQLTVTSRLGPGVAAGGFIQRDGWKLAAPTRLPPGLGRGGPICVHRGTEELQSDLFLFSERNLKSSSKSPVEAHGQGSQYCLSVILNMGGAVSAGEDNDELIDNLKEAQYIRTELVEQAFRAIDRADYYLEEFKENAYKDLAWKHGNIHLSAPCIYSEVMEALDLQPGLSFLNLGSGTGYLSSMVGLILGPFGVNHGVELHSDVIEYAKQKLDFFIRTSDSFDKFDFCEPSFVTGNCLEISPDCSQYDRVYCGAGVQKEHEEYMKNLLKVGGILVMPLEEKLTKITRTGPSAWETKKILAVSFAPLIQPCHSESGKSRLVQLPPVAVRSLQDLARIAIRGTIKKIIHQETVSKNGNGLKNTPRFKRRRVRRRRMETIVFLDKEVFASRISNPSDDNSCEDLEEERREEEEKTPPETKPDPPVNFLRQKVLSLPLPDPLKYYLLYYREK

SEQ ID NO: 902465 - protein, 1109 aa, Homo sapiens
MSLENEDKRARTRSKALRGPPETTAADLSCPTPGCTGSGHVRGKYSRHRSLQSCPLAKKRKLEGAEAEHLVSKRKSHPLKLALDEGYGVDSDGSEDTEVKDASVSDESEGTLEGAEAETSGQDEIHRPETAEGRSPVKSHFGSNPIGSATASSKGSYSSYQGIIATSLLNLGQIAEETLVEEDLGQAAKPGPGIVHLLQEAAEGAASEEGEKGLFIQPEDAEEVVEVTTERSQDLCPQSLEDAASEESSKQKGILSHEEEDEEEEEEEEEEEEDEEEEEEEEEEEEEEEEEEEEEEEEEEEEEEEEAAPDVIFQEDTSHTSAQKAPELRGPESPSPKPEYSVIVEVRSDDDKDEDTHSRKSTVTDESEMQDMMTRGNLGLLEQAIALKAETDPSRAEKREIKCPTPGCDGTGHVTGLYPHHRSLSGCPHKDRIPPEILAMHENVLKCPTPGCTGQGHVNSNRNTHRSLSGCPIAAAEKLAKSHEKQQPQTGDPSKSSSNSDRILRPMCFVKQLEVPPYGSYRPNVAPATPRANLAKELEKFSKVTFDYASFDAQVFGKRMLAPKIQTSETSPKAFQSKPFPKASSPRHSPSSSYVRSTSSSSAGFDYSQDAEAAHMAATAILNLSTRCWEMPENLSTKPQDLPSKSVDIEVDENGTLDLSMHKHRKRENAFPSSSSCSSSPGVKSPDASQRHSSTSAPSSSMTSPQSSQASRQDEWDRPLDYTKPSRLREEEPEESEPAAHSFASSEADDQEVSEENFEERKYPGEVTLTNFKLKFLSKDIKKELLTCPTPGCDGSGHITGNYASHRSLSGCPLADKSLRNLMAAHSADLKCPTPGCDGSGHITGNYASHRSLSGCPRAKKSGVKVAPTKDDKEDPELMKCPVPGCVGLGHISGKYASHRSASGCPLAARRQKEGSLNGSSFSWKSLKNEGPTCPTPGCDGSGHANGSFLTHRSLSGCPRATFAGKKGKLSGDEVLSPKFKTSDVLENDEEIKQLNQEIRDLNESNSEMEAAMVQLQSQISSMEKNLKNIEEENKLIEEQNEALFLELSGLSQALIQSLANIRLPHMEPICEQNFDAYVSTLTDMYSNQDPENKDLLESIKQAVRGIQV

SEQ ID NO: 902466 - protein, 439 aa, Homo sapiens
RRRGGGGGGGGGCLRRPRLERRCSAADTRGTRPRSCRWQPRRSEPVGRPSLEVEPPPPPPPLGPACGERVYCLSVILNMGGAVSAGEDNDELIDNLKEAQYIRTELVEQAFRAIDRADYYLEEFKENAYKDLAWKHGNIHLSAPCIYSEVMEALDLQPGLSFLNLGSGTGYLSSMVGLILGPFGVNHGVELHSDVIEYAKQKLDFFIRTSDSFDKFDFCEPSFVTGNCLEISPDCSQYDRVYCGAGVQKEHEEYMKNLLKVGGILVMPLEEKLTKITRTGPSAWETKKILAVSFAPLIQPCHSESGKSRLVQLPPVAVRSLQDLARIAIRGTIKKIIHQETVSKNGNGLKNTPRFKRRRVRRRRMETIVFLDKEVFASRISNPSDDNSCEDLEEERREEEEKTPPETKPDPPVNFLRQKVLSLPLPDPLKYYLLYYREK

SEQ ID NO: 902467 - protein, 174 aa, Homo sapiens
LILSLGYLTKITRTGPSAWETKKILAVSFAPLIQPCHSESGKSRLVQLPPVAVRSLQDLARIAIRGTIKKIIHQETVSKNGNGLKNTPRFKRRRVRRRRMETIVFLDKEVFASRISNPSDDNSCEDLEEERREEEEKTPPETKPDPPVNFLRQKVLSLPLPDPLKYYLLYYREK

SEQ ID NO: 902468 - protein, 421 aa, Homo sapiens; identical to SEQ ID NO: 902462

SEQ ID NO: 902469 - protein, 1595 aa, Homo sapiens; identical to SEQ ID NO: 902463

SEQ ID NO: 902470 - protein, 421 aa, Homo sapiens; identical to SEQ ID NO: 902462

SEQ ID NO: 902471 - protein, 319 aa, Homo sapiens
RRRGGGGGGGGGCLRRPRLERRCSAADTRGTRPRSCRWQPRRSEPVGRPSLEYCLSVILNMGGAVSAGEDNDELIDNLKEAQYIRTELVEQAFRAIDRADYYLEEFKENAYKDLAWKHGNIHLSAPCIYSEVMEALDLQPGLSFLNLGSGTGYLSSMVGLILGPFGVNHGVELHSDVIEYAKQKLDFFIRTSDSFDKFDFCEPSFVTGNCLEISPDCSQYDRVYCGAGVQKEHEEYMKNLLKVGGILVMPLEEKLTKITRTGPSAWETKKILAVSFAPLIQPCHSESGKSRLVQLRSPSFVQGWSVVVLSQLTAASTFQ

SEQ ID NO: 902472 - protein, 900 aa, Homo sapiens
MSLENEDKRARTRSKALRGPPETTAADLSCPTPGCTGSGHVRGKYSRHRSLQSCPLAKKRKLEGAEAEHLVSKRKSHPLKLALDEGYGVDSDGSEDTEVKDASVSDESEGTLEGAEAETSGQDEIHRPETAEGRSPVKSHFGSNPIGSATASSKGSYSSYQGIIATSLLNLGQIAEETLVEEDLGQAAKPGPGIVHLLQEAAEGAASEEGEKGLFIQPEDAEEVVEVTTERSQDLCPQSLEDAASEESSKQKGILSHEEEDEEEEEEEEEEEEDEEEEEEEEEEEEEEEEEEEEEEEEEEEEEEEEAAPDVIFQEDTSHTSAQKAPELRGPESPSPKPEYSVIVEVRSDDDKDEDTHSRKSTVTDESEMQDMMTRGNLGLLEQAIALKAETDPSRAEKREIKCPTPGCDGTGHVTGLYPHHRSLSGCPHKDRIPPEILAMHENVLKCPTPGCTGQGHVNSNRNTHRSLSGCPIAAAEKLAKSHEKQQPQTGDPSKSSSNSDRILRPMCFVKQLEVPPYGSYRPNVAPATPRANLAKELEKFSKVTFDYASFDAQVFGKRMLAPKIQTSETSPKAFQSKPFPKASSPRHSPSSSYVRSTSSSSAGFDYSQDAEAAHMAATAILNLSTRCWEMPENLSTKPQDLPSKSVDIEVDENGTLDLSMHKHRKRENAFPSSSSCSSSPGVKSPDASQRHSSTSAPSSSMTSPQSSQASRQDEWDRPLDYTKPSRLREEEPEESEPAAHSFASSEADDQEVSEENFEERKYPGEVTLTNFKLKFLSKDIKKELLTCPTPGCDGSGHITGNYASHRSLSGCPLADKSLRNLMAAHSADLKCPTPGCDGSGHITGNYASHRSLSGCPRAKKSGVKVAPTKDDKEDPELMKYVGPCWLFHCIAELRFSCVL

SEQ ID NO: 902473 - protein, 1595 aa, Homo sapiens; identical to SEQ ID NO: 902463

SEQ ID NO: 902474 - protein, 1583 aa, Homo sapiens
MSLENEDKRARTRSKALRGPPETTAADLSCPTPGCTGSGHVRGKYSRHRSLQSCPLAKKRKLEGAEAEHLVSKRKSHPLKLALDEGYGVDSDGSEDTEVKDASVSDESEGTLEGAEAETSGQDEIHRPETAEGRSPVKSHFGSNPIGSATASSKGSYSSYQGIIATSLLNLGQIAEETLVEEDLGQAAKPGPGIVHLLQEAAEGAASEEGEKGLFIQPEDAEEVVEVTTERSQDLCPQSLEDAASEESSKQKGILSHEEEDEEEEEEEEEEEEDEEEEEEEEEEEEEEEEEEEEEEEEEEEEEEEEAAPDVIFQEDTSHTSAQKAPELRGPESPSPKPEYSVIVEVRSDDDKDEDTHSRKSTVTDESEMQDMMTRGNLGLLEQAIALKAETDPSRAEKREIKCPTPGCDGTGHVTGLYPHHRSLSGCPHKDRIPPEILAMHENVLKCPTPGCTGQGHVNSNRNTHRSLSGCPIAAAEKLAKSHEKQQPQTGDPSKSSSNSDRILRPMCFVKQLEVPPYGSYRPNVAPATPRANLAKELEKFSKVTFDYASFDAQVFGKRMLAPKIQTSETSPKAFQSKPFPKASSPRHSPSSSYVRSTSSSSAGFDYSQDAEAAHMAATAILNLSTRCWEMPENLSTKPQDLPSKSVDIEVDENGTLDLSMHKHRKRENAFPSSSSCSSSPGVKSPDASQRHSSTSAPSSSMTSPQSSQASRQDEWDRPLDYTKPSRLREEEPEESEPAAHSFASSEADDQEVSEENFEERKYPGEVTLTNFKLKFLSKDIKKELLTCPTPGCDGSGHITGNYASHRSLSGCPLADKSLRNLMAAHSADLKCPTPGCDGSGHITGNYASHRSLSGCPRAKKSGVKVAPTKDDKEDPELMKCPVPGCVGLGHISGKYASHRSASGCPLAARRQKEGSLNGSSFSWKSLKNEGPTCPTPGCDGSGHANGSFLTHRSLSGCPRATFAGKKGKLSGDEVLSPKFKTSDVLENDEEIKQLNQEIRDLNESNSEMEAAMVQLQSQISSMEKNLKNIEEENKLIEEQNEALFLELSGLSQALIQSLANIRLSAHGANMRTEFRCLCEHPHRHVLQPGPGEQGPPGEHQAGCEGHPGLGRVVPRSVPAHHTVYLPRPAPHRGDAQLTVTSRLGPGVAAGGFIQRDGWKLAAPTRLPPGLGRGGPICVHRGTEELQSDLFLFSERNLKSSSKSPVEAHGQGSQYCLSVILNMGGAVSAGEDNDELIDNLKEAQYIRTELVEQAFRAIDRADYYLEEFKENAYKDLAWKHGNIHLSAPCIYSEVMEALDLQPGLSFLNLGSGTGYLSSMVGLILGPFGVNHGVELHSDVIEYAKQKLDFFIRTSDSFDKFDFCEPSFVTGNCLEISPDCSQYDRVYCGAGVQKEHEEYMKNLLKVGGILVMPLEEKLTKITRTGPSAWETKKILAVSFAPLIQPCHSESGKSRLVQLPPVAVRSLQDLARIAIRGTIKKIIHQETVSKNGNGLKNTPRFKRRRVRRRRMETIVFLDKEVFASRISNPSDDNSCEDLEEERREEEEKTPPETKPDPPVNFLRQKVLSLPLPDPLKYYLLYYREK

SEQ ID NO: 902475 - protein, 261 aa, Homo sapiens
MEAWKHSPLSPVHHSDVIEYAKQKLDFFIRTSDSFDKFDFCEPSFVTGNCLEISPDCSQYDRVYCGAGVQKEHEEYMKNLLKVGGILVMPLEEKLTKITRTGPSAWETKKILAVSFAPLIQPCHSESGKSRLVQLPPVAVRSLQDLARIAIRGTIKKIIHQETVSKNGNGLKNTPRFKRRRVRRRRMETIVFLDKEVFASRISNPSDDNSCEDLEEERREEEEKTPPETKPDPPVNFLRQKVLSLPLPDPLKYYLLYYREK

SEQ ID NO: 902476 - protein, 361 aa, Homo sapiens
MGGAVSAGEDNDELIDNLKEAQYIRTELVEQAFRAIDRADYYLEEFKENAYKDLAWKHGNIHLSAPCIYSEVMEALDLQPGLSFLNLGSGTGYLSSMVGLILGPFGVNHGVELHSDVIEYAKQKLDFFIRTSDSFDKFDFCEPSFVTGNCLEISPDCSQYDRVYCGAGVQKEHEEYMKNLLKVGGILVMPLEEKLTKITRTGPSAWETKKILAVSFAPLIQPCHSESGKSRLVQLPPVAVRSLQDLARIAIRGTIKKIIHQETVSKNGNGLKNTPRFKRRRVRRRRMETIVFLDKEVFASRISNPSDDNSCEDLEEERREEEEKTPPETKPDPPVNFLRQKVLSLPLPDPLKYYLLYYREK

SEQ ID NO: 902477 - protein, 1109 aa, Homo sapiens; identical to SEQ ID NO: 902465

SEQ ID NO: 902478 - protein, 850 aa, Homo sapiens
MSLENEDKRARTRSKALRGPPETTAADLSCPTPGCTGSGHVRGKYSRHRSLQSCPLAKKRKLEGAEAEHLVSKRKSHPLKLALDEGYGVDSDGSEDTEVKDASVSDESEGTLEGAEAETSGQDEIHRPETAEDPSRAEKREIKCPTPGCDGTGHVTGLYPHHRSLSGCPHKDRIPPEILAMHENVLKCPTPGCTGQGHVNSNRNTHRSLSGCPIAAAEKLAKSHEKQQPQTGDPSKSSSNSDRILRPMCFVKQLEVPPYGSYRPNVAPATPRANLAKELEKFSKVTFDYASFDAQVFGKRMLAPKIQTSETSPKAFQSKPFPKASSPRHSPSSSYVRSTSSSSAGFDYSQDAEAAHMAATAILNLSTRCWEMPENLSTKPQDLPSKSVDIEVDENGTLDLSMHKHRKRENAFPSSSSCSSSPGVKSPDASQRHSSTSAPSSSMTSPQSSQASRQDEWDRPLDYTKPSRLREEEPEESEPAAHSFASSEADDQEVSEENFEERKYPGEVTLTNFKLKFLSKDIKKELLTCPTPGCDGSGHITGNYASHRSLSGCPLADKSLRNLMAAHSADLKCPTPGCDGSGHITGNYASHRSLSGCPRAKKSGVKVAPTKDDKEDPELMKCPVPGCVGLGHISGKYASHRSASGCPLAARRQKEGSLNGSSFSWKSLKNEGPTCPTPGCDGSGHANGSFLTHRSLSGCPRATFAGKKGKLSGDEVLSPKFKTSDVLENDEEIKQLNQEIRDLNESNSEMEAAMVQLQSQISSMEKNLKNIEEENKLIEEQNEALFLELSGLSQALIQSLANIRLPHMEPICEQNFDAYVSTLTDMYSNQDPENKDLLESIKQAVRGIQV

SEQ ID NO: 902479 - protein, 315 aa, Homo sapiens
RRRGGGGGGGGGCLRRPRLERRCSAADTRGTRPRSCRWQPRRSEPVGRPSLEYCLSVILNMGGAVSAGEDNDELIDNLKEAQYIRTELVEQAFRAIDRADYYLEEFKENAYKDLAWKHGNIHLSAPCIYSEVMEALDLQPGLSFLNLGSGTGYLSSMVGLILGPFGVNHGVELHSDVIEYAKQKLDFFIRTSDSFDKFDFCEPSFVTGNCLEISPDCSQYDRVYCGAGVQKEHEEYMKNLLKVGGILVMPLEEKLTKITRTGPSAWETKKILAVSFAPLIQPCHSESGKSRLVQLRKYTNLYLFYLLDLFSLVRF

SEQ ID NO: 902480 - protein, 259 aa, Homo sapiens
RRRGGGGGGGGGCLRRPRLERRCSAADTRGTRPRSCRWQPRRSEPVGRPSLEYCLSVILNMGGAVSAGEDNDELIDNLKEAQYIRTELVEQAFRAIDRADYYLEEFKENAYKDLAWKHGNIHLSAPCIYSEVMEALDLQPGLSFLNLGSGTGYLSSMVGLILGPFGVNHGVELHSDVIEYAKQKLDFFIRTSDSFDKFDFCEPSFVTGNCLEISPDCSQYDRVYCGAGVQKEHEEYMKNLLKVGGILVMPLEEKVRFPS

SEQ ID NO: 902481 - protein, 139 aa, Homo sapiens
PHTPPPPTPPQLKARYELVVQPPVASSARVSLFRLAPGFLRSQRGRVITRSGLSPSCRQVLRPRGPRLPARAVWQPGAFRGPPPARGPTTPYWASTISEDRGSGPSAFDSRRSRVRGPTGLSWRSTSRRCVQQHPPGGA

SEQ ID NO: 902482 - protein, 326 aa, Homo sapiens
PTPPPPPPPPNLRLGTRLVVAAARCQFCACESLSPCSGLSSLAARQGYHQIWAFPFLPSGATATWPAASRSRSLAARSLPRSPARPGPNDALLGEHDFRGQGVRAQRFRFSEEPGPGADGAVLEVHVPQVLHLQYGMYVWPCAVVLAQYLWFHRRSLPGKAILEIGAGVSLPGILAAKCGAEVILSDSSELPHCLEVCRQSCQMNNLPHLQVVGLTWGHISWDLLALPPQDIILASDVFFEPEDFEDILATIYFLMHKNPKVQLWSTYQVRSADWSLEALLYKWDMKCVHIPLESFDADKEDIAESTLPGRHTVEMLVISFAKDSL

SEQ ID NO: 902483 - protein, 291 aa, Homo sapiens
PTPPPPPPPPNLRLGTRLVVAAARCQFCACESLSPCSGLSSLAARQGYHQIWAFPFLPSGATATWPAASRSRSLAARSLPRSPARPGPNDALLGEHDFRGQGVRAQRFRFSEEPGPGADGAVLEVHVPQIGAGVSLPGILAAKCGAEVILSDSSELPHCLEVCRQSCQMNNLPHLQVVGLTWGHISWDLLALPPQDIILASDVFFEPEDFEDILATIYFLMHKNPKVQLWSTYQVRSADWSLEALLYKWDMKCVHIPLESFDADKEDIAESTLPGRHTVEMLVISFAKDSL

SEQ ID NO: 902484 - protein, 139 aa, Homo sapiens; identical to SEQ ID NO: 902481

SEQ ID NO: 902485 - protein, 284 aa, Homo sapiens
PTPPPPPPPPNLRLGTRLVVAAARCQFCACESLSPCSGLSSLAARQGYHQIWAFPFLPSGATATWPAASRSRSLAARSLPRSPARPGPNDALLGEHDFRGQGVLAQYLWFHRRSLPGKAILEIGAGVSLPGILAAKCGAEVILSDSSELPHCLEVCRQSCQMNNLPHLQVVGLTWGHISWDLLALPPQDIILASDVFFEPEDFEDILATIYFLMHKNPKVQLWSTYQVRSADWSLEALLYKWDMKCVHIPLESFDADKEDIAESTLPGRHTVEMLVISFAKDSL

SEQ ID NO: 902486 - protein, 131 aa, Homo sapiens
PHTPPPPTPPQLKARYEAGWLQPPVASSARVSLFRLAPGFLRSQRGRVITRSGLSPSCRQVLRPRGPRLPARAVWQPGAFRGPPPARGPTTPYWASTISEDRGSGPSAFDSRRSRVRGPTGLSWRSTSRRF

SEQ ID NO: 902487 - protein, 139 aa, Homo sapiens; identical to SEQ ID NO: 902481

SEQ ID NO: 902488 - protein, 190 aa, Homo sapiens
MYVWPCAVVLAQYLWFHRRSLPGKAILEIGAGVSLPGILAAKCGAEVILSDSSELPHCLEVCRQSCQMNNLPHLQVVGLTWGHISWDLLALPPQDIILASDVFFEPEDFEDILATIYFLMHKNPKVQLWSTYQVRSADWSLEALLYKWDMKCVHIPLESFDADKEDIAESTLPGRHTVEMLVISFAKDSL

SEQ ID NO: 902489 - protein, 227 aa, Homo sapiens
PHTPPPPTPPQLKARYEAGWLQPPVASSARVLHLQYGMYVWPCAVVLAQYLWFHRRSLPGKAILEIGAGVSLPGILAAKCGAEVILSDSSELPHCLEVCRQSCQMNNLPHLQVVGLTWGHISWDLLALPPQDIILASDVFFEPEDFEDILATIYFLMHKNPKVQLWSTYQVRSADWSLEALLYKWDMKCVHIPLESFDADKEDIAESTLPGRHTVEMLVISFAKDSL

SEQ ID NO: 902490 - protein, 179 aa, Homo sapiens
MSHCAGPAFSTSNLSCQIGAGVSLPGILAAKCGAEVILSDSSELPHCLEVCRQSCQMNNLPHLQVVGLTWGHISWDLLALPPQDIILASDVFFEPEDFEDILATIYFLMHKNPKVQLWSTYQVRSADWSLEALLYKWDMKCVHIPLESFDADKEDIAESTLPGRHTVEMLVISFAKDSL

SEQ ID NO: 902491 - protein, 119 aa, Homo sapiens
MYVWPCAVVLAQYLWFHRRSLPGKAILEIGAGVSLPGILAAKCGAEVILSDSSELPHCLEVCRQSCQMNNLPHLQVVGLTWGHISWDLLALPPQDIILASDVFFEPEGKLFWLNSTFGQ

SEQ ID NO: 902492 - protein, 170 aa, Homo sapiens
CAHHFRSRQPPVASSARVLHLQYGMYVWPCAVVLAQYLWFHRRSLPGKAILEIGAGVSLPGILAAKCGAEVILSDSSELPHCLEVCRQSCQMNNLPHLQVVGLTWGHISWDLLALPPQDIILASDVFFEPEDFEDILATIYFLMHKNPKVQLWSTYQVRRQVWMTLTFYM

SEQ ID NO: 902493 - protein, 235 aa, Homo sapiens
RSIAPLVITEEPGVWRDHGERRRSKKGRYQATFWVEKEGKQKKTRKYATMKRMLSLRDQRLKEKDRLKPKKKEKKDPSALKEREVPQHPSCLFFQYNTQLGPPYHILVDTNFINFSIKAKLDLVQSMMDCLYAKCIPCITDCVMAEIEKLGQKYRVALRIAKDPRFERLPCTHKGTYADDCLVQRVTQHKCYIVATVDRDLKRRIRKIPGVPIMYISNHRYNIERMPDDYGAPRF

SEQ ID NO: 902494 - protein, 198 aa, Homo sapiens
MGKQKKTRKYATMKRMLSLRDQRLKEKDRLKPKKKEKKDPSALKEREVPQHPSCLFFQYNTQLGPPYHILVDTNFINFSIKAKLDLVQSMMDCLYAKCIPCITDCVMAEIEKLGQKYRVALRIAKDPRFERLPCTHKGTYADDCLVQRVTQHKCYIVATVDRDLKRRIRKIPGVPIMYISNHRYNIERMPDDYGAPRF

SEQ ID NO: 902495 - protein, 180 aa, Homo sapiens
MGKQKKTRKYATMKRMLSLRDQRLKEKDRLKPKKKEKKDPSALKEREVPQHPSCLFFQYNTQLGPPYHILVDTNFINFSIKAKLDLVQSMMDCLYAKCIPCITDCVMAEIEKLGQKYRVALRIAKDPRFERLPCTHKGTYADDCLVQRVTQHKCYIVATVDRDLKYNIERMPDDYGAPRF

SEQ ID NO: 902496 - protein, 183 aa, Homo sapiens
MGKQKKTRKYATMKRMLSLRDQRLKEKDRLKPKKKEKKDPSALKEREVPQHPSCLFFQYNTQLGPPYHILVDTNFINFSIKAKLDLVQSMMDCLYAKCIPCITDCVMAEIEKLGQKYRVALRIAKDPRFERLPCTHKGTYADDCLVQRVTQHKCYIVATVDRDLKRRIRKIPGVPIMYISNHR

SEQ ID NO: 902497 - protein, 162 aa, Homo sapiens
MGKQKKTRKYATMKRMLSLRDQRLKEKDRLKPKKKEKKDPSALKEREVPQHPSCLFFQYNTQLGPPYHILVDTNFINFSIKAKLDLVQSMMDCLYAKCIPCITDCVMAEIEKLGQKYRVALRIAKDPRFERLPCTHKGTYADDCLVQRVTQVLSVHNCLLCA

SEQ ID NO: 902498 - protein, 198 aa, Homo sapiens; identical to SEQ ID NO: 902494

SEQ ID NO: 902499 - protein, 198 aa, Homo sapiens; identical to SEQ ID NO: 902494

SEQ ID NO: 902500 - protein, 192 aa, Homo sapiens
RKNQEFGVTMGKQKKTRNKEKDRLKPKKKEKKDPSALKEREVPQHPSCLFFQYNTQLGPPYHILVDTNFINFSIKAKLDLVQSMMDCLYAKCIPCITDCVMAEIEKLGQKYRVALRIAKDPRFERLPCTHKGTYADDCLVQRVTQHKCYIVATVDRDLKRRIRKIPGVPIMYISNHRYNIERMPDDYGAPRF

SEQ ID NO: 902501 - protein, 224 aa, Homo sapiens
PTPNNESPLDKLRGKYPPIKTNLEIVRKLKLLMGENNLETERMPSHKEERWKKRYEVVNGKLTNTGTVKMLPPLETPLFSGSAYFVVSREYVGYVLQNEKIQKLMEWAQDTYSPDEYLWATIQRIPEVPGSLPASHKYDLSDMQAVARFVKWQYFEGDVSKGAPYPPCDGVHVRSVCIFGAGDLNWMLRKHHLFANKFDVDVDLFAIQCLDEHLRHKALETLKH

SEQ ID NO: 902502 - protein, 428 aa, Homo sapiens
MLRTLLRRRLFSYPTKYYFMVLVLSLITFSVLRIHQKPEFVSVRHLELAGENPSSDINCTKVLQGDVNEIQKVKLEILTVKFKKRPRWTPDDYINMTSDCSSFIKRRKYIVEPLSKEEAEFPIAYSIVVHHKIEMLDRLLRAIYMPQNFYCIHVDTKSEDSYLAAVMGIASCFSNVFVASRLESVVYASWSRVQADLNCMKDLYAMSANWKYLINLCGMDFPIKTNLEIVRKLKLLMGENNLETERMPSHKEERWKKRYEVVNGKLTNTGTVKMLPPLETPLFSGSAYFVVSREYVGYVLQNEKIQKLMEWAQDTYSPDEYLWATIQRIPEVPGSLPASHKYDLSDMQAVARFVKWQYFEGDVSKGAPYPPCDGVHVRSVCIFGAGDLNWMLRKHHLFANKFDVDVDLFAIQCLDEHLRHKALETLKH

SEQ ID NO: 902503 - protein, 428 aa, Homo sapiens; identical to SEQ ID NO: 902502

SEQ ID NO: 902504 - protein, 88 aa, Homo sapiens
RGVTRKSTRGSAPPAHGEVGSDRPAELLQSFAPSSPSPPTSCSSSCLDLHWATWLECIWLRTMIYQTVAKKLEEIKKDLDAKKKPPSA

SEQ ID NO: 902505 - protein, 88 aa, Homo sapiens; identical to SEQ ID NO: 902504

SEQ ID NO: 902506 - protein, 88 aa, Homo sapiens; identical to SEQ ID NO: 902504

SEQ ID NO: 902507 - protein, 72 aa, Homo sapiens
DRPAEPPFWGPWQSFAPSSPSPPTSCSSSCLDLHWATWLECIWLRTMIYQTVAKKLEEIKKDLDAKKKPPSA

SEQ ID NO: 902508 - protein, 131 aa, Homo sapiens
DRPAEPPFWGPWQSFAPSSPSPPTSCSSSWVSGAAEERGPLPGACLGPHFPLEDCRPRRPGLGVGPAVPSSPAPGRRLAGRPFSSCLPRKSLCQYFSAAIQVPKTLRCQRVCVSRASYCVPRPALIVQSLY

SEQ ID NO: 902509 - protein, 72 aa, Homo sapiens; identical to SEQ ID NO: 902507

SEQ ID NO: 902510 - protein, 91 aa, Homo sapiens
NSRPRRHGCAEDDRRGPAHGEVGSDRPAELLQSFAPSSPSPPTSCSSSCLDLHWATWLECIWLRTMIYQTVAKKLEEIKKDLDAKKKPPSA

SEQ ID NO: 902511 - protein, 113 aa, Homo sapiens
MLQFLVLGFTRGNVVWKCIVAQNLCIYPKTGGSLKKKTFCKKENTFFNQHDGGTLVAKFGPIREDGKKAAPLKVGHLTHLAFPGNCGPFTRGTYLPVDFHNRGPPFGRASFTI

SEQ ID NO: 902512 - protein, 907 aa, Homo sapiens
MATPDQKSPNVLLQNLCCRILGRSEADVAQQFQYAVRVIGSNFAPTVERDEFLVAEKIKKELIRQRREADAALFSELHRKLHSQGVLKNKWSILYLLLSLSEDPRRQPSKVSSYATLFAQALPRDAHSTPYYYARPQTLPLSYQDRSAQSAQSSGSVGSSGISSIGLCALSGPAPAPQSLLPGQSNQAPGVGDCLRQQLGSRLAWTLTANQPSSQATTSKGVPSAVSRNMTRSRREGDTGGTMEITEAALVRDILYVFQGIDGKNIKMNNTENCYKVEGKANLSRSLRDTAVRLSELGWLHNKIRRYTDQRSLDRSFGLVGQSFCAALHQELREYYRLLSVLHSQLQLEDDQGVNLGLESSLTLRRLLVWTYDPKIRLKTLAALVDHCQGRKGGELASAVHAYTKTGDPYMRSLVQHILSLVSHPVLSFLYRWIYDGELEDTYHEFFVASDPTVKTDRLWHDKYTLRKSMIPSFMTMDQSRKVLLIGKSINFLHQVCHDQTPTTKMIAVTKSAESPQDAADLFTDLENAFQGKIDAAYFETSKYLLDVLNKKYSLLDHMQAMRRYLLLGQGDFIRHLMDLLKPELVRPATTLYQHNLTGILETAVRATNAQFDSPEILRRLDVRLLEVSPGDTGWDVFSLDYHVDGPIATVFTRECMSHYLRVFNFLWRAKRMEYILTDIRKGHMCNAKLLRNMPEFSGVLHQCHILASEMVHFIHQMQYYITFEVLECSWDELWNKVQQAQDLDHIIAAHEVFLDTIISRCLLDSDSRALLNQLRAVFDQIIELQNAQDAIYRAALEELQRRLQFEEKKKQREIEGQWGVTAAEEEEENKRIGEFKESIPKMCSQLRILTHFYQGIVQQFLVLLTTSSDESLRFLSFRLDFNEHYKAREPRLRVSLGTRGRRSSHT

SEQ ID NO: 902513 - protein, 434 aa, Homo sapiens
MATPDQKSPNVLLQNLCCRILGRSEADVAQQFQYAVRVIGSNFAPTVERDEFLVAEKIKKELIRQRREADAALFSELHRKLHSQGVLKNKWSILYLLLSLSEDPRRQPSKVSSYATLFAQALPRDAHSTPYYYARPQTLPLSYQDRSAQSAQSSGSVGSSGISSIGLCALSGPAPAPQSLLPGQSNQAPGVGDCLRQQLGSRLAWTLTANQPSSQATTSKGVPSAVSRNMTRSRREGDTGGTMEITEAALVRDILYVFQGIDGKNIKMNNTENCYKVEGKANLSRSLRDTAVRLSELGWLHNKIRRYTDQRSLDRSFGLVGQSFCAALHQELREYYRLLSVLHSQLQLEDDQGVNLGLESSLTLRRLLVWTYDPKIRLKTLAALVDHCQGPTRVFPTHVFPTRDFPTRDFPTHVFPTRVFPTRVWHSLCFRTRL

SEQ ID NO: 902514 - protein, 907 aa, Homo sapiens; identical to SEQ ID NO: 902512

SEQ ID NO: 902515 - protein, 678 aa, Homo sapiens
MTRSRREGDTGGTMEITEAALVRDILYVFQGIDGKNIKMNNTENCYKVEGKANLSRSLRDTAVRLSELGWLHNKIRRYTDQRSLDRSFGLVGQSFCAALHQELREYYRLLSVLHSQLQLEDDQGVNLGLESSLTLRRLLVWTYDPKIRLKTLAALVDHCQGRKGGELASAVHAYTKTGDPYMRSLVQHILSLVSHPVLSFLYRWIYDGELEDTYHEFFVASDPTVKTDRLWHDKYTLRKSMIPSFMTMDQSRKVLLIGKSINFLHQVCHDQTPTTKMIAVTKSAESPQDAADLFTDLENAFQGKIDAAYFETSKYLLDVLNKKYSLLDHMQAMRRYLLLGQGDFIRHLMDLLKPELVRPATTLYQHNLTGILETAVRATNAQFDSPEILRRLDVRLLEVSPGDTGWDVFSLDYHVDGPIATVFTRECMSHYLRVFNFLWRAKRMEYILTDIRKGHMCNAKLLRNMPEFSGVLHQCHILASEMVHFIHQMQYYITFEVLECSWDELWNKVQQAQDLDHIIAAHEVFLDTIISRCLLDSDSRALLNQLRAVFDQIIELQNAQDAIYRAALEELQRRLQFEEKKKQREIEGQWGVTAAEEEEENKRIGEFKESIPKMCSQLRILTHFYQGIVQQFLVLLTTSSDESLRFLSFRLDFNEHYKAREPRLRVSLGTRGRRSSHT

SEQ ID NO: 902516 - protein, 534 aa, Homo sapiens [sequence omitted]

SEQ ID NO: 902517 - protein, 468 aa, Homo sapiens
MPLCFQFFVASDPTVKTDRLWHDKYTLRKSMIPSFMTMDQSRKVLLIGKSINFLHQVCHDQTPTTKMIAVTKSAESPQDAADLFTDLENAFQGKIDAAYFETSKYLLDVLNKKYSLLDHMQAMRRYLLLGQGDFIRHLMDLLKPELVRPATTLYQHNLTGILETAVRATNAQFDSPEILRRLDVRLLEVSPGDTGWDVFSLDYHVDGPIATVFTRECMSHYLRVFNFLWRAKRMEYILTDIRKGHMCNAKLLRNMPEFSGVLHQCHILASEMVHFIHQMQYYITFEVLECSWDELWNKVQQAQDLDHIIAAHEVFLDTIISRCLLDSDSRALLNQLRAVFDQIIELQNAQDAIYRAALEELQRRLQFEEKKKQREIEGQWGVTAAEEEEENKRIGEFKESIPKMCSQLRILTHFYQGIVQQFLVLLTTSSDESLRFLSFRLDFNEHYKAREPRLRVSLGTRGRRSSHT

SEQ ID NO: 902518 - protein, 120 aa, Homo sapiens
MINDIIMNKLQLRCLTADYPQLTVPNWWVRAMQGLDECCVHIEGVPTRGVLCSEFCPMVIVCDLVVYQGIVQQFLVLLTTSSDESLRFLSFRLDFNEHYKAREPRLRVSLGTRGRRSSHT

SEQ ID NO: 902519 - protein, 452 aa, Homo sapiens
MATPDQKSPNVLLQNLCCRILGRSEADVAQQFQYAVRVIGSNFAPTVERDEFLVAEKIKKELIRQRREADAALFSELHRKLHSQGVLKNKWSILYLLLSLSEDPRRQPSKVSSYATLFAQALPRDAHSTPYYYARPQTLPLSYQDRSAQSAQSSGSVGSSGISSIGLCALSGPAPAPQSLLPGQSNQAPGVGDCLRQQLGSRLAWTLTANQPSSQATTSKGVPSAVSRNMTRSRREGDTGGTMEITEAALVRDILYVFQGIDGKNIKMNNTENCYKVEGKANLSRSLRDTAVRLSELGWLHNKIRRYTDQRSLDRSFGLVGQSFCAALHQELREYYRLLSVLHSQLQLEDDQGVNLGLESSLTLRRLLVWTYDPKIRLKTLAALVDHCQGRKGGELASAVHAYTKTGDPYMRSLVQHILSLVSHPVLSFLYRWIYDGELEDTYHEVRIGVRF

SEQ ID NO: 902520 - protein, 824 aa, Homo sapiens
MATPDQKSPNVLLQNLCCRILGRSEADVAQQFQYAVRVIGSNFAPTVERDEFLVAEKIKKELIRQRREADAALFSELHRKLHSQGVLKNKWSILYLLLSLSEDPRRQPSKVSSYATLFAQALPRDAHSTPYYYARPQTLPLSYQDRSAQSAQSSGSVGSSGISSIGLCALSGPAPAPQSLLPGQSNQAPGVGDCLRQQLGSRLAWTLTANQPSSQATTSKGVPSAVSRNMTRSRREGDTGGTMEITEAALVRDILYVFQGIDGKNIKMNNTENCYKVEGKANLSRSLRDTAVRLSELGWLHNKIRRYTDQRSLDRSFGLVGQSFCAALHQELREYYRLLSVLHSQLQLEDDQGVNLGLESSLTLRRLLVWTYDPKIRLKTLAALVDHCQGRKGGELASAVHAYTKTGDPYMRSLVQHILSLVSHPVLSFLYRWIYDGELEDTYHEFFVASDPTVKTDRLWHDKYTLRKSMIPSFMTMDQSRKVLLIGKSINFLHQVCHDQTPTTKMIAVTKSAESPQDAADLFTDLENAFQGKIDAAYFETSKYLLDVLNKKYSLLDHMQAMRRYLLLGQGDFIRHLMDLLKPELVRPATTLYQHNLTGILETAVRATNAQFDSPEILRRLDVRLLEVSPGDTGWDVFSLDYHVDGPIATVFTRECMSHYLRVFNFLWRAKRMEYILTDIRKGHMCNAKLLRNMPEFSGVLHQCHILASEMVHFIHQMQYYITFEVLECSWDELWNKVQQAQDLDHIIAAHEVFLDTIISRCLLDSDSRALLNQLRAVFDQIIELQNAQDAIYRAALEELQRRLQFEEKKKQREIEVEMCLYCV

SEQ ID NO: 902521 - protein, 611 aa, Homo sapiens
MATPDQKSPNVLLQNLCCRILGRSEADVAQQFQYAVRVIGSNFAPTVERDEFLVAEKIKKELIRQRREADAALFSELHRKLHSQGVLKNKWSILYLLLSLSEDPRRQPSKVSSYATLFAQALPRDAHSTPYYYARPQTLPLSYQDRSAQSAQSSGSVGSSGISSIGLCALSGPAPAPQSLLPGQSNQAPGVGDCLRQQLGSRLAWTLTANQPSSQATTSKGVPSAVSRNMTRSRREGDTGGTMEITEAALVRDILYVFQGIDGKNIKMNNTENCYKVEGKANLSRSLRDTAVRLSELGWLHNKIRRYTDQRSLDRSFGLVGQSFCAALHQELREYYRLLSVLHSQLQLEDDQGVNLGLESSLTLRRLLVWTYDPKIRLKTLAALVDHCQGRKGGELASAVHAYTKTGDPYMRSLVQHILSLVSHPVLSFLYRWIYDGELEDTYHEFFVASDPTVKTDRLWHDKYTLRKSMIPSFMTMDQSRKVLLIGKSINFLHQVCHDQTPTTKMIAVTKSAESPQDAADLFTDLENAFQGKIDAAYFETSKYLLDVLNKKYSLLDHMQAMRRYLLLGQGDFIRHLMDLLKSLQVTLDGMSSASIIMLTDQLQLCLLENV

SEQ ID NO: 902522 - protein, 890 aa, Homo sapiens
MVENRTFYADVAQQFQYAVRVIGSNFAPTVERDEFLVAEKIKKELIRQRREADAALFSELHRKLHSQGVLKNKWSILYLLLSLSEDPRRQPSKVSSYATLFAQALPRDAHSTPYYYARPQTLPLSYQDRSAQSAQSSGSVGSSGISSIGLCALSGPAPAPQSLLPGQSNQAPGVGDCLRQQLGSRLAWTLTANQPSSQATTSKGVPSAVSRNMTRSRREGDTGGTMEITEAALVRDILYVFQGIDGKNIKMNNTENCYKVEGKANLSRSLRDTAVRLSELGWLHNKIRRYTDQRSLDRSFGLVGQSFCAALHQELREYYRLLSVLHSQLQLEDDQGVNLGLESSLTLRRLLVWTYDPKIRLKTLAALVDHCQGRKGGELASAVHAYTKTGDPYMRSLVQHILSLVSHPVLSFLYRWIYDGELEDTYHEFFVASDPTVKTDRLWHDKYTLRKSMIPSFMTMDQSRKVLLIGKSINFLHQVCHDQTPTTKMIAVTKSAESPQDAADLFTDLENAFQGKIDAAYFETSKYLLDVLNKKYSLLDHMQAMRRYLLLGQGDFIRHLMDLLKPELVRPATTLYQHNLTGILETAVRATNAQFDSPEILRRLDVRLLEVSPGDTGWDVFSLDYHVDGPIATVFTRECMSHYLRVFNFLWRAKRMEYILTDIRKGHMCNAKLLRNMPEFSGVLHQCHILASEMVHFIHQMQYYITFEVLECSWDELWNKVQQAQDLDHIIAAHEVFLDTIISRCLLDSDSRALLNQLRAVFDQIIELQNAQDAIYRAALEELQRRLQFEEKKKQREIEGQWGVTAAEEEEENKRIGEFKESIPKMCSQLRILTHFYQGIVQQFLVLLTTSSDESLRFLSFRLDFNEHYKAREPRLRVSLGTRGRRSSHT

SEQ ID NO: 902523 - protein, 484 aa, Homo sapiens
PYPLLSGTLSCCETQLEDTYHEFFVASDPTVKTDRLWHDKYTLRKSMIPSFMTMDQSRKVLLIGKSINFLHQVCHDQTPTTKMIAVTKSAESPQDAADLFTDLENAFQGKIDAAYFETSKYLLDVLNKKYSLLDHMQAMRRYLLLGQGDFIRHLMDLLKPELVRPATTLYQHNLTGILETAVRATNAQFDSPEILRRLDVRLLEVSPGDTGWDVFSLDYHVDGPIATVFTRECMSHYLRVFNFLWRAKRMEYILTDIRKGHMCNAKLLRNMPEFSGVLHQCHILASEMVHFIHQMQYYITFEVLECSWDELWNKVQQAQDLDHIIAAHEVFLDTIISRCLLDSDSRALLNQLRAVFDQIIELQNAQDAIYRAALEELQRRLQFEEKKKQREIEGQWGVTAAEEEEENKRIGEFKESIPKMCSQLRILTHFYQGIVQQFLVLLTTSSDESLRFLSFRLDFNEHYKAREPRLRVSLGTRGRRSSHT

SEQ ID NO: 902524 - protein, 439 aa, Homo sapiens
MATPDQKSPNVLLQNLCCRILGRSEADVAQQFQYAVRVIGSNFAPTVERDEFLVAEKIKKELIRQRREADAALFSELHRKLHSQGVLKNKWSILYLLLSLSEDPRRQPSKVSSYATLFAQALPRDAHSTPYYYARPQTLPLSYQDRSAQSAQSSGSVGSSGISSIGLCALSGPAPAPQSLLPGQSNQAPGVGDCLRQQLGSRLAWTLTANQPSSQATTSKGVPSAVSRNMTRSRREGDTGGTMEITEAALVRDILYVFQGIDGKNIKMNNTENCYKVEGKANLSRSLRDTAVRLSELGWLHNKIRRYTDQRSLDRSFGLVGQSFCAALHQELREYYRLLSVLHSQLQLEDDQGVNLGLESSLTLRRLLVWTYDPKIRLKTLAALVDHCQGPTRVFPTHVFPTRDFPTRDFPTRDFPMHVFPTRVFPTRVWHSLCFRTRL

SEQ ID NO: 902525 - protein, 133 aa, Homo sapiens [sequence omitted]

SEQ ID NO: 902526 - protein, 715 aa, Homo sapiens
HGRFQAALTVLACPLASVWRKAVPVSSAVGAPGSASPGIPQNPRALLFREVLRADPHSCRCPDSTPSSLLGPYPRAGLPMRPLSGRLPTAAPDIGPCAQGWSLGLGEGTDGWRGSCRKRGERRPPPVPPQLLRVGKAAPAALTFLPSGCEACSQRAVGFPECLSVHKLDPQEAPTGRSSSPSPALRPALAVLAQWVPIVRALSAQMGPSGPEDLWGRLGPQEEPGCSGAPVGAGCGCFPACHEEVGRPACHAQLWVLQLGHSLVLPLRPPAMVSRDQAHLGPKYVGLWDFKSRTDEELSFRAGDVFHVARKEEQWWWATLLDEAGGAVAQGYVPHNYLAERETVESEPWFFGCISRSEAVRRLQAEGNATGAFLIRVSEKPSADYVLSVRDTQAVRHYKIWRRAGGRLHLNEAVSFLSLPELVNYHRAQSLSHGLRLAAPCRKHEPEPLPHWDDWERPREEFTLCRKLGSGYFGEVFEGLWKDRVQVAIKVISRDAAVGDPAMKKLRHKHILALYAVVSVGDPVYIITELMAKGSLLELLRDSDEKVLPVSELLDIAWQVAEGMCYLESQNYIHRDLAARNILVGENTLCKVGDFGLARLIKEDVYLSHDHNIPYKWTAPEALSRGHYSTKSDVWSFGILLHEMFSRGQVPYPGMSNHEAFLRVDAGYRMPCPLECPPSVHKLMLTCWCRDPEQRPCFKALRERLSSFTSYENPT

SEQ ID NO: 902527 - protein, 656 aa, Homo sapiens
HGRFQAALTVLACPLASVWRKAVPVSSAVGAPGSASPGIPQNPRALLFREVLRADPHSCRCPDSTPSSLLGPYPRAGLPMRPLSGRLPTAAPDIGPCAQGWSLGLGEGTDGWRGSCRKRGERRPPPVPPQLLRVGKAAPAALTFLPSGCEACSQRAVGFPECLSVHKLDPQEAPTGRSSSPSPALRPALAVLAQWVPIVRALSAQMGPSGPEDLWGRLGPQEEPGCSGAPVGAGCGCFPACHEEVGRPACHAQLWVLQLGHSLVLPLRPPAMVSRDQAHLGPKYVGLWDFKSRTDEELSFRAGDVFHVARKEEQWWWATLLDEAGGAVAQGYVPHNYLAERETVESEPWFFGCISRSEAVRRLQAEGNATGAFLIQVRDTQAVRHYKIWRRAGGRLHLNEAVSFLSLPELVNYHRAQSLSHGLRLAAPCRKHEPEPLPHWDDWERPREEFTLCRKLGSGYFGEVFEGLWKDRVQVAIKVISRDSDEKVLPVSELLDIAWQVAEGMCYLESQNYIHRDLAARNILVGENTLCKVGDFGLARLIKEDVYLSHDHNIPYKWTAPEALSRGHYSTKSDVWSFGILLHEMFSRGQVPYPGMSNHEAFLRVDAGYRMPCPLECPPSVHKLMLTCWCRDPEQRPCFKALRERLSSFTSYENPT

SEQ ID NO: 902528 - protein, 681 aa, Homo sapiens
HGRFQAALTVLACPLASVWRKAVPVSSAVGAPGSASPGIPQNPRALLFREVLRADPHSCRCPDSTPSSLLGPYPRAGLPMRPLSGRLPTAAPDIGPCAQGWSLGLGEGTDGWRGSCRKRGERRPPPVPPQLLRVGKAAPAALTFLPSGCEACSQRAVGFPECLSVHKLDPQEAPTGRSSSPSPALRPALAVLAQWVPIVRALSAQMGPSGPEDLWGRLGPQEEPGCSGAPVGAGCGCFPACHEEVGRPACHAQLWVLQLGHSLVLPLRPPAMVSRDQAHLGPKYVGLWDFKSRTDEELSFRAGDVFHVARKEEQWWWATLLDEAGGAVAQGYVPHNYLAERETVESEPWFFGCISRSEAVRRLQAEGNATGAFLIRVSEKPSADYVLSVRDTQAVRHYKIWRRAGGRLHLNEAVSFLSLPELVNYHRAQSLSHGLRLAAPCRKHEPEPLPHWDDWERPREEFTLCRKLGSGYFGEVFEGLWKDRVQVAIKVISRDAAVGDPAMKKLRHKHILALYAVVSVGDPVYIITELMAKGSLLELLRDSDEKVLPVSELLDIAWQVAEGMCYLESQNYIHRDLAARNILVGENTLCKVGDFGLARLIKEDVYLSHDHNIPYKWTAPEALSRGHYSTKSDVWSFGILLHEMFSRGQVPYPGDSGSCYVAQAGLELLGSSNPPASGLQA

SEQ ID NO: 902529 - protein, 722 aa, Homo sapiens
HGRFQAALTVLACPLASVWRKAVPVSSAVGAPGSASPGIPQNPRALLFREVLRADPHSCRCPDSTPSSLLGPYPRAGLPMRPLSGRLPTAAPDIGPCAQGWSLGLGEGTDGWRGSCRKRGERRPPPVPPQLLRVGKAAPAALTFLPSGCEACSQRAVGFPECLSVHKLDPQEAPTGRSSSPSPALRPALAVLAQWVPIVRALSAQMGPSGPEDLWGRLGPQEEPGCSGAPVGAGCGCFPACHEEVGRPACHAQLWVLQLGHSLVLPLRPPAMVSRDQAHLGPKYVGLWDFKSRTDEELSFRAGDVFHVARKEEQWWWATLLDEAGGAVAQGYVPHNYLAERETVESEPWFFGCISRSEAVRRLQAEGNATGAFLIRVSEKPSADYVLSVRDTQAVRHYKIWRRAGGRLHLNEAVSFLSLPELVNYHRAQSLSHGLRLAAPCRKHEPEPLPHWDDWERPREEFTLCRKLGSGYFGEVFEGLWKDRVQVAIKVISRDNLLHQQMLQSEIQAMKKLRHKHILALYAVVSVGDPVYIITELMAKGSLLELLRDSDEKVLPVSELLDIAWQVAEGMCYLESQNYIHRDLAARNILVGENTLCKVGDFGLARLIKEDVYLSHDHNIPYKWTAPEALSRGHYSTKSDVWSFGILLHEMFSRGQVPYPGMSNHEAFLRVDAGYRMPCPLECPPSVHKLMLTCWCRDPEQRPCFKALRERLSSFTSYENPT

SEQ ID NO: 902530 - protein, 374 aa, Homo sapiens
VTGCVGLAPGGPKQQAGEAVKRPSGRGPWWRPLYYVQTHDLVSRVTRRPTTSLVSRGAGVGSGRRLVSSQVQKTLSPENSPRWFFGCISRSEAVRRLQAEGNATGAFLIRCGTRRLCGTTRSGYFGEVFEGLWKDRVQVAIKVISRDNLLHQQMLQSEIQAMKKLRHKHILALYAVVSVGDPVYIITELMAKGSLLELLRDSDEKVLPVSELLDIAWQVAEGMCYLESQNYIHRDLAARNILVGENTLCKVGDFGLARLIKEDVYLSHDHNIPYKWTAPEALSRGHYSTKSDVWSFGILLHEMFSRGQVPYPGMSNHEAFLRVDAGYRMPCPLECPPSVHKLMLTCWCRDPEQRPCFKALRERLSSFTSYENPT

SEQ ID NO: 902531 - protein, 546 aa, Homo sapiens
HGRFQAALTVLACPLASVWRKAVPVSSAVGAPGSASPGIPQNPRALLFREVLRADPHSCRCPDSTPSSLLGPYPRAGLPMRPLSGRLPTAAPDIGPCAQGWSLGLGEGTDGWRGSCRKRGERRPPPVPPQLLRVGKAAPAALTFLPSGCEACSQRAVGFPECLSVHKLDPQEAPTGRSSSPSPALRPALAVLAQWVPIVRALSAQMGPSGPEDLWGRLGPQEEPGCSGAPVGAGCGCFPACHEEVGRPACHAQLWVLQLGHSLVLPLRPPAMVSRDQAHLGPKYVGLWDFKSRTDEELSFRAGDVFHVARKEEQWWWATLLDEAGGAVAQGYVPHNYLAERETVESEPWFFGCISRSEAVRRLQAEGNATGAFLIRVSEKPSADYVLSVRDTQAVRHYKIWRRAGGRLHLNEAVSFLSLPELVNYHRAQSLSHGLRLAAPCRKHEPEPLPHWDDWERPREEFTLCRKLGSGYFGEVFEGLWKDRVQVAIKVISRGEWAPIRALCGPVPALGHPPTPPTGTSGLEPQAAPTASMREWFPFNCTYVFT

SEQ ID NO: 902532 - protein, 1369 aa, Homo sapiens [sequence omitted]

SEQ ID NO: 902533 - protein, 500 aa, Homo sapiens
MRPEAAAGAAPELRTRKRPGRGRGVPASLRRGYRVHGAVTAPISLPAPQPRARPSGRYPSCSAAAVAVAAAAAAMANDSGGPGGPSPSERDRQYCELCGKMENLLRCSRCRSSFYCCKEHQRQDWKKHKLVCQGSEGALGHGVGPHQHSGPAPPAAVPPPRAGAREPRKAAARRDNASGDAAKGKVKAKPPADPAAAASPCRAAAGGQGSAVAAEAEPGKEEPPARSSLFQEKANLYPPSNTPGDALSPGGGLRPNGQTKPLPALKLALEYIVPCMNKHGICVVDDFLGKETGQQIGDEVRALHDTGKFTDGQLVSQKSDSSKDIRGDKITWIEGKEPGCETIGLLMSSMDDLIRHCNGKLGSYKINGRTKAMVACYPGNGTGYVRHVDNPNGDGRCVTCIYYLNKDWDAKVSGGILRIFPEGKAQFADIEPKFDRLLFFWSDRRNPHEVQPAYATRYAITVWYFDADERARAKVKYLTGEKGVRVELNKPSDSVGKDVF

SEQ ID NO: 902534 - protein, 500 aa, Homo sapiens; identical to SEQ ID NO: 902533

SEQ ID NO: 902535 - protein, 500 aa, Homo sapiens; identical to SEQ ID NO: 902533

SEQ ID NO: 902536 - protein, 302 aa, Homo sapiens
ARSVYFEKIRCSAVAAEAEPGKEEPPARSSLFQEKANLYPPSNTPGDALSPGGGLRPNGQTKPLPALKLALEYIVPCMNKHGICVVDDFLGKETGQQIGDEVRALHDTGKFTDGQLVSQKSDSSKDIRGDKITWIEGKEPGCETIGLLMSSMDDLIRHCNGKLGSYKINGRTKAMVACYPGNGTGYVRHVDNPNGDGRCVTCIYYLNKDWDAKVSGGILRIFPEGKAQFADIEPKFDRLLFFWSDRRNPHEVQPAYATRYAITVWYFDADERARAKVKYLTGEKGVRVELNKPSDSVGKDVF

SEQ ID NO: 902537 - protein, 439 aa, Homo sapiens
MRPEAAAGAAPELRTRKRPGRGRGVPASLRRGYRVHGAVTAPISLPAPQPRARPSGRYPSCSAAAVAVAAAAAAMANDSGGPGGPSPSERDRQYCELCGKMENLLRCSRCRSSFYCCKEHQRQDWKKHKLVCQGSEGALGHGVGPHQHSGPAPPAAVPPPRAGAREPRKAAARRDNASGDAAKGKVKAKPPADPAAAASPCRAAAGGQGSAVAAEAEPGKEEPPARSSLFQEKANLYPPSNTPGDALSPGGGLRPNGQTKPLPALKLALEYIVPCMNKHGICVVDDFLGKETGQQIGDEVRALHDTGKFTDGQLVSQKSDSSKDIRGDKITWIEGKEPGCETIGLLMSSMDDLIRHCNGKLGSYKINGRTKAMVACYPGNGTGYVRHVDNPNGDGRCVTCIYYLNKDWDAKPNLIDCCFSGLTVATLMKYNQHMLQGTQ

SEQ ID NO: 902538 - protein, 500 aa, Homo sapiens; identical to SEQ ID NO: 902533

SEQ ID NO: 902539 - protein, 473 aa, Homo sapiens
MRPEAAAGAAPELRTRKRPGRGRGVPASLRRGYRVHGAVTAPISLPAPQPRARPSGRYPSCSAAAVAVAAAAAAMANDSGGPGGPSPSERDRQYCELCGKMENLLRCSRCRSSFYCCKEHQRQDWKKHKLVCQGSEGALGHGVGPHQHSGPAPPAAVPPPRAGAREPRKAAARRDNASGDAAKGKVKAKPPADPAAAASPCRAAAGGQGSAVAAEAEPGKEEPPARSSLFQEKANLYPPSNTPGDALSPGGGLRPNGQTKPLPALKLALEYIVPCMNKHGICVVDDFLGKETGQQIGDEVRALHDTGKFTDGQLVSQKSDSSKDIRGDKITWIEGKEPGCETIGLLMSSMDDLIRHCNGKLGSYKINGRTKAMVACYPGNGTGYVRHVDNPNGDGRCVTCIYYLNKDWDAKVSGGILRIFPEGKAQFADIEPKFDRLLFFWSDRRNPHEVQPAYATSYPELLCTCDVDIPDSL

SEQ ID NO: 902540 - protein, 110 aa, Homo sapiens
QLLPVYRPPRNPPRNETFLEDVSGGILRIFPEGKAQFADIEPKFDRLLFFWSDRRNPHEVQPAYATRYAITVWYFDADERARAKVKYLTGEKGVRVELNKPSDSVGKDVF

SEQ ID NO: 902541 - protein, 500 aa, Homo sapiens; identical to SEQ ID NO: 902533

SEQ ID NO: 902542 - protein, 128 aa, Homo sapiens
MVACYPGNGTGYVRHVDNPNGDGRCVTCIYYLNKDWDAKVSGGILRIFPEGKAQFADIEPKFDRLLFFWSDRRNPHEVQPAYATRYAITVWYFDADERARAKVKYLTGEKGVRVELNKPSDSVGKDVF

SEQ ID NO: 902543 - protein, 416 aa, Homo sapiens
MELRVGNKYRLGRKIGSGSFGDIYLGANIASGEEVAIKLECVKTKHPQLHIESKFYKMMQGGVGIPSIKWCGAEGDYNVMVMELLGPSLEDLFNFCSRKFSLKTVLLLADQMISRIEYIHSKNFIHRDVKPDNFLMGLGKKGNLVYIIDFGLAKKYRDARTHQHIPYRENKNLTGTARYASINTHLGIEQSRRDDLESLGYVLMYFNLGSLPWQGLKAATKRQKYERISEKKMSTPIEVLCKGYPSEFSTYLNFCRSLRFDDKPDYSYLRQLFRNLFHRQGFSYDYVFDWNMLKFGAARNPEDVDRERREHEREERMGQLRGSATRALPPGPPTGATANRLRSAAEPVASTPASRIQPAGNTSPRAISRVDRERKVSMRLHRGAPANVSSSDLTGRQEVSRIPASQTSVPFDHLGK

SEQ ID NO: 902544 - protein, 416 aa, Homo sapiens; identical to SEQ ID NO: 902543

SEQ ID NO: 902545 - protein, 416 aa, Homo sapiens; identical to SEQ ID NO: 902543

SEQ ID NO: 902546 - protein, 416 aa, Homo sapiens; identical to SEQ ID NO: 902543

SEQ ID NO: 902547 - protein, 408 aa, Homo sapiens
LKLIVVMAAQACEYTKNGANIASGEEVAIKLECVKTKHPQLHIESKFYKMMQGGVGIPSIKWCGAEGDYNVMVMELLGPSLEDLFNFCSRKFSLKTVLLLADQMISRIEYIHSKNFIHRDVKPDNFLMGLGKKGNLVYIIDFGLAKKYRDARTHQHIPYRENKNLTGTARYASINTHLGIEQSRRDDLESLGYVLMYFNLGSLPWQGLKAATKRQKYERISEKKMSTPIEVLCKGYPSEFSTYLNFCRSLRFDDKPDYSYLRQLFRNLFHRQGFSYDYVFDWNMLKFGAARNPEDVDRERREHEREERMGQLRGSATRALPPGPPTGATANRLRSAAEPVASTPASRIQPAGNTSPRAISRVDRERKVSMRLHRGAPANVSSSDLTGRQEVSRIPASQTSVPFDHLGK

SEQ ID NO: 902548 - protein, 416 aa, Homo sapiens; identical to SEQ ID NO: 902543

SEQ ID NO: 902549 - protein, 416 aa, Homo sapiens; identical to SEQ ID NO: 902543

SEQ ID NO: 902550 - protein, 416 aa, Homo sapiens; identical to SEQ ID NO: 902543

SEQ ID NO: 902551 - protein, 416 aa, Homo sapiens; identical to SEQ ID NO: 902543

SEQ ID NO: 902552 - protein, 431 aa, Homo sapiens [sequence omitted]

SEQ ID NO: 902553 - protein, 416 aa, Homo sapiens; identical to SEQ ID NO: 902543

SEQ ID NO: 902554 - protein, 369 aa, Homo sapiens
MELRVGNKYRLGRKIGSGSFGDIYLGANIASGEEVAIKLECVKTKHPQLHIESKFYKMMQGGVGIPSIKWCGAEGDYNVMVMELLGPSLEDLFNFCSRKFSLKTVLLLADQMISRIEYIHSKNFIHRDVKPDNFLMGLGKKGNLVYIIDFGLAKKYRDARTHQHIPYRENKNLTGTARYASINTHLGIEQSRRDDLESLGYVLMYFNLGSLPWQGLKAATKRQKYERISEKKMSTPIEVLCKGYPSEFSTYLNFCRSLRFDDKPDYSYLRQLFRNLFHRQGFSYDYVFDWNMLKFGASSSQAQPRDSPMTAKGPFCPRPCPCAGPTYSPTYWCPAPLGTQSPPDRPVEEVEELSPQNYWPVVWTPGPHF

SEQ ID NO: 902555 - protein, 336 aa, Homo sapiens
MELRVGNKYRLGRKIGSGSFGDIYLGANIASGEEVAIKLECVKTKHPQLHIESKFYKMMQGGVGIPSIKWCGAEGDYNVMVMELLGPSLEDLFNFCSRKFSLKTVLLLADQMISRIEYIHSKNFIHRDVKPDNFLMGLGKKGNLVYIIDFGLAKKYRDARTHQHIPYRENKNLTGTARYASINTHLGIEQSRRDDLESLGYVLMYFNLGSLPWQGLKAATKRQKYERISEKKMSTPIEVLCKGYPSEFSTYLNFCRSLRFDDKPDYSYLRQLFRNLFHRQGFSYDYVFDWNMLKFMRPPSCQPPALPCGRPQDELGCSPESRGCGPGAARTRTRGR

SEQ ID NO: 902556 - protein, 351 aa, Homo sapiens
LASLPRAGANIASGEEVAIKLECVKTKHPQLHIESKFYKMMQGGVGIPSIKWCGAEGDYNVMVMELLGPSLEDLFNFCSRKFSLKTVLLLADQMISRIEYIHSKNFIHRDVKPDNFLMGLGKKGNLVYIIDFGLAKKYRDARTHQHIPYRENKNLTGTARYASINTHLGIEQSRRDDLESLGYVLMYFNLGSLPWQGLKAATKRQKYERISEKKMSTPIEVLCKGYPSEFSTYLNFCRSLRFDDKPDYSYLRQLFRNLFHRQGFSYDYVFDWNMLKFGASSSQAQPRDSPMTAKGPFCPRPCPCAGPTYSPTYWCPAPLGTQSPPDRPVEEVEELSPQNYWPVVWTPGPHF

SEQ ID NO: 902557 - protein, 419 aa, Homo sapiens
MELRVGNKYRLGRKIGSGSFGDIYLGANIASGEEVAIKLECVKTKHPQLHIESKFYKMMQGGVGIPSIKWCGAEGDYNVMVMELLGPSLEDLFNFCSRKFSLKTVLLLADQMISRIEYIHSKNFIHRDVKPDNFLMGLGKKGNLVYIIDFGLAKKYRDARTHQHIPYRENKNLTGTARYASINTHLGIEQSRRDDLESLGYVLMYFNLGSLPWQGLKAATKRQKYERISEKKMSTPIEVLCKGYPSEFSTYLNFCRSLRFDDKPDYSYLRQLFRNLFHRQGFSYDYVFDWNMLKFGAARNPEDVDRERREHEREERMGQLRGSATRALPPGPPTGATANRLRSAAEPVASTPASRIQPAGNTSPRAISRVDRERKVSMRLHRGAPANVSSSDLTGRQEVSRIPASQVSCPPASPSGPQN

SEQ ID NO: 902558 - protein, 369 aa, Homo sapiens; identical to SEQ ID NO: 902554

SEQ ID NO: 902559 - protein, 498 aa, Homo sapiens
MELRVGNKYRLGRKIGSGSFGDIYLGANIASGEEVAIKLECVKTKHPQLHIESKFYKMMQGGVGIPSIKWCGAEGDYNVMVMELLGPSLEDLFNFCSRKFSLKTVLLLADQMISRIEYIHSKNFIHRDVKPDNFLMGLGKKGNLVYIIDFGLAKKYRDARTHQHIPYRENKNLTGTARYASINTHLGIEQSRRDDLESLGYVLMYFNLGSLPWQGLKAATKRQKYERISEKKMSTPIEVLCKGYPSEFSTYLNFCRSLRFDDKPDYSYLRQLFRNLFHRQGFSYDYVFDWNMLKFVSHLEAKAGLGDWMGKALTQRARVSWWREGLPTDGRYELDSVVDLTGVQSPPASSVLTACATMGSRARQGAVSRRNKEDLASPGVPPGCPQQGMGGAGGAPCCPDCCLHRPAAPVLHIPGGYLHHGPSGQPGPSHGACFLLGHGPLGLARQLFCFPLLRVPGVGLGGEQHWPAVPRALESVKLYVLFHISSGKGGFLEPGSAP

SEQ ID NO: 902560 - protein, 117 aa, Homo sapiens
MTVADFPCWAFPLSPWPPGSSSASPWSGWGGGGGRRPLRVCVCVCVCGCIDLCFPRQQVPRPAPPASPNSRSPVSTNKDMGVGGDLRIPQSSEGPRCHRSPPSPSSAGGSSIFHSWF

SEQ ID NO: 902561 - protein, 101 aa, Homo sapiens
DCINAADCINAADCINAADCIQRRCNGNLHPEARPFPCYPTVDRTPCVVGCTGVLGSVDPWGLEATLSTYSHCVPRSSQLAGKEFNTAKDRGPYDDGWMLV

SEQ ID NO: 902562 - protein, 105 aa, Homo sapiens
LGSEGSSLCPSQFELQGKEEEVFALRFSTGGECMSPGYLSGPCVDIPSCLLKSLALNQPGLCSLRHSEPGGGLSLQQSNIFCSVVNSRLFSQGPSALPGEERDPG

SEQ ID NO: 902563 - protein, 416 aa, Homo sapiens; identical to SEQ ID NO: 902543

SEQ ID NO: 902564 - protein, 416 aa, Homo sapiens; identical to SEQ ID NO: 902543

SEQ ID NO: 902565 - protein, 416 aa, Homo sapiens; identical to SEQ ID NO: 902543

SEQ ID NO: 902566 - protein, 416 aa, Homo sapiens; identical to SEQ ID NO: 902543

SEQ ID NO: 902567 - protein, 416 aa, Homo sapiens; identical to SEQ ID NO: 902543

SEQ ID NO: 902568 - protein, 416 aa, Homo sapiens; identical to SEQ ID NO: 902543

SEQ ID NO: 902569 - protein, 498 aa, Homo sapiens; identical to SEQ ID NO: 902559

SEQ ID NO: 902570 - protein, 260 aa, Homo sapiens
LLDPATWQRLLATVRRSSLALKAAEALLTGRLGFHHSRIGKAMALLPPFLASHRLEVSRDSGWLGQCWLQGVWERGPHSGLLYPLQHPPAEFSTYLNFCRSLRFDDKPDYSYLRQLFRNLFHRQGFSYDYVFDWNMLKFGAARNPEDVDRERREHEREERMGQLRGSATRALPPGPPTGATANRLRSAAEPVASTPASRIQPAGNTSPRAISRVDRERKVSMRLHRGAPANVSSSDLTGRQEVSRIPASQTSVPFDHLGK

SEQ ID NO: 902571 - protein, 498 aa, Homo sapiens; identical to SEQ ID NO: 902559

SEQ ID NO: 902572 - protein, 369 aa, Homo sapiens; identical to SEQ ID NO: 902554

SEQ ID NO: 902573 - protein, 498 aa, Homo sapiens; identical to SEQ ID NO: 902559

SEQ ID NO: 902574 - protein, 157 aa, Homo sapiens
MELRVGNKYRLGRKIGSGSFGDIYLGANIASGEEVAIKLECVKTKHPQLHIESKFYKMMQGGVGIPSIKWCGAEGDYNVMVMELLGPSLEDLFNFCSRKFSLKTVLLLADQMISRIEYIHPKNFLQTVRKILSRLFRVFVHVYIHHFDRIAMGSEAH

SEQ ID NO: 902575 - protein, 323 aa, Homo sapiens
ERRSHTWVPAPQRSRDSPRRRARRPELPKPSRAAHTPGLHSLFQHPLVLAAARVPETELPQRPRRRRCEGPMRAPLLPPAPVVLSLLILGSGHYAAGLDLNDTYSGKREPFSGDHSADGFEVTSRSEMSSGSEISPVSEMPSSSEPSSGADYDYSEEYDNEPQIPGYIVDDSVRVEQVVKPPQNKTESENTSDKPKRKKKGGKNGKNRRNRKKKNPCNAEFQNFCIHGECKYIEHLEAVTCKCQQEYFGERCGEKSMKTHSMIDSSLSKIALAAIAAFMSAVILTAVAVITVQLRRQYVRKYEGEAEERKKLRQENGNVHAIA

SEQ ID NO: 902576 - protein, 323 aa, Homo sapiens; identical to SEQ ID NO: 902575

SEQ ID NO: 902577 - protein, 262 aa, Homo sapiens
ERRSHTWVPAPQRSRDSPRRRARRPELPKPSRAAHTPGLHSLFQHPLVLAAARVPETELPQRPRRRRCEGPMRAPLLPPAPVVLSLLILGSGHYAAGLDLNDTYSGKREPFSGDHSADGFEVTSRSEMSSGSEISPVSEMPSSSEPSSGADYDYSEEYDNEPQIPGYIVDDSVRVEQVVKPPQNKTESENTSDKPKRKKKGGKNGKNRRNRKKKNPCNAEFQNFCIHGECKYIEHLEAVTCKCQQEYFVTVLGYIGILYITS

SEQ ID NO: 902578 - protein, 106 aa, Homo sapiens
MSSLSEYAFRMSRLSARLFGEVTRPTNSKSMKVVKLFSELPLAKKKETYDWYPNHHTYAELMQTLRFLGLYRDEHQDFMDEQKRLKKLRGKEKPKKGEGKRAAKRK

SEQ ID NO: 902579 - protein, 106 aa, Homo sapiens; identical to SEQ ID NO: 902578

SEQ ID NO: 902580 - protein, 106 aa, Homo sapiens; identical to SEQ ID NO: 902578

SEQ ID NO: 902581 - protein, 106 aa, Homo sapiens; identical to SEQ ID NO: 902578

SEQ ID NO: 902582 - protein, 223 aa, Homo sapiens
MEDVKLEFPSLPQCKEDAEEWTYPMRREMQEILPGLFLGPYSSAMKSKLPVLQKHGITHIICIRQNIEANFIKPNFQQLFRYLVLDIADNPVENIIRFFPMTKEFIDGSLQMGGKVLVHGNAGISRSAAFVIAYIMETFGMKYRDAFAYVQERRFCINPNAGFVHQLQEYEAIYLAKLTIQMMSPLQIERSLSVHSGTTGSLKRTHEEEDDFGTMQVATAQNG

SEQ ID NO: 902583 - protein, 164 aa, Homo sapiens
MEDVKLEFPSLPQCKEDAEEWTYPMRREMQEILPGLFLGPYSSAMKSKLPVLQKHGITHIICIRQNIEANFIKPNFQQLFRYLVLDIADNPVENIIRFFPMTKEFIDGSLQNGRFPSLPQCKEDAEEWTYPMRREMQEILPGLFLGPYSSAMKSKLPVLQKHLE

SEQ ID NO: 902584 - protein, 72 aa, Homo sapiens
MCWDICWLNSKGELCLHFKKVEAEGMVSILVCNSKKFSWLKFKGKICGMDEPFSYAWVWTFSVVFLRLGVKC

SEQ ID NO: 902585 - protein, 223 aa, Homo sapiens; identical to SEQ ID NO: 902582

SEQ ID NO: 902586 - protein, 534 aa, Homo sapiens
GQGGCDQISRGSGKRPGNWAAGPAPASGGKMAAQALALLREVARLEAPLEELRALHSVLQAVPLNELRQQAAELRLGPLFSLLNENHREKTTLCVSILERLLQAMEPVHVARNLRVDLQRGLIHPDDSVKILTLSQIGRIVENSDAVTEILNNAELLKQIVYCIGGENLSVAKAAIKSLSRISLTQAGLEALFESNLLDDLKSVMKTNDIVRYRVYELIIEISSVSPESLNYCTTSGLVTQLLRELTGEDVLVRATCIEMVTSLAYTHHGRQYLAQEGVIDQISNIIVGADSDPFSSFYLPGFVKFFGNLAVMDSPQQICERYPIFVEKVFEMIESQDPTMIGVAVDTVGILGSNVEGKQVLQKTGTRFERLLMRIGHQSKNAPVELKIRCLDAISSLLYLPPEQQTDDLLRMTESWFSSLSRDPLELFRGISSQPFPELHCAALKVFTAIANQPWAQKLMFNSPGFVEYVVDRSVEHDKASKDAKYELVKALANSKTIAEIFGNPNYLRLRTYLSEGPYYVKPVSTTAVEGAE

SEQ ID NO: 902587 - protein, 182 aa, Homo sapiens
GQGGCDQISRGSGKRPGNWAAGPAPASGGKMAAQALALLREVARLEAPLEELRALHSVLQAVPLNELRQQAAELRLGPLFSLLNENHREKTTLCVSILERLLQAMEPVHVARNLRVDLQRGLIHPDDSVKILTLSQIGRIVENSDAVTEILNNAELLKQIVYCIGGENLSVAKAVSLLESLT

SEQ ID NO: 902588 - protein, 534 aa, Homo sapiens; identical to SEQ ID NO: 902586

SEQ ID NO: 902589 - protein, 330 aa, Homo sapiens [sequence omitted]

SEQ ID NO: 902590 - protein, 416 aa, Homo sapiens
GQGGCDQISRGSGKRPGNWAAGPAPASGGKMAAQALALLREVARLEAPLEELRALHSVLQAVPLNELRQQAAELRLGPLFSLLNENHREKTTLCVSILERLLQAMEPVHVARNLRVDLQRGLIHPDDSVKILTLSQIGRIVENSDAVTEILNNAELLKQIVYCIGGENLSVAKAAIKSLSRISLTQAGLEALFESNLLDDLKSVMKTNDIVRYRVYELIIEISSVSPESLNYCTTSGLVTQLLRELTGEDVLVRATCIEMVTSLAYTHHGRQYLAQEGVIDQISNIIVGADSDPFSSFYLPGFVKFFGNLAVMDSPQQICERYPIFVEKVFEMIESQDPTMIGVAVDTVGILGSNVEGKQVLQKTGWYDLALFRDILIFDRGSICKFICWWVNYIVETILWVAVLLTMTLYSCLKI

SEQ ID NO: 902591 - protein, 243 aa, Homo sapiens
GQGGCDQISRGSGKRPGNWAAGPAPASGGKMAAQALALLREVARLEAPLEELRALHSVLQAVPLNELRQQAAELRLGPLFSLLNENHREKTTLCVSILERLLQAMEPVHVARNLRVDLQRGLIHPDDSVKILTLSQIGRIVENSDAVTEILNNAELLKQIVYCIGGENLSVAKAAIKSLSRISLTQAGLEALFESNLLDDLKSVMKTNDIVRYRVYESHLYRNGDITGIYSSWATISCSRRSN

SEQ ID NO: 902592 - protein, 303 aa, Homo sapiens
GQGGCDQISRGSGKRPGNWAAGPAPASGGKMAAQALALLREVARLEAPLEELRALHSVLQAVPLNELRQQAAELRLGPLFSLLNENHREKTTLCVSILERLLQAMEPVHVARNLRVDLQRGLIHPDDSVKILTLSQIGRIVENSDAVTEILNNAELLKQIVYCIGGENLSVAKAAIKSLSRISLTQAGLEALFESNLLDDLKSVMKTNDIVRYRVYELIIEISSVSPESLNYCTTSGLVTQLLRELTGEDVLVRATCIEMVTSLAYTHHGRQYLAQEGVIDQISNIIVGADSDPFSSFYLPES

SEQ ID NO: 902593 - protein, 534 aa, Homo sapiens; identical to SEQ ID NO: 902586

SEQ ID NO: 902594 - protein, 534 aa, Homo sapiens; identical to SEQ ID NO: 902586

SEQ ID NO: 902595 - protein, 470 aa, Homo sapiens
GQGGCDQISRGSGKRPGNWAAGPAPASGGKMAAQALALLREVARLEAPLEELRALHSVLQAVPLNELRQQAAELRLGPLFSLLNENHREKTTLCVSILERLLQAMEPVHVARNLRVDLQRGLIHPDDSVKILTLSQIGRIVENSDAVTEILNNAELLKQIVYCIGGENLSVAKAAIKSLSRISLTQAGLEALFESNLLDDLKSVMKTNDIVRYRVYELIIEISSVSPESLNYCTTSGLVTQLLRELTGEDVLVRATCIEMVTSLAYTHHGRQYLAQEGVIDQISNIIVGADSDPFSSFYLPGFVKFFGNLAVMDSPQQICERYPIFVEKVFEMIESQDPTMIGVAVDTVGILGSNVEGKQVLQKTGTRFERLLMRIGHQSKNAPVELKIRCLDAISSLLYLPPEQQTDDLLRMTESWFSSLSRDPLELFRGISSQPFPELHCAALKVFTGRKHLHLEELVGGNQVKNTVE

SEQ ID NO: 902596 - protein, 67 aa, Homo sapiens
MILLLNDYAFNIVVGALMMTSMSGSPVPVERARMRSWVTGPSRELCGCLHQRFPSALLALAALGDGL

SEQ ID NO: 902597 - protein, 124 aa, Homo sapiens
HGVHREQIYRGICRWEDGGQSQVHPPYRNNICWGNEGWHVSRRGNPVLPQRKPIRRHLGKRIGHKGMAQLTNMDPPRKIPKGYYDCGDGFYNPVTRVVKDYRNRFLRNADDDEHEWITRTCRKG

SEQ ID NO: 902598 - protein, 150 aa, Homo sapiens
MSSSRMEGKAKYILPTETIYVGEMKDGMFHGEGTLYFPSGSQYDAIWENGLAIKGTYTFSDGLHYDEKNWHYCDGYDRRFYTEILNGLKPAGMAQLTNMDPPRKIPKGYYDCGDGFYNPVTRVVKDYRNRFLRNADDDEHEWITRTCRKG

SEQ ID NO: 902599 - protein, 161 aa, Homo sapiens
MEYTGSKYIGEYVDGRMEGKAKYILPTETIYVGEMKDGMFHGEGTLYFPSGSQYDAIWENGLAIKGTYTFSDGLHYDEKNWHYCDGYDRRFYTEILNGLKPAGMAQLTNMDPPRKIPKGYYDCGDGFYNPVTRVVKDYRNRFLRNADDDEHEWITRTCRKG

SEQ ID NO: 902600 - protein, 170 aa, Homo sapiens
VRGLNSDVQFKDGGQSKYILPTETIYVGEMKDGMFHGEGTLYFPSGSQYDAIWENGLAIKGTYTFSDGLHYDEKNWHYCDGYDRRFYTEILNGLKPAGMAQLTNMDPPRKIPKGYYDCGDGFYNPVTRVVKDYRNRFLRNAGRFLPTLQHVFSSPTYEYVHLYVQMYAHT

SEQ ID NO: 902601 - protein, 244 aa, Homo sapiens
LSRGSAAGGRALGRPWPGRRVACVGSAGDSGGSGAGGACATAWVCEMAADISESSGADCKGDPRNSAKLDADYPLRVLYCGVCSLPTEYCEYMPDVAKCRQWLEKNFPNEFAKLTVENSPKQEAGISEGQGTAGEEEEKKKQKRGGRGQIKQKKKTVPQKVTIAKIPRAKKKYVTRVCGLATFEIDLKEAQRFFAQKFSCGASVTGEDEIIIQGDFTDDIIDVIQEKWPEVDDDSIEDLGEVKK

SEQ ID NO: 902602 - protein, 68 aa, Homo sapiens
CLAGALLAVGRSGGPGRGDELHVLVQLAIAAGAEPAGPVRPPGFVKWLLTFLNPAGLTAKETQGTVPS

SEQ ID NO: 902603 - protein, 244 aa, Homo sapiens; identical to SEQ ID NO: 902601

SEQ ID NO: 902604 - protein, 244 aa, Homo sapiens; identical to SEQ ID NO: 902601

SEQ ID NO: 902605 - protein, 185 aa, Homo sapiens
LSRGSAAGGRALGRPWPGRRVACVGSAGDSGGSGAGGACATAWVCEMAADISESSGADCKGDPRNSAKLDADYPLRVLYCGVCSLPTEYCEYMPDVAKCRQWLEKNFPNEFAKLTVENSPKQEAGISEGQGTAGEEEEKKKQKRGGRGQIKQKKKTVPQKVTIAKIPRAKKKYVTRVCGLATFGR

SEQ ID NO: 902606 - protein, 244 aa, Homo sapiens; identical to SEQ ID NO: 902601

SEQ ID NO: 902607 - protein, 244 aa, Homo sapiens; identical to SEQ ID NO: 902601

SEQ ID NO: 902608 - protein, 244 aa, Homo sapiens; identical to SEQ ID NO: 902601

SEQ ID NO: 902609 - protein, 782 aa, Homo sapiens
MLENYWNLVSLGLCHFDMNIISMLEEGKEPWTVKSCVKIARKPRTRECVKGVVTDIPPKCTIKDLLPKEKSSTEAVFHTVVLERHESPDIEDFSFKEPQKNVHDFECQWRDDTGNYKGVLMAQKEGKRDQRDRRDIENKLMNNQLGVSFHSHLPELQLFQGEGKMYECNQVEKSTNNGSSVSPLQQIPSSVQTHRSKKYHELNHFSLLTQRRKANSCGKPYKCNECGKAFTQNSNLTSHRRIHSGEKPYKCSECGKTFTVRSNLTIHQVIHTGEKPYKCHECGKVFRHNSYLATHRRIHTGEKPYKCNECGKAFRGHSNLTTHQLIHTGEKPFKCNECGKLFTQNSHLISHWRIHTGEKPYKCNECGKAFSVRSSLAIHQTIHTGEKPYKCNECGKVFRYNSYLGRHRRVHTGEKPYKCNECGKAFSMHSNLATHQVIHTGTKPFKCNECSKVFTQNSQLANHRRIHTGEKPYKCNECGKAFSVRSSLTTHQAIHSGEKPYKCIECGKSFTQKSHLRSHRGIHSGEKPYKCNECGKVFAQTSQLARHWRVHTGEKPYKCNDCGRAFSDRSSLTFHQAIHTGEKPYKCHECGKVFRHNSYLATHRRIHTGEKPYKCNECGKAFSMHSNLTTHKVIHTGEKPYKCNQCGKVFTQNSHLANHQRTHTGEKPYRCNECGKAFSVRSSLTTHQAIHTGKKPYKCNECGKVFTQNAHLANHRRIHTGEKPYRCTECGKAFRVRSSLTTHMAIHTGEKRYKCNECGKVFRQSSNLASHHRMHTGEKPYK

SEQ ID NO: 902610 - protein, 67 aa, Homo sapiens
AHRPGSGSCGASITPWRMSVPLCRLNLRLAVPHSHTRCPGVATDLKSPHRTLHLRNVPGSEHCPLTT

SEQ ID NO: 902611 - protein, 67 aa, Homo sapiens; identical to SEQ ID NO: 902610

SEQ ID NO: 902612 - protein, 818 aa, Homo sapiens
MALTQVRLTFRDVAIEFSQEEWKCLDPAQRILYRDVMLENYWNLVSLGLCHFDMNIISMLEEGKEPWTVKSCVKIARKPRTRECVKGVVTDIPPKCTIKDLLPKEKSSTEAVFHTVVLERHESPDIEDFSFKEPQKNVHDFECQWRDDTGNYKGVLMAQKEGKRDQRDRRDIENKLMNNQLGVSFHSHLPELQLFQGEGKMYECNQVEKSTNNGSSVSPLQQIPSSVQTHRSKKYHELNHFSLLTQRRKANSCGKPYKCNECGKAFTQNSNLTSHRRIHSGEKPYKCSECGKTFTVRSNLTIHQVIHTGEKPYKCHECGKVFRHNSYLATHRRIHTGEKPYKCNECGKAFRGHSNLTTHQLIHTGEKPFKCNECGKLFTQNSHLISHWRIHTGEKPYKCNECGKAFSVRSSLAIHQTIHTGEKPYKCNECGKVFRYNSYLGRHRRVHTGEKPYKCNECGKAFSMHSNLATHQVIHTGTKPFKCNECSKVFTQNSQLANHRRIHTGEKPYKCNECGKAFSVRSSLTTHQAIHSGEKPYKCIECGKSFTQKSHLRSHRGIHSGEKPYKCNECGKVFAQTSQLARHWRVHTGEKPYKCNDCGRAFSDRSSLTFHQAIHTGEKPYKCHECGKVFRHNSYLATHRRIHTGEKPYKCNECGKAFSMHSNLTTHKVIHTGEKPYKCNQCGKVFTQNSHLANHQRTHTGEKPYRCNECGKAFSVRSSLTTHQAIHTGKKPYKCNECGKVFTQNAHLANHRRIHTGEKPYRCTECGKAFRVRSSLTTHMAIHTGEKRYKCNECGKVFRQSSNLASHHRMHTGEKPYK

SEQ ID NO: 902613 - protein, 818 aa, Homo sapiens; identical to SEQ ID NO: 902612

SEQ ID NO: 902614 - protein, 817 aa, Homo sapiens
MALTQVRLTFRDVAIEFSQEEWKCLDPAQRILYRDVMLENYWNLVSLGLCHFDMNIISMLEEGKEPWTVKSCVKIARKPRTRECVKGVVTDIPPKCTIKDLLPKEKSSTEAVFHTVVLERHESPDIEDFSFKEPQKNVHDFECQWRDDTGNYKGVLMAQKEGKRDQRDRRDIENKLMNNQLGVSFHSHLPELQLFQGEGKMYECNQVEKSTNNGSSVSPLQQIPSSVQTHRSKKYHELNHFSLLTQRRKANSCGKPYKCNECGKAFTQNSNLTSHRRIHSGEKPYKCSECGKTFTVRSNLTIHQVIHTGEKPYKCHECGKVFRHNSYLATHRRIHTGEKPYKCNECGKAFRGHSNLTTHQLIHTGEKPFKCNECGKLFTQNSHLISHWRIHTGEKPYKCNECGKAFSVRSSLAIHQTIHTGEKPYKCNECGKVFRYNSYLGRHRRVHTGEKPYKCNECGKAFSMHSNLATHQVIHTGTKPFKCNECSKVFTQNSQLANHRRIHTGEKPYKCNECGKAFSVRSSLTTHQAIHSGEKPYKCIECGKSFTQKSHLRSHRGIHSGEKPYKCNECGKVFAQTSQLARHWRVHTGEKPYKCNDCGRAFSDRSSLTFHQAIHTGEKPYKCHECGKVFRHNSYLATHRRIHTGEKPYKCNECGKAFSMHSNLTTHKVIHTGEKPYKCNQCGKVFTQNSHLANHQRTHTGEKPYRCNECGKAFSVRSSLTTHQAIHTGKKPYKCNECGKVFTQNAHLANHRRIHTGEKPYRCTECGKAFRVRSSLTTHMAIHTGEKRYKCNECGKVFRQTACSSSIWLLFHSCYEN

SEQ ID NO: 902615 - protein, 147 aa, Homo sapiens
MALTQVRLTFRDVAIEFSQEEWKCLDPAQRILYRDVMLENYWNLVSLGLCHFDMNIISMLEEGKEPWTVKSCVKIARKPRTRECVKGVVTDLLRRWKHWLLLLGICCPKPHGRVSSRLRLSRSLGHFFHSAFATFMGVCDKRVGSIF

SEQ ID NO: 902616 - protein, 67 aa, Homo sapiens; identical to SEQ ID NO: 902610

SEQ ID NO: 902617 - protein, 818 aa, Homo sapiens; identical to SEQ ID NO: 902612

SEQ ID NO: 902618 - protein, 179 aa, Homo sapiens
MALTQVRLTFRDVAIEFSQEEWKCLDPAQRILYRDVMLENYWNLVSLGLCHFDMNIISMLEEGKEPWTVKSCVKIARKPRTRECVKGVVTDIPPKCTIKDLLPKEKSSTEAVFHTVVLERHESPDIEDFSFKEPQKNVHDFECQWRDDTGNYKGVLMAQKEGKRDQRDRRDIEPTKIKQ

SEQ ID NO: 902619 - protein, 685 aa, Homo sapiens [sequence omitted]

SEQ ID NO: 902620 - protein, 667 aa, Homo sapiens
MAEWLLSASWQRRAKAMTAAAGSAGRAAVPLLLCALLAPGGAYVLDDSDGLGREFDGIGAVSGGGATSRLLVNYPEPYRSQILDYLFKPNFGASLHILKVEIGGDGQTTDGTEPSHMHYALDENYFRGYEWWLMKEAKKRNPNITLIGLPWSFPGWLGKGFDWPYVNLQLTAYYVVTWIVGAKRYHDLDIDYIGIWNERSYNANYIKILRKMLNYQGLQRVKIIASDNLWESISASMLLDAELFKVVDVIGAHYPGTHSALNSDMGAGCWGRILNQNYINGYMTSTIAWNLVASYYEQLPYGRCGLMTAQEPWSGHYVVESPVWVSAHTTQFTQPGWYYLKTVGHLEKGGSYVALTDGLGNLTIIIETMSHKHSKCIRPFLPYFNVSQQFATFVLKGSFSEIPELQVWYTKLGKTSERFLFKQLDSLWLLDSDGSFTLSLHEDELFTLTTLTTGRKGSYPLPPKSQPFPSTYKDDFNVDYPFFSEAPNFADQTGVFEYFTNIEDPGEHHFTLRQVLNQRPITWAADASNTISIIGDYNWTNLTIKCDVYIETPDTGGVFIAGRVNKGGILIRSARGIFFWIFANGSYRVTGDLAGWIIYALGRVEVTAKKWYTLTLTIKGHFASGMLNDKSLWTDIPVNFPKNGWAAIGTHSFEFAQFDNFLVEATR

SEQ ID NO: 902621 - protein, 611 aa, Homo sapiens
MGFMVADLWATSRLLVNYPEPYRSQILDYLFKPNFGASLHILKVEIGGDGQTTDGTEPSHMHYALDENYFRGYEWWLMKEAKKRNPNITLIGLPWSFPGWLGKGFDWPYVNLQLTAYYVVTWIVGAKRYHDLDIDYIGIWNERSYNANYIKILRKMLNYQGLQRVKIIASDNLWESISASMLLDAELFKVVDVIGAHYPGTHSALNSDMGAGCWGRILNQNYINGYMTSTIAWNLVASYYEQLPYGRCGLMTAQEPWSGHYVVESPVWVSAHTTQFTQPGWYYLKTVGHLEKGGSYVALTDGLGNLTIIIETMSHKHSKCIRPFLPYFNVSQQFATFVLKGSFSEIPELQVWYTKLGKTSERFLFKQLDSLWLLDSDGSFTLSLHEDELFTLTTLTTGRKGSYPLPPKSQPFPSTYKDDFNVDYPFFSEAPNFADQTGVFEYFTNIEDPGEHHFTLRQVLNQRPITWAADASNTISIIGDYNWTNLTIKCDVYIETPDTGGVFIAGRVNKGGILIRSARGIFFWIFANGSYRVTGDLAGWIIYALGRVEVTAKKWYTLTLTIKGHFASGMLNDKSLWTDIPVNFPKNGWAAIGTHSFEFAQFDNFLVEATR

SEQ ID NO: 902622 - protein, 685 aa, Homo sapiens [sequence omitted]

SEQ ID NO: 902623 - protein, 569 aa, Homo sapiens
MHYALDENYFRGYEWWLMKEAKKRNPNITLIGLPWSFPGWLGKGFDWPYVNLQLTAYYVVTWIVGAKRYHDLDIDYIGIWNERSYNANYIKILRKMLNYQGLQRVKIIASDNLWESISASMLLDAELFKVVDVIGAHYPGTHSAKDAKLTGKKLWSSEDFSTLNSDMGAGCWGRILNQNYINGYMTSTIAWNLVASYYEQLPYGRCGLMTAQEPWSGHYVVESPVWVSAHTTQFTQPGWYYLKTVGHLEKGGSYVALTDGLGNLTIIIETMSHKHSKCIRPFLPYFNVSQQFATFVLKGSFSEIPELQVWYTKLGKTSERFLFKQLDSLWLLDSDGSFTLSLHEDELFTLTTLTTGRKGSYPLPPKSQPFPSTYKDDFNVDYPFFSEAPNFADQTGVFEYFTNIEDPGEHHFTLRQVLNQRPITWAADASNTISIIGDYNWTNLTIKCDVYIETPDTGGVFIAGRVNKGGILIRSARGIFFWIFANGSYRVTGDLAGWIIYALGRVEVTAKKWYTLTLTIKGHFASGMLNDKSLWTDIPVNFPKNGWAAIGTHSFEFAQFDNFLVEATR

SEQ ID NO: 902624 - protein, 667 aa, Homo sapiens
MAEWLLSASWQRRAKAMTAAAGSAGRAAVPLLLCALLAPGGAYVLDDSDGLGREFDGIGAVSGGGATSRLLVNYPEPYRSQILDYLFKPNFGASLHILKVEIGGDGQTTDGTEPSHMHYALDENYFRGYEWWLMKEAKKRNPNITLIGLPWSFPGWLGTWIVGAKRYHDLDIDYIGIWNERSYNANYIKILRKMLNYQGLQRVKIIASDNLWESISASMLLDAELFKVVDVIGAHYPGTHSAKDAKLTGKKLWSSEDFSTLNSDMGAGCWGRILNQNYINGYMTSTIAWNLVASYYEQLPYGRCGLMTAQEPWSGHYVVESPVWVSAHTTQFTQPGWYYLKTVGHLEKGGSYVALTDGLGNLTIIIETMSHKHSKCIRPFLPYFNVSQQFATFVLKGSFSEIPELQVWYTKLGKTSERFLFKQLDSLWLLDSDGSFTLSLHEDELFTLTTLTTGRKGSYPLPPKSQPFPSTYKDDFNVDYPFFSEAPNFADQTGVFEYFTNIEDPGEHHFTLRQVLNQRPITWAADASNTISIIGDYNWTNLTIKCDVYIETPDTGGVFIAGRVNKGGILIRSARGIFFWIFANGSYRVTGDLAGWIIYALGRVEVTAKKWYTLTLTIKGHFASGMLNDKSLWTDIPVNFPKNGWAAIGTHSFEFAQFDNFLVEATR

SEQ ID NO: 902625 - protein, 685 aa, Homo sapiens [sequence omitted]

SEQ ID NO: 902626 - protein, 685 aa, Homo sapiens [sequence omitted]

SEQ ID NO: 902627 - protein, 685 aa, Homo sapiens [sequence omitted]

SEQ ID NO: 902628 - protein, 499 aa, Homo sapiens
MAEWLLSASWQRRAKAMTAAAGSAGRAAVPLLLCALLAPGGAYVLDDSDGLGREFDGIGAVSGGGATSRLLVNYPEPYRSQILDYLFKPNFGASLHILKVEIGGDGQTTDGTEPSHMHYALDENYFRGYEWWLMKEAKKRNPNITLIGLPWSFPGWLGKGFDWPYVNLQLTAYYVVTWIVGAKRYHDLDIDYIGIWNERSYNANYIKILRKMLNYQGLQRVKIIASDNLWESISASMLLDAELFKVVDVIGAHYPGTHSAKDAKLTGKKLWSSEDFSTLNSDMGAGCWGRILNQNYINGYMTSTIAWNLVASYYEQLPYGRCGLMTAQEPWSGHYVVESPVWVSAHTTQFTQPGWYYLKTVGHLEKGGSYVALTDGLGNLTIIIETMSHKHSKCIRPFLPYFNVSQQFATFVLKGSFSEIPELQVWYTKLGKTSERFLFKQLDSLWLLDSDGSFTLSLHEDELFTLTTLTTGRKGSYPLPPKSQPFPSTYKDDFNVGPI

SEQ ID NO: 902629 - protein, 685 aa, Homo sapiens [sequence omitted]

SEQ ID NO: 902630 - protein, 644 aa, Homo sapiens
RVEEGFESYEDILVTEGTWEVGQKATSRLLVNYPEPYRSQILDYLFKPNFGASLHILKVEIGGDGQTTDGTEPSHMHYALDENYFRGYEWWLMKEAKKRNPNITLIGLPWSFPGWLGKGFDWPYVNLQLTAYYVVTWIVGAKRYHDLDIDYIGIWNERSYNANYIKILRKMLNYQGLQRVKIIASDNLWESISASMLLDAELFKVVDVIGAHYPGTHSAKDAKLTGKKLWSSEDFSTLNSDMGAGCWGRILNQNYINGYMTSTIAWNLVASYYEQLPYGRCGLMTAQEPWSGHYVVESPVWVSAHTTQFTQPGWYYLKTVGHLEKGGSYVALTDGLGNLTIIIETMSHKHSKCIRPFLPYFNVSQQFATFVLKGSFSEIPELQVWYTKLGKTSERFLFKQLDSLWLLDSDGSFTLSLHEDELFTLTTLTTGRKGSYPLPPKSQPFPSTYKDDFNVDYPFFSEAPNFADQTGVFEYFTNIEDPGEHHFTLRQVLNQRPITWAADASNTISIIGDYNWTNLTIKCDVYIETPDTGGVFIAGRVNKGGILIRSARGIFFWIFANGSYRVTGDLAGWIIYALGRVEVTAKKWYTLTLTIKGHFASGMLNDKSLWTDIPVNFPKNGWAAIGTHSFEFAQFDNFLVEATR

SEQ ID NO: 902631 - protein, 146 aa, Homo sapiens
RNCQFQKQPISIIGDYNWTNLTIKCDVYIETPDTGGVFIAGRVNKGGILIRSARGIFFWIFANGSYRVTGDLAGWIIYALGRVEVTAKKWYTLTLTIKGHFASGMLNDKSLWTDIPVNFPKNGWAAIGTHSFEFAQFDNFLVEATR

SEQ ID NO: 902632 - protein, 407 aa, Homo sapiens
MAEWLLSASWQRRAKAMTAAAGSAGRAAVPLLLCALLAPGGAYVLDDSDGLGREFDGIGAVSGGGATSRLLVNYPEPYRSQILDYLFKPNFGASLHILKVEIGGDGQTTDGTEPSHMHYALDENYFRGYEWWLMKEAKKRNPNITLIGLPWSFPGWLGKGFDWPYVNLQLTAYYVVTWIVGAKRYHDLDIDYIGIWNERSYNANYIKILRKMLNYQGLQRVKIIASDNLWESISASMLLDAELFKVVDVIGAHYPGTHSAKDAKLTGKKLWSSEDFSTLNSDMGAGCWGRILNQNYINGYMTSTIAWNLVASYYEQLPYGRCGLMTAQEPWSGHYVVESPVWVSAHTTQFTQPGWYYLKTVGHLEKGGSYVALTDGLGNLTIIIETMVNFCCCYWINSLLYYWKNKI

SEQ ID NO: 902633 - protein, 358 aa, Homo sapiens
MAGQDAGCGRGGDDYSEDEGDSSVSRAAVEVFGKLKDLNCPFLEGLYITEPKTIQELLCSPSEYRLEILEWMCTRVWPSLQDRFSSLKGVPTEVKIQEMTKLGHELMLCAPDDQELLKGCACAQKQLHFMDQLLDTIRSLTIGCSSCSSLMEHFEDTREKNEALLGELFSSPHLQMLLNPECDPWPLDMQPLLNKQSDDWQWASASAKSEEEEKLAELARQLQESAAKLHALRTEYFAQHEQGAAAGAADISTLDQKLRLVTSDFHQLILAFLQVYDDELGECCQRPGPDLHPCGPIIQATHQNLTSYSQLLQVVMAVADTSAKAVETVKKQQGEQICWGGSSSVMSLATKMNELMEK

SEQ ID NO: 902634 - protein, 358 aa, Homo sapiens; identical to SEQ ID NO: 902633

SEQ ID NO: 902635 - protein, 328 aa, Homo sapiens
MAGQDAGCGRGGDDYSEDEGDSSVSRAAVEVFGKLKDLNCPFLEGLYITEPKTIQELLCSPSEYRLEILEWMCTRVWPSLQDRFSSLKGVPTEVKIQEMTKLGHELMLCAPDDQELLKGCACAQKQLHFMDQLLDTIRSLTIGCSSCSSLMEHFEDTREKNEALLGELFSSPHLQMLLNPECDPWPLDMQPLLNKQSDDWQWASASAKSEEEEKLAELARQLQESAAKLHALRTEYFAQHEQGAAAGAADISTLDQKLRLVTSDFHQLILAFLQVYDDELGECCQRPGPDLHPCGPIIQATHQNLTSYSQVRVPFPSPLTAPSPVHSD

SEQ ID NO: 902636 - protein, 328 aa, Homo sapiens; identical to SEQ ID NO: 902635

SEQ ID NO: 902637 - protein, 451 aa, Homo sapiens
MSSTSACTISLTSSSKATRGFQFSFCFALVQSPCRKSSAAACDPLSNAAVDVSSRAAAKREFFLGGGFGLFVPTVKSVHVASRTHAFIKRKLEFHEAILRLSVQERCRRSILFYPYSTRFDSVPKKMPISTHLYFHERSCSQQLCRTPHCPPPSPLAVPSSSRFPQLLHSRKPEDRFSSLKGVPTEVKIQEMTKLGHELMLCAPDDQELLKGCACAQKQLHFMDQLLDTIRSLTIGCSSCSSLMEHFEDTREKNEALLGELFSSPHLQMLLNPECDPWPLDMQPLLNKQSDDWQWASASAKSEEEEKLAELARQLQESAAKLHALRTEYFAQHEQGAAAGAADISTLDQKLRLVTSDFHQLILAFLQVYDDELGECCQRPGPDLHPCGPIIQATHQNLTSYSQLLQVVMAVADTSAKAVETVKKQQGEQICWGGSSSVMSLATKMNELMEK

SEQ ID NO: 902638 - protein, 265 aa, Homo sapiens
MAGQDAGCGRGGDDYSEDEGDSSVSRAAVEVFGKLKDLNCPFLEGLYITEPKTIQELLCSPSEYRLEILEWMCTRVWPSLQDRFSSLKGVPTEVKIQEMTKLGHELMLCAPDDQELLKGCACAQKQLHFMDQLLDTIRSLTIGCSSCSSLMEHFEDTREKNEALLGELFSSPHLQMLLNPECDPWPLDMQPLLNKQSDDWQWASASAKSEEEEKLAELARQLQESAAKLHALRTESTTTSWASAASAQALTSTRAAPSSRPRTRI

SEQ ID NO: 902639 - protein, 230 aa, Homo sapiens
MTKLGHELMLCAPDDQELLKGCACAQKQLHFMDQLLDTIRSLTIGCSSCSSLMEHFEDTREKNEALLGELFSSPHLQMLLNPECDPWPLDMQPLLNKQSDDWQWASASAKSEEEEKLAELARQLQESAAKLHALRTEYFAQHEQGAAAGAADISTLDQKLRLVTSDFHQLILAFLQVYDDELGECCQRPGPDLHPCGPIIQATHQNLTSYSQVRVPFPSPLTAPSPVHSD

SEQ ID NO: 902640 - protein, 99 aa, Homo sapiens
MDDCGSRSRCSPTLCSRQGPLAPLGRERQTGGLTWTQRKPWFLKQKKQQERSKEQTEHENKRKKAQGGPQKRDRREATGHNTHTKEYSKGDAQQGNRQH

SEQ ID NO: 902641 - protein, 236 aa, Homo sapiens
MSEAPRAETFVFLDLEATGLPSVEPEIAELSLFAVHRSSLENPEHDESGALVLPRVLDKLTLCMCPERPFTAKASEITGLSSEGLARCRKAGFDGAVVRTLQAFLSRQAGPICLVAHNGFDYDFPLLCAELRRLGARLPRDTVCLDTLPALRGLDRAHSHGTRARGRQGYSLGSLFHRYFRAEPSAAHSAEGDVHTLLLIFLHRAAELLAWADEQARGWAHIEPMYLPPDDPSLEA

SEQ ID NO: 902642 - protein, 174 aa, Homo sapiens
MAGQDAGCGRGGDDYSEDEGDSSVSRAAVEVFGKLKDLNCPFLEGLYITEPKTIQELLCSPSEYRLEILEWMCTRVWPSLQDRFSSLKGVPTEVKIQEMTKLGHELMLCAPDDQELLKGCACAQKQLHFMDQLLDTIRSLTIGCSSCSSLMEHFEDTKESAAKCTRLERSTCTA

SEQ ID NO: 902643 - protein, 196 aa, Homo sapiens
AGCGRGGDDYSEDEGDSSVSRAAVEVFGKLKVLLAQKATPGRGTGEGPARGPGGLAAEVRGATRPPSPVPAAPCSLAAGGACGSFIFALWCAPGLRSCCLHGPCLVVGASTACGTAVPALGARSKCRHRGPRPGLRDLAGSGGTDGQSLVPLCQVSETRAWCQLVSDARGDSLQKPSTAPQDRALTAAVRKAGPRG

SEQ ID NO: 902644 - protein, 417 aa, Homo sapiens
MAGQDAGCGRGGDDYSEDEGDSSVSRAAVEVFGKLKDLNCPFLEGLYITEPKTIQELLCSPSEYRLEILEWMCTRVWPSLQDRFSSLKGVPTEVKIQEMTKLGHELMLCAPDDQELLKGCACAQKQLHFMDQLLDTIRSLTIGCSSCSSLMEHFEDTREKNEALLGELFSSPHLQMLLNPECDPWPLDMQPLLNKQSDDWQWASASAKSEEEEKLAELARQLQESAAKLHALRTEYFAQHEQGAAAGAADISTLDQKLRLVTSDFHQLILAFLQVYDDELGECCQRPGPDLHPCGPIIQATHQNLTSYSQIPRGQPKKPALVTMTTVPTCATLPLAQGFRDVHFGFLSERLRAFQPLTGWSCETPRSGMLLQVVMAVADTSAKAVETVKKQQGEQICWGGSSSVMSLATKMNELMEK

SEQ ID NO: 902645 - protein, 358 aa, Homo sapiens; identical to SEQ ID NO: 902633

SEQ ID NO: 902646 - protein, 263 aa, Homo sapiens
MDDCGSRSRCSPTLCSLRTCYPRGNITMSEAPRAETFVFLDLEATGLPSVEPEIAELSLFAVHRSSLENPEHDESGALVLPRVLDKLTLCMCPERPFTAKASEITGLSSEGLARCRKAGFDGAVVRTLQAFLSRQAGPICLVAHNGFDYDFPLLCAELRRLGARLPRDTVCLDTLPALRGLDRAHSHGTRARGRQGYSLGSLFHRYFRAEPSAAHSAEGDVHTLLLIFLHRAAELLAWADEQARGWAHIEPMYLPPDDPSLEA

SEQ ID NO: 902647 - protein, 417 aa, Homo sapiens; identical to SEQ ID NO: 902644

SEQ ID NO: 902648 - protein, 417 aa, Homo sapiens; identical to SEQ ID NO: 902644

SEQ ID NO: 902649 - protein, 412 aa, Homo sapiens
MAGQDAGCGRGGDDYSEDEGDSSVSRAAVEVFGKLKDLNCPFLEGLYITEPKTIQELLCSPSEYRLEILEWMCTRVWPSLQDRFSSLKGVPTEVKIQEMTKLGHELMLCAPDDQELLKGCACAQKQLHFMDQLLDTIRSLTIGCSSCSSLMEHFEDTREKNEALLGELFSSPHLQMLLNPECDPWPLDMQPLLNKQSDDWQWASASAKSEEEEKLAELARQLQESAAKLHALRTEYFAQHEQGAAAGAADISTLDQKLRLVTSDFHQLILAFLQVYDDELGECCQRPGPDLHPCGPIIQATHQNLTSYSQIPRGQPKKPALVTMTTVPTRQGPLAPLGRERQTGGLTWTQRKPWFLKQKKQQERSKEQTEHENKRKKAQGGPQKRDRREATGHNTHTKEYSKGDAQQGNRQH

SEQ ID NO: 902650 - protein, 111 aa, Homo sapiens
MGGARLGARNMAGQDAGCGRGGDDYSEDEGDSSVSRAAVEVFGKLKDLNCPFLEGLYITEPKTIQECCGRSRHQHPRPEAASGHFRLPPANLGFSPSLRRRAGRVLPAPRP

SEQ ID NO: 902651 - protein, 254 aa, Homo sapiens
MAGQDAGCGRGGDDYSEDEGDSSVSRAAVEVFGKLKDLNCPFLEGLYITEPKTIQELLCSPSEYRLEILEWMCTRVWPSLQDRFSSLKGVPTEVKIQEMTKLGHELMLCAPDDQELLKGCACAQKQLHFMDQLLDTIRSLTIGCSSCSSLMEHFEDTREKNEALLGELFSSPHLQMLLNPECDPWPLDMQPLLNKQSDDWQWASASAKSEEEEKLAELARQLQESAAKLHALRTEYFCQHGPGACAGAPHLSTS

SEQ ID NO: 902652 - protein, 149 aa, Homo sapiens
MAGQDAGCGRGGDDYSEDEGDSSVSRAAVEVFGKLKDLNCPFLEGLYITEPKTIQELLCSPSEYRLEILEWMCTRVWPSLQDRFSSLKGVPTEVKIQEMTKLGHELMLCAPDDQELLKGCACAQKQLHFMDQLLDTIRSLTIGCSSCSR

SEQ ID NO: 902653 - protein, 564 aa, Homo sapiens
MEATGTWALLLALALLLLLTLALSGTRARGHLPPGPTPLPLLGNLLQLRPGALYSGLMRLSKKYGPVFTIYLGPWRPVVVLVGQEAVREALGGQAEEFSGRGTVAMLEGTFDGHGVFFSNGERWRQLRKFTMLALRDLGMGKREGEELIQAEARCLVETFQGTEGRPFDPSLLLAQATSNVVCSLLFGLRFSYEDKEFQAVVRAAGGTLLGVSSQGGQTYEMFSWFLRPLPGPHKQLLHHVSTLAAFTVRQVQQHQGNLDASGPARDLVDAFLLKMAQEEQNPGTEFTNKNMLMTVIYLLFAGTMTVSTTVGYTLLLLMKYPHVQKWVREELNRELGAGQAPSLGDRTRLPYTDAVLHEAQRLLALVPMGIPRTLMRTTRFRGYTLPQGTEVFPLLGSILHDPNIFKHPEEFNPDRFLDADGRFRKHEAFLPFSLGKRVCLGEGLAKAELFLFFTTILQAFSLESPCPPDTLSLKPTVSGLFNIPPASTVGMDRVNVSRVYTAGSHIYTPAVVFRSLSHGPHAHLTHAAKMHNRTPIHNYKGHKATAGLAFHRHKYSPSAITST

SEQ ID NO: 902654 - protein, 390 aa, Homo sapiens
MEATGTWALLLALALLLLLTLALSGTRARGHLPPGPTPLPLLGNLLQLRPGALYSGLMRLSKKYGPVFTIYLGPWRPVVVLVGQEAVREALGGQAEEFSGRGTVAMLEGTFDGHGVFFSNGERWRQLRKFTMLALRDLGMGKREGEELIQAEARCLVETFQGTEGGTKPGTEFTNKNMLMTVIYLLFAGTMTVSTTVGYTLLLLMKYPHVQKWVREELNRELGAGQAPSLGDRTRLPYTDAVLHEAQRLLALVPMGIPRTLMRTTRFRGYTLPQGTEVFPLLGSILHDPNIFKHPEEFNPDRFLDADGRFRKHEAFLPFSLGKRVCLGEGLAKAELFLFFTTILQAFSLESPCPPDTLSLKPTVSGLFNIPPAFQLQVRPTDLHSTTQTR

SEQ ID NO: 902655 - protein, 504 aa, Homo sapiens
MEATGTWALLLALALLLLLTLALSGTRARGHLPPGPTPLPLLGNLLQLRPGALYSGLMRLSKKYGPVFTIYLGPWRPVVVLVGQEAVREALGGQAEEFSGRGTVAMLEGTFDGHGVFFSNGERWRQLRKFTMLALRDLGMGKREGEELIQAEARCLVETFQGTEGRPFDPSLLLAQATSNVVCSLLFGLRFSYEDKEFQAVVRAAGGTLLGVSSQGGQTYEMFSWFLRPLPGPHKQLLHHVSTLAAFTVRQVQQHQGNLDASGPARDLVDAFLLKMAQEEQNPGTEFTNKNMLMTVIYLLFAGTMTVSTTVGYTLLLLMKYPHVQKWVREELNRELGAGQAPSLGDRTRLPYTDAVLHEAQRLLALVPMGIPRTLMRTTRFRGYTLPQGTEVFPLLGSILHDPNIFKHPEEFNPDRFLDADGRFRKHEAFLPFSLGKRVCLGEGLAKAELFLFFTTILQAFSLESPCPPDTLSLKPTVSGLFNIPPAFQLQVRPTDLHSTTQTR

SEQ ID NO: 902656 - protein, 571 aa, Homo sapiens
MEATGTWALLLALALLLLLTLALSGTRARGHLPPGPTPLPLLGNLLQLRPGALYSGLMRLSKKYGPVFTIYLGPWRPVVVLVGQEAVREALGGQAEEFSGRGTVAMLEGTFDGHGVFFSNGERWRQLRKFTMLALRDLGMGKREGEELIQAEARCLVETFQGTEGRPFDPSLLLAQATSNVVCSLLFGLRFSYEDKEFQAVVRAAGGTLLGVSSQGGQTYEMFSWFLRPLPGPHKQLLHHVSTLAAFTVRQVQQHQGNLDASGPARDLVDAFLLKMAQEEQNPGTEFTNKNMLMTVIYLLFAGTMTVSTTVGYTLLLLMKYPHVQKWVREELNRELGAGQAPSLGDRTRLPYTDAVLHEAQRLLALVPMGIPRTLMRTTRFRGYTLPQGTEVFPLLGSILHDPNIFKHPEEFNPDRFLDADGRFRKHEAFLPFSLGKRVCLGEGLAKAELFLFFTTICMSPLGLSLAWEPGYWGPFPTLPLTCCVTLGSLCPSLSLSVPRAPKHSILVEEFLAEISNSPPHLNCHQLTKGLYHIEHIFLKALLSAEERQEDVLVTHELPIPSSVLPLVSVT

SEQ ID NO: 902657 - protein, 504 aa, Homo sapiens; identical to SEQ ID NO: 902655

SEQ ID NO: 902658 - protein, 147 aa, Homo sapiens [sequence omitted]

SEQ ID NO: 902659 - protein, 232 aa, Homo sapiens
AHEVAAPSGSGKIAGAQEFEHFVGSRCPHVGVWLSPSQATETATHVHSSHALSIHRTSQCPCPWCLAQGTACPLRGHATQRLSLSMAPTHAPSLGYTTLPACDHRCPHTPNHLSTQLPTYDIVLAPQSIFPLRHAAPTEAQSPATSATAALSHPFLSTLILPNANTSGSAIMHRDFGHTRTLRPEEHLPNPNTCLCNHVESGPCCPSTHTYTLTDLQPLFGVRVPTRPSGRG

SEQ ID NO: 902660 - protein, 464 aa, Homo sapiens
PRQVHLGKDPMSFKLKKELTEEWQKACAKYKLDRGDPILDEEFQRLKTEVSHKRVVRNQEEKIKEFHPTFDPLINNTWLSRSRAQKRFQQVARKVMIQGRLFNMLSAVREMDKESILRKIGQAKQSIAQEANFFKFFLRRISQDDYTSRFSVSPKEVLPFAFPDCSPPQDSNELAPDGLGLVPIKSSEVQIKQSYSFFNLQVPQLYKIKRYQPFSVHKSSTSYRPQKLARALKQGAEDEVTTITALPKQDSTTQLSGKTSILSMKPPEALAMSLDYDPLYVFNPNPGLFAVMHPLTYAETLIDYHLCSHPKYKFTKESRHGSSIPVTQKQFLHHTDIIPGIMHWKSFQSLVLSSLPDPSKMETTKSCDSFNSFMLPIDVPAILDALPEEDRLETVERELCEQNVEVMLTPEMIKVEFPMLNYKDIRKEKEVKDQAQPAEKAGEKLLEEMRNLRGKALNTYLILE

SEQ ID NO: 902661 - protein, 412 aa, Homo sapiens
PRQVHLGKDPMSFKLKKELTEEWQKACAKYKLDRGDPILDEEFQRLKTEVSHKRVVRNQEEKIKEFHPTFDPLINNTWLSRSRAQKRFQQVARKVMIQGRLFNMLSAVREMDKESILRKIGQAKQSIAQEANFFKFFLRRISQDDYTSRFSVSPKEVLPFAFPDCSPPQDSNELAPDGLGLVPIKSSEVQIKQSYSFFNLQVPQLYKIKRYQPFSVHKSSTSYRPQKLARALKQGAEDEVTTITALPKQDSTTQLSGKTSILSMKPPEALAMSLDYDPLYVFNPNPGLFAVMHPLTYAETLIDYHLCSHPKYKFTKESRHGSSIPVTQKQFLHHTDIIPGIMHWKSFQSLVLSSLPDPSKMETTKSCDSFNSFMLPIDVPAILDALPEEDRLETVERSTWICCCICDDRVGV

SEQ ID NO: 902662 - protein, 302 aa, Homo sapiens
PRQVHLGKDPMSFKLKKELTEEWQKACAKYKLDRGDPILDEEFQRLKTEVSHKRVVRNQEEKIKEFHPTFDPLINNTWLSRSRAQKRFQQVARKVMIQGRLFNMLSAVREMDKESILRKIGQAKQSIAQEANFFKFFLRRISQDDYTSRFSVSPKEVLPFAFPDCSPPQDSNELAPDGLGLVPIKSSEVQIKQSYSFFNLQVPQLYKIKRYQPFSVHKSSTSYRPQKLARALKQGAEDEVTTITALPKQDSTTQLSGKTSILSMKPPEALAMSLDYDPLYVFVSDNWQKPCFLCSFISAITL

SEQ ID NO: 902663 - protein, 433 aa, Homo sapiens
PRQVHLGKDPMSFKLKKELTEEWQKACAKYKLDRGDPILDEEFQRLKTEVSHKRVVRNQEEKIKEFHPTFDPLINNTWLSRSRAQKRFQQVARKVMIQGRLFNMLSAVREMDKESILRKIGQAKQSIAQEANFFKFFLRRISQDDYTSRFSVSPKEVLPFAFPDCSPPQDSNELAPDGLGLVPIKSSEVQIKQSYSFFNLQVPQLYKIKRYQPFSVHKSSTSYRPQKLARALKQGAEDEVTTITALPKQDSTTQLSGKTSILSMKPPEALAMSLDYDPLYVFNPNPGLFAVMHPLTYAETLIDYHLCSHPKYKFTKESRHGSSIPVTQKQFLHHTDIIPGIMHWKSFQSLVLSSLPDPSKMETTKSELCEQNVEVMLTPEMIKVEFPMLNYKDIRKEKEVKDQAQPAEKAGEKLLEEMRNLRGKALNTYLILE

SEQ ID NO: 902664 - protein, 637 aa, Homo sapiens
MASNERDAISWYQKKIGAYDQQIWEKSIEQTQIKGLKNKPKKMGHIKPDLIDVDLIRGSTFAKAKPEIPWTSLTRKGLVRVVFFPLFSNWWIQVTSLRIFVWLLLLYFMQVIAIVLYLMMPIVNISEVLGPLCLMLLMGTVHCQIVSTQITRPSGNNGNRRRRKLRKTVNGDGSRENGNNSSDKVRGIETLESVPIIGGFWETIFGNRIKRVKLISNKGTETDNDPSCVHPIIKRRQCRPEIRMWQTREKAKFSDGEKCRREAFRRLGNGVSDDLSSEEDGEARTQMILLRRSVEGASSDNGCEVKNRKSILSRHLNSQVKKTTTRWCHIVRDSDSLAESEFESAAFSQGSRSGVSGGSRSLNMSRRDSESTRHDSETEDMLWDDLLHGPECRSSVTSDSEGAHVNTLHSGTKRDPKEDVFQQNHLFWLQNSSPSSDRVSAIIWEGNECKKMDMSVLEISGIIMSRVNAYQQGVGYQMLGNVVTIGLAFFPFLHRLFREKSLDQLKSISAEEILTLFCGAPPVTPIIVLSIINFFERLCLTWMFFFMMCVAERTYKQRFLFAKLFSHITSARKARKYEIPHFRLKKVENIKIWLSLRSYLKRRGPQRSVDVVVSSVFLLTLSIAFICCAQVKVSHLL

SEQ ID NO: 902665 - protein, 762 aa, Homo sapiens
MASNERDAISWYQKKIGAYDQQIWEKSIEQTQIKGLKNKPKKMGHIKPDLIDVDLIRGSTFAKAKPEIPWTSLTRKGLVRVVFFPLFSNWWIQVTSLRIFVWLLLLYFMQVIAIVLYLMMPIVNISEVLGPLCLMLLMGTVHCQIVSTQITRPSGNNGNRRRRKLRKTVNGDGSRENGNNSSDKVRGIETLESVPIIGGFWETIFGNRIKRVKLISNKGTETDNDPSCVHPIIKRRQCRPEIRMWQTREKAKFSDGEKCRREAFRRLGNGVSDDLSSEEDGEARTQMILLRRSVEGASSDNGCEVKNRKSILSRHLNSQVKKTTTRWCHIVRDSDSLAESEFESAAFSQGSRSGVSGGSRSLNMSRRDSESTRHDSETEDMLWDDLLHGPECRSSVTSDSEGAHVNTLHSGTKRDPKEDVFQQNHLFWLQNSSPSSDRVSAIIWEGNECKKMDMSVLEISGIIMSRVNAYQQGVGYQMLGNVVTIGLAFFPFLHRLFREKSLDQLKSISAEEILTLFCGAPPVTPIIVLSIINFFERLCLTWMFFFMMCVAERTYKQRFLFAKLFSHITSARKARKYEIPHFRLKKVENIKIWLSLRSYLKRRGPQRSVDVVVSSVFLLTLSIAFICCAQVLQGHKTFLNDAYNWEFLIWETALLLFLLRLASLGSETNKKYSNVSILLTEQINLYLKMEKKPNKKEQLTLVNNVLKLSTKLLKELDTPFRLYGLTMNPLIYNITRVVILSAVSGVISDLLGFNIRLWKIKS

SEQ ID NO: 902666 - protein, 651 aa, Homo sapiens
MGRYWVYFVTMGGSSNVLGPLCLMLLMGTVHCQIVSTQITRPSGNNGNRRRRKLRKTVNGDGSRENGNNSSDKVRGIETLESVPIIGGFWETIFGNRIKRVKLISNKGTETDNDPSCVHPIIKRRQCRPEIRMWQTREKAKFSDGEKCRREAFRRLGNGVSDDLSSEEDGEARTQMILLRRSVEGASSDNGCEVKNRKSILSRHLNSQVKKTTTRWCHIVRDSDSLAESEFESAAFSQGSRSGVSGGSRSLNMSRRDSESTRHDSETEDMLWDDLLHGPECRSSVTSDSEGAHVNTLHSGTKRDPKEDVFQQNHLFWLQNSSPSSDRVSAIIWEGNECKKMDMSVLEISGIIMSRVNAYQQGVGYQMLGNVVTIGLAFFPFLHRLFREKSLDQLKSISAEEILTLFCGAPPVTPIIVLSIINFFERLCLTWMFFFMMCVAERTYKQRFLFAKLFSHITSARKARKYEIPHFRLKKVENIKIWLSLRSYLKRRGPQRSVDVVVSSVFLLTLSIAFICCAQVLQGHKTFLNDAYNWEFLIWETALLLFLLRLASLGSETNKKYSNVSILLTEQINLYLKMEKKPNKKEQLTLVNNVLKLSTKLLKELDTPFRLYGLTMNPLIYNITRVVILSAVSGVISDLLGFNIRLWKIKS

SEQ ID NO: 902667 - protein, 763 aa, Homo sapiens
MASNERDAISWYQKKIGAYDQQIWEKSIEQTQIKGLKNKPKKMGHIKPDLIDVDLIRGSTFAKAKPEIPWTSLTRKGLVRVVFFPLFSNWWIQVTSLRIFVWLLLLYFMQVIAIVLYLMMPIVNISEVLGPLCLMLLMGTVHCQIVSTQITRPSGNNGNRRRRKLRKTVNGDGSRENGNNSSDKVRGIETLESVPIIGGFWETIFGNRIKRVKLISNKGTETDNDPSCVHPIIKRRQCRPEIRMWQTREKAKFSDGEKCRREAFRRLGNGVSDDLSSEEDGEARTQMILLRRSVEGASSDNGCEVKNRKSILSRHLNSQVKKTTTRWCHIVRDSDSLAESEFESAAFSQGSRSGVSGGSRSLNMSRRDSESTRHDSETEDMLWDDLLHGPECRSSVTSDSEGAHVNTLHSGTKRDPKEDVFQQNHLFWLQNSSPSSDRVSAIIWEGNECKKMDMSVLEISGIIMSRVNAYQQGVGYQMLGNVVTIGLAFFPFLHRLFREKSLDQLKSISAEEILTLFCGAPPVTPIIVLSIINFFERLCLTWMFFFMMCVAERTYKQRFLFAKLFSHITSARKARKYEIPHFRLKKVENIKIWLSLRSYLKRRGPQRSVDVVVSSVFLLTLSIAFICCAQVLQGHKTFLNDAYNWEFLIWETALLLFLLRLASLGSETNKKYSNVSILLTEQINLYLKMEKKPNKKEQLTLVNNVLKLSTKLLKELDTPFRLYGLTMNPLIYNITRVVILSAVSGVISDLLGFNIRVSITTTL

SEQ ID NO: 902668 - protein, 575 aa, Homo sapiens
MASNERDAISWYQKKIGAYDQQIWEKSIEQTQIKGLKNKPKKMGHIKPDLIDVDLIRGSTFAKAKPEIPWTSLTRKGLVRVVFFPLFSNWWIQVTSLRIFVWLLLLYFMQVIAIVLYLMMPIVNISEVLGPLCLMLLMGTVHCQIVSTQITRPSGNNGNRRRRKLRKTVNGDGSRENGNNSSDKVRGIETLESVPIIGGFWETIFGNRIKRVKLISNKGTETDNDPSCVHPIIKRRQCRPEIRMWQTREKAKFSDGEKCRREAFRRLGNGVSDDLSSEEDGEARTQMILLRRSVEGASSDNGCEVKNRKSILSRHLNSQVKKTTTRWCHIVRDSDSLAESEFESAAFSQGSRSGVSGGSRSLNMSRRDSESTRHDSETEDMLWDDLLHGPECRSSVTSDSEGAHVNTLHSGTKRDPKEDVFQQNHLFWLQNSSPSSDRVSAIIWEGNECKKMDMSVLEISGIIMSRVNAYQQGVGYQMLGNVVTIGLAFFPFLHRLFREKSLDQLKSISAEEILTLFCGAPPVTPIIVLSIINFFERLCLTWMFFFMMCVAERTYKQVSGEIRKIFYLFLYMIFH

SEQ ID NO: 902669 - protein, 224 aa, Homo sapiens
MASNERDAISWYQKKIGAYDQQIWEKSIEQTQIKGLKNKPKKMGHIKPDLIDVDLIRGSTFAKAKPEIPWTSLTRKGLVRVVFFPLFSNWWIQVTSLRIFVWLLLLYFMQVIAIVLYLMMPIVNISEVLGPLCLMLLMGTVHCQIVSTQITRPSGNNGNRRRRVSLLLPRLECNGAISAHCNRYLLSSSDSPASASQVAGITCVCHHTQLIFFLEFSRDGISPC

SEQ ID NO: 902670 - protein, 762 aa, Homo sapiens; identical to SEQ ID NO: 902665

SEQ ID NO: 902671 - protein, 575 aa, Homo sapiens; identical to SEQ ID NO: 902668

SEQ ID NO: 902672 - protein, 691 aa, Homo sapiens
MASNERDAISWYQKKIGAYDQQIWEKSIEQTQIKGLKNKPKKMGHIKPDLIDVDLIRGSTFAKAKPEIPWTSLTRKGLVRVVFFPLFSNWWIQVTSLRIFVWLLLLYFMQVIAIVLYLMMPIVNISEVLGPLCLMLLMGTVHCQIVSTQITRPSGNNGNRRRRKLRKTVNGDGSRENGNNSSDKVRGIETLESVPIIGGFWETIFGNRIKRVKLISNKGTETDNDPSCVHPIIKRRQCRPEIRMWQTREKAKFSDGEKCRREAFRRLGNGVSDDLSSEEDGEARTQMILLRRSVEGASSDNGCEVKNRKSILSRHLNSQVKKTTTRWCHIVRDSDSLAESEFESAAFSQGSRSGVSGGSRSLNMSRRDSESTRHDSETEDMLWDDLLHGPECRSSVTSDSEGAHVNTLHSGTKRDPKEDVFQQNHLFWLQNSSPSSDRVSAIIWEGNECKKMDMSVLEISGIIMSRVNAYQQGVGYQMLGNVVTIGLAFFPFLHRLFREKSLDQLKSISAEEILTLFCGAPPVTPIIVLSIINFFERLCLTWMFFFMMCVAERTYKQRFLFAKLFSHITSARKARKYEIPHFRLKKVENIKIWLSLRSYLKRRGPQRSVDVVVSSVFLLTLSIAFICCAQVLQGHKTFLNDAYNWEFLIWETALLLFLLRLASLGSETNKKYSNVSILLTEQVLISPVNWV

SEQ ID NO: 902673 - protein, 637 aa, Homo sapiens; identical to SEQ ID NO: 902664

SEQ ID NO: 902674 - protein, 177 aa, Homo sapiens
MASNERDAISWYQKKIGAYDQQIWEKSIEQTQIKGLKNKPKKMGHIKPDLIDVDLIRGSTFAKAKPEIPWTSLTRKGLVRVVFFPLFSNWWIQVTSLRIFVWLLLLYFMQDNKTIRKQWKSKKKSFALVAQAGVQWRNLGSLQPIPPEFKRFSCLSLSSSWDYLRMPPHPANFFFGI

SEQ ID NO: 902675 - protein, 619 aa, Homo sapiens
MLLSWLTVLGAGMVVLHFLQKLLFPYFWDDFWFVLKVVLIIIRLKKYEKRGELVTVLDKFLSHAKRQPRKPFIIYEGDIYTYQDVDKRSSRVAHVFLNHSSLKKGDTVALLMSNEPDFVHVWFGLAKLGCVVAFLNTNIRSNSLLNCIRACGPRALVVGADLLGTVEEILPSLSENISVWGMKDSVPQGVISLKEKLSTSPDEPVPRSHHVVSLLKSTCLYIFTSGTTGLPKAAVISQLQVLRGSAVLWAFGCTAHDIVYITLPLYHSSAAILGISGCVELGATCVLKKKFSASQFWSDCKKYDVTVFQYIGELCRYLCKQSKREGEKDHKVRLAIGNGIRSDVWREFLDRFGNIKVCELYAATESSISFMNYTGRIGAIGRTNLFYKLLSTFDLIKYDFQKDEPMRNEQGWCIHVKKGEPGLLISRVNAKNPFFGYAGPYKHTKDKLLCDVFKKGDVYLNTGDLIVQDQDNFLYFWDRTGDTFRWKGENVATTEVADVIGMLDFIQEANVYGVAISGYEGRAGMASIILKPNTSLDLEKVYEQVVTFLPAYACPRFLRIQEKMEATGTFKLLKHQLVEDGFNPLKISEPLYFMDNLKKSYVLLTRELYDQIMLGEIKL

SEQ ID NO: 902676 - protein, 438 aa, Homo sapiens [sequence omitted]

SEQ ID NO: 902677 - protein, 104 aa, Homo sapiens
KAIFSSSAKIVKPNGEKPDEFESGISQALLELEMNSDLKAQLRELNITAAKEIEVGGGRKAIIIFVPVPQLKSFQKIQVRLVRRIGEKVQWEACRLYRSEENSA

SEQ ID NO: 902678 - protein, 104 aa, Homo sapiens; identical to SEQ ID NO: 902677

SEQ ID NO: 902679 - protein, 104 aa, Homo sapiens; identical to SEQ ID NO: 902677

SEQ ID NO: 902680 - protein, 450 aa, Homo sapiens
MAASKTQGAVARMQEDRDGSCSTVGGVGYGDSKDCILEPLSLPESPGGTTTLEGSPSVPCIFCEEHFPVAEQDKLLKHMIIEHKIVIADVKLVADFQRYILYWRKRFTEQPITDFCSVIRINSTAPFEEQENYFLLCDVLPEDRILREELQKQRLREILEQQQQERNDTNFHGVCMFCNEEFLGNRSVILNHMAREHAFNIGLPDNIVNCNEFLCTLQKKLDNLQCLYCEKTFRDKNTLKDHMRKKQHRKINPKNREYDRFYVINYLELGKSWEEVQLEDDRELLDHQEDDWSDWEEHPASAVCLFCEKQAETIEKLYVHMEDAHEFDLLKIKSELGLNFYQQVKLVNFIRRQVHQCRCYGCHVKFKSKADLRTHMEETKHTSLLPDRKTWDQLEYYFPTYENDTLLCTLSDSESDLTAQEQNENVPIISEDTSKLYALKQSSILNQLLL

SEQ ID NO: 902681 - protein, 450 aa, Homo sapiens; identical to SEQ ID NO: 902680

SEQ ID NO: 902682 - protein, 407 aa, Homo sapiens
MAASKTQGAVARMQEDRDGSCSTVGGVGYGDSKDCILEPLSLPESPGGTTTLEGSPSVPCIFCEEHFPVAEQDKLLKHMIIEHKIVIADVKLVADFQRYILYWRKRFTEQPITDFCSVIRINSTAPFEEQENYFLLCDVLPEDRILREELQKQRLREILEQQQQERNDTNFHGVCMFCNEEFLGNRSVILNHMAREHAFNIGLPDNIVNCNEFLCTLQKKLDNLQCLYCEKTFRDKNTLKDHMRKKQHRKINPKNREYDRFYVINYLELGKSWEEVQLEDDRELLDHQEDDWSDWEEHPASAVCLFCEKQAETIEKLYVHMEDAHEFDLLKIKSELGLNFYQQVKLVNFIRRYYFPTYENDTLLCTLSDSESDLTAQEQNENVPIISEDTSKLYALKQSSILNQLLL

SEQ ID NO: 902683 - protein, 450 aa, Homo sapiens; identical to SEQ ID NO: 902680

SEQ ID NO: 902684 - protein, 450 aa, Homo sapiens; identical to SEQ ID NO: 902680

SEQ ID NO: 902685 - protein, 290 aa, Homo sapiens
MAASKTQGAVARMQEDRDGSCSTVGGVGYGDSKDCILEPLSLPESPGGTTTLEGSPSVPCIFCEEHFPVAEQDKLLKHMIIEHKIVIADVKLVADFQRYILYWRKRFTEQPITDFCSVIRINSTAPFEEQENYFLLCDVLPEDRILREELQKQRLREILEQQQQERNDTNFHGVCMFCNEEFLGNRSVILNHMAREHAFNIGLPDNIVNCNEFLCTLQKKLDNLQCLYCEKTFRDKNTLKDHMRKKQHRKINPKNREYDRFYVINYLVRLSFHNLKFDCSTANKIFLRTN

SEQ ID NO: 902686 - protein, 283 aa, Homo sapiens
MNWTGLYTLLSGVNRHSTAIGRVWLSVIFIFRIMVLVVAAESVWGDEKSSFICNTLQPGCNSVCYDQFFPISHVRLWSLQLILVSTPALLVAMHVAHQQHIEKKMLRLEGHGDPLHLEEVKRHKVHISGTLWWTYVISVVFRLLFEAVFMYVFYLLYPGYAMVRLVKCDVYPCPNTVDCFVSRPTEKTVFTVFMLAASGICIILNVAEVVYLIIRACARRAQRRSNPPSRKGSGFGHRLSPEYKQNEINKLLSEQDGSLKDILRRSPGTGAGLAEKSDRCSAC

SEQ ID NO: 902687 - protein, 283 aa, Homo sapiens; identical to SEQ ID NO: 902686

SEQ ID NO: 902688 - protein, 283 aa, Homo sapiens; identical to SEQ ID NO: 902686

SEQ ID NO: 902689 - protein, 283 aa, Homo sapiens; identical to SEQ ID NO: 902686

SEQ ID NO: 902690 - protein, 283 aa, Homo sapiens; identical to SEQ ID NO: 902686

SEQ ID NO: 902691 - protein, 283 aa, Homo sapiens; identical to SEQ ID NO: 902686

SEQ ID NO: 902692 - protein, 167 aa, Homo sapiens
MNWTGLYTLLSGVNRHSTAIGRVWLSVIFIFRIMVLVVAAESVWGDEKSSFICNTLQPGCNSVCYDQFFPISHVRLWSLQLILVSTPALLVAMHVAHQQHIEKKMLRLEGHGDPLHLEEVKRHKVHISGTLWWTYVISVVFRLLFEAVFMYVFYLLYPGYAMVRLCL

SEQ ID NO: 902693 - protein, 240 aa, Homo sapiens
MNWTGLYTLLSGVNRHSTAIGRVWLSVIFIFRIMVLVVAAESVWGDEKSSFICNTLQPGCNSVCYDQFFPISHVRLWSLQLILVSTPALLVAMHVAHQQHIEKKMLRLEGHGDPLHLEEVKRHKVHISGTLWWTYVISVVFRLLFEAVFMYVFYLLYPGYAMVRLVKCDVYPCPNTVDCFVSRPTEKTVFTVFMLAASGICIILNVAEVVYLIIRACARRAQGVNHTSEGGWPAFLGQGV

SEQ ID NO: 902694 - protein, 283 aa, Homo sapiens; identical to SEQ ID NO: 902686

SEQ ID NO: 902695 - protein, 283 aa, Homo sapiens; identical to SEQ ID NO: 902686

SEQ ID NO: 902696 - protein, 283 aa, Homo sapiens; identical to SEQ ID NO: 902686

SEQ ID NO: 902697 - protein, 283 aa, Homo sapiens; identical to SEQ ID NO: 902686

SEQ ID NO: 902698 - protein, 288 aa, Homo sapiens
MHAKHRGHEAMHAEMVLILIATLVVAQLLLVQWKQRHPRSYNMVTLFQMWVVPLYFTVKLHWWRFLVIWILFSAVTAFVTFRATRKPLVQTTPRLVYKWFLLIYKISYATGIVGYMAVMFTLFGLNLLFKIKPEDAMDFGISLLFYGLYYGVLERDFAEMCADYMASTIGFYSESGMPTKHLSDSVCAVCGQQIFVDVSEEGIIENTYRLSCNHVFHEFCIRGWCIVGKKQTCPYCKEKVDLKRMFSNPWERPHVMYGQLLDWLRYLVAWQPVIIGVVQGINYILGLE

SEQ ID NO: 902699 - protein, 373 aa, Homo sapiens
MAAVVEVEVGGGAAGERELDEVDMSDLSPEEQWRVEHARMHAKHRGHEAMHAEMVLILIATLVVAQLLLVQWKQRHPRSYNRDGVSLCWPGWSRSPDLVIRLGLPKCWDYRREATAPGRFLQPILKKMVTLFQMWVVPLYFTVKLHWWRFLVIWILFSAVTAFVTFRATRKPLVQTTPRLVYKWFLLIYKISYATGIVGYMAVMFTLFGLNLLFKIKPEDAMDFGISLLFYGLYYGVLERDFAEMCADYMASTIGFYSESGMPTKHLSDSVCAVCGQQIFVDVSEEGIIENTYRLSCNHVFHEFCIRGWCIVGKKQTCPYCKEKVDLKRMFSNPWERPHVMYGQLLDWLRYLVAWQPVIIGVVQGINYILGLE

SEQ ID NO: 902700 - protein, 232 aa, Homo sapiens
PVLSAGDTELDKTWSLPSRSTLFNGGDGQEKLLLQCSWLVYKWFLLIYKISYATGIVGYMAVMFTLFGLNLLFKIKPEDAMDFGISLLFYGLYYGVLERDFAEMCADYMASTIGFYSESGMPTKHLSDSVCAVCGQQIFVDVSEEGIIENTYRLSCNHVFHEFCIRGWCIVGKKQTCPYCKEKVDLKRMFSNPWERPHVMYGQLLDWLRYLVAWQPVIIGVVQGINYILGLE

SEQ ID NO: 902701 - protein, 336 aa, Homo sapiens
TAVRGRAVKMAAVVEVEVGGGAAGERELDEVDMSDLSPEEQWRVEHARMHAKHRGHEAMHAEMVLILIATLVVAQLLLVQWKQRHPRSYNMVTLFQMWVVPLYFTVKLHWWRFLVIWILFSAVTAFVTFRATRKPLVQTTPRLVYKWFLLIYKISYATGIVGYMAVMFTLFGLNLLFKIKPEDAMDFGISLLFYGLYYGVLERDFAEMCADYMASTIGFYSESGMPTKHLSDSVCAVCGQQIFVDVSEEGIIENTYRLSCNHVFHEFCIRGWCIVGKKQTCPYCKEKVDLKRMFSNPWERPHVMYGQLLDWLRYLVAWQPVIIGVVQGINYILGLE

SEQ ID NO: 902702 - protein, 152 aa, Homo sapiens
TAVRGRAVKMAAVVEVEVGGGAAGERELDEVDMSDLSPEEQWRVEHARMHAKHRGHEAMHAEMVLILIATLVVAQLLLVQWKQRHPRSYNMVTLFQMWVVPLYFTVKLHWWRFLVIWILFSAVTAFVTFRATRKPLVQTTPSPPAVSDWGGI

SEQ ID NO: 902703 - protein, 319 aa, Homo sapiens
TAVRGRAVKMAAVVEVEVGGGAAGERELDEVDMSDLSPEEQWRVEHARMHAKHRGHEAMHAEMVLILIATLVVAQLLLVQWKQRHPRSYNMVTLFQMWVVPLYFTVKLHWWRFLVIWILFSAVTAFVTFRATRKPLVQTTPRLVYKWFLLIYKISYATGIVGYMAVMFTLFGLNLLFKIKPEDAMDFGISLLFYGLYYGVLERDFAEMCADYMASTIGFYSESGMPTKHLSDSVCAVCGQQIFVDVSEEGIIENTYRLSCNHVYPASSSWATSLLQSAHCSEREKEGGHDPRHAVQTLECRRATRGPPSLPFPTDQSHS

SEQ ID NO: 902704 - protein, 336 aa, Homo sapiens; identical to SEQ ID NO: 902701

SEQ ID NO: 902705 - protein, 235 aa, Homo sapiens
MPSTVAMKLCMLKWSSSSSQPWWWPSCSWCSGSRGTHAPTMLVYKWFLLIYKISYATGIVGYMAVMFTLFGLNLLFKIKPEDAMDFGISLLFYGLYYGVLERDFAEMCADYMASTIGFYSESGMPTKHLSDSVCAVCGQQIFVDVSEEGIIENTYRLSCNHVFHEFCIRGWCIVGKKQTCPYCKEKVDLKRMFSNPWERPHVMYGQLLDWLRYLVAWQPVIIGVVQGINYILGLE

SEQ ID NO: 902706 - protein, 336 aa, Homo sapiens; identical to SEQ ID NO: 902701

SEQ ID NO: 902707 - protein, 220 aa, Homo sapiens
MRLICQISLQKSNGGSSTHACMPSTVAMKLCMLKWSSSSSQPWWWPSCSWCSGSRGTHAPTMIKPEDAMDFGISLLFYGLYYGVLERDFAEMCADYMASTIGFYSESGMPTKHLSDSVCAVCGQQIFVDVSEEGIIENTYRLSCNHVFHEFCIRGWCIVGKKQTCPYCKEKVDLKRMFSNPWERPHVMYGQLLDWLRYLVAWQPVIIGVVQGINYILGLE

SEQ ID NO: 902708 - protein, 192 aa, Homo sapiens
TAVRGRAVKMAAVVEVEVGGGAAGERELDEVDMSDLSPEEQWRVEHARMHAKHRGHEAMHAEMVLILIATLVVAQLLLVQWKQRHPRSYNMVTLFQMWVVPLYFTVKLHWWRFLVIWILFSAVTAFVTFRATRKPLVQTTPRGESLSSGKSPGFPKLMGWNAWEEHRFRLKKFLVLSAKIIWHGASLKQADW

SEQ ID NO: 902709 - protein, 259 aa, Homo sapiens
MGDAAADPPGPALPCEFLRPGCGAPLSPGAQLGRGAPTSAFPPPAAEAHPAARRGLRSPQLPSGAMSQNGAPGMQEESLQGSWVELHFSNNGNGGSVPASVSIYNGDMEKILLDAQHESGRSSSKSSHCDSPPRSQTPQDTNRASETDTHSIGEKNSSQSEEDDIERRKEVESILKKNSDWIWDWSSRPENIPPKEFLFKHPKRTATLSMRNTSVMKKGGIFSAEFLKVFLPSLLLSHLLAIGLGIYIGRRLTTSTSTF

SEQ ID NO: 902710 - protein, 288 aa, Homo sapiens
MGDAAADPPGPALPCEFLRPGCGAPLSPGAQLGRGAPTSAFPPPAAEAHPAARRGLRSPQLPSGAMSQNGAPGMQEESLQGSWVELHFSNNGNGGSVPASVSIYNGDMEKILLDAQHESGRSSSKSSHCDSPPRSQTPQDTNRASETDTHSIGEKNSSQSEEDDIERRKEVESILKKNSDWIWDWSSRPENIPPKEFLFKHPKRTATLSMRNTSVMKKGGIFSAEFLKVFLPSLLLSHLLAIGLGSILEGVENLTDFDENGSAGRRNNLSVIVLRGYLGRPGMVKGLL

SEQ ID NO: 902711 - protein, 168 aa, Homo sapiens
MGDAAADPPGPALPCEFLRPGCGAPLSPGAQLGRGAPTSAFPPPAAEAHPAARRGLRSPQLPSGAMSQNGAPGMQEESLQGSWVELHFSNNGNGGSVPASVSIYNGDMEKILLDAQHESGRSSSKSSHCDSPPRSQTPQDTNRASETDTHSIGEKNSSQVSWKENVQL

SEQ ID NO: 902712 - protein, 259 aa, Homo sapiens; identical to SEQ ID NO: 902709

SEQ ID NO: 902713 - protein, 259 aa, Homo sapiens; identical to SEQ ID NO: 902709

SEQ ID NO: 902714 - protein, 254 aa, Homo sapiens
MGDAAADPPGPALPCEFLRPGCGAPLSPGAQLGRGAPTSAFPPPAAEAHPAARRGLRSPQLPSGAMSQNGAPGMQEESLQGSWVELHFSNNGNGGSVPASVSIYNGDMEKILLDAQHESGRSSSKSSHCDSPPRSQTPQDTNRASETDTHSIGEKNSSQSEEDDIERRKEVESILKKNSDWIWDWSSRPENIPPKEFLFKHPKRTATLSMRNTSVMKKGGIFSAEFLKVFLPSLLLSHLLAIGLGDGASPRCPG

SEQ ID NO: 902715 - protein, 259 aa, Homo sapiens; identical to SEQ ID NO: 902709

SEQ ID NO: 902716 - protein, 259 aa, Homo sapiens; identical to SEQ ID NO: 902709

SEQ ID NO: 902717 - protein, 125 aa, Homo sapiens
YGEVQLRVRYSYVVRYSYVVRYSSQSEEDDIERRKEVESILKKNSDWIWDWSSRPENIPPKEFLFKHPKRTATLSMRNTSVMKKGGIFSAEFLKVFLPSLLLSHLLAIGLGIYIGRRLTTSTSTF

SEQ ID NO: 902718 - protein, 254 aa, Homo sapiens; identical to SEQ ID NO: 902714

SEQ ID NO: 902719 - protein, 315 aa, Homo sapiens
FKKELFLSCYWCLGCPVLKHHDPSLPYLEQYQIDCQQFRALYHLLSPWAHSANKDSLALWTFRLLDENSDCLINFKEFSSAIDIMCNGSFTEKLKLLFKLHIPPAYTEVKSKDASKGDELSKEELLYFSQLHVSKPANEKEAESAKHSPEKGKGKIDIQAYLSQWQDELFKKEENIKDLPRMNQSQFIQFSKTLYNLFHEDPEEESLYQAIAVVTSLLLRMEEVGRKLHSPTSSAKGFSGTVCGSGGPSEEKTGSHLEKDPCSFREEPQWSFAFEQILASLLNEPALVRFFEKPIDVKAKLENARISQLRSRTKM

SEQ ID NO: 902720 - protein, 528 aa, Homo sapiens
RWCCCRDCLPHWRRAERRNVQLLTAAETWEPRGPLSSQPPPPSSRAGPPRPRLLLTPRPGARFCGSIILCHYEMSSLGASFVQIKFDDLQFFENCGGGSFGSVYRAKWISQDKEVAVKKLLKIEKEAEILSVLSHRNIIQFYGVILEPPNYGIVTEYASLGSLYDYINSNRSEEMDMDHIMTWATDVAKGMHYLHMEAPVKVIHRDLKSRNVVIAADGVLKICDFGASRFHNHTTHMSLVGTFPWMAPEVIQSLPVSETCDTYSYGVVLWEMLTREVPFKGLEGLQVAWLVVEKNERLTIPSSCPRSFAELLHQCWEADAKKRPSFKQIISILESMSNDTSLPDKCNSFLHNKAEWRCEIEATLERLKKLERDLSFKEQELKERERRLKMWEQKLTEQSNTPLLLPLAARMSEESYFESKTEESNSAEMSCQITATSNGEGHGMNPSLQAMMLMGFGDIFSMNKAGAVMHSGMQINMQAKQNSSKTTSKRRGKKVNMALGFSDFDLSEGDDDDDDDGEEEDNDMDNSE

SEQ ID NO: 902721 - protein, 873 aa, Homo sapiens
RWCCCRDCLPHWRRAERRNVQLLTAAETWEPRGPLSSQPPPPSSRAGPPRPRLLLTPRPGARFCGSIILCHYEMSSLGASFVQIKFDDLQFFENCGGGSFGSVYRAKWISQDKEVAVKKLLKIEKEAEILSVLSHRNIIQFYGVILEPPNYGIVTEYASLGSLYDYINSNRSEEMDMDHIMTWATDVAKGMHYLHMEAPVKVIHRDLKSRNVVIAADGVLKICDFGASRFHNHTTHMSLVGTFPWMAPEVIQSLPVSETCDTYSYGVVLWEMLTREVPFKGLEGLQVAWLVVEKNERLTIPSSCPRSFAELLHQCWEADAKKRPSFKQIISILESMSNDTSLPDKCNSFLHNKAEWRCEIEATLERLKKLERDLSFKEQELKERERRLKMWEQKLTEQSNTPLLPSFEIGAWTEDDVYCWVQQLVRKGDSSAEMSVYASLFKENNITGKRLLLLEEEDLKDMGIVSKGHIIHFKSAIEKLTHDYINLFHFPPLIKDSGGEPEENEEKIVNLELVFGFHLKPGTGPQDCKWKMYMEMDGDEIAITYIKDVTFNTNLPDAEILKMTKPPFVMEKWIVGIAKSQTVECTVTYESDVRTPKSTKHVHLIQWSRTKPQDEVKAVQLAIQTLFTNSDGNPGSRSDSSADCQWLDTLRMRQIASNTSLQRSQSNPILGSPFFSHFDGQDSYAAAVRRPQVPIKYQQITPVNQSRSSSPTQYGLTKNFSSLHLNSRDSGFSSGNTDTSSERGRYSDRSRNKYGRGSISLNSSPRGRYSGKSQHSTPSRGRYPGKFYRVSQSALNPHQSPDFKRSPRDLHQPNTIPGMPLHPETDSRASEEDSKVSEGGWTKVEYRKKPHRPSPAKTNKERARGDHRGWRNF

SEQ ID NO: 902722 - protein, 528 aa, Homo sapiens; identical to SEQ ID NO: 902720

SEQ ID NO: 902723 - protein, 503 aa, Homo sapiens
RWCCCRDCLPHWRRAERRNVQLLTAAETWEPRGPLSSQPPPPSSRAGPPRPRLLLTPRPGARFCGSIILCHYEMSSLGASFVQIKFDDLQFFENCGGGSFGSVYRAKWISQDKEVAVKKLLKIEKEAEILSVLSHRNIIQFYGVILEPPNYGIVTEYASLGSLYDYINSNRSEEMDMDHIMTWATDVAKGMHYLHMEAPVKVIHRDLKSRNVVIAADGVLKICDFGASRFHNHTTHMSLVGTFPWMAPEVIQSLPVSETCDTYSYGVVLWEMLTREVPFKGLEGLQVAWLVVEKNERLTIPSSCPRSFAELLHQCWEADAKKRPSFKQIISILESMSNDTSLPDKCNSFLHNKAEWRCEIEATLERLKKLERDLSFKEQELKERERRLKMWEQKLTEQSNTPSQHSTPSRGRYPGKFYRVSQSALNPHQSPDFKRSPRDLHQPNTIPGMPLHPETDSRASEEDSKVSEGGWTKVEYRKKPHRPSPAKTNKERARGDHRGWRNF

SEQ ID NO: 902724 - protein, 697 aa, Homo sapiens
MDHIMTWATDVAKGMHYLHMEAPVKVIHRDLKSRNVVIAADGVLKICDFGASRFHNHTTHMSLVGTFPWMAPEVIQSLPVSETCDTYSYGVVLWEMLTREVPFKGLEGLQVAWLVVEKNERLTIPSSCPRSFAELLHQCWEADAKKRPSFKQIISILESMSNDTSLPDKCNSFLHNKAEWRCEIEATLERLKKLERDLSFKEQELKERERRLKMWEQKLTEQSNTPLLPSFEIGAWTEDDVYCWVQQLVRKGDSSAEMSVYASLFKENNITGKRLLLLEEEDLKDMGIVSKGHIIHFKSAIEKLTHDYINLFHFPPLIKDSGGEPEENEEKIVNLELVFGFHLKPGTGPQDCKWKMYMEMDGDEIAITYIKDVTFNTNLPDAEILKMTKPPFVMEKWIVGIAKSQTVECTVTYESDVRTPKSTKHVHLIQWSRTKPQDEVKAVQLAIQTLFTNSDGNPGSRSDSSADCQWLDTLRMRQIASNTSLQRSQSNPILGSPFFSHFDGQDSYAAAVRRPQVPIKYQQITPVNQSRSSSPTQYGLTKNFSSLHLNSRDSGFSSGNTDTSSERGRYSDRSRNKYGRGSISLNSSPRGRYSGKSQHSTPSRGRYPGKFYRVSQSALNPHQSPDFKRSPRDLHQPNTIPGMPLHPETDSRASEEDSKVSEGGWTKVEYRKKPHRPSPAKTNKERARGDHRGWRNF

SEQ ID NO: 902725 - protein, 538 aa, Homo sapiens [sequence omitted]

SEQ ID NO: 902726 - protein, 324 aa, Homo sapiens
RWCCCRDCLPHWRRAERRNVQLLTAAETWEPRGPLSSQPPPPSSRAGPPRPRLLLTPRPGARFCGSIILCHYEMSSLGASFVQIKFDDLQFFENCGGGSFGSVYRAKWISQDKEVAVKKLLKIEKEAEILSVLSHRNIIQFYGVILEPPNYGIVTEYASLGSLYDYINSNRSEEMDMDHIMTWATDVAKGMHYLHMEAPVKVIHRDLKSRNVVIAADGVLKICDFGASRFHNHTTHMSLVGTFPWMAPEVIQSLPVSETCDTYSYGVVLWEMLTREVPFKGLEGLQVAWLVVEKNEVRLRFSIQVHRSENSIGVLQKTFSSSSN

SEQ ID NO: 902727 - protein, 284 aa, Homo sapiens
RWCCCRDCLPHWRRAERRNVQLLTAAETWEPRGPLSSQPPPPSSRAGPPRPRLLLTPRPGARFCGSIILCHYEMSSLGASFVQIKFDDLQFFENCGGGSFGSVYRAKWISQDKEVAVKKLLKIEKEAEILSVLSHRNIIQFYGVILEPPNYGIVTEYASLGSLYDYINSNRSEEMDMDHIMTWATDVAKGMHYLHMEAPVKVIHRDLKSRNVVIAADGVLKICDFGASRFHNHTTHMSLVGTFPWMAPEVIQSLPVSETCDTYSYGVVLMGHSLCEHLPSTGRE

SEQ ID NO: 902728 - protein, 873 aa, Homo sapiens; identical to SEQ ID NO: 902721

SEQ ID NO: 902729 - protein, 873 aa, Homo sapiens; identical to SEQ ID NO: 902721

SEQ ID NO: 902730 - protein, 800 aa, Homo sapiens
MSSLGASFVQIKFDDLQFFENCGGGSFGSVYRAKWISQDKEVAVKKLLKIEKEAEILSVLSHRNIIQFYGVILEPPNYGIVTEYASLGSLYDYINSNRSEEMDMDHIMTWATDVAKGMHYLHMEAPVKVIHRDLKSRNVVIAADGVLKICDFGASRFHNHTTHMSLVGTFPWMAPEVIQSLPVSETCDTYSYGVVLWEMLTREVPFKGLEGLQVAWLVVEKNERLTIPSSCPRSFAELLHQCWEADAKKRPSFKQIISILESMSNDTSLPDKCNSFLHNKAEWRCEIEATLERLKKLERDLSFKEQELKERERRLKMWEQKLTEQSNTPLLPSFEIGAWTEDDVYCWVQQLVRKGDSSAEMSVYASLFKENNITGKRLLLLEEEDLKDMGIVSKGHIIHFKSAIEKLTHDYINLFHFPPLIKDSGGEPEENEEKIVNLELVFGFHLKPGTGPQDCKWKMYMEMDGDEIAITYIKDVTFNTNLPDAEILKMTKPPFVMEKWIVGIAKSQTVECTVTYESDVRTPKSTKHVHLIQWSRTKPQDEVKAVQLAIQTLFTNSDGNPGSRSDSSADCQWLDTLRMRQIASNTSLQRSQSNPILGSPFFSHFDGQDSYAAAVRRPQVPIKYQQITPVNQSRSSSPTQYGLTKNFSSLHLNSRDSGFSSGNTDTSSERGRYSDRSRNKYGRGSISLNSSPRGRYSGKSQHSTPSRGRYPGKFYRVSQSALNPHQSPDFKRSPRDLHQPNTIPGMPLHPETDSRASEEDSKVSEGGWTKVEYRKKPHRPSPAKTNKERARGDHRGWRNF

SEQ ID NO: 902731 - protein, 503 aa, Homo sapiens
RWCCCRDCLPHWRRAERRNVQLLTAAETWEPRGPLSSQPPPPSSRAGPPRPRLLLTPRPGARFCGSIILCHYEMSSLGASFVQIKFDDLQFFENCGGGSFGSVYRAKWISQDKEVAVKKLLKIEKEAEILSVLSHRNIIQFYGVILEPPNYGIVTEYASLGSLYDYINSNRSEEMDMDHIMTWATDVAKGMHYLHMEAPVKVIHRDLKSRNVVIAADGVLKICDFGASRFHNHTTHMSLVGTFPWMAPEVIQSLPVSETCDTYSYGVVLWEMLTREVPFKGLEGLQVAWLVVEKNEKRPSFKQIISILESMSNDTSLPDKCNSFLHNKAEWRCEIEATLERLKKLERDLSFKEQELKERERRLKMWEQKLTEQSNTPLLLPLAARMSEESYFESKTEESNSAEMSCQITATSNGEGHGMNPSLQAMMLMGFGDIFSMNKAGAVMHSGMQINMQAKQNSSKTTSKRRGKKVNMALGFSDFDLSEGDDDDDDDGEEEDNDMDNSE

SEQ ID NO: 902732 - protein, 783 aa, Homo sapiens
VVLLPGLSSSLAPCREAECSTPNCGGNVGAARAAVVPTPAALVARGASAPPAAAHAPPGSQAEILSVLSHRNIIQFYGVILEPPNYGIVTEYASLGSLYDYINSNRSEEMDMDHIMTWATDVAKGMHYLHMEAPVKVIHRDLKSRNVVIAADGVLKICDFGASRFHNHTTHMSLVGTFPWMAPEVIQSLPVSETCDTYSYGVVLWEMLTREVPFKGLEGLQVAWLVVEKNEKRPSFKQIISILESMSNDTSLPDKCNSFLHNKAEWRCEIEATLERLKKLERDLSFKEQELKERERRLKMWEQKLTEQSNTPLLPSFEIGAWTEDDVYCWVQQLVRKGDSSAEMSVYASLFKENNITGKRLLLLEEEDLKDMGIVSKGHIIHFKSAIEKLTHDYINLFHFPPLIKDSGGEPEENEEKIVNLELVFGFHLKPGTGPQDCKWKMYMEMDGDEIAITYIKDVTFNTNLPDAEILKMTKPPFVMEKWIVGIAKSQTVECTVTYESDVRTPKSTKHVHLIQWSRTKPQDEVKAVQLAIQTLFTNSDGNPGSRSDSSADCQWLDTLRMRQIASNTSLQRSQSNPILGSPFFSHFDGQDSYAAAVRRPQVPIKYQQITPVNQSRSSSPTQYGLTKNFSSLHLNSRDSGFSSGNTDTSSERGRYSDRSRNKYGRGSISLNSSPRGRYSGKSQHSTPSRGRYPGKFYRVSQSALNPHQSPDFKRSPRDLHQPNTIPGMPLHPETDSRASEEDSKVSEGGWTKVEYRKKPHRPSPAKTNKERARGDHRGWRNF

SEQ ID NO: 902733 - protein, 221 aa, Homo sapiens
MSKSWDQCWEADAKKRPSFKQIISILESMSNDTSLPDKCNSFLHNKAEWRCEIEATLERLKKLERDLSFKEQELKERERRLKMWEQKLTEQSNTPLLLPLAARMSEESYFESKTEESNSAEMSCQITATSNGEGHGMNPSLQAMMLMGFGDIFSMNKAGAVMHSGMQINMQAKQNSSKTTSKRRGKKVNMALGFSDFDLSEGDDDDDDDGEEEDNDMDNSE

SEQ ID NO: 902734 - protein, 376 aa, Homo sapiens
MARGPGPLGRPRPDTVAMPKRGKRLKFRAHDACSGRVTVADYANSDPAVVRSGRVKKAVANAVQQEVKSLCGLEASQVPAEEALSGAGEPCDIIDSSDEMDAQEESIHERTVSRKKKSKRHKEELDGAGGEEYPMDIWLLLASYIRPEDIVNFSLICKNAWTVTCTAAFWTRLYRRHYTLDASLPLRLRPESMEKLRCLRACVIRSLYHMYEPFAARISKNPAIPESTPSTLKNSKCLLFWCRKIVGNRQEPMWEFNFKFKKQSPRLKSKCTGGLQPPVQYEDVHTNPDQDCCLLQVTTLNFIFIPIVMGMIFTLFTINVSTDMRHHRVRLVFQDSPVHGGRKLRSEQGVQVILDPVHSVRLFDWWHPQYPFSLRA

SEQ ID NO: 902735 - protein, 376 aa, Homo sapiens; identical to SEQ ID NO: 902734

SEQ ID NO: 902736 - protein, 376 aa, Homo sapiens; identical to SEQ ID NO: 902734

SEQ ID NO: 902737 - protein, 376 aa, Homo sapiens; identical to SEQ ID NO: 902734

SEQ ID NO: 902738 - protein, 320 aa, Homo sapiens
MSRFPLLFLSCGDSGQVALPFQASQSAGNNRRADLRGPRTGLCLLRLAEARSLLPRRSCRIRHERRGAGRSWLAAPGAGSPAGDMARGPGPLGRPRPDTVAMPKRGKRLKFRAHDACSGRVTVADYANSDPAVVRSGRVKKAVANAVQQEVKSLCGLEASQVPAEEALSGAGEPCDIIDSSDEMDAQEESIHERTVSRKKKSKRHKEELDGAGGEEYPMDIWLLLASYIRPEDIVNFSLICKNAWTVTCTAAFWTRLYRRHYTLDASLPLRLRPESMEKLRCLRACVIRSLYHMYEPFAARISKNPAIPESTPSTLKNSK

SEQ ID NO: 902739 - protein, 259 aa, Homo sapiens
MRWMPRRKASMRELSPDMDIWLLLASYIRPEDIVNFSLICKNAWTVTCTAAFWTRLYRRHYTLDASLPLRLRPESMEKLRCLRACVIRSLYHMYEPFAARISKNPAIPESTPSTLKNSKCLLFWCRKIVGNRQEPMWEFNFKFKKQSPRLKSKCTGGLQPPVQYEDVHTNPDQDCCLLQVTTLNFIFIPIVMGMIFTLFTINVSTDMRHHRVRLVFQDSPVHGGRKLRSEQGVQVILDPVHSVRLFDWWHPQYPFSLRA

SEQ ID NO: 902740 - protein, 124 aa, Homo sapiens [sequence omitted]

SEQ ID NO: 902741 - protein, 149 aa, Homo sapiens
STGIMQIFQNLKKWETLLAPSVLDKGYSIRSAMKKKSPRLKSKCTGGLQPPVQYEDVHTNPDQDCCLLQVTTLNFIFIPIVMGMIFTLFTINVSTDMRHHRVRLVFQDSPVHGGRKLRSEQGVQVILDPVHSVRLFDWWHPQYPFSLRA

SEQ ID NO: 902742 - protein, 320 aa, Homo sapiens; identical to SEQ ID NO: 902738

SEQ ID NO: 902743 - protein, 376 aa, Homo sapiens; identical to SEQ ID NO: 902734

SEQ ID NO: 902744 - protein, 460 aa, Homo sapiens
MSRFPLLFLSCGDSGQVALPFQASQSAGNNRRADLRGPRTGLCLLRLAEARSLLPRRSCRIRHERRGAGRSWLAAPGAGSPAGDMARGPGPLGRPRPDTVAMPKRGKRLKFRAHDACSGRVTVADYANSDPAVVRSGRVKKAVANAVQQEVKSLCGLEASQVPAEEALSGAGEPCDIIDSSDEMDAQEESIHERTVSRKKKSKRHKEELDGAGGEEYPMDIWLLLASYIRPEDIVNFSLICKNAWTVTCTAAFWTRLYRRHYTLDASLPLRLRPESMEKLRCLRACVIRSLYHMYEPFAARISKNPAIPESTPSTLKNSKCLLFWCRKIVGNRQEPMWEFNFKFKKQSPRLKSKCTGGLQPPVQYEDVHTNPDQDCCLLQVTTLNFIFIPIVMGMIFTLFTINVSTDMRHHRVRLVFQDSPVHGGRKLRSEQGVQVILDPVHSVRLFDWWHPQYPFSLRA

SEQ ID NO: 902745 - protein, 376 aa, Homo sapiens; identical to SEQ ID NO: 902734

SEQ ID NO: 902746 - protein, 277 aa, Homo sapiens
MDAQEESIHERTVSRKKKSKRHKEELDGAGGEEYPMDIWLLLASYIRPEDIVNFSLICKNAWTVTCTAAFWTRLYRRHYTLDASLPLRLRPESMEKLRCLRACVIRSLYHMYEPFAARISKNPAIPESTPSTLKNSKCLLFWCRKIVGNRQEPMWEFNFKFKKQSPRLKSKCTGGLQPPVQYEDVHTNPDQDCCLLQVTTLNFIFIPIVMGMIFTLFTINVSTDMRHHRVRLVFQDSPVHGGRKLRSEQGVQVILDPVHSVRLFDWWHPQYPFSLRA

SEQ ID NO: 902747 - protein, 342 aa, Homo sapiens
MSRFPLLFLSCGDSGQVALPFQASQSAGNNRRADLRGPRTGLCLLRLAEARSLLPRRSCRIRHERRGAGRSWLAAPGAGSPAGDMARGPGPLGRPRPDTVAMPKRGKRLKFRAHDACSGRVTVADYANSDPAVVRSGRVKKAVANAVQQEVKSLCGLEASQVPAEEALSGAGEPCDIIDSSDEMDAQEESIHERTVSRKKKSKRHKEELDGAGGEEYPMDIWLLLASYIRPEDIVNFSLICKNAWTVTCTAAFWTRLYRRHYTLDASLPLRLRPESMEKLRCLRACVIRSLYHMYEPFAARISKNPAIPESTPSTLKNSKKDCWEQTGTNVGIQLQVQKTVP

SEQ ID NO: 902748 - protein, 124 aa, Homo sapiens [sequence omitted]

SEQ ID NO: 902749 - protein, 320 aa, Homo sapiens; identical to SEQ ID NO: 902738

SEQ ID NO: 902750 - protein, 299 aa, Homo sapiens
MSRFPLLFLSCGDSGQVALPFQASQSAGNNRRADLRGPRTGLCLLRLAEARSLLPRRSCRIRHERRGAGRSWLAAPGAGSPAGDMARGPGPLGRPRPDTVAMPKRGKRLKFRAHDACSGRVTVADYANSDPAVVRSGRVKKAVANAVQQEVKSLCGLEASQVPAEEALSGAGEPCDIIDSSDEMDAQEESIHERTVSRKKKSKRHKEELDGAGGEEYPMDIWLLLASYIRPEDIVNFSLICKNAWTVTCTAAFWTRLYRRCDHRELTLLSVWLISLLFVIWSYSLDGDLFSLSLLHVWA

SEQ ID NO: 902751 - protein, 314 aa, Homo sapiens
YPSPALHLSTFSARPEALDPSPLAPARPGARPRGANAASHWLCGPPLSLMCQFEGLRRRVAAERRSPRSLEVRRPGARGGRRAEPAGAGRAAAAAVPGRTGAGGRMELNSLLILLEAAEYLERRDREAEHGYASVLPFDGDFAREKTKAAGLVRKAPNNRSSHNELEKHRRAKLRLYLEQLKQLVPLGPDSTRHTTLSLLKRAKVHIKKLEEQDRRALSIKEQLQQEHRFLKRRLEQLSVQSVERVRTDSTGSAVSTDDSEQEVDIEGMEFGPGELDSVGSSSDADDHYSLQSGTGGDSGFGPHCRRLGRPALS

SEQ ID NO: 902752 - protein, 242 aa, Homo sapiens
MAGGRAGAPRKCLAVTRCGFAGHGELGASARCLGAVGVGLLLGVGDGGSQPGQEGILREGPSAHVQQWMVGVGLCRALETACCPPPPQPDGSVSGSFRRAKLRLYLEQLKQLVPLGPDSTRHTTLSLLKRAKVHIKKLEEQDRRALSIKEQLQQEHRFLKRRLEQLSVQSVERVRTDSTGSAVSTDDSEQEVDIEGMEFGPGELDSVGSSSDADDHYSLQSGTGGDSGFGPHCRRLGRPALS

SEQ ID NO: 902753 - protein, 231 aa, Homo sapiens
MPGGDALGFAGHGELGASARCLGAVGVGLLLGVGDGGSQPGQEGILREGPSAHVQQWMVGVGLCRALETACCPPPPQPDGSVSGSFRRAKLRLYLEQLKQLVPLGPDSTRHTTLSLLKRAKVHIKKLEEQDRRALSIKEQLQQEHRFLKRRLEQLSVQSVERVRTDSTGSAVSTDDSEQEVDIEGMEFGPGELDSVGSSSDADDHYSLQSGTGGDSGFGPHCRRLGRPALS

SEQ ID NO: 902754 - protein, 231 aa, Homo sapiens; identical to SEQ ID NO: 902753

SEQ ID NO: 902755 - protein, 163 aa, Homo sapiens
YPSPALHLSTFSARPEALDPSPLAPARPGARPRGANAASHWLCGPPLSLMCQFEGLRRRVAAERRSPRSLEVRRPGARGGRRAEPAGAGRAAAAAVPGRTGAGGRMELNSLLILLEAAEYLERRDREAEHGYASVLPFDGDFAREKTKAAGLVRKAPNNRPPQ

SEQ ID NO: 902756 - protein, 176 aa, Homo sapiens
YPSPALHLSTFSARPEALDPSPLAPARPGARPRGANAASHWLCGPPLSLMCQFEGLRRRVAAERRSPRSLEVRRPGARGGRRAEPAGAGRAAAAAVPGRTGAGGRMELNSLLILLEAAEYLERRDREAEHGYASVLPFDGDFAREKTKAAGLVRKAPNNRSSHNELEKHRKVFRDF

SEQ ID NO: 902757 - protein, 231 aa, Homo sapiens; identical to SEQ ID NO: 902753

SEQ ID NO: 902758 - protein, 231 aa, Homo sapiens; identical to SEQ ID NO: 902753

SEQ ID NO: 902759 - protein, 231 aa, Homo sapiens; identical to SEQ ID NO: 902753

SEQ ID NO: 902760 - protein, 197 aa, Homo sapiens
YPSPALHLSTFSARPEALDPSPLAPARPGARPRGANAASHWLCGPPLSLMCQFEGLRRRVAAERRSPRSLEVRRPGARGGRRAEPAGAGRAAAAAVPGRTGAGGRMELNSLLILLEAAEYLERRDREAEHGYASVLPFDGDFAREKTKAAGLVRKAPNNRSSHNELEKHRDRIPGTQRLSHILHCSPRALTLPMRLG

SEQ ID NO: 902761 - protein, 316 aa, Homo sapiens
MPGGDALGFAGHGELGASARCLGAVGVGLLLGVGDGGSQPGQEGILREGPSAHVQQWMVGVGLCRALETACCPPPPQPDGSVSGSFRRAKLRLYLEQLKQLVPLGPDSTRHTTLSLLKRAKVHIKKLEEQDRRALSIKEQLQQEHRFLKRRLEQLSVQSVERVRTDSTGSAVSTDDSEQEVDIEGMEFGPGELDSVGSSSDADDHYSLQSGTGGDSGFGPHCRRLGRPALAVSTDDSEQEVDIEGMEFGPGELDSVGSSSDADDQLCHSGSSSCCWAAWHCPLAGQGLPSCLPLPAGQSPLQGGRAQLPHPEPWSA

SEQ ID NO: 902762 - protein, 255 aa, Homo sapiens
MPGGDALGFAGHGELGASARCLGAVGVGLLLGVGDGGSQPGQEGILREGPSAHVQQWMVGVGLCRALETACCPPPPQPDGSVSGSFRRAKLRLYLEQLKQLVPLGPDSTRHTTLSLLKRAKVHIKKLEEQDRRALSIKEQLQQEHRFLKRRLEQLSVQSVERVRTDSTGSAVSTDDSEQEVDIEGMEFGPGELDAVPFWKLQLLLGCLALPACRSGPAELPAPSSWAESPARRQGPASTSGALVSIAAHGLFSDS

SEQ ID NO: 902763 - protein, 105 aa, Homo sapiens
VLLRPGSQPEPSWRLLPQGPDSALRTSAPLPRASASRKGRNGLAPSEWPDPIPTLFSLEVDIEGMEFGPGELDSVGSSSDADDHYSLQSGTGGDSGFGPHCRRLG

SEQ ID NO: 902764 - protein, 231 aa, Homo sapiens; identical to SEQ ID NO: 902753

SEQ ID NO: 902765 - protein, 276 aa, Homo sapiens
MSGSFQISVQPERHPRLTPPLPACGLQGGDGGWGMAGGRAGAPRKCLAVTRCGFAGHGELGASARCLGAVGVGLLLGVGDGGSQPGQEGILREGPSAHVQQWMVGVGLCRALETACCPPPPQPDGSVSGSFRRAKLRLYLEQLKQLVPLGPDSTRHTTLSLLKRAKVHIKKLEEQDRRALSIKEQLQQEHRFLKRRLEQLSVQSVERVRTDSTGSAVSTDDSEQEVDIEGMEFGPGELDSVGSSSDADDHYSLQSGTGGDSGFGPHCRRLGRPALS

SEQ ID NO: 902766 - protein, 255 aa, Homo sapiens; identical to SEQ ID NO: 902762

SEQ ID NO: 902767 - protein, 197 aa, Homo sapiens; identical to SEQ ID NO: 902760

SEQ ID NO: 902768 - protein, 274 aa, Homo sapiens
YPSPALHLSTFSARPEALDPSPLAPARPGARPRGANAASHWLCGPPLSLMCQFEGLRRRVAAERRSPRSLEVRRPGARGGRRAEPAGAGRAAAAAVPGRTGAGGRMELNSLLILLEAAEYLERRDRGCAILEAPAAAGLPGTARLPVRACRAACPFQLGRVPCKEAGPSFHIRSPGQHSRPRSVLRFLIIPEVLNVIAANLGRCRVRGLMTTTGSSDPNPGSQEKGVDRGRKEGKAVCPSVRLSTYLSVHIGSWRGQGVCEGRELGEHLGQVGG

SEQ ID NO: 902769 - protein, 231 aa, Homo sapiens; identical to SEQ ID NO: 902753

SEQ ID NO: 902770 - protein, 231 aa, Homo sapiens; identical to SEQ ID NO: 902753

SEQ ID NO: 902771 - protein, 314 aa, Homo sapiens; identical to SEQ ID NO: 902751

SEQ ID NO: 902772 - protein, 197 aa, Homo sapiens; identical to SEQ ID NO: 902760

SEQ ID NO: 902773 - protein, 168 aa, Homo sapiens
MGKGDPNKPRGKMSSYAFFVQTCREEHKKKHPDSSVNFAEFSKKCSERWKTMSAKEKSKFEDMAKSDKARYDREMKNYVPPKGDKKGKKKDPNAPKRPPSAFFLFCSEHRPKIKSEHPGLSIGDTAKKLGEMWSEQSAKDKQPYEQKAAKLKEKYEQGYCCISCQGQK

SEQ ID NO: 902774 - protein, 168 aa, Homo sapiens; identical to SEQ ID NO: 902773

SEQ ID NO: 902775 - protein, 168 aa, Homo sapiens; identical to SEQ ID NO: 902773

SEQ ID NO: 902776 - protein, 168 aa, Homo sapiens; identical to SEQ ID NO: 902773

SEQ ID NO: 902777 - protein, 168 aa, Homo sapiens; identical to SEQ ID NO: 902773

SEQ ID NO: 902778 - protein, 168 aa, Homo sapiens; identical to SEQ ID NO: 902773

SEQ ID NO: 902779 - protein, 168 aa, Homo sapiens; identical to SEQ ID NO: 902773

SEQ ID NO: 902780 - protein, 117 aa, Homo sapiens
MSAKEKSKFEDMAKSDKARYDREMKNYVPPKGDKKGKKKDPNAPKRPPSAFFLFCSEHRPKIKSEHPGLSIGDTAKKLGEMWSEQSAKDKQPYEQKAAKLKEKYEQGYCCISCQGQK

SEQ ID NO: 902781 - protein, 173 aa, Homo sapiens
MGKGDPNKPRGKMSSYAFFVQTCREEHKKKHPDSSVNFAEFSKKCSERWKTMSAKEKSKFEDMAKSDKARYDREMKNYVPPKGDKKGKKKDPNAPKRPPSAFFLFCSEHRPKIKSEHPGLSIGDTAKKLGEMWSEQSAKDKQPYEQKAAKLKEKYEQGYSVIFFKAVDKTRYR

SEQ ID NO: 902782 - protein, 103 aa, Homo sapiens
MGKGDPNKPRGKMSSYAFFVQTCREEHKKKHPDSSVNFAEFSKKCSERWKTMSAKEKSKFEDMAKSDKARYDREMKNYVPPKGDKKGKKKDPNAPKRPPVSLK

SEQ ID NO: 902783 - protein, 134 aa, Homo sapiens
MGKGDPNKPRGKMSSYAFFVQTCREEHKKKHPDSSVNFAEFSKKCSERWKTMSAKEKSKFEDMAKSDKARYDREMKNYVPPKDLPSSCFALNIAQRSKVNTLAYPLGILQRNWVKCGLSSQPKINNHMNRKQLS

SEQ ID NO: 902784 - protein, 123 aa, Homo sapiens
MSAKEKSKFEDMAKSDKARYDREMKNYVPPKGDKKGKKKDPNAPKRPPKFKITQIALGFFLQFIKLCCFLSDLPSSCFALNIAQRSKVNTLAYPLGILQRNWVKCGLSSQPKINNHMNRKQLS

SEQ ID NO: 902785 - protein, 168 aa, Homo sapiens; identical to SEQ ID NO: 902773

SEQ ID NO: 902786 - protein, 164 aa, Homo sapiens
MGKGDPNKPRGKMSSYAFFVQTCREEHKKKHPDSSVNFAEFSKKCSERWKTMSAKEKSKFEDMAKSDKARYDREMKNYVPPKGDKKGKKKDPNAPKRPPSAFFLFCSEHRPKIKSEHPGLSIGDTAKKLGEMWSEQSAKDKQPYEQKAAKLKEKYEQAVDSRDP

SEQ ID NO: 902787 - protein, 143 aa, Homo sapiens
MGKGDPNKPRGKMSSYAFFVQTCREEHKKKHPDSSVNFAEFSKKCSERWKTMSAKEKSKFEDMAKSDKARYDREMKNYVPPKGDKKGKKKDPNAPKRPPSAFFLFCSEHRPKIKSEHPGLSIGDTAKKLGEMWSEQSAKDKQP

SEQ ID NO: 902788 - protein, 168 aa, Homo sapiens; identical to SEQ ID NO: 902773

SEQ ID NO: 902789 - protein, 168 aa, Homo sapiens; identical to SEQ ID NO: 902773

SEQ ID NO: 902790 - protein, 168 aa, Homo sapiens; identical to SEQ ID NO: 902773

SEQ ID NO: 902791 - protein, 168 aa, Homo sapiens; identical to SEQ ID NO: 902773

SEQ ID NO: 902792 - protein, 156 aa, Homo sapiens
MSSYAFFVQTCREEHKKKHPDSSVNFAEFSKKCSERWKTMSAKEKSKFEDMAKSDKARYDREMKNYVPPKGDKKGKKKDPNAPKRPPSAFFLFCSEHRPKIKSEHPGLSIGDTAKKLGEMWSEQSAKDKQPYEQKAAKLKEKYEQGYCCISCQGQK

SEQ ID NO: 902793 - protein, 117 aa, Homo sapiens; identical to SEQ ID NO: 902780

SEQ ID NO: 902794 - protein, 168 aa, Homo sapiens; identical to SEQ ID NO: 902773

SEQ ID NO: 902795 - protein, 173 aa, Homo sapiens
MGKGDPNKPRGKMSSYAFFVQTCREEHKKKHPDSSVNFAEFSKKCSERWKTMSAKEKSKFEDMAKSDKARYDREMKNYVPPKGDKKGKKKDPNAPKRPPSAFFLFCSEHRPKIKSEHPGLSIGDTAKKLGEMWSEQSAKDKQPYEQKAAKLKEKYEQGPWQANRLKEEERTRR

SEQ ID NO: 902796 - protein, 168 aa, Homo sapiens; identical to SEQ ID NO: 902773

SEQ ID NO: 902797 - protein, 173 aa, Homo sapiens; identical to SEQ ID NO: 902781

SEQ ID NO: 902798 - protein, 181 aa, Homo sapiens
MGKGDPNKPRGKMSSYAFFVQTCREEHKKKHPDSSVNFAEFSKKCSERWKTMSAKEKSKFEDMAKSDKARYEKKKKKKNRRTQCVGARPGPPEKRAFEKTMGGGAEGTRKANSKQGAKRVYPSEKPGTIHKGRGLSPDRKKTREGNREGSGERARGEPEGHKRENAKQGSPSGTQETNVTR

SEQ ID NO: 902799 - protein, 69 aa, Homo sapiens
ERGIKGAGGRLVPVLQTPPATRRGKPCTISHGQPHRVLRHCRRRRALGPRHPLSCLQTRSQRQQKIFVL

SEQ ID NO: 902800 - protein, 77 aa, Homo sapiens
EKRERERKQEYEPDAEELRKKADKRAEPLEPRLLRAVCRQGPKEQQNFRALSTGEKGFGYKGSCFHRIIPGLYVSGW

SEQ ID NO: 902801 - protein, 69 aa, Homo sapiens; identical to SEQ ID NO: 902799

SEQ ID NO: 902802 - protein, 92 aa, Homo sapiens
GGKLTAKERGWVVATRRGKPCTISHGQPHRVLRHCRRRRALGPRHPLSCLQTRSQRQQAFTELFQGFMCQGGDFTRHNGTGGKSIYGEKFER

SEQ ID NO: 902803 - protein, 123 aa, Homo sapiens
MALVASPSMGRNLNDENFILKHTGSWHLCPWANAWTQHKWFPVFHLHCQALSDWISLLSPRLECSGAISAHCNLLPGSSNSSASASQVAGTTGMHHHSQLNCVLLVERDLPCCPGWSRTPGLK

SEQ ID NO: 902804 - protein, 123 aa, Homo sapiens; identical to SEQ ID NO: 902803

SEQ ID NO: 902805 - protein, 103 aa, Homo sapiens
MALVASPSMGRNLNDENFILKHTGSWHLCPWANAWTQHKWFPVFHLHCQALSDWISLLSPRLECSGAISAHCNLLPGSSNSSASASQVAGTTGWMASMWCLAK

SEQ ID NO: 902806 - protein, 69 aa, Homo sapiens
LLSLLSPSLSFALPLLTCSAWQALDGKHVVFGKVKEGMNIRGRPWSACGSRNWQDQQEDHHVLTVDNSN

SEQ ID NO: 902807 - protein, 84 aa, Homo sapiens
MALVASPSMGTEDEEEDDEDEDDDDDDRSRRRPHDARMTEGRRHEAGTHEETDNRTHPHTRPPPRHWHPTNALTTATTKWKAQN

SEQ ID NO: 902808 - protein, 69 aa, Homo sapiens; identical to SEQ ID NO: 902799

SEQ ID NO: 902809 - protein, 103 aa, Homo sapiens; identical to SEQ ID NO: 902805

SEQ ID NO: 902810 - protein, 123 aa, Homo sapiens; identical to SEQ ID NO: 902803

SEQ ID NO: 902811 - protein, 194 aa, Homo sapiens [sequence omitted]

SEQ ID NO: 902812 - protein, 194 aa, Homo sapiens [sequence omitted]

SEQ ID NO: 902813 - protein, 194 aa, Homo sapiens [sequence omitted]

SEQ ID NO: 902814 - protein, 214 aa, Homo sapiens
MVGGGGRRRTACRVTRQHGAQHTAVPRGKHPRNKKMRPGGGFPPNNKKNAAGGEQPEGLLWETTNRRGVDRRNRRLAFKTGGDPHRERRHLTMTPTRTGGEKMSKTQKKRQTSNQGSEVKVEALFIKTRSEYEKIRKQQKTKEDITNSSERYTDQIKIRNAKCEKNTHYGRSIKNVDSQRENNTTNKKKTTKTINKEYIRREAEKKRKKQHRIL

SEQ ID NO: 902815 - protein, 194 aa, Homo sapiens [sequence omitted]

SEQ ID NO: 902816 - protein, 66 aa, Homo sapiens
GSLTVRSLYDGLSKIKWLGRCAVRCMANMKSARMNMVFISQGEFPQEIPGSPADVDPLTHYFIPVI

SEQ ID NO: 902817 - protein, 106 aa, Homo sapiens [sequence omitted]

SEQ ID NO: 902818 - protein, 194 aa, Homo sapiens [sequence omitted]

SEQ ID NO: 902819 - protein, 194 aa, Homo sapiens [sequence omitted]

SEQ ID NO: 902820 - protein, 194 aa, Homo sapiens [sequence omitted]

SEQ ID NO: 902821 - protein, 372 aa, Homo sapiens
ETSTGFHIPLPKPHGSDYRYCSFHHNTHLCCRNEARQQISISRMWGLKVLLLPVVSFALYPEEILDTHWELWKKTHRKQYNNKVDEISRRLIWEKNLKYISIHNLEASLGVHTYELAMNHLGDMTSEEVVQKMTGLKVPLSHSRSNDTLYIPEWEGRAPDSVDYRKKGYVTPVKNQGQCGSCWAFSSVGALEGQLKKKTGKLLNLSPQNLVDCVSENDGCGGGYMTNAFQYVQKNRGIDSEDAYPYVGQEESCMYNPTGKAAKCRGYREIPEGNEKALKRAVARVGPVSVAIDASLTSFQFYSKGVYYDESCNSDNLNHAVLAVGYGIQKGNKHWIIKNSWGENWGNKGYILMARNKNNACGIANLASFPKM

SEQ ID NO: 902822 - protein, 329 aa, Homo sapiens
MWGLKVLLLPVVSFALYPEEILDTHWELWKKTHRKQYNNKVDEISRRLIWEKNLKYISIHNLEASLGVHTYELAMNHLGDMTSEEVVQKMTGLKVPLSHSRSNDTLYIPEWEGRAPDSVDYRKKGYVTPVKNQGQCGSCWAFSSVGALEGQLKKKTGKLLNLSPQNLVDCVSENDGCGGGYMTNAFQYVQKNRGIDSEDAYPYVGQEESCMYNPTGKAAKCRGYREIPEGNEKALKRAVARVGPVSVAIDASLTSFQFYSKGVYYDESCNSDNLNHAVLAVGYGIQKGNKHWIIKNSWGENWGNKGYILMARNKNNACGIANLASFPKM

SEQ ID NO: 902823 - protein, 329 aa, Homo sapiens; identical to SEQ ID NO: 902822

SEQ ID NO: 902824 - protein, 341 aa, Homo sapiens
MEEFSLTTFFCRMWGLKVLLLPVVSFALYPEEILDTHWELWKKTHRKQYNNKVDEISRRLIWEKNLKYISIHNLEASLGVHTYELAMNHLGDMTSEEVVQKMTGLKVPLSHSRSNDTLYIPEWEGRAPDSVDYRKKGYVTPVKNQGQCGSCWAFSSVGALEGQLKKKTGKLLNLSPQNLVDCVSENDGCGGGYMTNAFQYVQKNRGIDSEDAYPYVGQEESCMYNPTGKAAKCRGYREIPEGNEKALKRAVARVGPVSVAIDASLTSFQFYSKGVYYDESCNSDNLNHAVLAVGYGIQKGNKHWIIKNSWGENWGNKGYILMARNKNNACGIANLASFPKM

SEQ ID NO: 902825 - protein, 311 aa, Homo sapiens
MWGLKVLLLPVVSFALYPEEILDTHWELWKKTHRKQYNNKVDEISRRLIWEKYELAMNHLGDMTSEEVVQKMTGLKVPLSHSRSNDTLYIPEWEGRAPDSVDYRKKGYVTPVKNQGQCGSCWAFSSVGALEGQLKKKTGKLLNLSPQNLVDCVSENDGCGGGYMTNAFQYVQKNRGIDSEDAYPYVGQEESCMYNPTGKAAKCRGYREIPEGNEKALKRAVARVGPVSVAIDASLTSFQFYSKGVYYDESCNSDNLNHAVLAVGYGIQKGNKHWIIKNSWGENWGNKGYILMARNKNNACGIANLASFPKM

SEQ ID NO: 902826 - protein, 300 aa, Homo sapiens
MEEFSLTTFFCRMWGLKVLLLPVVSFALYPEEILDTHWELWKKTHRKQYNNKTSEEVVQKMTGLKVPLSHSRSNDTLYIPEWEGRAPDSVDYRKKGYVTPVKNQGQCGSCWAFSSVGALEGQLKKKTGKLLNLSPQNLVDCVSENDGCGGGYMTNAFQYVQKNRGIDSEDAYPYVGQEESCMYNPTGKAAKCRGYREIPEGNEKALKRAVARVGPVSVAIDASLTSFQFYSKGVYYDESCNSDNLNHAVLAVGYGIQKGNKHWIIKNSWGENWGNKGYILMARNKNNACGIANLASFPKM

SEQ ID NO: 902827 - protein, 329 aa, Homo sapiens; identical to SEQ ID NO: 902822

SEQ ID NO: 902828 - protein, 329 aa, Homo sapiens; identical to SEQ ID NO: 902822

SEQ ID NO: 902829 - protein, 346 aa, Homo sapiens
VVEDPVRRSVEQISISRMWGLKVLLLPVVSFALYPEEILDTHWELWKKTHRKQYNNKVDEISRRLIWEKNLKYISIHNLEASLGVHTYELAMNHLGDMTSEEVVQKMTGLKVPLSHSRSNDTLYIPEWEGRAPDSVDYRKKGYVTPVKNQGQCGSCWAFSSVGALEGQLKKKTGKLLNLSPQNLVDCVSENDGCGGGYMTNAFQYVQKNRGIDSEDAYPYVGQEESCMYNPTGKAAKCRGYREIPEGNEKALKRAVARVGPVSVAIDASLTSFQFYSKGVYYDESCNSDNLNHAVLAVGYGIQKGNKHWIIKNSWGENWGNKGYILMARNKNNACGIANLASFPKM

SEQ ID NO: 902830 - protein, 329 aa, Homo sapiens; identical to SEQ ID NO: 902822

SEQ ID NO: 902831 - protein, 391 aa, Homo sapiens
EEEMHKENEEIYNVSENRKHCPIFPCPLLTRSGKVPEFRHEREERLEEMIRRQNLDGNLSFVMWGLKVLLLPVVSFALYPEEILDTHWELWKKTHRKQYNNKVDEISRRLIWEKNLKYISIHNLEASLGVHTYELAMNHLGDMTSEEVVQKMTGLKVPLSHSRSNDTLYIPEWEGRAPDSVDYRKKGYVTPVKNQGQCGSCWAFSSVGALEGQLKKKTGKLLNLSPQNLVDCVSENDGCGGGYMTNAFQYVQKNRGIDSEDAYPYVGQEESCMYNPTGKAAKCRGYREIPEGNEKALKRAVARVGPVSVAIDASLTSFQFYSKGVYYDESCNSDNLNHAVLAVGYGIQKGNKHWIIKNSWGENWGNKGYILMARNKNNACGIANLASFPKM

SEQ ID NO: 902832 - protein, 148 aa, Homo sapiens
MTNAFQYVQKNRGIDSEDAYPYVGQEESCMYNPTGKAAKCRGYREIPEGNEKALKRAVARVGPVSVAIDASLTSFQFYSKGVYYDESCNSDNLNHAVLAVGYGIQKGNKHWIIKNSWGENWGNKGYILMARNKNNACGIANLASFPKM

SEQ ID NO: 902833 - protein, 307 aa, Homo sapiens
RVPGCSASSATGRNITSKVDEISRRLIWEKNLKYISIHNLEASLGVHTYELAMNHLGDMTSEEVVQKMTGLKVPLSHSRSNDTLYIPEWEGRAPDSVDYRKKGYVTPVKNQGQCGSCWAFSSVGALEGQLKKKTGKLLNLSPQNLVDCVSENDGCGGGYMTNAFQYVQKNRGIDSEDAYPYVGQEESCMYNPTGKAAKCRGYREIPEGNEKALKRAVARVGPVSVAIDASLTSFQFYSKGVYYDESCNSDNLNHAVLAVGYGIQKGNKHWIIKNSWGENWGNKGYILMARNKNNACGIANLASFPKM

SEQ ID NO: 902834 - protein, 68 aa, Homo sapiens
PHLLINHDNLSLCADEQLVISESFIGTTHCYNCTIAGELIRRYLGYILMARNKNNACGIANLASFPKM

SEQ ID NO: 902835 - protein, 242 aa, Homo sapiens
MWGLKVLLLPVVSFALYPEEILDTHWELWKKTHRKQYNNKVDEISRRLIWEKNLKYISIHNLEASLGVHTYELAMNHLGDMTSEEVVQKMTGLKVPLSHSRSNDTLYIPEWEGRAPDSVDYRKKGYVTPVKNQGQCGSCWAFSSVGALEGQLKKKTGKLLNLSPQNLVDCVSENDGCGGGYMTNAFQYVQKNRGIDSEDAYPYVGQEESCMYNPTGKAAKCRGYRDRSHSGHCIFRAFSFPS

SEQ ID NO: 902836 - protein, 636 aa, Homo sapiens
AGLHASNARSDAQAPPPPARLPEVAGPELWGGLRAVSGGVGESDQGERIRQGRSFGAGGWAAHLRARSGVDRELVTMAGPQPLALQLEQLLNPRPSEADPEADPEEATAARVIDRFDEGEDGEGDFLVVGSIRKLASASLLDTDKRYCGKTTSRKAWNEDHWEQTLPGSSDEEISDEEGSGDEDSEGLGLEEYDEDDLGAAEEQECGDHRESKKSRSHSAKTPGFSVQSISDFEKFTKGMDDLGSSEEEEDEESGMEEGDDAEDSQGESEEDRAGDRNSEDDGVVMTFSSVKVSEEVEKGRAVKNQIALWDQLLEGRIKLQKALLTTNQLPQPDVFPLFKDKGGPEFSSALKNSHKALKALLRSLVGLQEELLFQYPDTRYLVDGTKPNAGSEEISSEDDELVEEKKQQRRRVPAKRKLEMEDYPSFMAKRFADFTVYRNRTLQKWHDKTKLASGKLGKGFGAFERSILTQIDHILMDKERLLRRTQTKRSVYRVLGKPEPAAQPVPESLPGEPEILPQAPANAHLKDLDEEIFDDDDFYHQLLRELIERKTSSLDPNDQVAMGRQWLAIQKLRSKIHKKVDRKASKGRKLRFHVLSKLLSFMAPIDHTTMNDDARTELYRSLFGQLHPPDEGHGD

SEQ ID NO: 902837 - protein, 636 aa, Homo sapiens; identical to SEQ ID NO: 902836

SEQ ID NO: 902838 - protein, 636 aa, Homo sapiens; identical to SEQ ID NO: 902836

SEQ ID NO: 902839 - protein, 636 aa, Homo sapiens; identical to SEQ ID NO: 902836

SEQ ID NO: 902840 - protein, 636 aa, Homo sapiens; identical to SEQ ID NO: 902836

SEQ ID NO: 902841 - protein, 636 aa, Homo sapiens; identical to SEQ ID NO: 902836

SEQ ID NO: 902842 - protein, 622 aa, Homo sapiens
AGLHASNARSDAQAPPPPARLPEVAGPELWGGLRAVSGGVGESDQGERIRQGRSFGAGGWAAHLRARSGVDRELVTMAGPQPLALQLEQLLNPRPSEADPEADPEEATAARVIDRFDEGEDGEGDFLVVGSIRKLASASLLDTDKRYCGKTTSRKAWNEDHWEQTLPGSSDEEISDEEGSGDEDSEGLGLEEYDEDDLGAAEEQECGDHRESKKSRSHSAKTPGFSVQSISDFEKFTKGMDDLGSSEEEEDEESGMEEGAGDRNSEDDGVVMTFSSVKVSEEVEKGRAVKNQIALWDQLLEGRIKLQKALLTTNQLPQPDVFPLFKDKGGPEFSSALKNSHKALKALLRSLVGLQEELLFQYPDTRYLVDGTKPNAGSEEISSEDDELVEEKKQQRRRVPAKRKLEMEDYPSFMAKRFADFTVYRNRTLQKWHDKTKLASGKLGKGFGAFERSILTQIDHILMDKERLLRRTQTKRSVYRVLGKPEPAAQPVPESLPGEPEILPQAPANAHLKDLDEEIFDDDDFYHQLLRELIERKTSSLDPNDQVAMGRQWLAIQKLRSKIHKKVDRKASKGRKLRFHVLSKLLSFMAPIDHTTMNDDARTELYRSLFGQLHPPDEGHGD

SEQ ID NO: 902843 - protein, 216 aa, Homo sapiens [sequence omitted]

SEQ ID NO: 902844 - protein, 630 aa, Homo sapiens
AGLHASNARSDAQAPPPPARLPEVAGPELWGGLRAVSGGVGESDQGERIRQGRSFGAGGWAAHLRARSGVDRELVTMAGPQPLALQLEQLLNPRPSEADPEADPEEATAARVIDRFDEGEDGEGDFLVVGSIRKLASASLLDTDKRYCGKTTSRKAWNEDHWEQTLPGSSDEEISDEEGSGDEDSEGLGLEEYDEDDLGAAEEQECGDHRESKKSRSHSAKTPGFSVQSISDFEKFTKGMDDLGSSEEEEDEESGMEEGDDAEDSQGESEEDRAGDRNSEDDGVVMTFSSVKVSEEVEKGRAVKNQIALWDQLLEGRIKLQKALLTTNQLPQPDVFPLFKDKGGPEFSSALKNSHKALKALLRSLVGLQEELLFQYPDTRYLVDGTKPNAGSEEISSEDDELVEEKKQQRRRVPAKRKLEMEDYPSFMAKRFADFTVYRNRTLQKWHDKTKLASGKLGKGFGAFERSILTQIDHILMDKERLLRRTQTKRSVYRVLGKPEPAAQPVPESLPGEPEILPQAPANAHLKDLDEEIFDDDDFYHQLLRELIERKTSSLDPNDQVAMGRQWLAIQKLQVDRKASKGRKLRFHVLSKLLSFMAPIDHTTMNDDARTELYRSLFGQLHPPDEGHGD

SEQ ID NO: 902845 - protein, 267 aa, Homo sapiens
RDPDVAYPDTRYLVDGTKPNAGSEEISSEDDELVEEKKQQRRRVPAKRKLEMEDYPSFMAKRFADFTVYRNRTLQKWHDKTKLASGKLGKGFGAFERSILTQIDHILMDKERLLRRTQTKRSVYRVLGKPEPAAQPVPESLPGEPEILPQAPANAHLKDLDEEIFDDDDFYHQLLRELIERKTSSLDPNDQVAMGRQWLAIQKLRSKIHKKVDRKASKGRKLRFHVLSKLLSFMAPIDHTTMNDDARTELYRSLFGQLHPPDEGHGD

SEQ ID NO: 902846 - protein, 257 aa, Homo sapiens
CAATTLLIFHRYTEEISSEDDELVEEKKQQRRRVPAKRKLEMEDYPSFMAKRFADFTVYRNRTLQKWHDKTKLASGKLGKGFGAFERSILTQIDHILMDKERLLRRTQTKRSVYRVLGKPEPAAQPVPESLPGEPEILPQAPANAHLKDLDEEIFDDDDFYHQLLRELIERKTSSLDPNDQVAMGRQWLAIQKLRSKIHKKVDRKASKGRKLRFHVLSKLLSFMAPIDHTTMNDDARTELYRSLFGQLHPPDEGHGD

SEQ ID NO: 902847 - protein, 638 aa, Homo sapiens
AGLHASNARSDAQAPPPPARLPEVAGPELWGGLRAVSGGVGESDQGERIRQGRSFGAGGWAAHLRARSGVDRELVTMAGPQPLALQLEQLLNPRPSEADPEADPEEATAARVIDRFDEGEDGEGDFLVVGSIRKLASASLLDTDKRYCGKTTSRKAWNEDHWEQTLPGSSDEEISDEEGSGDEDSEGLGLEEYDEDDLGAAEEQECGDHRESKKSRSHSAKTPGFSVQSISDFEKFTKGMDDLGSSEEEEDEESGMEEGDDAEDSQGESEEDRAGDRNSEDDGVVMTFSSVKVSEEVEKGRAVKNQIALWDQLLEGRIKLQKALLTTNQLPQPDVFPLFKDKGGPEFSSALKNSHKALKALLRSLVGLQEELLFQYPDTRYLVDGTKPNAGSEEISSEDDELVEEKKQQRRRVPAKRKLEMEDYPSFMAKRFADFTVYRNRTLQKWHDKTKLASGKLGKGFGAFERSILTQIDHILMDKERLLRRTQTKRSVYRVLGKPEPAAQPVPESLPGEPEILPQAPANAHLKDLDEEIFDDDDFYHQLLRELIERKTSSLDPNDQVAMGRQWLAIQKLRSKIHKKVDRKASKGRKLRFHVLSKLLSFMAPIDHTTMNDDARPSGRLGWCGCWSRWRKPVTLWG

SEQ ID NO: 902848 - protein, 569 aa, Homo sapiens
AGLHASNARSDAQAPPPPARLPEVAGPELWGGLRAVSGGVGESDQGERIRQGRSFGAGGWAAHLRARSGVDRELVTMAGPQPLALQLEQLLNPRPSEADPEADPEEATAARVIDRFDEGEDGEGDFLVVGSIRKLASASLLDTDKRYCGKTTSRKAWNEDHWEQTLPGSSDEEISDEEGSGDEDSEGLGLEEYDEDDLGAAEEQECGDHRESKKSRSHSAKTPGFSVQSISDFEKFTKGMDDLGSSEEEEDEESGMEEGDDAEDSQGESEEDRAGDRNSEDDGVVMTFSSVKVSEEVEKGRAVKNQIALWDQLLEGRIKLQKALLTTNQLPQPDVFPLFKDKGGPEFSSALKNSHKALKALLRSLVGLQEELLFQYPDTRYLVDGTKPNAGSEEISSEDDELVEEKKQQRRRVPAKRKLEMEDYPSFMAKRFADFTVYRNRTLQKWHDKTKLASGKLGKGFGAFERSILTQIDHILMDKERLLRRTQTKRSVYRVLGKPEPAAQPVPESLPGEPEILPQAPANAHLKDLDEEIFDDDDFYHQFLRELIEGKTVLGSKIRGHGTPGCIQK

SEQ ID NO: 902849 - protein, 117 aa, Homo sapiens
MFPLLANGEGRASCTSLLFSPLQLLRELIERKTSSLDPNDQVAMGRQWLAIQKLRSKIHKKVDRKASKGRKLRFHVLSKLLSFMAPIDHTTMNDDARTELYRSLFGQLHPPDEGHGD

SEQ ID NO: 902850 - protein, 70 aa, Homo sapiens
KPQSRNGSVLSSYELAPTYYMNDDAGQNCTALFLASSTLPTKATGIDIAHLRHPVGALAGVAAGPDGGNQ

SEQ ID NO: 902851 - protein, 636 aa, Homo sapiens; identical to SEQ ID NO: 902836

SEQ ID NO: 902852 - protein, 636 aa, Homo sapiens; identical to SEQ ID NO: 902836

SEQ ID NO: 902853 - protein, 520 aa, Homo sapiens
RLEDPLRYYYLVVGSIRKLASASLLDTDKRYCGKTTSRKAWNEDHWEQTLPGSSDEEISDEEGSGDEDSEGLGLEEYDEDDLGAAEEQECGDHRESKKSRSHSAKTPGFSVQSISDFEKFTKGMDDLGSSEEEEDEESGMEEGDDAEDSQGESEEDRAGDRNSEDDGVVMTFSSVKVSEEVEKGRAVKNQIALWDQLLEGRIKLQKALLTTNQLPQPDVFPLFKDKGGPEFSSALKNSHKALKALLRSLVGLQEELLFQYPDTRYLVDGTKPNAGSEEISSEDDELVEEKKQQRRRVPAKRKLEMEDYPSFMAKRFADFTVYRNRTLQKWHDKTKLASGKLGKGFGAFERSILTQIDHILMDKERLLRRTQTKRSVYRVLGKPEPAAQPVPESLPGEPEILPQAPANAHLKDLDEEIFDDDDFYHQLLRELIERKTSSLDPNDQVAMGRQWLAIQKLRSKIHKKVDRKASKGRKLRFHVLSKLLSFMAPIDHTTMNDDARTELYRSLFGQLHPPDEGHGD

SEQ ID NO: 902854 - protein, 409 aa, Homo sapiens
VLRCSRGSQFDGDSRLGSSEEEEDEESGMEEGDDAEDSQGESEEDRAGDRNSEDDGVVMTFSSVKVSEEVEKGRAVKNQIALWDQLLEGRIKLQKALLTTNQLPQPDVFPLFKDKGGPEFSSALKNSHKALKALLRSLVGLQEELLFQYPDTRYLVDGTKPNAGSEEISSEDDELVEEKKQQRRRVPAKRKLEMEDYPSFMAKRFADFTVYRNRTLQKWHDKTKLASGKLGKGFGAFERSILTQIDHILMDKERLLRRTQTKRSVYRVLGKPEPAAQPVPESLPGEPEILPQAPANAHLKDLDEEIFDDDDFYHQLLRELIERKTSSLDPNDQVAMGRQWLAIQKLRSKIHKKVDRKASKGRKLRFHVLSKLLSFMAPIDHTTMNDDARTELYRSLFGQLHPPDEGHGD

SEQ ID NO: 902855 - protein, 322 aa, Homo sapiens
LVVNRAFCSLILPSKSWSHSAIWFFTDKGGPEFSSALKNSHKALKALLRSLVGLQEELLFQYPDTRYLVDGTKPNAGSEEISSEDDELVEEKKQQRRRVPAKRKLEMEDYPSFMAKRFADFTVYRNRTLQKWHDKTKLASGKLGKGFGAFERSILTQIDHILMDKERLLRRTQTKRSVYRVLGKPEPAAQPVPESLPGEPEILPQAPANAHLKDLDEEIFDDDDFYHQLLRELIERKTSSLDPNDQVAMGRQWLAIQKLRSKIHKKVDRKASKGRKLRFHVLSKLLSFMAPIDHTTMNDDARTELYRSLFGQLHPPDEGHGD

SEQ ID NO: 902856 - protein, 285 aa, Homo sapiens
ILLPALALEDPRVGQCLQEELLFQYPDTRYLVDGTKPNAGSEEISSEDDELVEEKKQQRRRVPAKRKLEMEDYPSFMAKRFADFTVYRNRTLQKWHDKTKLASGKLGKGFGAFERSILTQIDHILMDKERLLRRTQTKRSVYRVLGKPEPAAQPVPESLPGEPEILPQAPANAHLKDLDEEIFDDDDFYHQLLRELIERKTSSLDPNDQVAMGRQWLAIQKLRSKIHKKVDRKASKGRKLRFHVLSKLLSFMAPIDHTTMNDDARTELYRSLFGQLHPPDEGHGD

SEQ ID NO: 902857 - protein, 612 aa, Homo sapiens
AGLHASNARSDAQAPPPPARLPEVAGPELWGGLRAVSGGVGESDQGERIRQGRSFGAGGWAAHLRARSGVDRELVTMAGPQPLALQLEQLLNPRPSEADPEADPEEATAARVIDRFDEGEDGEGDFLVVGSIRKLASASLLDTDKRYCGKTTSRKAWNEDHWEQTLPGSSDEEISDEEGSGDEDSEGLGLEEYDEDDLGAAEEQECGDHRESKKSRSHSAKTPGFSVQSISDFEKFTKGMDDLGSSEEEEDEESGMEEGDDAEDSQGESEEDRAGDRNSEDDGVVMTFSSVKVSEEVEKGRAVKNQIALWDQLLEGRIKLQKALLTTNQLPQPDVFPLFKDKGGPEFSSALKNSHKALKALLRSLVGLQEELLFQYPDTRYLVDGTKPNAGSEEISSEDDELVEEKKQQRRRVPAKRKLEMEDYPSFMAKRFADFTVYRNRTLQKWHDKTKLASGKLGKGFGAFERSILTQIDHILMDKERLLRRTQTKRSVYRVLGKPEPAAQPVPESLPGEPEILPQAPANAHLKDLDEEIFDDDDFYHQLLRELIERKTSSLDPNDQVAMGRQWLAIQKLRSKIHKKVDRKASKGRKLRTELYRSLFGQLHPPDEGHGD

SEQ ID NO: 902858 - protein, 612 aa, Homo sapiens; identical to SEQ ID NO: 902857

SEQ ID NO: 902859 - protein, 514 aa, Homo sapiens
AGLHASNARSDAQAPPPPARLPEVAGPELWGGLRAVSGGVGESDQGERIRQGRSFGAGGWAAHLRARSGVDRELVTMAGPQPLALQLEQLLNPRPSEADPEADPEEATAARVIDRFDEGEDGEGDFLVVGSIRKLASASLLDTDKRYCGKTTSRKAWNEDHWEQTLPGSSDEEISDEEGSGDEDSEGLGLEEYDEDDLGAAEEQECGDHRESKKSRSHSAKTPGFSVQSISDFEKFTKGMDDLGSSEEEEDEESGMEEGDDAEDSQGESEEDRAGDRNSEDDGVVMTFSSVKVSEEVEKGRAVKNQIALWDQLLEGRIKLQKALLTTNQLPQPDVFPLFKDKGGPEFSSALKNSHKALKALLRSLVGLQEELLFQYPDTRYLVDGTKPNAGSEEISSEDDELVEEKKQQRRRVPAKRKLEMEDYPSFMAKRFADFTVYRNRTLQKWHDKTKLASGKLGKGFGAFERSILTQIDHILMDKERLLRRTQTKRSVYRVLGSFSAPVMVIEDLVKKFL

SEQ ID NO: 902860 - protein, 119 aa, Homo sapiens
AASGSQAPFLRDTCCAYLRISPRPFLRPPLPTQKPMNVGLSETQNGGMSQEAVGNIKVTKSPQKSTVLTNGEAAMQSSNSESKKKKKKKRKMVNDAEPDTNKPHCYYGESEVARYRDTS

SEQ ID NO: 902861 - protein, 665 aa, Homo sapiens [sequence omitted]

SEQ ID NO: 902862 - protein, 665 aa, Homo sapiens [sequence omitted]

SEQ ID NO: 902863 - protein, 485 aa, Homo sapiens
MKLLRKKIEKRNLKLRQRNLKFQGASNLTLSETQNGDVSEETMGSRKVKKSKQKPMNVGLSETQNGGMSQEAVGNIKVTKSPQKSTVLTNGEAAMQSSNSESKKKKKKKRKMVNDAEPDTKKAKTENKGKSEEESAETTKETENNVEKPDNDEDESEVPSLPLGLTGAFEDTSFASLCNLVNENTLKAIKEMGFTNMTEIQHKSIRPLLEGRDLLAAAKTGSGKTLAFLIPAVELIVKLRFMPRNGTGVLILSPTRELAMQTFGVLKELMTHHVHTYGLIMGGSNRSAEAQKLGNGINIIVATPGRLLDHMQNTPGFMYKNLQCLVIDEADRILDVGFEEELKQIIKLLPTRRQTMLFSATQTRKVEDLARISLKKEPLYVGVDDDKANATVDGLEQGYVVCPSEKRFLLLFTFLKKNRKKKLMVFFSSCMSVKYHYELLNYIDLPVLAIHVSDDDELIENRVCLLNPIDCRIGGIALSWKHCSE

SEQ ID NO: 902864 - protein, 665 aa, Homo sapiens [sequence omitted]

SEQ ID NO: 902865 - protein, 690 aa, Homo sapiens
YVPPRRGLVATRTRVDLVFRMSHLPMKLLRKKIEKRNLKLRQRNLKFQGASNLTLSETQNGDVSEETMGSRKVKKSKQKPMNVGLSETQNGGMSQEAVGNIKVTKSPQKSTVLTNGEAAMQSSNSESKKKKKKKRKMVNDAEPDTKKAKTENKGKSEEESAETTKETENNVEKPDNDEDESEVPSLPLGLTGAFEDTSFASLCNLVNENTLKAIKEMGFTNMTEIQHKSIRPLLEGRDLLAAAKTGSGKTLAFLIPAVELIVKLRFMPRNGTGVLILSPTRELAMQTFGVLKELMTHHVHTYGLIMGGSNRSAEAQKLGNGINIIVATPGRLLDHMQNTPGFMYKNLQCLVIDEADRILDVGFEEELKQIIKLLPTRRQTMLFSATQTRKVEDLARISLKKEPLYVGVDDDKANATVDGLEQGYVVCPSEKRFLLLFTFLKKNRKKKLMVFFSSCMSVKYHYELLNYIDLPVLAIHGKQKQNKRTTTFFQFCNADSGTLLCTDVAARGLDIPEVDWIVQYDPPDDPKEYIHRVGRTARGLNGRGHALLILRPEELGFLRYLKQSKVPLSEFDFSWSKISDIQSQLEKLIEKNYFLHKSAQEAYKSYIRAYDSHSLKQIFNVNNLNLPQVALSFGFKVPPFVDLNVNSNEGKQKKRGGGGGFGYQKTKKVEKSKIFKHISKKSSDSRQFSH

SEQ ID NO: 902866 - protein, 252 aa, Homo sapiens
EKPNFSYIIGKNTWVEHWPEEENAKTKRTRNNAGTSAPSPRAWLSLGAPTDHTPIPPLPYQLVRDVAARGLDIPEVDWIVQYDPPDDPKEYIHRVGRTARGLNGRGHALLILRPEELGFLRYLKQSKVPLSEFDFSWSKISDIQSQLEKLIEKNYFLHKSAQEAYKSYIRAYDSHSLKQIFNVNNLNLPQVALSFGFKVPPFVDLNVNSNEGKQKKRGGGGGFGYQKTKKVEKSKIFKHISKKSSDSRQFSH

SEQ ID NO: 902867 - protein, 658 aa, Homo sapiens
MSHLPMKLLRKKIEKRNLKLRQRNLKFQGASNLTLSETQNGDVSEETMGSRKVKKSKQKPMNVGLSETQNGGMSQEAVGNIKVTKSPQKSTVLTNGEAAMQSSNSESKKKKKKKRKMVNDAEPDTKKAKTENKGKSEEESAETTKETENNVEKPDNDEDESEVPSLPLGLTGAFEDTSFASLCNLVNENTLKAIKEMGFTNMTEIQHKSIRPLLEGRDLLAAAKTGSGKTLAFLIPAVELIVKLRFMPRNGTGVLILSPTRELAMQTFGVLKELMTHHVHTYGLIMGGSNRSAEAQKLGNGINIIVATPGRLLDHMQNTPGFMYKNLQCLVIDEADRILDVGFEEELKQIIKLLPTRRQTMLFSATQTRKVEDLARISLKKEPLYVGVDDDKANATVDGLEQGYVVCPSEKRFLLLFTFLKKNRKKKLMVFFSSCMSVKYHYELLNYIDLPVLAIHGKQKQNKRTTTFFQFCNADSGTLLCTDVAARGLDIPEVDWIVQYDPPDDPKEYIHRVGRTARGLNGRGHALLILRPEELGFLRYLKQSKVPLSEFDFSWSKISDIQSQLEKLIEKNYFLHKSAQEAYKSYIRAYDSHSLKQIFNVNNLNLPQVALSFGFKVPPFVDLNVNSNEGKQKKRGGGGGFGYQKTKKVEVSVRGYRA

SEQ ID NO: 902868 - protein, 181 aa, Homo sapiens
MSHLPMKLLRKKIEKRNLKLRQRNLKFQGASNLTLSETQNGDVSEETMGSRKVKKSKQKPMNVGLSETQNGGMSQEAVGNIKVTKSPQKSTVLTNGEAAMQSSNSESKKKKNTTKKTLLGGLGPGKVFYPFGLWPRAAPMRAMWNHGVHIGCSRGETRGRELRARRFPPFKKARGETRRFS

SEQ ID NO: 902869 - protein, 665 aa, Homo sapiens [sequence omitted]

SEQ ID NO: 902870 - protein, 665 aa, Homo sapiens [sequence omitted]

SEQ ID NO: 902871 - protein, 665 aa, Homo sapiens [sequence omitted]

SEQ ID NO: 902872 - protein, 651 aa, Homo sapiens
MSHLPMKLLRKKIEKRNLKLRQRNLKFQGASNLTLSETQNGDVSEETMGSRKVKKSKQKPMNVGLSETQNGGMSQEAVGNIKVTKSPQKSTVLTNGEAAMQSSNSESKKKKKKKRKMVNDAEPDTKKAKTENKGKSEEESAETTKETENNVEKPDNDEDESEVPSLPLGLTGAFEDTSFASLCNLVNENTLKAIKEMGFTNMTEIQHKSIRPLLEGRDLLAAAKTGSGKTLAFLIPAVELIVKLRFMPRNGTGVLILSPTRELAMQTFGVLKELMTHHVHTYGLIMGGSNRSAEAQKLGNGINIIVATPGRLLDHMQNTPGFMYKNLQCLVIDEADRILDVGFEEELKQIIKLLPTRRQTMLFSATQTRKVEDLARISLKKEPLYVGVDDDKANATVDGLEQKNRKKKLMVFFSSCMSVKYHYELLNYIDLPVLAIHGKQKQNKRTTTFFQFCNADSGTLLCTDVAARGLDIPEVDWIVQYDPPDDPKEYIHRVGRTARGLNGRGHALLILRPEELGFLRYLKQSKVPLSEFDFSWSKISDIQSQLEKLIEKNYFLHKSAQEAYKSYIRAYDSHSLKQIFNVNNLNLPQVALSFGFKVPPFVDLNVNSNEGKQKKRGGGGGFGYQKTKKVEKSKIFKHISKKSSDSRQFSH

SEQ ID NO: 902873 - protein, 665 aa, Homo sapiens [sequence omitted]

SEQ ID NO: 902874 - protein, 665 aa, Homo sapiens [sequence omitted]

SEQ ID NO: 902875 - protein, 614 aa, Homo sapiens
MSHLPMKLLRKKIEKRNLKLRQRNLKFQGASNLTLSETQNGDVSEETMGSRKVKKSKQKPMNVGLSETQNGGMSQEAVGNIKVTKSPQKSTVLTNGEAAMQSSNSESKKKKKKKRKMVNDAEPDTKKAKTENKGKSEEESAETTKETENNVEKPDNDEDESEVPSLPLGLTGAFEDTSFASLCNLVNENTLKAIKEMGFTNMTEIQHKSIRPLLEGRDLLAAAKTGSGKTLAFLIPAVELIVKLRFMPRNGTGVLILSPTRELAMQTFGVLKELMTHHVHTYGLIMGGSNRSAEAQKLGNGINIIVATPGRLLDHMQNTPGFMYKNLQCLVIDEADRILDVGFEEELKQIIKLLPTRRQTMLFSATQTRKVEDLARISLKKEPLYVGVDDDKANATVDGLEQGYVVCPSEKRFLLLFTFLKKNRKKKLMVFFSSCMSVKYHYELLNYIDLPVLAIHGKQKQNKRTTTFFQFCNADSGTLLCTDVAARGLDIPEVDWIVQYDPPDDPKEYIHRVGRTARGLNGRGHALLILRPEELGFLRYLKQSKVPLSEFDFSWSKISDIQSQLEKLIEKNYFLHKSAQEAYKSYIRAYDSHSLFSILRSLPSLLNAKFFYAL

SEQ ID NO: 902876 - protein, 144 aa, Homo sapiens
MSHLPMKLLRKKIEKRNLKLRQRNLKFQGASNLTLSETQNGDVSEETMGSRKVKKSKQKPMNVGLSETQNGGMSQEAVGNIKVTKSPQKSTVLTNGEAAMQSSNSESKKKKKKKRKMVNDAEPDTNKPHCYYGESEVARYRDTS

SEQ ID NO: 902877 - protein, 197 aa, Homo sapiens
MSRLSRSLLWAATCLGVLCVLSADKNTTQHPNVTTLAPISNVTSAPVTSLPLVTTPAPETCEGRNSCVSCFNVSVVNTTCFWIECKDESYCSHNSTVSDCQVGNTTDFCSVSTATPVPTANSTAKPTVQPSPSTTSKTVTTSGTTNNTVTPTSQPVRKSTFDAASFIGGIVLVLGVQAVIFFLYKFCKSKERNYHTL

SEQ ID NO: 902878 - protein, 178 aa, Homo sapiens
MSRLSRSLLWAATCLGVLCVLSADKNTTQHPNVTTLAPISNVTSAPVTSLPLVTTPAPETCEGRNSCVSCFNVSVVNTTCFWIECKDESYCSHNSTVSDCQVGNTTDFCSVSTATPVPTANSTGTTNNTVTPTSQPVRKSTFDAASFIGGIVLVLGVQAVIFFLYKFCKSKERNYHTL

SEQ ID NO: 902879 - protein, 197 aa, Homo sapiens; identical to SEQ ID NO: 902877

SEQ ID NO: 902880 - protein, 197 aa, Homo sapiens; identical to SEQ ID NO: 902877

SEQ ID NO: 902881 - protein, 197 aa, Homo sapiens; identical to SEQ ID NO: 902877

SEQ ID NO: 902882 - protein, 197 aa, Homo sapiens; identical to SEQ ID NO: 902877

SEQ ID NO: 902883 - protein, 197 aa, Homo sapiens; identical to SEQ ID NO: 902877

SEQ ID NO: 902884 - protein, 197 aa, Homo sapiens; identical to SEQ ID NO: 902877

SEQ ID NO: 902885 - protein, 197 aa, Homo sapiens; identical to SEQ ID NO: 902877

SEQ ID NO: 902886 - protein, 197 aa, Homo sapiens; identical to SEQ ID NO: 902877

SEQ ID NO: 902887 - protein, 197 aa, Homo sapiens; identical to SEQ ID NO: 902877

SEQ ID NO: 902888 - protein, 197 aa, Homo sapiens; identical to SEQ ID NO: 902877

SEQ ID NO: 902889 - protein, 197 aa, Homo sapiens; identical to SEQ ID NO: 902877

SEQ ID NO: 902890 - protein, 197 aa, Homo sapiens; identical to SEQ ID NO: 902877

SEQ ID NO: 902891 - protein, 197 aa, Homo sapiens; identical to SEQ ID NO: 902877

SEQ ID NO: 902892 - protein, 197 aa, Homo sapiens; identical to SEQ ID NO: 902877

SEQ ID NO: 902893 - protein, 188 aa, Homo sapiens
MSRLSRSLLWAATCLGVLCVLSADKNTTQHPNVTTLAPISNVTSAPVTSLPLVTTPAPETCEGRNSCVSCFNVSVVNTTCFWIECKDESYCSHNSTVSDCQVGNTTDFCSVSTATPVPTANSTAKPTVQPSPSTTSKTVTTSGTTNNTVTPTSQPVRKSTFDAASFIGGIVLVLVRCHTRNYIPDLKK

SEQ ID NO: 902894 - protein, 197 aa, Homo sapiens; identical to SEQ ID NO: 902877

SEQ ID NO: 902895 - protein, 197 aa, Homo sapiens; identical to SEQ ID NO: 902877

SEQ ID NO: 902896 - protein, 179 aa, Homo sapiens
MSRLSRSLLWAATCLGVLCVLSADKNTTQHPNVTTLAPISNVTSAPVTSLPLVTTPAPETCEGRNSCVSCFNVSVVNTTCFWIECKDESYCSHNSTVSDCQVGNTTDFCSVSTATPVPTANSTAKPTVQPSPSTTSKTVTTSATNARGFPIQQLCATTATVDAAMSSGGIVVVSGTAAR

SEQ ID NO: 902897 - protein, 140 aa, Homo sapiens
MCLGQKIYICLYYVPETVQVPLSKRAKFVGPGGYNLKKLQAETGVTISQVDEETFSVFAPTPSAMHEARDFITEICKDDQEQQLEFGAVYTATITEIRDTGVMVKLYPNMTAVLLHNTQLDQRKIKHPTALGLEVGQEIQ

SEQ ID NO: 902898 - protein, 802 aa, Homo sapiens
SSAINAELPLRPGDRVPGVMAACRYCCSCLRLRPLSDGPFLLPRRDRALTQLQVRALWSSAGSRAVAVDLGNRKLEISSGKLARFADGSAVVQSGDTAVMVTAVSKTKPSPSQFMPLVVDYRQKAAAAGRIPTNYLRREIGTSDKEILTSRIIDRSIRPLFPAGYFYDTQVLCNLLAVDGVNEPDVLAINGASVALSLSDIPWNGPVGAVRIGIIDGEYVVNPTRKEMSSSTLNLVVAGAPKSQIVMLEASAENILQQDFCHAIKVGVKYTQQIIQGIQQLVKETGVTKRTPQKLFTPSPEIVKYTHKLAMERLYAVFTDYEHDKVSRDEAVNKIRLDTEEQLKEKFPEADPYEIIESFNVVAKEVFRSIVLNEYKRCDGRDLTSLRNVSCEVDMFKTLHGSALFQRGQTQVLCTVTFDSLESGIKSDQVITAINGIKDKNFMLHYEFPPYATNEIGKVTGLNRRELGHGALAEKALYPVIPRDFPFTIRVTSEVLESNGSSSMASACGGSLALMDSGVPISSAVAGVAIGLVTKTDPEKGEIEDYRLLTDILGIEDYNGDMDFKIAGTNKGITALQADIKLPGIPIKIVMEAIQQASVAKKEILQIMNKTISKPRASRKENGPVVETVQVPLSKRAKFVGPGGYNLKKLQAETGVTISQVDEETFSVFAPTPSAMHEARDFITEICKDDQEQQLEFGAVYTATITEIRDTGVMVKLYPNMTAVLLHNTQLDQRKIKHPTALGLEVGQEIQVKYFGRDPADGRMRLSRKVLQSPATTVVRTLNDRSSIVMGEPISQSSSNSQ

SEQ ID NO: 902899 - protein, 802 aa, Homo sapiens; identical to SEQ ID NO: 902898

SEQ ID NO: 902900 - protein, 780 aa, Homo sapiens
SSAINAELPLRPGDRVPGVMAACRYCCSCLRLRPLSDGPFLLPRRDRALTQLQVRALWSSAGSRAVAVDLGNRKLEISSGKLARFADGSAVVQSGDTAVMVTAVSKTKPSPSQFMPLVVDYRQKAAAAGRIPTNYLRREIGTSDKEILTSRIIDRSIRPLFPAGYFYDTQVLCNLLAVDGVNEPDVLAINGASVALSLSDIPWNGPVGAVRIGIIDGEYVVNPTRKEMSSSTLNLVVAGAPKSQIVMLEASAENILQQDFCHAIKVGVKYTQQIIQGIQQLVKETGVTKRTPQKLFTPSPEIVKYTHKLAMERLYAVFTDYEHDKVSRDEAVNKIRLDTEEQLKEKFPEADPYEIIESFNVVAKEVFRSIVLNEYKRCDGRDLTSLRNVSCEVDMFKTLHGSALFQRGQTQVLCTVTFDSLESGIKSDQVITAINGIKDKNFMLHYEGALAEKALYPVIPRDFPFTIRVTSEVLESNGSSSMASACGGSLALMDSGVPISSAVAGVAIGLVTKTDPEKGEIEDYRLLTDILGIEDYNGDMDFKIAGTNKGITALQADIKLPGIPIKIVMEAIQQASVAKKEILQIMNKTISKPRASRKENGPVVETVQVPLSKRAKFVGPGGYNLKKLQAETGVTISQVDEETFSVFAPTPSAMHEARDFITEICKDDQEQQLEFGAVYTATITEIRDTGVMVKLYPNMTAVLLHNTQLDQRKIKHPTALGLEVGQEIQVKYFGRDPADGRMRLSRKVLQSPATTVVRTLNDRSSIVMGEPISQSSSNSQ

SEQ ID NO: 902901 - protein, 446 aa, Homo sapiens
RIAIRQCAKEVQKYGLNEYKRCDGRDLTSLRNVSCEVDMFKTLHGSALFQRGQTQVLCTVTFDSLESGIKSDQVITAINGIKDKNFMLHYEFPPYATNEIGKVTGLNRRELGHGALAEKALYPVIPRDFPFTIRVTSEVLESNGSSSMASACGGSLALMDSGVPISSAVAGVAIGLVTKTDPEKGEIEDYRLLTDILGIEDYNGDMDFKIAGTNKGITALQADIKLPGIPIKIVMEAIQQASVAKKEILQIMNKTISKPRASRKENGPVVETVQVPLSKRAKFVGPGGYNLKKLQAETGVTISQVDEETFSVFAPTPSAMHEARDFITEICKDDQEQQLEFGAVYTATITEIRDTGVMVKLYPNMTAVLLHNTQLDQRKIKHPTALGLEVGQEIQVKYFGRDPADGRMRLSRKVLQSPATTVVRTLNDRSSIVMGEPISQSSSNSQ

SEQ ID NO: 902902 - protein, 784 aa, Homo sapiens
SSAINAELPLRPGDRVPGVMAACRYCCSCLRLRPLSDGPFLLPRRDRALTQLQVRALWSSAGSRAVAVDLGNRKLEISSGKLARFADGSAVVQSGDTAVMVTAVSKTKPSPSQFMPLVVDYRQKAAAAGRIPTNYLRREIGTSDKEILTSRIIDRSIRPLFPAGYFYDTQVLCNLLAVDGVNEPDVLAINGASVALSLSDIPWNGPVGAVRIGIIDGEYVVNPTRKEMSSSTLNLVVAGAPKSQIVMLEASAENILQQDFCHAIKVGVKYTQQIIQGIQQLVKETGVTKRTPQKLFTPSPEIVKYTHKLAMERLYAVFTDYEHDKVSRDEAVNKIRLDTEEQLKEKFPEADPYEIIESFNVVAKEVFRSIVLNEYKRCDGRDLTSLRNVSCEVDMFKTLHGSALFQRGQTQVLCTVTFDSLESGIKSDQVITAINGIKDKNFMLHYEFPPYATNEIGKVTGLNRRELGHGALAEKALYPVIPRDFPFTIRVTSEVLESNGSSSMASACGGSLALMDSGVPISSAVAGVAIGLVTKTDPEKGEIEDYRLLTDILGIEDYNGDMDFKIAGTNKGITALQADIKLPGIPIKIVMEAIQQASVAKKEILQIMNKTISKPRASRKENGPVVETVQVPLSKRAKFVGPGGYNLNSVFAPTPSAMHEARDFITEICKDDQEQQLEFGAVYTATITEIRDTGVMVKLYPNMTAVLLHNTQLDQRKIKHPTALGLEVGQEIQVKYFGRDPADGRMRLSRKVLQSPATTVVRTLNDRSSIVMGEPISQSSSNSQ

SEQ ID NO: 902903 - protein, 626 aa, Homo sapiens
SSAINAELPLRPGDRVPGVMAACRYCCSCLRLRPLSDGPFLLPRRDRALTQLQVRALWSSAGSRAVAVDLGNRKLEISSGKLARFADGSAVVQSGDTAVMVTAVSKTKPSPSQFMPLVVDYRQKAAAAGRIPTNYLRREIGTSDKEILTSRIIDRSIRPLFPAGYFYDTQVLCNLLAVDGVNEPDVLAINGASVALSLSDIPWNGPVGAVRIGIIDGEYVVNPTRKEMSSSTLNLVVAGAPKSQIVMLEASAENILQQDFCHAIKVGVKYTQQIIQGIQQLVKETGVTKRTPQKLFTPSPEIVKYTHKLAMERLYAVFTDYEHDKVSRDEAVNKIRLDTEEQLKEKFPEADPYEIIESFNVVAKEVFRSIVLNEYKRCDGRDLTSLRNVSCEVDMFKTLHGSALFQRGQTQVLCTVTFDSLESGIKSDQVITAINGIKDKNFMLHYEFPPYATNEIGKVTGLNRRELGHGALAEKALYPVIPRDFPSLSAIFPRRHNGAMNVLADALKSINNAEKRGKRQVLIRPCSKVIVRFLTVMMKHGYIGEFEIIDDHRAGKIVVNLTGRLNKCGVISPRFDVQLKDLEKWQNNLLPSRQFGFIVLTTSAGIMDHEEARRKHTGGKILGFFF

SEQ ID NO: 902904 - protein, 466 aa, Homo sapiens
SSAINAELPLRPGDRVPGVMAACRYCCSCLRLRPLSDGPFLLPRRDRALTQLQVRALWSSAGSRAVAVDLGNRKLEISSGKLARFADGSAVVQSGDTAVMVTAVSKTKPSPSQFMPLVVDYRQKAAAAGRIPTNYLRREIGTSDKEILTSRIIDRSIRPLFPAGYFYDTQVLCNLLAVDGVNEPDVLAINGASVALSLSDIPWNGPVGAVRIGIIDGEYVVNPTRKEMSSSTLNLVVAGAPKSQIVMLEASAENILQQDFCHAIKVGVKYTQQIIQGIQQLVKETGVTKRTPQKLFTPSPEIVKYTHKLAMERLYAVFTDYEHDKVSRDEAVNKIRLDTEEQLKEKFPEADPYEIIESFNVVAKEVFRSIVLNEYKRCDGRDLTSLRNVSCEVDMFKTLHGSALFQRGQTQVLCTVTFDSLESGIKSDQVITAINGIKDKNFMLHYEVLLLRKLCILLFPEIFLSP

SEQ ID NO: 902905 - protein, 165 aa, Homo sapiens
PLCPAKLTLICYILFLKGVTISQVDEETFSVFAPTPSAMHEARDFITEICKDDQEQQLEFGAVYTATITEIRDTGVMVKLYPNMTAVLLHNTQLDQRKIKHPTALGLEVGQEIQVKYFGRDPADGRMRLSRKVLQSPATTVVRTLNDRSSIVMGEPISQSSSNSQ

SEQ ID NO: 902906 - protein, 342 aa, Homo sapiens
SSAINAELPLRPGDRVPGVMAACRYCCSCLRLRPLSDGPFLLPRRDRALTQLQVRALWSSAGSRAVAVDLGNRKLEISSGKLARFADGSAVVQSGDTAVMVTAVSKTKPSPSQFMPLVVDYRQKAAAAGRIPTNYLRREIGTSDKEILTSRIIDRSIRPLFPAGYFYDTQVLCNLLAVDGVNEPDVLAINGASVALSLSDIPWNGPVGAVRIGIIDGEYVVNPTRKEMSSSTLNLVVAGAPKSQIVMLEASAENILQQDFCHAIKVGVKYTQQIIQGIQQLVKETGVTKRTPQKLFTPSPEIVKYTHKLAMERLYAVFTDYEHDKVSRDEAVNKIRLIHEGF

SEQ ID NO: 902907 - protein, 800 aa, Homo sapiens
CKNSNRDGLWYSAEAGVWLSCRYCCSCLRLRPLSDGPFLLPRRDRALTQLQVRALWSSAGSRAVAVDLGNRKLEISSGKLARFADGSAVVQSGDTAVMVTAVSKTKPSPSQFMPLVVDYRQKAAAAGRIPTNYLRREIGTSDKEILTSRIIDRSIRPLFPAGYFYDTQVLCNLLAVDGVNEPDVLAINGASVALSLSDIPWNGPVGAVRIGIIDGEYVVNPTRKEMSSSTLNLVVAGAPKSQIVMLEASAENILQQDFCHAIKVGVKYTQQIIQGIQQLVKETGVTKRTPQKLFTPSPEIVKYTHKLAMERLYAVFTDYEHDKVSRDEAVNKIRLDTEEQLKEKFPEADPYEIIESFNVVAKEVFRSIVLNEYKRCDGRDLTSLRNVSCEVDMFKTLHGSALFQRGQTQVLCTVTFDSLESGIKSDQVITAINGIKDKNFMLHYEFPPYATNEIGKVTGLNRRELGHGALAEKALYPVIPRDFPFTIRVTSEVLESNGSSSMASACGGSLALMDSGVPISSAVAGVAIGLVTKTDPEKGEIEDYRLLTDILGIEDYNGDMDFKIAGTNKGITALQADIKLPGIPIKIVMEAIQQASVAKKEILQIMNKTISKPRASRKENGPVVETVQVPLSKRAKFVGPGGYNLKKLQAETGVTISQVDEETFSVFAPTPSAMHEARDFITEICKDDQEQQLEFGAVYTATITEIRDTGVMVKLYPNMTAVLLHNTQLDQRKIKHPTALGLEVGQEIQVKYFGRDPADGRMRLSRKVLQSPATTVVRTLNDRSSIVMGEPISQSSSNSQ

SEQ ID NO: 902908 - protein, 802 aa, Homo sapiens; identical to SEQ ID NO: 902898

SEQ ID NO: 902909 - protein, 833 aa, Homo sapiens
SSAINAELPLRPGDRVPGVMAACRYCCSCLRLRPLSDGPFLLPRRDRALTQLQVRALWSSAGSRAVAVDLGNRKLEISSGKLARFADGSAVVQSGDTAVMVTAVSKTKPSPSQFMPLVVDYRQKAAAAGRIPTNYLRREIGTSDKEILTSRIIDRSIRPLFPAGYFYDTQVLCNLLAVDGVNEPDVLAINGGKYKSRDENYQIKNFFKAMKFNFGPDFSPFLTSVALSLSDIPWNGPVGAVRIGIIDGEYVVNPTRKEMSSSTLNLVVAGAPKSQIVMLEASAENILQQDFCHAIKVGVKYTQQIIQGIQQLVKETGVTKRTPQKLFTPSPEIVKYTHKLAMERLYAVFTDYEHDKVSRDEAVNKIRLDTEEQLKEKFPEADPYEIIESFNVVAKEVFRSIVLNEYKRCDGRDLTSLRNVSCEVDMFKTLHGSALFQRGQTQVLCTVTFDSLESGIKSDQVITAINGIKDKNFMLHYEFPPYATNEIGKVTGLNRRELGHGALAEKALYPVIPRDFPFTIRVTSEVLESNGSSSMASACGGSLALMDSGVPISSAVAGVAIGLVTKTDPEKGEIEDYRLLTDILGIEDYNGDMDFKIAGTNKGITALQADIKLPGIPIKIVMEAIQQASVAKKEILQIMNKTISKPRASRKENGPVVETVQVPLSKRAKFVGPGGYNLKKLQAETGVTISQVDEETFSVFAPTPSAMHEARDFITEICKDDQEQQLEFGAVYTATITEIRDTGVMVKLYPNMTAVLLHNTQLDQRKIKHPTALGLEVGQEIQVKYFGRDPADGRMRLSRKVLQSPATTVVRTLNDRSSIVMGEPISQSSSNSQ

SEQ ID NO: 902910 - protein, 461 aa, Homo sapiens
SSAINAELPLRPGDRVPGVMAACRYCCSCLRLRPLSDGPFLLPRRDRALTQLQVRALWSSAGSRAVAVDLGNRKLEISSGKLARFADGSAVVQSGDTAVMVTAVSKTKPSPSQFMPLVVDYRQKAAAAGRIPTNYLRREIGTSDKEILTSRIIDRSIRPLFPAGYFYDTQVLCNLLAVDGVNEPDVLAINGASVALSLSDIPWNGPVGAVRIGIIDGEYVVNPTRKEMSSSTLNLVVAGAPKSQIVMLEASAENILQQDFCHAIKVGVKYTQQIIQGIQQLVKETGVTKRTPQKLFTPSPEIVKYTHKLAMERLYAVFTDYEHDKVSRDEAVNKIRLDTEEQLKEKFPEADPYEIIESFNVVAKEVFRSIVLNEYKRCDGRDLTSLRNVSCEVDMFKTLHGSALFQRGQTQVLCTVTFDSLESGIKSDQVITAINGIKDKNFMLHYEFPPYATNEMAKSLV

SEQ ID NO: 902911 - protein, 632 aa, Homo sapiens
SSAINAELPLRPGDRVPGVMAACRYCCSCLRLRPLSDGPFLLPRRDRALTQLQVRALWSSAGSRAVAVDLGNRKLEISSGKLARFADGSAVVQSGDTAVMVTAVSKTKPSPSQFMPLVVDYRQKAAAAGRIPTNYLRREIGTSDKEILTSRIIDRSIRPLFPAGYFYDTQVLCNLLAVDGVNEPDVLAINGASVALSLSDIPWNGPVGAVRIGIIDGEYVVNPTRKEMSSSTLNLVVAGAPKSQIVMLEASAENILQQDFCHAIKVGVKYTQQIIQGIQQLVKETGVTKRTPQKLFTPSPEIVKYTHKLAMERLYAVFTDYEHDKVSRDEAVNKIRLDTEEQLKEKFPEADPYEIIESFNVVAKEVFRSIVLNEYKRCDGRDLTSLRNVSCEVDMFKTLHGSALFQRGQTQVLCTVTFDSLESGIKSDQVITAINGIKDKNFMLHYEFPPYATNEIGKVTGLNRRELGHGALAEKALYPVIPRDFPFTIRVTSEVLESNGSSSMASACGGSLALMDSGVPISSAVAGVAIGLVTKTDPEKGEIEDYRLLTDILGIEDYNGDMDFKIAGTNKGITALQADIKLPGIPIKIVMEAIQQASVAKKEILQIMNKTISKPRASRKENGPVVGNTLKF

SEQ ID NO: 902912 - protein, 308 aa, Homo sapiens
SSAINAELPLRPGDRVPGVMAACRYCCSCLRLRPLSDGPFLLPRRDRALTQLQVRALWSSAGSRAVAVDLGNRKLEISSGKLARFADGSAVVQSGDTAVMVTAVSKTKPSPSQFMPLVVDYRQKAAAAGRIPTNYLRREIGTSDKEILTSRIIDRSIRPLFPAGYFYDTQVLCNLLAVDGVNEPDVLAINGASVALSLSDIPWNGPVGAVRIGIIDGEYVVNPTRKEMSSSTLNLVVAGAPKSQIVMLEASAENILQQDFCHAIKVGVKYTQQIIQGIQQLVKETGVTKRTPQKLFTPSPEIVKYTHK

SEQ ID NO: 902913 - protein, 260 aa, Homo sapiens
SSAINAELPLRPGDRVPGVMAACRYCCSCLRLRPLSDGPFLLPRRDRALTQLQVRALWSSAGSRAVAVDLGNRKLEISSGKLARFADGSAVVQSGDTAVMVTAVSKTKPSPSQFMPLVVDYRQKAAAAGRIPTNYLRREIGTSDKEILTSRIIDRSIRPLFPAGYFYDTQVLCNLLAVDGVNEPDVLAINGASVALSLSDIPWNGPVGAVRIGIIDGEYVVNPTRKEMFQSPATTVVRTLNDRSSIVMGEPISQSSSNSQ

SEQ ID NO: 902914 - protein, 404 aa, Homo sapiens
MRKRTEPVALEHERCAAAGSSSSGSAAAALDADCRLKQNLRLTGPAAAEPRCAADAGMKRALGRRKGVWLRLRKILFCVLGLYIAIPFLIKLCPGIQAKLIFLNFVRVPYFIDLKKPQDQGLNHTCNYYLQPEEDVTIGVWHTVPAVWWKNAQGKDQMWYEDALASSHPIILYLHGNAGTRGGDHRVELYKVLSSLGYHVVTFDYRGWGDSVGTPSERGMTYDALHVFDWIKARSGDNPVYIWGHSLGTGVATNLVRRLCERETPPDALILESPFTNIREEAKSHPFSVIYRYFPGFDWFFLDPITSSGIKFANDENVKHISCPLLILHAEDDPVVPFQLGRKLYSIAAPARSFRDFKVQFVPFHSDLGYRHKYIYKSPELPRILRPQQGPGSSPDPSMWSELV

SEQ ID NO: 902915 - protein, 316 aa, Homo sapiens
WNTGHSLMRNGMACIPGHSLMRNGIQAKLIFLNFVRVPYFIDLKKPQDQGLNHTCNYYLQPEEDVTIGVWHTVPAVWWKNAQGKDQMWYEDALASSHPIILYLHGNAGTRGGDHRVELYKVLSSLGYHVVTFDYRGWGDSVGTPSERGMTYDALHVFDWIKARSGDNPVYIWGHSLGTGVATNLVRRLCERETPPDALILESPFTNIREEAKSHPFSVIYRYTYPWVDWVLPLILSQRGGTSPLPTDENVKQISCSPGILHGDEDEPEGDPYTTWQKASIEIAEQRVEALRDPKSRRGLNQTWATAENDGKSRVPG

SEQ ID NO: 902916 - protein, 398 aa, Homo sapiens
MRKRTEPVALEHERCAAAGSSSSGSAAAALDADCRLKQNLRLTGPAAAEPRCAADAGMKRALGRRKGVWLRLRKILFCVLGLYIAIPFLIKLCPGIQAKLIFLNFVRVPYFIDLKKPQDQGLNHTCNYYLQPEEDVTIGVWHTVPAVWWKNAQGKDQMWYEDALASSHPIILYLHGNAGTRGGDHRVELYKVLSSLGYHVVTFDYRGWGDSVGTPSERGMTYDALHVFDWIKARSGDNPVYIWGHSLGTGVATNLVRRLCERETPPDALILESPFTNIREEAKSHPFSVIYRYFPGFDWFFLDPITSSGIKFANDENVKHISCPLLILHAEDDPVVPFQLGRKLYSIAAPARSFRDFKVQFVPFHSDLGYRHKYIYKSPELPRILREFLGKSEPEHQH

SEQ ID NO: 902917 - protein, 404 aa, Homo sapiens
SPWKIPGRQAQQRREAEGPAPDPESAGAHSDLLLLLCIRPHTELPGRAPLGLGCVRGALLAPWALGGSPRRKGVWLRLRKILFCVLGLYIAIPFLIKLCPGIQAKLIFLNFVRVPYFIDLKKPQDQGLNHTCNYYLQPEEDVTIGVWHTVPAVWWKNAQGKDQMWYEDALASSHPIILYLHGNAGTRGGDHRVELYKVLSSLGYHVVTFDYRGWGDSVGTPSERGMTYDALHVFDWIKARSGDNPVYIWGHSLGTGVATNLVRRLCERETPPDALILESPFTNIREEAKSHPFSVIYRYFPGFDWFFLDPITSSGIKFANDENVKHISCPLLILHAEDDPVVPFQLGRKLYSIAAPARSFRDFKVQFVPFHSDLGYRHKYIYKSPELPRILREFLGKSEPEHQH

SEQ ID NO: 902918 - protein, 346 aa, Homo sapiens
GGLRRPLFPDTRRKGVWLRLRKILFCVLGLYIAIPFLIKLCPGIQAKLIFLNFVRVPYFIDLKKPQDQGLNHTCNYYLQPEEDVTIGVWHTVPAVWWKNAQGKDQMWYEDALASSHPIILYLHGNAGTRGGDHRVELYKVLSSLGYHVVTFDYRGWGDSVGTPSERGMTYDALHVFDWIKARSGDNPVYIWGHSLGTGVATNLVRRLCERETPPDALILESPFTNIREEAKSHPFSVIYRYFPGFDWFFLDPITSSGIKFANDENVKHISCPLLILHAEDDPVVPFQLGRKLYSIAAPARSFRDFKVQFVPFHSDLGYRHKYIYKSPELPRILREFLGKSEPEHQH

SEQ ID NO: 902919 - protein, 516 aa, Homo sapiens
MAALTLCICVQSGRGTAYAFPGILARLRAIASSTAFSCFSSSSRRDSVLAFPDLVLAAPGSEALPGTLVTLLELLDWGDSWRFLSAGAAGALEFWPLCRSGFGEPSLPPDFRSQNLGDRYRVRPPSCCTGNGCVGGLTDARDSLLKPEAAEFTTFIFISCRIRQRAEPRCAADAGMKRALGRRKGVWLRLRKILFCVLGLYIAIPFLIKLCPGIQAKLIFLNFVRVPYFIDLKKPQDQGLNHTCNYYLQPEEDVTIGVWHTVPAVWWKNAQGKDQMWYEDALASSHPIILYLHGNAGTRGGDHRVELYKVLSSLGYHVVTFDYRGWGDSVGTPSERGMTYDALHVFDWIKARSGDNPVYIWGHSLGTGVATNLVRRLCERETPPDALILESPFTNIREEAKSHPFSVIYRYFPGFDWFFLDPITSSGIKFANDENVKHISCPLLILHAEDDPVVPFQLGRKLYSIAAPARSFRDFKVQFVPFHSDLGYRHKYIYKSPELPRILREFLGKSEPEHQH

SEQ ID NO: 902920 - protein, 179 aa, Homo sapiens [sequence omitted]

SEQ ID NO: 902921 - protein, 179 aa, Homo sapiens [sequence omitted]

SEQ ID NO: 902922 - protein, 398 aa, Homo sapiens; identical to SEQ ID NO: 902916

SEQ ID NO: 902923 - protein, 179 aa, Homo sapiens [sequence omitted]

SEQ ID NO: 902924 - protein, 401 aa, Homo sapiens
MRKRTEPVALEHERCAAAGSSSSGSAAAALDADCRLKQNLRLTGPAAAEPRCAADAGMKRALGRRKGVWLRLRKILFCVLGLYIAIPFLIKLCPGIQAKLIFLNFVRVPYFIDLKKPQDQGLNHTCNYYLQPEEDVTIGVWHTVPAVWWKNAQGKDQMWYEDALASSHPIILYLHGNAGTRREADHRGEPLPGCWSSLGFTIVVTFDSGGWGDSVGTPSERGMTYDALHVFDWIKARSGDNPVYIWGHSLGTGVATNLVRRLCERETPPDALILESPFTNIREEAKSHPFSVIYRYFPGFDWFFLDPITSSGIKFANDENVKHISCPLLILHAEDDPVVPFQLGRKLYSIAAPARSFRDFKVQFVPFHSDLGYRHKYIYKSPELPRILREFLGKSEPEHQH

SEQ ID NO: 902925 - protein, 241 aa, Homo sapiens
MWYEDALASSHPIILYLHGNAGTRGGDHRVELYKVLSSLGYHVVTFDYRGWGDSVGTPSERGMTYDALHVFDWIKARSGDNPVYIWGHSLGTGVATNLVRRLCERETPPDALILESPFTNIREEAKSHPFSVIYRYFPGFDWFFLDPITSSGIKFANDENVKHISCPLLILHAEDDPVVPFQLGRKLYSIAAPARSFRDFKVQFVPFHSDLGYRHKYIYKSPELPRILREFLGKSEPEHQH

SEQ ID NO: 902926 - protein, 179 aa, Homo sapiens [sequence omitted]

SEQ ID NO: 902927 - protein, 954 aa, Homo sapiens
GGGLGSAGRGLLQQRGGRESGPAPPAAKLRPPPEGSAGACAPVPAAAAVAAGPEPAPAGPAKPAGPAALAARAGPGPGPGPGPGPGPGKPAGPGAAQTLNGSAALLNSHHAAAPAVSLVNNGPAALLPLPKPAAPAAAPPPPPPAPATLARPPGHPAGPPTAAPAVPPPAAAQNGGSAGAAPAPAPAAGGPAGVSGQPGPGAAAAAPAPGVKAESPKRVVQAAPPAAQTLAASGPASTAASMVIGPTMQGALPSPAAVPPPAPGTPTGLPKGAAGAVTQSLSRTPTATTSGIRATLTPTVLAPRLPQPPQNPTNIQNFQLPPGMVLVRSENGQLLMIPQQALAQMQAQAHAQPQTTMAPRPATPTSAPPVQISTVQAPGTPIIARQVTPTTIIKQVSQAQTTVQPSATLQRSPGVQPQLVLGGAAQTASLGTATAVQTGTPQRTVPGATTTSSAATETMENVKKCKNFLSTLIKLASSGKQSTETAANVKELVQNLLDGKIEAEDFTSRLYRELNSSPQPYLVPFLKRSLPALRQLTPDSAAFIQQSQQQPPPPTSQATTALTAVVLSSSVQRTAGKTAATVTSALQPPVLSLTQPTQVGVGKQGQPTPLVIQQPPKPGALIRPPQVTLTQTPMVALRQPHNRIMLTTPQQIQLNPLQPVPVVKPAVLPGTKALSAVSAQAAAAQKNKLKEPGGGSFRDDDDINDVASMAGVNLSEESARILATNSELVGTLTRSCKDETFLLQAPLQRRILEIGKKHGITELHPDVVSYVSHATQQRLQNLVEKISETAQQKNFSYKDDDRYEQASDVRAQLKFFEQLDQIEKQRKDEQEREILMRAAKSRSRQEDPEQLRLKQKAKEMQQQELAQMRQRDANLTALAAIGPRKKRKVDCPGPGSGAEGSGPGSVVPGSSGVGTPRQFTRQRITRVNLRDLIFCLENERETSHSLLLYKAFLK

SEQ ID NO: 902928 - protein, 1083 aa, Homo sapiens
MAAGSDLLDEVFFNSEVDEKVVSDLVGSLESQLAASAAHHHHLAPRTPEVRAAAAGALGNHVVSGSPAGAAGAGPAAPAEGAPGAAPEPPPAGRARPGGGGPQRPGPPSPRRPLVPAGPAPPAAKLRPPPEGSAGACAPVPAAAAVAAGPEPAPAGPAKPAGPAALAARAGPGPGPGPGPGPGPGKPAGPGAAQTLNGSAALLNSHHAAAPAVSLVNNGPAALLPLPKPAAPGTVIQTPPFVGAAAPPAPAAPSPPAAPAPAAPAAAPPPPPPAPATLARPPGHPAGPPTAAPAVPPPAAAQNGGSAGAAPAPAPAAGGPAGVSGQPGPGAAAAAPAPGVKAESPKRVVQAAPPAAQTLAASGPASTAASMVIGPTMQGALPSPAAVPPPAPGTPTGLPKGAAGAVTQSLSRTPTATTSGIRATLTPTVLAPRLPQPPQNPTNIQNFQLPPGMVLVRSENGQLLMIPQQALAQMQAQAHAQPQTTMAPRPATPTSAPPVQISTVQAPGTPIIARQVTPTTIIKQVSQAQTTVQPSATLQRSPGVQPQLVLGGAAQTASLGTATAVQTGTPQRTVPGATTTSSAATETMENVKKCKNFLSTLIKLASSGKQSTETAANVKELVQNLLDGKIEAEDFTSRLYRELNSSPQPYLVPFLKRSLPALRQLTPDSAAFIQQSQQQPPPPTSQATTALTAVVLSSSVQRTAGKTAATVTSALQPPVLSLTQPTQVGVGKQGQPTPLVIQQPPKPGALIRPPQVTLTQTPMVALRQPHNRIMLTTPQQIQLNPLQPVPVVKPAVLPGTKALSAVSAQAAAAQKNKLKEPGGGSFRDDDDINDVASMAGVNLSEESARILATNSELVGTLTRSCKDETFLLQAPLQRRILEIGKKHGITELHPDVVSYVSHATQQRLQNLVEKISETAQQKNFSYKDDDRYEQASDVRAQLKFFEQLDQIEKQRKDEQEREILMRAAKSRSRQEDPEQLRLKQKAKEMQQQELAQMRQRDANLTALAAIGPRKKRKVDCPGPGSGAEGSGPGSVVPGSSGVGTPRQFTRQRITRVNLRDLIFCLENERETSHSLLLYKAFLK

SEQ ID NO: 902929 - protein, 139 aa, Homo sapiens
GKKKERRGTIAEQMQMKGLGASQEEREREGRQERGVKAETEGKEMQQQELAQMRQRDANLTALAAIGPRKKRKVDCPGPGSGAEGSGPGSVVPGSSGVGTPRQFTRQRITRVNLRDLIFCLENERETSHSLLLYKAFLK

SEQ ID NO: 902930 - protein, 1049 aa, Homo sapiens
MAAGSDLLDEVFFNSEVDEKVVSDLVGSLESQLAASAAHHHHLAPRTPEVRAAAAGALGNHVVSGSPAGAAGAGPAAPAEGAPGAAPEPPPAGRARPGGGGPQRPGPPSPRRPLVPAGPAPPAAKLRPPPEGSAGACAPVPAAAAVAAGPEPAPAGPAKPAGPAALAARAGPGPGPGPGPGPGPGKPAGPGAAQTLNGSAALLNSHHAAAPAVSLVNNGPAALLPLPKPAAPGTVIQTPPFVGAAAPPAPAAPSPPAAPAPAAPAAAPPPPPPAPATLARPPGHPAGPPTAAPAVPPPAAAQNGGSAGAAPAPAPAAGGPAGVSGQPGPGAAAAAPAPGVKAESPKRVVQAAPPAAQTLAASGPASTAASMVIGPTMQGALPSPAAVPPPAPGTPTGLPKGAAGAVTQSLSRTPTATTSGIRATLTPTVLAPRLPQPPQNPTNIQNFQLPPGMVLVRSENGQLLMIPQQALAQMQAQAHAQPQTTMAPRPATPTSAPPVQISTVQAPGTPIIARQVTPTTIIKQVSQAQTTVQPSATLQRSPGVQPQLVLGGAAQTASLGTATAVQTGTPQRTVPGATTTSSAATETMENVKKCKNFLSTLIKLASSGKQSTETAANVKELVQNLLDGKIEAEDFTSRLYRELNSSPQPYLVPFLKRSLPALRQLTPDSAAFIQQSQQQPPPPTSQATTALTAVVLSSSVQRTAGKTAATVTSALQPPVLSLTQPTQVGVGKQGQPTPLVIQQPPKPGALIRPPQVTLTQTPMVALRQPHNRIMLTTPQQIQLNPLQPVPVVKPAVLPGTKALSAVSAQAAAAQKNKLKEPGGGSFRDDDDINDVASMAGVNLSEESARILATNSELVGTLTRSCKDETFLLQAPLQRRILEIGKKHGITELHPDVVSYVSHATQQRLQNLVEKISETAQQKNFSYKDDDRYEQASDVRAQLKFFEQLDQIEKQRKDEQEREILMRAAKSRSRQEDPEQLRLKQKAKEMQQQELAQMRQRDANLTALAAIGPRKKRKVDCPGPGSGAEASVALSKQRAQGERPGWSPCR

SEQ ID NO: 902931 - protein, 637 aa, Homo sapiens
MAAGSDLLDEVFFNSEVDEKVVSDLVGSLESQLAASAAHHHHLAPRTPEVRAAAAGALGNHVVSGSPAGAAGAGPAAPAEGAPGAAPEPPPAGRARPGGGGPQRPGPPSPRRPLVPAGPAPPAAKLRPPPEGSAGACAPVPAAAAVAAGPEPAPAGPAKPAGPAALAARAGPGPGPGPGPGPGPGKPAGPGAAQTLNGSAALLNSHHAAAPAVSLVNNGPAALLPLPKPAAPGTVIQTPPFVGAAAPPAPAAPSPPAAPAPAAPAAAPPPPPPAPATLARPPGHPAGPPTAAPAVPPPAAAQNGGSAGAAPAPAPAAGGPAGVSGQPGPGAAAAAPAPGVKAESPKRVVQAAPPAAQTLAASGPASTAASMVIGPTMQGALPSPAAVPPPAPGTPTGLPKGAAGAVTQSLSRTPTATTSGIRATLTPTVLAPRLPQPPQNPTNIQNFQLPPGMVLVRSENGQLLMIPQQALAQMQAQAHAQPQTTMAPRPATPTSAPPVQISTVQAPGTPIIARQVTPTTIIKQVSQAQTTVQPSATLQRSPGVQPQLVLGGAAQTASLGTATAVQTGTPQRTVPGATTTSSAATETMENVKKCKNFLSTLIKLASSGKQSTETAANVKELVQNLLVRNLDFTFPFP

SEQ ID NO: 902932 - protein, 1083 aa, Homo sapiens; identical to SEQ ID NO: 902928

SEQ ID NO: 902933 - protein, 119 aa, Homo sapiens [sequence omitted]

SEQ ID NO: 902934 - protein, 758 aa, Homo sapiens
MAAGSDLLDEVFFNSEVDEKVVSDLVGSLESQLAASAAHHHHLAPRTPEVRAAAAGALGNHVVSGSPAGAAGAGPAAPAEGAPGAAPEPPPAGRARPGGGGPQRPGPPSPRRPLVPAGPAPPAAKLRPPPEGSAGACAPVPAAAAVAAGPEPAPAGPAKPAGPAALAARAGPGPGPGPGPGPGPGKPAGPGAAQTLNGSAALLNSHHAAAPAVSLVNNGPAALLPLPKPAAPGTVIQTPPFVGAAAPPAPAAPSPPAAPAPAAPAAAPPPPPPAPATLARPPGHPAGPPTAAPAVPPPAAAQNGGSAGAAPAPAPAAGGPAGVSGQPGPGAAAAAPAPGVKAESPKRVVQAAPPAAQTLAASGPASTAASMVIGPTMQGALPSPAAVPPPAPGTPTGLPKGAAGAVTQSLSRTPTATTSGIRATLTPTVLAPRLPQPPQNPTNIQNFQLPPGMVLVRSENGQLLMIPQQALAQMQAQAHAQPQTTMAPRPATPTSAPPVQISTVQAPGTPIIARQVTPTTIIKQVSQAQTTVQPSATLQRSPGVQPQLVLGGAAQTASLGTATAVQTGTPQRTVPGATTTSSAATETMENVKKCKNFLSTLIKLASSGKQSTETAANVKELVQNLLDGKIEAEDFTSRLYRELNSSPQPYLVPFLKRSLPALRQLTPDSAAFIQQSQQQPPPPTSQATTALTAVVLSSSVQRTAGKTAATVTSALQPPVLSLTQPTQVGVGKQGQPTPLVIQQPPKPGALIRPPQSLW

SEQ ID NO: 902935 - protein, 275 aa, Homo sapiens
MTDDKDVLRDVWFGRIPTCFTLYQDEITEREAEPYYLLLPRVSYLTLVTDKVKKHFQKVMRQEDISEIWFEYEGTPLKWHYPIGLLFDLLASSSALPWNITVHFKSFPEKDLLHCPSKDAIEAHFMSCMKEADALKHKSQVINEMQKKDHKQLWMGLQNDRFDQFWAINRKLMEYPAEENGFRYIPFRIYQTTTERPFIQKLFRPVAADGQLHTLGDLLKEVCPSAIDPEDGEKKNQVMIHGIEPMLETPLQWLSEHLSYPDNFLHISIIPQPTD

SEQ ID NO: 902936 - protein, 275 aa, Homo sapiens; identical to SEQ ID NO: 902935

SEQ ID NO: 902937 - protein, 197 aa, Homo sapiens
MHYPIGLLFDLLASSSALPWNITVHFKSFPEKDLLHCPSKDAIEAHFMSCMKEADALKHKSQVINEMQKKDHKQLWMGLQNDRFDQFWAINRKLMEYPAEENGFRYIPFRIYQTTTERPFIQKLFRPVAADGQLHTLGDLLKEVCPSAIDPEDGEKKNQVMIHGIEPMLETPLQWLSEHLSYPDNFLHISIIPQPTD

SEQ ID NO: 902938 - protein, 187 aa, Homo sapiens
TASPSFYLSTYSPPRGVSFPEKDLLHCPSKDAIEAHFMSCMKEADALKHKSQVINEMQKKDHKQLWMGLQNDRFDQFWAINRKLMEYPAEENGFRYIPFRIYQTTTERPFIQKLFRPVAADGQLHTLGDLLKEVCPSAIDPEDGEKKNQVMIHGIEPMLETPLQWLSEHLSYPDNFLHISIIPQPTD

SEQ ID NO: 902939 - protein, 119 aa, Homo sapiens
MANDRFDQFWAINRKLMEYPAEENGFRYIPFRIYQTTTERPFIQKLFRPVAADGQLHTLGDLLKEVCPSAIDPEDGEKKNQVMIHGIEPMLETPLQWLSEHLSYPDNFLHISIIPQPTD

SEQ ID NO: 902940 - protein, 275 aa, Homo sapiens; identical to SEQ ID NO: 902935

SEQ ID NO: 902941 - protein, 275 aa, Homo sapiens; identical to SEQ ID NO: 902935

SEQ ID NO: 902942 - protein, 106 aa, Homo sapiens
WGDFKDVGTAWMGLQNDRFDQFWAINRKLMEYPAEENGFRYIPFRIYQTTTERPFIQKLFRPVAADGQLHTLGDLLKEVCPSAIDPEGNTISNIKTFLSFSVTEVK

SEQ ID NO: 902943 - protein, 81 aa, Homo sapiens
QDRDKPAQIRFSNISAAKAVADAIRTSLGPKGMDENDGEKKNQVMIHGIEPMLETPLQWLSEHLSYPDNFLHISIIPQPTD

SEQ ID NO: 902944 - protein, 249 aa, Homo sapiens [sequence omitted]

SEQ ID NO: 902945 - protein, 195 aa, Homo sapiens
RELQSYAAFGAVVTRVSLPAPRCPALGGLASGPGESGPALLQVCGAKCPGGAPRGENREKEETTRIGPGVMESKEKRAVNSLSMENANQENEEKEQVANKGEPLALPLDAGEYCVPRGNRRRFRVRQPILQYRWDMMHRLGEPQARMREENMERIGEEVRQLMEKLREKQLSHSLRAVSTDPPHHDHHDEFCLMP

SEQ ID NO: 902946 - protein, 255 aa, Homo sapiens
RELQSYAAFGAVVTRVSLPAPRCPALGGLASGPGESGPALLQVCGAKCPGGAPRGENREKEETTRIGPGVMESKEKRAVNSLSMENANQEKKKKTSENSFSLSSGSPLCEGGPPANVLWRHSWQVGWVGGGNVASKFPWIKEGIRQDLTGIGAQITWKGPANSFRRNNRDVDSHRQRDWWAVETPGKPRRAKGWSGGGLIKRGSIRATGKALAHLPFGGGTNLLTKDWFCGHGFSKLSDHLDRDRPSVRPRTGAW

SEQ ID NO: 902947 - protein, 195 aa, Homo sapiens; identical to SEQ ID NO: 902945

SEQ ID NO: 902948 - protein, 214 aa, Homo sapiens
GVAPPPVGGGAEAGGGGPRMRRRQLAWGRDHAGGGGAGGGRFRERGGLRGGGGAWWGRGLCGLRRGAEWAAGMRGTSCVGGGAESPGGAGLSEGPRGRWLRLAPVCAYFLCVSLAAVLLAVYYGLIWVPTRSPAAPAGPQPSAPSPPCAARPGVPPVPAPAAASLSCLLGVPGGPRPQLQLPLSRRRRYSDPDRRPSRQTPRETPEAAEGRRPG

SEQ ID NO: 902949 - protein, 214 aa, Homo sapiens; identical to SEQ ID NO: 902948

SEQ ID NO: 902950 - protein, 56 aa, Homo sapiens
MLSTEPTAHLPLHLPESVSICNKRQPRQRRNRHTRRKHKHGGATKYPRGHTKTTFW

SEQ ID NO: 902951 - protein, 231 aa, Homo sapiens
GVAPPPVGGGAEAGGGGPRMRRRQLAWGRDHAGGGGAGGGRFRERGGLRGGGGAWWGRGLCGLRRGAEWAAGMRGTSCVGGGAESPGGAGLSEGPRGRWLRLAPVCAYFLCVSLAAVLLAVYYGLIWVPTRSPAAPAGPQPSAPSPPCAARPGVPPVPAPAAASLSCLLGVPGGPRPQLQLPLSRRRRYSDPDRRPSRQTPRETPEAAEGPCLLQLLCGQAGSSTIRKIPS

SEQ ID NO: 902952 - protein, 389 aa, Homo sapiens
MKLLTRAGSFSRFYSLKVAPKVKATAAPAGAPPQPQDLEFTKLPNGLVIASLENYSPVSRIGLFIKAGSRYEDFSNLGTTHLLRLTSSLTTKGASSFKITRGIEAVGGKLSVTATRENMAYTVECLRGDVDILMEFLLNVTTAPEFRRWEVADLQPQLKIDKAVAFQNPQTHVIENLHAAAYRNALANPLYCPDYRIGKVTSEELHYFVQNHFTSARMALIGLGVSHPVLKQVAEQFLNMRGGLGLSGAKANYRGGEIREQNGDSLVHAAFVAESAVAGSAEANAFSVLQHVLGAGPHVKRGSNTTSHLHQAVAKATQQPFDVSAFNASYSDSGLFGIYTISQATAAGDVIKAAYNQVKTIAQGNLSNTDVQAAKNKLKAGIPNVSGVF

SEQ ID NO: 902953 - protein, 151 aa, Homo sapiens
PFNSLHSHMGAVYLSSHSVSEPETDEHLVHAAFVAESAVAGSAEANAFSVLQHVLGAGPHVKRGSNTTSHLHQAVAKATQQPFDVSAFNASYSDSGLFGIYTISQATAAGDVIKAAYNQVKTIAQGNLSNTDVQAAKNKLKAGIPNVSGVF

SEQ ID NO: 902954 - protein, 192 aa, Homo sapiens
GSAEANAFSVLQHVLGAGPHVNVTTAPEFRRWEVADLQPQLKIDKAVAFQNPQTHVIENLHAAAYRNALANPLYCPDYRIGKVTSEELHYFVQNHFTSARMALIGLGVSHPVLKQVAEQFLNMRGGLGLSGAKANYRGGEIREQNGDSLVHAAFVAESAVAGSAEANAFSVLQHVPFDVSAFNAVNQILLWD

SEQ ID NO: 902955 - protein, 389 aa, Homo sapiens; identical to SEQ ID NO: 902952

SEQ ID NO: 902956 - protein, 389 aa, Homo sapiens; identical to SEQ ID NO: 902952

SEQ ID NO: 902957 - protein, 389 aa, Homo sapiens; identical to SEQ ID NO: 902952

SEQ ID NO: 902958 - protein, 389 aa, Homo sapiens; identical to SEQ ID NO: 902952

SEQ ID NO: 902959 - protein, 389 aa, Homo sapiens; identical to SEQ ID NO: 902952

SEQ ID NO: 902960 - protein, 380 aa, Homo sapiens
MKLLTRAGSFSRFYSLKVAPKVKATAAPAGAPPQPQDLEFTKLPNGLVIASLENYSPVSRIGLFIKAGSRYEDFSNLGTTHLLRLTSSLTTKGASSFKITRGIEAVGGKLSVTATRENMAYTVECLRGDVDILMEFLLNVTTAPEFRRWEVADLQPQLKIDKAVAFQNPQTHVIENLHAAAYRNALANPLYCPDYRIGKVTSEELHYFVQNHFTSARMALIGLGVSHPVLKQVAEQFLNMRGGLGLSGAKANYRGGEIREQNGDSLVHAAFVAESAVAGSAEANAFSVLQHVLGAGPHVKRGSNTTSHLHQAVAKATQQPFDVSAFNASYSDSGLFGIYTISQATAAGDVIKAAYNQVKTIAQGNLSNTDVQAAKGGQMR

SEQ ID NO: 902961 - protein, 370 aa, Homo sapiens
MKLLTRAGSFSRFYSLKVAPKVKATAAPAGAPPQPQDLEFTKLPNGLVIASLENYSPVSRIGLFIKAGSRYEDFSNLGTTHLLRLTSSLTTKGASSFKITRGIEAVGGKLSDILMEFLLNVTTAPEFRRWEVADLQPQLKIDKAVAFQNPQTHVIENLHAAAYRNALANPLYCPDYRIGKVTSEELHYFVQNHFTSARMALIGLGVSHPVLKQVAEQFLNMRGGLGLSGAKANYRGGEIREQNGDSLVHAAFVAESAVAGSAEANAFSVLQHVLGAGPHVKRGSNTTSHLHQAVAKATQQPFDVSAFNASYSDSGLFGIYTISQATAAGDVIKAAYNQVKTIAQGNLSNTDVQAAKNKLKAGIPNVSGVF

SEQ ID NO: 902962 - protein, 332 aa, Homo sapiens
MKLLTRAGSFSRFYSLKVAPKVKATAAPAGAPPQPQDLEFTKLPNGLVIASLENYSPVSRIGLFIKAGSRYEDFSNLGTTHLLRLTSSLTTKGASSFKITRGIEAVGGKLSVTATRENMAYTVECLRGDVDILMEFLLNVTTAPEFRRWEVADLQPQLKIDKAVAFQNPQTHVIENLHAAAYRNALANPLYCPDYRIGKVTSEELHYFVQNHFTSARMALIGLGVSHPVLKQVAEQFLNMRGGLGLSGAKANYRGGEIREQNGDSLVHAAFVAESAVAGSAEANAFSVLQHVLGAGPHVKRGSNTTSHLHSGQPLHSGQPLHSGQPLHSGQP

SEQ ID NO: 902963 - protein, 172 aa, Homo sapiens
MALIGLGVSHPVLKQVAEQFLNMRGGLGLSGAKANYRGGEIREQNGDSLVHAAFVAESAVAGSAEANAFSVLQHVLGAGPHVKRGSNTTSHLHQAVAKATQQPFDVSAFNASYSDSGLFGIYTISQATAAGDVIKAAYNQVKTIAQGNLSNTDVQAAKNKLKAGIPNVSGVF

SEQ ID NO: 902964 - protein, 213 aa, Homo sapiens
MKLLTRAGSFSRFYSLKVAPKVKATAAPAGAPPQPQDLEFTKLPNGLVIASLENYSPVSRIGLFIKAGSRYEDFSNLGTTHLLRLTSSLTTKGASSFKITRGIEAVGGKLSVTATRENMAYTVECLRGDVDILMEFLLNVTTAPEFRRWEVADLQPQLKIDKAVAFQNPQTHVIENLHAAAYRNALANPLYCPDYRIGKVTSEEVPIKHILKC

SEQ ID NO: 902965 - protein, 158 aa, Homo sapiens
MKLLTRAGSFSRFYSLKVAPKVKATAAPAGAPPQPQDLEFTKLPNGLVIASLENYSPVSRIGLFIKAGSRYEDFSNLGTTHLLRLTSSLTTKGASSFKITRGIEAVGGKLRVFTASSTRSRFYLKKPLCLLIHKKHLLICSSFIIRLQPFSHIFRPHF

SEQ ID NO: 902966 - protein, 114 aa, Homo sapiens
MALIGLGVSHPVLKQVAEQFLNMRGGLGLSGAKANYRGGEIREQNGDSLVHAAFVAESAVAGSAEANAFSVLQHVLGAGPHVKRGSNTTSHLHQAVAKATQQPFDKNKSAAGYR

SEQ ID NO: 902967 - protein, 389 aa, Homo sapiens; identical to SEQ ID NO: 902952

SEQ ID NO: 902968 - protein, 389 aa, Homo sapiens; identical to SEQ ID NO: 902952

SEQ ID NO: 902969 - protein, 366 aa, Homo sapiens
MKLLTRAGSFSRFYSLKVAPKVKATAAPAGAPPQPQDLEFTKLPNGLVIASLENYSPVSRIGLFIKAGSRYEDFSNLGTTHLLRLTSSLTTKGASSFKITRGIEAVGGKLSVTATRENMAYTVECLRGDVDILMEFLLNVTTAPEFRRWEVADLQPQLKIDKAVAFQNPQTHVIENLHAAAYRNALANPLYCPDYRIGKVTSEELHYFVQNHFTSARMALIGLGVSHPVLKQVAEQFLNMRGGLGLSGAKANYRGGEIREQNGDSLVHAAFVAESAVAGSAEANAFSVLQHVLGAGPHVKRGSNTTSHLHQAVAKATQQPFDVSAFNASYSDSGLFGIYTISQATAAGDVIKAAYNQVEQAESWDT

SEQ ID NO: 902970 - protein, 366 aa, Homo sapiens; identical to SEQ ID NO: 902969

SEQ ID NO: 902971 - protein, 295 aa, Homo sapiens
MKLLTRAGSFSRFYSLKVAPKVKATAAPAGAPPQPQDLEFTKLPNGLVIASLENYSPVSRIGLFIKAGSRYEDFSNLGTTHLLRLTSSLTTKGASSFKITRGIEAVGGKLSVTATRENMAYTVECLRGDVDILMEFLLNVTTAPEFRRWEVADLQPQLKIDKAVAFQNPQTHVIENLHAAAYRNALANPLYCPDYRIGKVTSEELHYFVQNHFTSARMALIGLGVSHPVLKQVAEQFLNMRGGLGLSGAKANYRGGEIREQNGDSLVHAAFVAESAVAGSAEANAFSVLQHVRTS

SEQ ID NO: 902972 - protein, 324 aa, Homo sapiens
MKLLTRAGSFSRFYSLKVAPKVKATAAPAGAPPQPQDLEFTKLPNGLVIASLENYSPVSRIGLFIKAGSRYEDFSNLGTTHLLRLTSSLTTKGASSFKITRGIEAVGGKLSVTATRENMAYTVECLRGDVDILMEFLLNVTTAPEFRRWEVADLQPQLKIDKAVAFQNPQTHVIENLHAAAYRNALANPLYCPDYRIGKVTSEELHYFVQNHFTSARMALIGLGVSHPVLKQVAEQFLNMRGGLGLSGAKANYRGGEIREQNGDSLVHAAFVAESAVAGSAEANAFSVLQHVHPLGVGPCQSELHTSLVSGLLRPGRLSLTPPA

SEQ ID NO: 902973 - protein, 194 aa, Homo sapiens
MCLKNWMPVARAVKSLWATDECVICGSLQTIQVAGLSIDPDAKPRMTVKVCYFPMDLTLDYQWSWAPRHVFCDSLEQLTRFLLVDEEANAFSVLQHVLGAGPHVKRGSNTTSHLHQAVAKATQQPFDVSAFNASYSDSGLFGIYTISQATAAGDVIKAAYNQVKTIAQGNLSNTDVQAAKNKLKAGIPNVSGVF

SEQ ID NO: 902974 - protein, 190 aa, Homo sapiens
MKLLTRAGSFSRFYSLKVAPKVKATAAPAGAPPQPQDLEFTKLPNGLVIASLENYSPVSRIGLFIKAGSRYEDFSNLGTTHLLRLTSSLTTKGASSFKITRGIEAVGGKLSVTATRENMAYTVECLRGDVDILMEFLLNVTTAPEFRRWEVADLQPQLKIDKAVAFQNPQTHVIEICMRTAGDVSGCLYQ

SEQ ID NO: 902975 - protein, 125 aa, Homo sapiens
MDSGPVQAENHDTFLLAMLLSVLLPLLPGAGLAWCCYRLPGAHLQRCSWGCRRDPACSGPKDGPHRDHPLGGVHPMELGPTATGQPWPLDPENSHEPSSHPEKPLPAVSPDPQADQVQMPRSCLW

SEQ ID NO: 902976 - protein, 309 aa, Homo sapiens
MGDCDLPEFCTGTSSHCPPDVYLLDGSPCARGSGYCWDGACPTLEQQCQQLWGPGSHPAPEACFQVVNSAGDAHGNCGQDSEGHFLPCAGRDALCGKLQCQGGKPSLLAPHMVPVDSTVHLDGQEVTCRGALALPSAQLDLLGLGLVEPGTQCGPRMVCNSNHNCHCAPGWAPPFCDKPGFGGSMDSGPVQAENHDTFLLAMLLSVLLPLLPGAGLAWCCYRLPGAHLQRCSWGCRRDPACSGPKDGPHRDHPLGGVHPMELGPTATGQPWPLDPENSHEPSSHPEKPLPAVSPDPQADQVQMPRSCLW

SEQ ID NO: 902977 - protein, 427 aa, Homo sapiens
PPAGSRSRGSSRRVPPSPAVHSPSSCALSSGVPAMSDEREVAEAATGEDASSPPPKTEAASDPQHPAASEGAAAAAASPPLLRCLVLTGFGGYDKVKLQSRPAAPPAPGPGQLTLRLRACGLNFADLMARQGLYDRLPPLPVTPGMEGAGVVIAVGEGVSDRKAGDRVMVLNRSGMWQEEVTVPSVQTFLIPEAMTFEEAAALLVNYITAYMVLFDFGNLQPGHSVLVHMAAGGVGMAAVQLCRTVENVTVFGTASASKHEALKENGVTHPIDYHTTDYVDEIKKISPKGVDIVMDPLGGSDTAKGYNLLKPMGKVVTYGMANLLTGPKRNLMALARTWWNQFSVTALQLLQANRAVCGFHLGYLDGEVELVSGVVARLLALYNQGHIKPHIDSVWPFEKVADAMKQMQEKKNVGKVLLVPGPEKEN

SEQ ID NO: 902978 - protein, 408 aa, Homo sapiens
MDQPSSCALSSGVPAMSDEREVAEAATGEDASSPPPKTEAASDPQHPAASEGAAAAAASPPLLRCLVLTGFGGYDKVKLQSRPAAPPAPGPGQLTLRLRACGLNFADLMARQGLYDRLPPLPVTPGMEGAGVVIAVGEGVSDRKAGDRVMVLNRSGMWQEEVTVPSVQTFLIPEAMTFEEAAALLVNYITAYMVLFDFGNLQPGHSVLVHMAAGGVGMAAVQLCRTVENVTVFGTASASKHEALKENGVTHPIDYHTTDYVDEIKKISPKGVDIVMDPLGGSDTAKGYNLLKPMGKVVTYGMANLLTGPKRNLMALARTWWNQFSVTALQLLQANRAVCGFHLGYLDGEVELVSGVVARLLALYNQGHIKPHIDSVWPFEKVADAMKQMQEKKNVGKVLLVPGPEKEN

SEQ ID NO: 902979 - protein, 147 aa, Homo sapiens
MTTSSGKKGALHCNLDDHDSVDKIVTQEYHTVNGHNCEVRKALSQQEMASASSSQRGRSGSGNFGGGRGGGFGGNDNFGRGGNFSGRGGFGGNRGGGGYGGSGDGYNGFGMMGGEMEQGSTEWDGQDLGHCNQNGDFLGREVTPSTH

SEQ ID NO: 902980 - protein, 408 aa, Homo sapiens; identical to SEQ ID NO: 902978

SEQ ID NO: 902981 - protein, 427 aa, Homo sapiens; identical to SEQ ID NO: 902977

SEQ ID NO: 902982 - protein, 427 aa, Homo sapiens; identical to SEQ ID NO: 902977

SEQ ID NO: 902983 - protein, 427 aa, Homo sapiens; identical to SEQ ID NO: 902977

SEQ ID NO: 902984 - protein, 427 aa, Homo sapiens; identical to SEQ ID NO: 902977

SEQ ID NO: 902985 - protein, 252 aa, Homo sapiens
MWQEEVTVPSVQTFLIPEAMTFEEAAALLVNYITAYMVLFDFGNLQPGHSVLVHMAAGGVGMAAVQLCRTVENVTVFGTASASKHEALKENGVTHPIDYHTTDYVDEIKKISPKGVDIVMDPLGGSDTAKGYNLLKPMGKVVTYGMANLLTGPKRNLMALARTWWNQFSVTALQLLQANRAVCGFHLGYLDGEVELVSGVVARLLALYNQGHIKPHIDSVWPFEKVADAMKQMQEKKNVGKVLLVPGPEKEN

SEQ ID NO: 902986 - protein, 427 aa, Homo sapiens; identical to SEQ ID NO: 902977

SEQ ID NO: 902987 - protein, 427 aa, Homo sapiens; identical to SEQ ID NO: 902977

SEQ ID NO: 902988 - protein, 123 aa, Homo sapiens
MFQPTVKHIGKVVTYGMANLLTGPKRNLMALARTWWNQFSVTALQLLQANRAVCGFHLGYLDGEVELVSGVVARLLALYNQGHIKPHIDSVWPFEKVADAMKQMQEKKNVGKVLLVPGPEKEN

SEQ ID NO: 902989 - protein, 118 aa, Homo sapiens
RLGSNNITMESAMDGNCGPKRNLMALARTWWNQFSVTALQLLQANRAVCGFHLGYLDGEVELVSGVVARLLALYNQGHIKPHIDSVWPFEKVADAMKQMQEKKNVGKVLLVPGPEKEN

SEQ ID NO: 902990 - protein, 194 aa, Homo sapiens
PPAGSRSRGSSRRVPPSPAVHSPSSCALSSGVPAMSDEREVAEAATGEDASSPPPKTEAASDPQHPAASEGAAAAAASPPLLRCLVLTGFGGYDKVKLQSRPAAPPAPGPGQLTLRLRACGLNFADLMARQGLYDRLPPLPVTPGMEGAGVVIAVGEGVSDRKAGDRVMVLNRSGMWQEEVTVPSVQTFLIPDL

SEQ ID NO: 902991 - protein, 134 aa, Homo sapiens
INQDLESRKEMTYRPLRRRLTQIKQKVDSLLKNLENIATEQSKQAVEMKNDKSEEETEQQLLKTDETNVKKVLLYSPVPSLFWWSWGFSPPQSHNTAKNLCMCHWVGQPQASWGGRAKTGALIVVCAMSRLYGG

SEQ ID NO: 902992 - protein, 285 aa, Homo sapiens
MDQPSSCALSSGVPAMSDEREVAEAATGEDASSPPPKTEAASDPQHPAASEGAAAAAASPPLLRCLVLTGFGGYDKVKLQSRPAAPPAPGPGQLTLRLRACGLNFADLMARQGLYDRLPPLPVTPGMEGAGVVIAVGEGVSDRKAGDRVMVLNRSGMWQEEVTVPSVQTFLIPEAMTFEEAAALLVNYITAYMVLFDFGNLQPGHSVLVHMAAGGVGMAAVQLCRTVENVTVFGTASASKHEALKENGVTHPIDYHTTDYVDEIKKISPKDGIALTLVVCRTLNM

SEQ ID NO: 902993 - protein, 92 aa, Homo sapiens
MVLNRSGMWQEEVTVPSVQTFLIPEAMTFEEAAALLVNYITAYMVLFDFGNLQPGHSVLVHMAAEVTGPLTLSPLTPPRFSSPFQSVDPLVP

SEQ ID NO: 902994 - protein, 427 aa, Homo sapiens; identical to SEQ ID NO: 902977

SEQ ID NO: 902995 - protein, 360 aa, Homo sapiens
PPAGSRSRGSSRRVPPSPAVHSPSSCALSSGVPAMSDEREVAEAATGEDASSPPPKTEAASDPQHPAASEGAAAAAASPPLLRCLVLTGFGGYDKVKLQSRPAAPPAPGPGQLTLRLRACGLNFADLMARQGLYDRLPPLPVTPGMEGAGVVIAVGEGVSDRKAGDRVMVLNRSGMWQEEVTVPSVQTFLIPEAMTFEEAAALLVNYITAYMVLFDFGNLQPGHSVLVHMAAGGVGMAAVQLCRTVENVTVFGTASASKHEALKENGVTHPIDYHTTDYVDEIKKISPKGVDIVMDPLGGSDTAKGYNLLKPMGKVVTYGPQTEPDGPGPDMVESVQRDSSAAAAGQPGCVWLPPGLPGW

SEQ ID NO: 902996 - protein, 427 aa, Homo sapiens; identical to SEQ ID NO: 902977

SEQ ID NO: 902997 - protein, 427 aa, Homo sapiens; identical to SEQ ID NO: 902977

SEQ ID NO: 902998 - protein, 281 aa, Homo sapiens
HFPPGKYRISCPGQESDAGDRVMVLNRSGMWQEEVTVPSVQTFLIPEAMTFEEAAALLVNYITAYMVLFDFGNLQPGHSVLVHMAAGGVGMAAVQLCRTVENVTVFGTASASKHEALKENGVTHPIDYHTTDYVDEIKKISPKGVDIVMDPLGGSDTAKGYNLLKPMGKVVTYGMANLLTGPKRNLMALARTWWNQFSVTALQLLQANRAVCGFHLGYLDGEVELVSGVVARLLALYNQGHIKPHIDSVWPFEKVADAMKQMQEKKNVGKVLLVPGPEKEN

SEQ ID NO: 902999 - protein, 191 aa, Homo sapiens [sequence omitted]

SEQ ID NO: 903000 - protein, 119 aa, Homo sapiens
HLEIHTIRMEAYYDGNRCGPKRNLMALARTWWNQFSVTALQLLQANRAVCGFHLGYLDGEVELVSGVVARLLALYNQGHIKPHIDSVWPFEKVADAMKQMQEKKNVGKVLLVPGPEKEN

SEQ ID NO: 903001 - protein, 129 aa, Homo sapiens
NSARGFLYWDQSKNPSTFPLQLGEALLPSQSREAAYQTQPKTLFTWVGRWSREVQSGMVRTWAIATKMGTSWVGRSLPLLTELGLGRVIASPPCCVPCAFTSASSFLPSLPRHLPKELKRQLRIWGQSL

SEQ ID NO: 903002 - protein, 191 aa, Homo sapiens [sequence omitted]

SEQ ID NO: 903003 - protein, 500 aa, Homo sapiens
MKCTAREWLRVTTVLFMARAIPAMVVPNATLLEKLLEKYMDEDGEWWIAKQRGKRAITDNDMQSILDLHNKLRSQVYPTASNMEYMTWDVELERSAESWAESCLWEHGPASLLPSIGQNLGAHWGRYRPPTFHVQSWYDEVKDFSYPYEHECNPYCPFRCSGPVCTHYTQVVWATSNRIGCAINLCHNMNIWGQIWPKAVYLVCNYSPKGNWWGHAPYKHGRPCSACPPSFGGGCRENLCYKEGSDRYYPPREEETNEIERQQSQVHDTHVRTRSDDSSRNEVISAQQMSQIVSCEVRLRDQCKGTTCNRYECPAGCLDSKAKVIGSVHYEMQSSICRAAIHYGIIDNDGGWVDITRQGRKHYFIKSNRNGIQTIGKYQSANSFTVSKVTVQAVTCETTVEQLCPFHKPASHCPRVYCPRNCMQANPHYARVIGTRVYSDLSSICRAAVHAGVVRNHGGYVDVMPVDKRKTYIASFQNGIFSESLQNPPGGKAFRVFAVV

SEQ ID NO: 903004 - protein, 425 aa, Homo sapiens
YLRHALILTAETWDVELERSAESWAESCLWEHGPASLLPSIGQNLGAHWGRYRPPTFHVQSWYDEVKDFSYPYEHECNPYCPFRCSGPVCTHYTQVVWATSNRIGCAINLCHNMNIWGQIWPKAVYLVCNYSPKGNWWGHAPYKHGRPCSACPPSFGGGCRENLCYKEGSDRYYPPREEETNEIERQQSQVHDTHVRTRSDDSSRNEVISAQQMSQIVSCEVRLRDQCKGTTCNRYECPAGCLDSKAKVIGSVHYEMQSSICRAAIHYGIIDNDGGWVDITRQGRKHYFIKSNRNGIQTIGKYQSANSFTVSKVTVQAVTCETTVEQLCPFHKPASHCPRVYCPRNCMQANPHYARVIGTRVYSDLSSICRAAVHAGVVRNHGGYVDVMPVDKRKTYIASFQNGIFSESLQNPPGGKAFRVFAVV

SEQ ID NO: 903005 - protein, 500 aa, Homo sapiens; identical to SEQ ID NO: 903003

SEQ ID NO: 903006 - protein, 500 aa, Homo sapiens; identical to SEQ ID NO: 903003

SEQ ID NO: 903007 - protein, 304 aa, Homo sapiens
LNLLSLTEGSDRYYPPREEETNEIERQQSQVHDTHVRTRSDDSSRSKGQETRLCREWSGEVVTVLGGGGGGGGGGGGGVGGGGGWVWWGGQQMSQIVSCEVRLRDQCKGTTCNRYECPAGCLDSKAKVIGSVHYEMQSSICRAAIHYGIIDNDGGWVDITRQGRKHYFIKSNRNGIQTIGKYQSANSFTVSKVTVQAVTCETTVEQLCPFHKPASHCPRVYCPRNCMQANPHYARVIGTRVYSDLSSICRAAVHAGVVRNHGGYVDVMPVDKRKTYIASFQNGIFSESLQNPPGGKAFRVFAVV

SEQ ID NO: 903008 - protein, 281 aa, Homo sapiens
MKCTAREWLRVTTVLFMARAIPAMVVPNATLLEKLLEKYMDEDGEWWIAKQRGKRAITDNDMQSILDLHNKLRSQVYPTASNMEYMTWDVELERSAESWAESCLWEHGPASLLPSIGQNLGAHWGRYRPPTFHVQSWYDEVKDFSYPYEHECNPYCPFRCSGPVCTHYTQVVWATSNRIGCAINLCHNMNIWGQIWPKAVYLVCNYSPKGNWWGHAPYKHGRPCSACPPSFGGGCRENLCYKEGSDRYYPPREEETNEIERQQSQVHDTHVRTRSDDSSRN

SEQ ID NO: 903009 - protein, 167 aa, Homo sapiens
GPAASGRSSRLRAPSLARGHPPPSGESACARALLRGRASQSRCTRSQSVGPPGGGGGHRGERGGRSMAASLRLLGAASGLRYWSRRLRPAAGSFAAVCSRSVASKTPVGFIGLGNMGNPMAKNLMKHGYPLIIYDVFPDACKEFQDAGEQQVVSSPADVADYSGAGF

SEQ ID NO: 903010 - protein, 348 aa, Homo sapiens
ALPRQAAPLGSALLPSRVGTRPRAVRARARAPFSVGEPASPAAHARSLWALREAAEVTAGRGAGAAWQPPYGSSELPPVSGTGAGGCGRQPAALQRVVSSPADVAEKADRIITMLPTSINAIEAYSGANGILKKVKKGSLLIDSSTIDPAVSKELAKEVEKMGAVFMDAPVSGGVGAARSGNLTFMVGGVEDEFAAAQELLGCMGSNVVYCGAVGTGQAAKICNNMLLAISMIGTAEAMNLGIRLGLDPKLLAKILNMSSGRCWSSDTYNPVPGVMDGVPSANNYQGGFGTTLMAKDLGLAQDSATSTKSPILLGSLAHQIYRMMCAKGYSKKDFSSVFQFLREEETF

SEQ ID NO: 903011 - protein, 235 aa, Homo sapiens
MLPTSINAIEAYSGANGILKKVKKGSLLIDSSTIDPAVSKELAKEVEKMGAVFMDAPVSGGVGAARSGNLTFMVGGVEDEFAAAQELLGCMGSNVVYCGAVGTGQAAKICNNMLLAISMIGTAEAMNLGIRLGLDPKLLAKILNMSSGRCWSSDTYNPVPGVMDGVPSANNYQGGFGTTLMAKDLGLAQDSATSTKSPILLGSLAHQIYRMMCAKGYSKKDFSSVFQFLREEETF

SEQ ID NO: 903012 - protein, 163 aa, Homo sapiens [sequence omitted]

SEQ ID NO: 903013 - protein, 384 aa, Homo sapiens
GPAASGRSSRLRAPSLARGHPPPSGESACARALLRGRASQSRCTRSQSVGPPGGGGGHRGERGGRSMAASLRLLGAASGLRYWSRRLRPAAGSFAAVCSRSVASKTPVGFIGLGNMGNPMAKNLMKHGYPLIIYDVFPDACKEFQDAGEQVVSSPADVAEKADRIITMLPTSINAIEAYSGANGILKKVKKGSLLIDSSTIDPAVSKELAKEVEKMGAVFMDAPVSGGVGAARSGNLTFMVGGVEDEFAAAQELLGCMGSNVVYCGAVGTGQAAKICNNMLLAISMIGTAEAMNLGIRLGLDPKLLAVPGVMDGVPSANNYQGGFGTTLMAKDLGLAQDSATSTKSPILLGSLAHQIYRMMCAKGYSKKDFSSVFQFLREEETF

SEQ ID NO: 903014 - protein, 402 aa, Homo sapiens
GPAASGRSSRLRAPSLARGHPPPSGESACARALLRGRASQSRCTRSQSVGPPGGGGGHRGERGGRSMAASLRLLGAASGLRYWSRRLRPAAGSFAAVCSRSVASKTPVGFIGLGNMGNPMAKNLMKHGYPLIIYDVFPDACKEFQDAGEQVVSSPADVAEKADRIITMLPTSINAIEAYSGANGILKKVKKGSLLIDSSTIDPAVSKELAKEVEKMGAVFMDAPVSGGVGAARSGNLTFMVGGVEDEFAAAQELLGCMGSNVVYCGAVGTGQAAKICNNMLLAISMIGTAEAMNLGIRLGLDPKLLAKILNMSSGRCWSSDTYNPVPGVMDGVPSANNYQGGFGTTLMAKDLGLAQDSATSTKSPILLGSLAHQIYRMMCAKGYSKKDFSSVFQFLREEETF

SEQ ID NO: 903015 - protein, 352 aa, Homo sapiens
GPAASGRSSRLRAPSLARGHPPPSGESACARALLRGRASQSRCTRSQSVGPPGGGGGHRGERGGRSMAASLRLLGAASGLRYWSRRLRPAAGSFAAVCSRSVASKTPVGFIGLGNMGNPMAKNLMKHGYPLIIYDVFPDACKEFQDAGEQVVSSPADVAEKADRIITMLPTSINAIEAYSGANGILKKVKKGSLLIDSSTIDPAVSKELAKEVEKMGAVFMDAPVSGGVGAARSGNLTFMVGGVEDEFAAAQELLGCMGSNVVYCGAVGTGQAAKICNNMLLAISMIGTAEAMNLGIRLGLDPKLLAKILNMSSGRCWSSDTYNPVPGVMDGVPSANNYQGGFGTTLMAKVW

SEQ ID NO: 903016 - protein, 277 aa, Homo sapiens
GPAASGRSSRLRAPSLARGHPPPSGESACARALLRGRASQSRCTRSQSVGPPGGGGGHRGERGGRSMAASLRLLGAASGLRYWSRRLRPAAGSFAAVCSRSVASKTPVGFIGLGNMGNPMAKNLMKHGYPLIIYDVFPDACKEFQDAGEQVVSSPADVAEKADRIITMLPTSINAIEAYSGANGILKKVKKGSLLIDSSTIDPAVSKELAKEVEKMGAVFMDAPVSGGVGAARSGNLTFMVGGVEDEFAAAQELLGCMGSNVVYCGAVGTGQRRKRS

SEQ ID NO: 903017 - protein, 402 aa, Homo sapiens; identical to SEQ ID NO: 903014

SEQ ID NO: 903018 - protein, 215 aa, Homo sapiens
GPAASGRSSRLRAPSLARGHPPPSGESACARALLRGRASQSRCTRSQSVGPPGGGGGHRGERGGRSMAASLRLLGAASGLRYWSRRLRPAAGSFAAVCSRSVASKTPVGFIGLGNMGNPMAKNLMKHGYPLIIYDVFPDACKEFQDAGEQVVSSPADVAEKADRIITMLPTSINAIEAYSGANGILKKVKKGSLLIDSSTIDPAVSKELAKEVEV

SEQ ID NO: 903019 - protein, 194 aa, Homo sapiens
DKTSVFVQVHINITISFKNIFLEGGETRRQNRKLHRSSSYPYHKDTKLTNNYTGKSIFLRAKNQAAKICNNMLLAISMIGTAEAMNLGIRLGLDPKLLAKILNMSSGRCWSSDTYNPVPGVMDGVPSANNYQGGFGTTLMAKDLGLAQDSATSTKSPILLGSLAHQIYRMMCAKGYSKKDFSSVFQFLREEETF

SEQ ID NO: 903020 - protein, 302 aa, Homo sapiens
GPAASGRSSRLRAPSLARGHPPPSGESACARALLRGRASQSRCTRSQSVGPPGGGGGHRGERGGRSMAASLRLLGAASGLRYWSRRLRPAAGSFAAVCSRSVASKTPVGFIGLGNMGNPMAKNLMKHGYPLIIYDVFPDACKEFQDAGEQSGTEPHGGGRGRPRAGGQRGGSGGDAGGKQQAGSEEESEWEERAGPKTTGKAGGQTLEAPRRRRGGGRGNNTEGGSGIGTRLCYQHKEPNPSWQSGPSDLQDDVCKGLLKERLLIRVPVPTRGGDLLSVPFGHGHCWEPNSVLEPPFSSLHK

SEQ ID NO: 903021 - protein, 279 aa, Homo sapiens
GPAASGRSSRLRAPSLARGHPPPSGESACARALLRGRASQSRCTRSQSVGPPGGGGGHRGERGGRSMAASLRLLGAASGLRYWSRRLRPAAGSFAAVCSRSVASKTPVGFIGLGNMGNPMAKNLMKHGYPLIIYDVFPDACKEFQDAGEQVVSSPADVAEKADRIITMLPTSINAIEAYSGANGILKKVKKGSLLIDSSTIDPAVSKELAKEVEKMGAVFMDAPVSGGVGAARSGNLTFMVGGVEDEFAAAQELLGCMGSNVVYCGAVGTGQCNTINLE

SEQ ID NO: 903022 - protein, 281 aa, Homo sapiens
MTCLAPTMSAELNVPIDPSAPACPEPGHKGMDYRDWVRRSYLELVTSNHHSVQALSWRKLYLSRAKLKASSRTSALLSGFAMVAMVEVQLETQYQYPRPLLIAFSACTTVLVAVHLFALLISTCILPNVEAVSNIHNLNSISESPHERMHPYIELAWGFSTVLGILLFLAEVVLLCWIKFLPRWGFAPGAPLPWWPPPNPWGPFAGTSSTRGLGQWAIAPWVLFAPRSIPFGCARVEVFHLFRGGALHTRTSQLCKHGFPIVCLPRKILGVRYTPVRDFVG

SEQ ID NO: 903023 - protein, 154 aa, Homo sapiens
MSGFDDPGIFYSDSFGGDAQADEGQARKSQLQRRFKEFLRQYRVGTDRTGFTFKYRDELKRHYNLGEYWIEVEMEDLASFDEDLADYLYKQPSRSYLELVTSNHHSVQALSWRKLYLSRAKLKASSRTSALLSGFAMDAMVEVQLETQTRYWYE

SEQ ID NO: 903024 - protein, 287 aa, Homo sapiens
APRPGHWATGHAATQSEREPSRAGRGQLRLAPTMSAELNVPIDPSAPACPEPGHKGMDYRDWVRRSYLELVTSNHHSVQALSWRKLYLSRAKLKASSRTSALLSGFAMVAMVEVQLETQYQYPRPLLIAFSACTTVLVAVHLFALLISTCILPNVEAVSNIHNLNSISESPHERMHPYIELAWGFSTVLGILLFLAEVVLLCWIKFLPVDARRQPGPPPGPGSHTGWQAALVSTIIMVPVGLIFVVFTIHFYRSLVRHKTERHNREIEELHKLKVQLDGHERSLQVL

SEQ ID NO: 903025 - protein, 287 aa, Homo sapiens; identical to SEQ ID NO: 903024

SEQ ID NO: 903026 - protein, 261 aa, Homo sapiens
MTCLAPTMSAELNVPIDPSAPACPEPGHKGMDYRDWVRRSYLELVTSNHHSVQALSWRKLYLSRAKLKASSRTSALLSGFAMVAMVEVQLETQYQYPRPLLIAFSACTTVLVAVHLFALLISTCILPNVEAVSNIHNLNSISESPHERMHPYIELAWGFSTVLGILLFLAEVVLLCWIKFLPVDARRQPGPPPGPGSHTGWQAALVSTIIMVPVGLIFVVFTIHFYRSLVRHKTERHNREIEELHKLKVQLDGHERSLQVL

SEQ ID NO: 903027 - protein, 287 aa, Homo sapiens; identical to SEQ ID NO: 903024

SEQ ID NO: 903028 - protein, 261 aa, Homo sapiens; identical to SEQ ID NO: 903026

SEQ ID NO: 903029 - protein, 287 aa, Homo sapiens; identical to SEQ ID NO: 903024

SEQ ID NO: 903030 - protein, 287 aa, Homo sapiens; identical to SEQ ID NO: 903024

SEQ ID NO: 903031 - protein, 287 aa, Homo sapiens; identical to SEQ ID NO: 903024

SEQ ID NO: 903032 - protein, 287 aa, Homo sapiens; identical to SEQ ID NO: 903024

SEQ ID NO: 903033 - protein, 656 aa, Homo sapiens
MEELDGEPTVTLIPGVNSKKNQMYFDWGPGEMLVCETSFNKKEKSEMVPSCPFIYIIRKDVDVYSQILRKLFNESHGIFLGLQRIDEELTGKSRKSQLVRVSKNYRSVIRACMEEMHQVAIAAKDPANGRQFSSQVSILSAMELIWNLCEILFIEVAPAGPLLLHLLDWVRLHVCEVDSLSADVLGSENPSKHDSFWNLVTILVLQGRLDEARQMLSKEADASPASAGICRIMGDLMRTMPILSPGNTQTLTELELKWQHWHEECERYLQDSTFATSPHLESLLKIMLGDEAALLEQKELLSNWYHFLVTRLLYSNPTVKPIDLHYYAQSSLDLFLGGESSPEPLDNILLAAFEFDIHQVIKECSIALSNWWFVAHLTDLLDHCKLLQSHNLYFGSNMREFLLLEYASGLFAHPSLWQLGVDYFDYCPELGRVSLELHIERIPLNTEQKALKVLRICEQRQMTEQVRSICKILAMKAVRNNRLGSALSWSIRAKDAAFATLVSDRFLRDYCERGCFSDLDLIDNLGPAMMLSDRLTFLGKYREFHRMYGEKRFADAASLLLSLMTSRIAPRSFWMTLLTDALPLLEQKQVIFSAEQTYELMRCLEDLTSRRPVHGESDTEQLQDDDIETTKVEMLRLSLARNLARAIIREGSLEGS

SEQ ID NO: 903034 - protein, 734 aa, Homo sapiens
MEELDGEPTVTLIPGVNSKKNQMYFDWGPGEMLVCETSFNKKEKSEMVPSCPFIYIIRKDVDVYSQILRKLFNESHGIFLGLQRIDEELTGKSRKSQLVRVSKNYRSVIRACMEEMHQVAIAAKDPANGRQFSSQVSILSAMELIWNLCEILFIEVAPAGPLLLHLLDWVRLHVCEVDSLSADVLGSENPSKHDSFWNLVTILVLQGRLDEARQMLSKEADASPASAGICRIMGDLMRTMPILSPGNTQTLTELELKWQHWHEECERYLQDSTFATSPHLESLLKVWEAVQIASMLASYGGCGIQCSSGRSLVLLGEGCLSLCRDGESFQTSGNPVPLAEEQEHYGEGTPERRTEFSTNVSPQIMLGDEAALLEQKELLSNWYHFLVTRLLYSNPTVKPIDLHYYAQSSLDLFLGGESSPEPLDNILLAAFEFDIHQVIKECSIALSNWWFVAHLTDLLDHCKLLQSHNLYFGSNMREFLLLEYASGLFAHPSLWQLGVDYFDYCPELGRVSLELHIERIPLNTEQKALKVLRICEQRQMTEQVRSICKILAMKAVRNNRLGSALSWSIRAKDAAFATLVSDRFLRDYCERGCFSDLDLIDNLGPAMMLSDRLTFLGKYREFHRMYGEKRFADAASLLLSLMTSRIAPRSFWMTLLTDALPLLEQKQVIFSAEQTYELMRCLEDLTSRRPVHGESDTEQLQDDDIETTKVEMLRLSLARNLARAIIREGSLEGS

SEQ ID NO: 903035 - protein, 367 aa, Homo sapiens
MEELDGEPTVTLIPGVNSKKNQMYFDWGPGEMLVCETSFNKKEKSEMVPSCPFIYIIRKDVDVYSQILRKLFNESHGIFLGLQRIDEELTGKSRKSQLVRVSKNYRSVIRACMEEMHQVAIAAKDPANGRQFSSQVSILSAMELIWNLCEILFIEVAPAGPLLLHLLDWVRLHVCEVDSLSADVLGSENPSKHDSFWNLVTILVLQGRLDEARQMLSKEADASPASAGICRIMGDLMRTMPILSPGNTQTLTELELKWQHWHEECERYLQDSTFATSPHLESLLKIMLGDEAALLEQKELLSNWYHFLVTRLLYSNPTVKPIDLHYYAQSSLDLFLGGESSPEPLDNILLAAFEFDIHQVIKECSFL

SEQ ID NO: 903036 - protein, 630 aa, Homo sapiens [sequence omitted]

SEQ ID NO: 903037 - protein, 634 aa, Homo sapiens
MYFDWGPGEMLVCETSFNKKEKSEMVPSCPFIYIIRKDVDVYSQILRKLFNESHGIFLGLQRIDEELTGKSRKSQLVRVSKNYRSVIRACMEEMHQVAIAAKDPANGRQFSSQVSILSAMELIWNLCEILFIEVAPAGPLLLHLLDWVRLHVCEVDSLSADVLGSENPSKHDSFWNLVTILVLQGRLDEARQMLSKEADASPASAGICRIMGDLMRTMPILSPGNTQTLTELELKWQHWHEECERYLQDSTFATSPHLESLLKIMLGDEAALLEQKELLSNWYHFLVTRLLYSNPTVKPIDLHYYAQSSLDLFLGGESSPEPLDNILLAAFEFDIHQVIKECSIALSNWWFVAHLTDLLDHCKLLQSHNLYFGSNMREFLLLEYASGLFAHPSLWQLGVDYFDYCPELGRVSLELHIERIPLNTEQKALKVLRICEQRQMTEQVRSICKILAMKAVRNNRLGSALSWSIRAKDAAFATLVSDRFLRDYCERGCFSDLDLIDNLGPAMMLSDRLTFLGKYREFHRMYGEKRFADAASLLLSLMTSRIAPRSFWMTLLTDALPLLEQKQVIFSAEQTYELMRCLEDLTSRRPVHGESDTEQLQDDDIETTKVEMLRLSLARNLARAIIREGSLEGS

SEQ ID NO: 903038 - protein, 610 aa, Homo sapiens
MVPSCPFIYIIRKDVDVYSQILRKLFNESHGIFLGLQRIDEELTGKSRKSQLVRVSKNYRSVIRACMEEMHQVAIAAKDPANGRQFSSQVSILSAMELIWNLCEILFIEVAPAGPLLLHLLDWVRLHVCEVDSLSADVLGSENPSKHDSFWNLVTILVLQGRLDEARQMLSKEADASPASAGICRIMGDLMRTMPILSPGNTQTLTELELKWQHWHEECERYLQDSTFATSPHLESLLKIMLGDEAALLEQKELLSNWYHFLVTRLLYSNPTVKPIDLHYYAQSSLDLFLGGESSPEPLDNILLAAFEFDIHQVIKECSIALSNWWFVAHLTDLLDHCKLLQSHNLYFGSNMREFLLLEYASGLFAHPSLWQLGVDYFDYCPELGRVSLELHIERIPLNTEQKALKVLRICEQRQMTEQVRSICKILAMKAVRNNRLGSALSWSIRAKDAAFATLVSDRFLRDYCERGCFSDLDLIDNLGPAMMLSDRLTFLGKYREFHRMYGEKRFADAASLLLSLMTSRIAPRSFWMTLLTDALPLLEQKQVIFSAEQTYELMRCLEDLTSRRPVHGESDTEQLQDDDIETTKVEMLRLSLARNLARAIIREGSLEGS

SEQ ID NO: 903039 - protein, 649 aa, Homo sapiens
MEELDGEPTVTLIPGVNSKKNQMYFDWGPGEMLVCETSFNKKEKSEMVPSCPFIYIIRKDVDVYSQILRKLFNESHGIFLGLQRIDEELTGKSRKSQLVRVSKNYRSVIRACMEEMHQVAIAAKDPANGRQFSSQVSILSAMELIWNLCEILFIEVAPAGPLLLHLLDWVRLHVCEVDSLSADVLGSENPSKHDSFWNLGRLDEARQMLSKEADASPASAGICRIMGDLMRTMPILSPGNTQTLTELELKWQHWHEECERYLQDSTFATSPHLESLLKIMLGDEAALLEQKELLSNWYHFLVTRLLYSNPTVKPIDLHYYAQSSLDLFLGGESSPEPLDNILLAAFEFDIHQVIKECSIALSNWWFVAHLTDLLDHCKLLQSHNLYFGSNMREFLLLEYASGLFAHPSLWQLGVDYFDYCPELGRVSLELHIERIPLNTEQKALKVLRICEQRQMTEQVRSICKILAMKAVRNNRLGSALSWSIRAKDAAFATLVSDRFLRDYCERGCFSDLDLIDNLGPAMMLSDRLTFLGKYREFHRMYGEKRFADAASLLLSLMTSRIAPRSFWMTLLTDALPLLEQKQVIFSAEQTYELMRCLEDLTSRRPVHGESDTEQLQDDDIETTKVEMLRLSLARNLARAIIREGSLEGS

SEQ ID NO: 903040 - protein, 488 aa, Homo sapiens
MAASSAARSPFCQQWSSSGTCVRFFLLKWPQVTILVLQGRLDEARQMLSKEADASPASAGICRIMGDLMRTMPILSPGNTQTLTELELKWQHWHEECERYLQDSTFATSPHLESLLKIMLGDEAALLEQKELLSNWYHFLVTRLLYSNPTVKPIDLHYYAQSSLDLFLGGESSPEPLDNILLAAFEFDIHQVIKECSIALSNWWFVAHLTDLLDHCKLLQSHNLYFGSNMREFLLLEYASGLFAHPSLWQLGVDYFDYCPELGRVSLELHIERIPLNTEQKALKVLRICEQRQMTEQVRSICKILAMKAVRNNRLGSALSWSIRAKDAAFATLVSDRFLRDYCERGCFSDLDLIDNLGPAMMLSDRLTFLGKYREFHRMYGEKRFADAASLLLSLMTSRIAPRSFWMTLLTDALPLLEQKQVIFSAEQTYELMRCLEDLTSRRPVHGESDTEQLQDDDIETTKVEMLRLSLARNLARAIIREGSLEGS

SEQ ID NO: 903041 - protein, 367 aa, Homo sapiens; identical to SEQ ID NO: 903035

SEQ ID NO: 903042 - protein, 616 aa, Homo sapiens
MEELDGEPTVTLIPGVNSKKNQMYFDWGPGEMLVCETSFNKKEKSEMVPSCPFIYIIRKDVDVYSQILRKLFNESHGIFLGLQRIDEELTGKSRKSQLVRVSKNYRSVIRACMEEMHQVAIAAKDPANGRQFSSQVSILSAMELIWNLCEILFIEVAPAGPLLLHLLDWVRLHVCEVDSLSADVLGSENPSKHDSFWNLIMLGDEAALLEQKELLSNWYHFLVTRLLYSNPTVKPIDLHYYAQSSLDLFLGGESSPEPLDNILLAAFEFDIHQVIKECSIALSNWWFVAHLTDLLDHCKLLQSHNLYFGSNMREFLLLEYASGLFAHPSLWQLGVDYFDYCPELGRVSLELHIERIPLNTEQKALKVLRICEQRQMTEQGELALLPAYCLWDAGVREILRSHFMPTPAILLLTSHTGDVGLWTPRVRSICKILAMKAVRNNRLGSALSWSIRAKDAAFATLVSDRFLRDYCERGCFSDLDLIDNLGPAMMLSDRLTFLGKYREFHRMYGEKRFADAASLLLSLMTSRIAPRSFWMTLLTDALPLLEQKQVIFSAEQTYELMRCLEDLTSRRPVHGESDTEQLQDDDIETTKVEMLRLSLARNLARAIIREGSLEGS

SEQ ID NO: 903043 - protein, 259 aa, Homo sapiens
MREFLLLEYASGLFAHPSLWQLGVDYFDYCPELGRVSLELHIERIPLNTEQKALKVLRICEQRQMTEQVRSICKILAMKAVRNNRLGSALSWSIRAKDAAFATLVSDRFLRDYCERGCFSDLDLIDNLGPAMMLSDRLTFLGKYREFHRMYGEKRFADAASLLLSLMTSRIAPRSFWMTLLTDALPLLEQKQVIFSAEQTYELMRCLEDLTSRRPVHGESDTEQLQDDDIETTKVEMLRLSLARNLARAIIREGSLEGS

SEQ ID NO: 903044 - protein, 259 aa, Homo sapiens; identical to SEQ ID NO: 903043

SEQ ID NO: 903045 - protein, 182 aa, Homo sapiens [sequence omitted]

SEQ ID NO: 903046 - protein, 42 aa, Homo sapiens
MKAVRNNRLGSALSWSIRAKDAAFATLVSDRWVPLVLASQGL

SEQ ID NO: 903047 - protein, 656 aa, Homo sapiens; identical to SEQ ID NO: 903033

SEQ ID NO: 903048 - protein, 700 aa, Homo sapiens
MEELDGEPTVTLIPGVNSKKNQMYFDWGPGEMLVCETSFNKKEKSEMVPSCPFIYIIRKDVDVYSQILRKLFNESHGIFLGLQRIDEELTGKSRKSQLVRVSKNYRSVIRACMEEMHQVAIAAKDPANGRQFSSQVSILSAMELIWNLCEILFIEVAPAGPLLLHLLDWVRLHVCEVDSLSADVLGSENPSKHDSFWNLVTILVLQGRLDEARQMLSKEADASPASAGICRIMGDLMRTMPILSPGNTQTLTELELKWQHWHEECERYLQDSTFATSPHLESLLKIMLGDEAALLEQKELLSNWYHFLVTRLLYSNPTVKPIDLHYYAQSSLDLFLGGESSPEPLDNILLAAFEFDIHQVIKECSFLLKTGQFLAVWQEETAGVHFTGSWARCRQFPGALQVLQKYRANIALSNWWFVAHLTDLLDHCKLLQSHNLYFGSNMREFLLLEYASGLFAHPSLWQLGVDYFDYCPELGRVSLELHIERIPLNTEQKALKVLRICEQRQMTEQVRSICKILAMKAVRNNRLGSALSWSIRAKDAAFATLVSDRFLRDYCERGCFSDLDLIDNLGPAMMLSDRLTFLGKYREFHRMYGEKRFADAASLLLSLMTSRIAPRSFWMTLLTDALPLLEQKQVIFSAEQTYELMRCLEDLTSRRPVHGESDTEQLQDDDIETTKVEMLRLSLARNLARAIIREGSLEGS

SEQ ID NO: 903049 - protein, 622 aa, Homo sapiens
MEELDGEPTVTLIPGVNSKKNQMYFDWGPGEMLVCETSFNKKEKSEMVPSCPFIYIIRKDVDVYSQILRKLFNESHGIFLGLQRIDEELTGKSRKSQLVRVSKNYRSVIRACMEEMHQVAIAAKDPANGRQFSSQVSILSAMELIWNLCEILFIEVAPAGPLLLHLLDWVRLHVCEVDSLSADVLGSENPSKHDSFWNLVTILVLQGRLDEARQMLSKEADASPASAGICRIMGDLMRTMPILSPGNTQTLTELELKWQHWHEECERYLQDSTFATSPHLESLLKIMLGDEAALLEQKELLSNWYHFLVTRLLYSNPTVKPIDLHYYAQSSLDLFLGGESSPEPLDNILLAAFEFDIHQVIKECSIALSNWWFVAHLTDLLDHCKLLQSHNLYFGSNMREFLLLEYASGLFAHPSLWQLGVDYFDYCPELGRVSLELHIERIPLNTEQKALKVLRICEQRQMTEQVRSICKILAMKAVRNNRLGSALSWSIRAKDAAFATLVSDRFLRDYCERGCFSDLDLIDNLGPAMMLSDRLTFLGKYREFHRMYGEKRFADAASLLLSLMTSRIAPRSFWMTLLTDALPLLEQKQDDDIETTKVEMLRLSLARNLARAIIREGSLEGS

SEQ ID NO: 903050 - protein, 610 aa, Homo sapiens; identical to SEQ ID NO: 903038

SEQ ID NO: 903051 - protein, 611 aa, Homo sapiens
MEELDGEPTVTLIPGVNSKKNQMYFDWGPGEMLVCETSFNKKEKSEMVPSCPFIYIIRKDVDVYSQILRKLFNESHGIFLGLQRIDEELTGKSRKSQLVRVSKNYRSVIRACMEEMHQVAIAAKDPANGRQFSSQVSILSAMELIWNLCEILFIEVAPAGPLLLHLLDWVRLHVCEVDSLSADVLGSENPSKHDSFWNLPGNTQTLTELELKWQHWHEECERYLQDSTFATSPHLESLLKIMLGDEAALLEQKELLSNWYHFLVTRLLYSNPTVKPIDLHYYAQSSLDLFLGGESSPEPLDNILLAAFEFDIHQVIKECSIALSNWWFVAHLTDLLDHCKLLQSHNLYFGSNMREFLLLEYASGLFAHPSLWQLGVDYFDYCPELGRVSLELHIERIPLNTEQKALKVLRICEQRQMTEQVRSICKILAMKAVRNNRLGSALSWSIRAKDAAFATLVSDRFLRDYCERGCFSDLDLIDNLGPAMMLSDRLTFLGKYREFHRMYGEKRFADAASLLLSLMTSRIAPRSFWMTLLTDALPLLEQKQVIFSAEQTYELMRCLEDLTSRRPVHGESDTEQLQDDDIETTKVEMLRLSLARNLARAIIREGSLEGS

SEQ ID NO: 903052 - protein, 426 aa, Homo sapiens
MEELDGEPTVTLIPGVNSKKNQMYFDWGPGEMLVCETSFNKKEKSEMVPSCPFIYIIRKDVDVYSQILRKLFNESHGIFLGLQRIDEELTGKSRKSQLVRVSKNYRSVIRACMEEMHQVAIAAKDPANGRQFSSQVSILSAMELIWNLCEILFIEVAPAGPLLLHLLDWVRLHVCEVDSLSADVLGSENPSKHDSFWNLVTILVLQGRLDEARQMLSKEADASPASAGICRIMGDLMRTMPILSPGNTQTLTELELKWQHWHEECERYLQDSTFATSPHLESLLKIMLGDEAALLEQKELLSNWYHFLVTRLLYSNPTVKPIDLHYYAQSSLDLFLGGESSPEPLDNILLAAFEFDIHQVIKECSIALSNWWFVAHLTDLLDHCKLLQSHNLYFGSNMREFLLLEYASGLFAHPSLWLPGGPAVWY

SEQ ID NO: 903053 - protein, 565 aa, Homo sapiens
MVPSCPFIYIIRKDVDVYSQILRKLFNESHGIFLGLQRIDEELTGKSRKSQLVRVSKNYRSVIRACMEEMHQVAIAAKDPANGRQFSSQVSILSAMELIWNLCEILFIEVAPAGPLLLHLLDWVRLHVCEVDSLSADVLGSENPSKHDSFWNLPGNTQTLTELELKWQHWHEECERYLQDSTFATSPHLESLLKIMLGDEAALLEQKELLSNWYHFLVTRLLYSNPTVKPIDLHYYAQSSLDLFLGGESSPEPLDNILLAAFEFDIHQVIKECSIALSNWWFVAHLTDLLDHCKLLQSHNLYFGSNMREFLLLEYASGLFAHPSLWQLGVDYFDYCPELGRVSLELHIERIPLNTEQKALKVLRICEQRQMTEQVRSICKILAMKAVRNNRLGSALSWSIRAKDAAFATLVSDRFLRDYCERGCFSDLDLIDNLGPAMMLSDRLTFLGKYREFHRMYGEKRFADAASLLLSLMTSRIAPRSFWMTLLTDALPLLEQKQVIFSAEQTYELMRCLEDLTSRRPVHGESDTEQLQDDDIETTKVEMLRLSLARNLARAIIREGSLEGS

SEQ ID NO: 903054 - protein, 259 aa, Homo sapiens; identical to SEQ ID NO: 903043

SEQ ID NO: 903055 - protein, 259 aa, Homo sapiens; identical to SEQ ID NO: 903043

SEQ ID NO: 903056 - protein, 136 aa, Homo sapiens
KSPALWSGWSEVFLLLFRARVTFVGVTWAIWGNMQVTQCSCFAIGKYREFHRMYGEKRFADAASLLLSLMTSRIAPRSFWMTLLTDALPLLEQKQVKVAAAVVFFACQSLLELSCIAVADVRVSSFVVLPVRVYSP

SEQ ID NO: 903057 - protein, 281 aa, Homo sapiens
MVADPKKKKLENGRTRGGHLAGVLGTAGAVTHAVACLASITWEGAGFHSWGLGTGFGFPAPPARPRPFPRPTITTASGRHPHLPPVPSPPHYTAHQPLQGSHGLSGEQFSPGLSSQLPPPTHAYTHALLDKANIPLSRTLHLLRPHSLGGGDIALWAFGLGAPSLLLHCSLWLPIVGPGRVPLALKGAQAPSHPGTPYSTALAAAGVANGGGCWPPGFPQPNCLCHHVGLTFHPSPTSLVPVLGWTAPFGYRKAGGVSPLLPLHCGHSPLALRLGSEYILW

SEQ ID NO: 903058 - protein, 281 aa, Homo sapiens; identical to SEQ ID NO: 903057

SEQ ID NO: 903059 - protein, 355 aa, Homo sapiens
MSESSSKSSQPLASKQEKDGTEKRGRGRPAQCSLRRSPAKCQHLRDLVGLTKGKQKQGVLPRPWKTTTTPGRKPMVADPKKKKLENGRTRGGHLAGVLGTAGAVTHAVACLASITWEGAGFHSWGLGTGFGFPAPPARPRPFPRPTITTASGRHPHLPPVPSPPHYTAHQPLQGSHGLSGEQFSPGLSSQLPPPTHAYTHALLDKANIPLSRTLHLLRPHSLGGGDIALWAFGLGAPSLLLHCSLWLPIVGPGRVPLALKGAQAPSHPGTPYSTALAAAGVANGGGCWPPGFPQPNCLCHHVGLTFHPSPTSLVPVLGWTAPFGYRKAGGVSPLLPLHCGHSPLALRLGSEYILW

SEQ ID NO: 903060 - protein, 148 aa, Homo sapiens
MFHSSTSVIAAATSAKCSSSLPPVLPTIPSPKILFVGKRGWGMAGWVTDYPSPREGGALPLGCCSRVSKGARIDHKGCRGHLLPLFCWGGVAMICPSLGLPLWFPICSYLNKKNILFWNKTKRREKHNKNTQNNTKQNTQRFYCVGKK

SEQ ID NO: 903061 - protein, 235 aa, Homo sapiens
MSESSSKSSQPLASKQEKDGTEKRGRGRPAQCSLRRSPAKCQHLRDLVGLTKGKQKQGVLPRPWKTTTTPGRKPMVADPKKKKLENGRTRGGHLAGVLGTAGAVTHAVACLASITWEGAGFHSWGLGTGFGFPAPPARPQRRHPGKDRTHIRIRTNTPEPRDANSYNRCKDHMEHAATQRVDDTNELAEQTTEDSKNTLTLTGRNEQKTDTHKTIGTEPHSKTATASQRKALTDP

SEQ ID NO: 903062 - protein, 289 aa, Homo sapiens
MFHSSTSVIAAATSAKCSSSLPPVLPTIPSPKILFVGKRGWGMAGWVTDYPSPREGGALPLGCCSRVSKGARIDHKGCRGHLLPLFCWGGVAMICPSLGLPLWFPICSYLNKKNILFWRKKKKKTKKKGGHSKKSTPQRGPKRNADTEIYDTKAAHNKEPTNQTATDEGTTLYKSAEKLGDNTSAPPGQISGRTAARPNPTCSDAPHNAHPHTPINEKMLKTDRTKKRANDRPTLTSRATNTGDTNTTATNTRLARRASTPEMGNHRKREGRITAERNLNPTDEATTGE

SEQ ID NO: 903063 - protein, 201 aa, Homo sapiens
MFHSSTSVIAAATSAKCSSSLPPVLPTIPSPKILFVGKRGWGMAGWVTDYPSPREGGALPLGCCSRVSKGARIDHKGCRGHLLPLFCWGGVAMICPSLGLPLWFPICSYLNKKNILFWRKKKKKTKKKKKTRGPSYCRAGGNKKANLETGTRGPNTPVVPWNPIFFGHQGGTNSAGPPKKRGRQKLQNPGLTLVLELREKH

SEQ ID NO: 903064 - protein, 161 aa, Homo sapiens
MFHSSTSVIAAATSAKCSSSLPPVLPTIPSPKILFVGKRGWGMAGWVTDYPSPREGGALPLGCCSRVSKGARIDHKGCRGHLLPLFCWGGVAMICPSLGLPLWFPICSYLNKKNILFWTEHNTITQKNPGTFARGTCFRCTSTSSDHSDKGLRPKGVFDTH

SEQ ID NO: 903065 - protein, 65 aa, Homo sapiens
MVGRGGTRRLIWKRAPGAPTRRWFRGTPFFLVTRGGQTRRAPPKREGGKNCKTPGEPGFRAARKT

SEQ ID NO: 903066 - protein, 281 aa, Homo sapiens; identical to SEQ ID NO: 903057

SEQ ID NO: 903067 - protein, 256 aa, Homo sapiens
MVADPKKKKLENGRTRGGHLAGVLGTAGAVTHAVACLASITWEGAGFHSWGLGTGFGFPAPPARPHYTAHQPLQGSHGLSGEQFSPGLSSQLPPPTHAYTHALLDKANIPLSRTLHLLRPHSLGGGDIALWAFGLGAPSLLLHCSLWLPIVGPGRVPLALKGAQAPSHPGTPYSTALAAAGVANGGGCWPPGFPQPNCLCHHVGLTFHPSPTSLVPVLGWTAPFGYRKAGGVSPLLPLHCGHSPLALRLGSEYILW

SEQ ID NO: 903068 - protein, 281 aa, Homo sapiens; identical to SEQ ID NO: 903057

SEQ ID NO: 903069 - protein, 149 aa, Homo sapiens
MLLPALHPSLGREQASILGDWGQALASPLPQRAPLHCSLWLPIVGPGRVPLALKGAQAPSHPGTPYSTALAAAGVANGGGCWPPGFPQPNCLCHHVGLTFHPSPTSLVPVLGWTAPFGYRKAGGVSPLLPLHCGHSPLALRLGSEYILW

SEQ ID NO: 903070 - protein, 281 aa, Homo sapiens; identical to SEQ ID NO: 903057

SEQ ID NO: 903071 - protein, 104 aa, Homo sapiens
MTLRSRYKQPIDNTTTATSKDHRTTTPKKVSEGKEGDSEGKKKLTNTQDTGKRARPKKRSNNKEANRQRERATQPRHHEEQHNTRETKDNNEQTKTIKTTHRRH

SEQ ID NO: 903072 - protein, 281 aa, Homo sapiens; identical to SEQ ID NO: 903057

SEQ ID NO: 903073 - protein, 166 aa, Homo sapiens
MQPPVSPGTALVGSQKEPSEVPTPKRPRGPDQREAKTRCAAKTLGERTDTRRASRRSPRHGRSSDPCCCLPCIPHLGGSKLPFMGTGDRLWLPRSPNAPPPLPQAHHHHRLWPPPPSSTCALTTTLHSTPAAAGLPWAEWGAVFPWPQFPAPPAHPRIHTCPPGQG

SEQ ID NO: 903074 - protein, 31 aa, Homo sapiens
MAGTSIGRPAQNAWPRKEATRKLNEAVACTQ

SEQ ID NO: 903075 - protein, 235 aa, Homo sapiens
MSESSSKSSQPLASKQEKDGTEKRGRGRPAQCSLRRSPAKCQHLRDLVGLTKGKQKQGVLPRPRKTTTTPGRKPMVADPKKKKLENGRTRGGHLAGVLGTAGAVTHAVACLASITWEGAGFHSWGLGTGFGFPAPPARPQRRHPGKDRTHIRIRTNTPEPRDANSYNRCKDHMEHAATQRVDDTNELAEQTTEDSKNTLTLTGRNEQKTDTHKTIGTEPHSKTATASQRKALTDP

SEQ ID NO: 903076 - protein, 155 aa, Homo sapiens
MSESSSKSSQPLASKQEKDGTEKRGRGRPAQCSLRRSPAKCQHLRDLVGLTKGKQKQGVLPRPWKTTTTPGRKPMVADPKKKKLENGRTRGGHLAGVLGTAGAVTHAVACLASITWEGAGFHSWGLGTGFGFPAPPARPQRASTSRDTLHRLAQP

SEQ ID NO: 903077 - protein, 355 aa, Homo sapiens; identical to SEQ ID NO: 903059

SEQ ID NO: 903078 - protein, 355 aa, Homo sapiens; identical to SEQ ID NO: 903059

SEQ ID NO: 903079 - protein, 123 aa, Homo sapiens
VGTSPFDSPFLFYFLLGLYFAGRGRREGAFFLSPAPARARFPAPRRAWVPPLAGSGAGCTRVAVHAVGVRCFPAPAGAACAPPPARPGPGSRRPACNGRAQTLAESPSGRVWSLMPRGFSPSR

SEQ ID NO: 903080 - protein, 281 aa, Homo sapiens; identical to SEQ ID NO: 903057

SEQ ID NO: 903081 - protein, 154 aa, Homo sapiens
MFHSSTSVIAAATSAKCSSSLPPVLPTIPSPKILFVGKRGWGMAGWVTDYPSPREGGALPLGCCSRVSKGARIDHKGCRGHLLPLFCWGGVAMICPSLGLPLWFPICSYLNKKNILFWTTKKKLRELFGGEQALMAGIVSDTFVKGMRPRREKT

SEQ ID NO: 903082 - protein, 190 aa, Homo sapiens
MFHSSTSVIAAATSAKCSSSLPPVLPTIPSPKILFVGKRGWGMAGWVTDYPSPREGGALPLGCCSRVSKGARIDHKGCRGHLLPLFCWGGVAMICPSLGLPLWFPICSYLNKKNILFWKKKKMSDQTHTATFCWAHSRGPLRKKLCKQPILGLERAGGPIGVLRRHVGQNGVPREKTRGQTKAAGISPAL

SEQ ID NO: 903083 - protein, 58 aa, Homo sapiens
MANLETGTRGPNTPVVPWNPIFFGHQGGTNSAGPPKKRGRQKLQNPGLTLVLELREKH

SEQ ID NO: 903084 - protein, 355 aa, Homo sapiens; identical to SEQ ID NO: 903059

SEQ ID NO: 903085 - protein, 114 aa, Homo sapiens
MGTGDRLWLPRSPNAPPPLPQAHHHHRLWPPPPSSTCALTTTSRCGQWRGVLAPRIPPAKLSLSPRGAHFSSFPNFPSPRTRLDSPLRLQEGRRGESPTPSSLWPQPPCPPPGI

SEQ ID NO: 903086 - protein, 355 aa, Homo sapiens
MSESSSKSSQPLASKQEKDGTEKRGRGRPAQCSLRRSPAKCQHLRDLVGLTKGKQKQGVLPRPRKTTTTPGRKPMVADPKKKKLENGRTRGGHLAGVLGTAGAVTHAVACLASITWEGAGFHSWGLGTGFGFPAPPARPRPFPRPTITTASGRHPHLPPVPSPPHYTAHQPLQGSHGLSGEQFSPGLSSQLPPPTHAYTHALLDKANIPLSRTLHLLRPHSLGGGDIALWAFGLGAPSLLLHCSLWLPIVGPGRVPLALKGAQAPSHPGTPYSTALAAAGVANGGGCWPPGFPQPNCLCHHVGLTFHPSPTSLVPVLGWTAPFGYRKAGGVSPLLPLHCGHSPLALRLGSEYILW

SEQ ID NO: 903087 - protein, 204 aa, Homo sapiens
MEENKKNKKGTNQQKTQKEKTLHDTHGMNAKTKTKGTRTKNTKNKQKTQRTQQKKTNREKKRKNNQKQKTEKKKKKEKKYIAEVSEAGVLHCSLWLPIVGPGRVPLALKGAQAPSHPGTPYSTALAAAGVANGGGCWPPGFPQPNCLCHHVGLTFHPSPTSLVPVLGWTAPFGYRKAGGVSPLLPLHCGHSPLALRLGSEYILW

SEQ ID NO: 903088 - protein, 58 aa, Homo sapiens; identical to SEQ ID NO: 903083

SEQ ID NO: 903089 - protein, 230 aa, Homo sapiens
MFHSSTSVIAAATSAKCSSSLPPVLPTIPSPKILFVGKRGWGMAGWVTDYPSPREGGALPLGCCSRVSKGARIDHKGCRGHLLPLFCWGGVAMICPSLGLPLWFPICSYLNKKNILFWKKKRKLRTKKRNRRGLFFAGGGRKGLLERALANGVPWTAFLVQRNLEGPHRRRKIAEAGSVIISKTTEPTDAKREHNLAQHGAQHSTHRKYIRQKKEVRRKYRQTRHVSSEK

SEQ ID NO: 903090 - protein, 141 aa, Homo sapiens
MQPPVSPGTALVGSQKEPSEVPTPKRPRGPDQREAKTRCAAKTLENHHNSRKETNGGRPKKKKTGERTDTRRASRRSPRHGRSTSILGDWEQALASPLPQRAPAPSPGPPSPPPLAATPIFHLCPHHHTTQHTSRCRAPMG

SEQ ID NO: 903091 - protein, 192 aa, Homo sapiens
MSESSSKSSQPLASKQEKDGTEKRGRGRPAQCSLRRSPAKCQHLRDLVGLTKGKQKQGVLPRPRKTTTTPGRKPMVADPKKKKLENGRTRGGHLAGVLGTAGAVTHAVACLASITWEGAGFHSWGLGTGFGFPAPPARPQGLGLSVRTDDSERLQDGASPSPMEPRRGHGQRTGPNLRAVPRGLALISPGLG

SEQ ID NO: 903092 - protein, 112 aa, Homo sapiens
MIPAVVLLLLLLVEQAAALGEPQLCYILDAILFLYGIVLTLLYCRLKIQVRKAAITSYEKSDGVYTMESPSITRLECSGMIWAHCNLCLLGSRDSRASPSRVAKTTGTTMPS

SEQ ID NO: 903093 - protein, 107 aa, Homo sapiens
QGTARGAQLHSAVRTADLQPKMIPAVVLLLLLLVEQAAALGEPQLCYILDAILFLYGIVLTLLYCRLKIQVRKAAITSYEKSDGVYTGLSTRNQETYETLKHEKPPQ

SEQ ID NO: 903094 - protein, 108 aa, Homo sapiens
QGTARGAQLHSAVRTADLQPKMIPAVVLLLLLLVEQAAALGEPQLCYILDAILFLYGIVLTLLYCRLKIQVRKAAITSYEKSDGVYTGLSTRNQETYETLKHEKPACH

SEQ ID NO: 903095 - protein, 107 aa, Homo sapiens; identical to SEQ ID NO: 903093

SEQ ID NO: 903096 - protein, 325 aa, Homo sapiens
AGPVLAVRRRGALSLSVGAACGLVALWQRRRQDSGTMSGFSTEERAAPFSLEYRVFLKNEKGQYISPFHDIPIYADKDVFHMVVEVPRWSNAKMEIATKDPLNPIKQDVKKGKLRYVANLFPYKGYIWNYGAIPQTWEDPGHNDKHTGCCGDNDPIDVCEIGSKVCARGEIIGVKVLGILAMIDEGETDWKVIAINVDDPDAANYNDINDVKRLKPGYLEATVDWFRRYKVPDGKPENEFAFNAEFKDKDFAIDIIKSTHDHWKALVTKKTNGKGISCMNTTLSESPFKCDPDAARAIVDALPPPCESACTVPTDVDKWFHHQKN

SEQ ID NO: 903097 - protein, 325 aa, Homo sapiens; identical to SEQ ID NO: 903096

SEQ ID NO: 903098 - protein, 325 aa, Homo sapiens; identical to SEQ ID NO: 903096

SEQ ID NO: 903099 - protein, 232 aa, Homo sapiens
MEIATKDPLNPIKQDVKKGKLRYVANLFPYKGYIWNYGAIPQTWEDPGHNDKHTGCCGDNDPIDVCEIGSKVCARGEIIGVKVLGILAMIDEGETDWKVIAINVDDPDAANYNDINDVKRLKPGYLEATVDWFRRYKVPDGKPENEFAFNAEFKDKDFAIDIIKSTHDHWKALVTKKTNGKGISCMNTTLSESPFKCDPDAARAIVDALPPPCESACTVPTDVDKWFHHQKN

SEQ ID NO: 903100 - protein, 292 aa, Homo sapiens
RRERCNGGAKDTPQSIDEGGSRISLLIYMDSLYGLQITFTSPLIETIIFNKALDINQRKKRKIATKDPLNPIKQDVKKGKLRYVANLFPYKGYIWNYGAIPQTWEDPGHNDKHTGCCGDNDPIDVCEIGSKVCARGEIIGVKVLGILAMIDEGETDWKVIAINVDDPDAANYNDINDVKRLKPGYLEATVDWFRRYKVPDGKPENEFAFNAEFKDKDFAIDIIKSTHDHWKALVTKKTNGKGISCMNTTLSESPFKCDPDAARAIVDALPPPCESACTVPTDVDKWFHHQKN

SEQ ID NO: 903101 - protein, 214 aa, Homo sapiens
AGPVLAVRRRGALSLSVGAACGLVALWQRRRQDSGTMSGFSTEERAAPFSLEYRVFLKNEKGQYISPFHDIPIYADKDVFHMVVEVPRWSNAKMEIATKDPLNPIKQDVKKGKLRYVANLFPYKGYIWNYGAIPQTWEDPGHNDKHTGCCGDNDPIDVCEIGSKVCARGEIIGVKVLGILAMIDEGETDWKVIAINVDDPDAANYNVCNSVVIL

SEQ ID NO: 903102 - protein, 338 aa, Homo sapiens
AGPVLAVRRRGALSLSVGAACGLVALWQRRRQDSGTMSGFSTEERAAPFSLEYRVFLKNEKGQYISPFHDIPIYADKDVFHMVVEVPRWSNAKMEIATKDPLNPIKQDVKKGKLRYVANLFPYKGYIWNYGAIPQTWEDPGHNDKHTGCCGDNDPIDVCEIGSKVCARGEIIGVKVLGILAMIDEGETDWKVIAINVDDPDAANYNDINDVKRLKPGYLEATVDWFRRYKVPDGKPENEFAFNAEFKDKDFAIDIIKSTHDHWKALVTKKTNGKGISCYHHPVNLPAQYQQTWISGSITRKTNEISLEYKLILLHRVHLDVLEVKVVAFQSFKFVELI

SEQ ID NO: 903103 - protein, 146 aa, Homo sapiens
KLPSHVSPMDLHEAEPSDEENYLRNYNDINDVKRLKPGYLEATVDWFRRYKVPDGKPENEFAFNAEFKDKDFAIDIIKSTHDHWKALVTKKTNGKGISCMNTTLSESPFKCDPDAARAIVDALPPPCESACTVPTDVDKWFHHQKN

SEQ ID NO: 903104 - protein, 182 aa, Homo sapiens
AGPVLAVRRRGALSLSVGAACGLVALWQRRRQDSGTMSGFSTEERAAPFSLEYRVFLKNEKGQYISPFHDIPIYADKDVFHMVVEVPRWSNAKMEIATKDPLNPIKQDVKKGKLRYVANLFPYKGYIWNLIPSKPVHSSFQVARFQPFDIIDIIIIGCIRIIHINGNDFPVGFPFVNHSQYA

SEQ ID NO: 903105 - protein, 125 aa, Homo sapiens [sequence omitted]

SEQ ID NO: 903106 - protein, 325 aa, Homo sapiens; identical to SEQ ID NO: 903096

SEQ ID NO: 903107 - protein, 244 aa, Homo sapiens
MVVEVPRWSNAKMEIATKDPLNPIKQDVKKGKLRYVANLFPYKGYIWNYGAIPQTWEDPGHNDKHTGCCGDNDPIDVCEIGSKVCARGEIIGVKVLGILAMIDEGETDWKVIAINVDDPDAANYNDINDVKRLKPGYLEATVDWFRRYKVPDGKPENEFAFNAEFKDKDFAIDIIKSTHDHWKALVTKKTNGKGISCMNTTLSESPFKCDPDAARAIVDALPPPCESACTVPTDVDKWFHHQKN

SEQ ID NO: 903108 - protein, 231 aa, Homo sapiens
MIATKDPLNPIKQDVKKGKLRYVANLFPYKGYIWNYGAIPQTWEDPGHNDKHTGCCGDNDPIDVCEIGSKVCARGEIIGVKVLGILAMIDEGETDWKVIAINVDDPDAANYNDINDVKRLKPGYLEATVDWFRRYKVPDGKPENEFAFNAEFKDKDFAIDIIKSTHDHWKALVTKKTNGKGISCMNTTLSESPFKCDPDAARAIVDALPPPCESACTVPTDVDKWFHHQKN

SEQ ID NO: 903109 - protein, 325 aa, Homo sapiens
AGPVLAVRRRGALSLSVGAACGLVALWQRRRQDSGTMSGFSTEERAAPFSLEYRVFLKNEKGQYISPFHDIPIYADKDVFHMVVEVPRWSNAKMEIATKDPLNPIKQDVKKGKLRYVANLFPYKGYIWNYGAIPQTWEDPGHNDKHTGCCGDNDPIDVCEIGSKVCARGEIIGVKVLGILAMIDEGETDWKVIAINVDDPDAANYNDINDVKRLKPGYLEATVDWFRRYKVPDGKPENEFAFNAEFKDKDFAIDIIKSTHDHWKALVTKKTNGKGISCMNTTLSESPFKCDPDAARAIVDALPPPCESACTVPTDGKISIPVKFH

SEQ ID NO: 903110 - protein, 306 aa, Homo sapiens
AGPVLAVRRRGALSLSVGAACGLVALWQRRRQDSGTMSGFSTEERAAPFSLEYRVFLKNEKGQYISPFHDIPIYADKDVFHMVVEVPRWSNAKMEIATKDPLNPIKQDVKKGKLRYVANLFPYKGYIWNYGAIPQTWEDPGHNDKHTGCCGDNDPIDVCEIGSKVCARGEIIGVKVLGILAMIDEGETDWKVIAINVDDPDAANYNDINDVKRLKPGYLEATVDWFRRYKDFAIDIIKSTHDHWKALVTKKTNGKGISCMNTTLSESPFKCDPDAARAIVDALPPPCESACTVPTDVDKWFHHQKN

SEQ ID NO: 903111 - protein, 257 aa, Homo sapiens
MVVEVPRWSNAKMEIATKDPLNPIKQDVKKGKLRYVANLFPYKGYIWNYGAIPQTWEDPGHNDKHTGCCGDNDPIDVCEIGSKVCARGEIIGVKVLGILAMIDEGETDWKVIAINVDDPDAANYNDINDVKRLKPGYLEATVDWFRRYKVPDGKPENEFAFNAEFKDKDFAIDIIKSTHDHWKALVTKKTNGKGISCYHHPVNLPAQYQQTWISGSITRKTNEISLEYKLILLHRVHLDVLEVKVVAFQSFKFVELI

SEQ ID NO: 903112 - protein, 110 aa, Homo sapiens
AGPVLAVRRRGALSLSVGAACGLVALWQRRRQDSGTMSGFSTEERAAPFSLEYRVFLKNEKGQYISPFHDIPIYADKDVFHMVVEVPRWSNAKMEVIFHLTFESDLGYWF

SEQ ID NO: 903113 - protein, 87 aa, Homo sapiens
ELHVLLSPTQSTPTGAGWSTPIQLDKVNLQVYCAWSLLDNFEWNQGYSSRFGLFHVDFEDPARPRVPYTSAKEYAKIIRNNGLEAHL

SEQ ID NO: 903114 - protein, 85 aa, Homo sapiens
GATPGRRVGFSLLGPLGIAIQLDKVNLQVYCAWSLLDNFEWNQGYSSRFGLFHVDFEDPARPRVPYTSAKEYAKIIRNNGLEAHL

SEQ ID NO: 903115 - protein, 86 aa, Homo sapiens
PAPPTVSVGGGRRKLHCNNTIQLDKVNLQVYCAWSLLDNFEWNQGYSSRFGLFHVDFEDPARPRVPYTSAKEYAKIIRNNGLEAHL

SEQ ID NO: 903116 - protein, 469 aa, Homo sapiens
MAFPAGFGWAAATAAYQVEGGWDADGKGPCVWDTFTHQGGERVFKNQTGDVACGSYTLWEEDLKCIKQLGLTHYRFSLSWSRLLPDGTTGFINQKGIDYYNKIIDDLLKNGVTPIVTLYHFDLPQTLEDQGGWLSEAIIESFDKYAQFCFSTFGDRVKQWITINEANVLSVMSYDLGMFPPGIPHFGTGGYQAAHNLIKAHARSWHSYDSLFRKKQKGMVSLSLFAVWLEPADPNSVSDQEAAKRAITFHLDLFAKPIFIDGDYPEVVKSQIASMSQKQGYPSSRLPEFTEEEKKMIKGTADFFAVQYYTTRLIKYQENKKGELGILQDAEIEFFPDPSWKNVDWIYVVPWGVCKLLKYIKDTYNNPVIYITENGFPQSDPAPLDDTQRWEYFRQTFQELFKAIQLDKVNLQVYCAWSLLDNFEWNQGYSSRFGLFHVDFEDPARPRVPYTSAKEYAKIIRNNGLEAHL

SEQ ID NO: 903117 - protein, 469 aa, Homo sapiens
SLYTCLVEITLPFHLEENVGGWDADGKGPCVWDTFTHQGGERVFKNQTGDVACGSYTLWEEDLKCIKQLGLTHYRFSLSWSRLLPDGTTGFINQKGIDYYNKIIDDLLKNGVTPIVTLYHFDLPQTLEDQGGWLSEAIIESFDKYAQFCFSTFGDRVKQWITINEANVLSVMSYDLGMFPPGIPHFGTGGYQAAHNLIKAHARSWHSYDSLFRKKQKGMVSLSLFAVWLEPADPNSVSDQEAAKRAITFHLDLFAKPIFIDGDYPEVVKSQIASMSQKQGYPSSRLPEFTEEEKKMIKGTADFFAVQYYTTRLIKYQENKKGELGILQDAEIEFFPDPSWKNVDWIYVVPWGVCKLLKYIKDTYNNPVIYITENGFPQSDPAPLDDTQRWEYFRQTFQELFKAIQLDKVNLQVYCAWSLLDNFEWNQGYSSRFGLFHVDFEDPARPRVPYTSAKEYAKIIRNNGLEAHL

SEQ ID NO: 903118 - protein, 162 aa, Homo sapiens
MAFPAGFGWAAATAAYQVEGGWDADGKGPCVWDTFTHQGGERVFKNQTGDVACGSYTLWEEDLKCIKQLGLTHYRFSLSWSRLLPDGTTGFINQKAIQLDKVNLQVYCAWSLLDNFEWNQGYSSRFGLFHVDFEDPARPRVPYTSAKEYAKIIRNNGLEAHL

SEQ ID NO: 903119 - protein, 84 aa, Homo sapiens
LRSSSSPNRKSEVFTVTPIQLDKVNLQVYCAWSLLDNFEWNQGYSSRFGLFHVDFEDPARPRVPYTSAKEYAKIIRNNGLEAHL

SEQ ID NO: 903120 - protein, 469 aa, Homo sapiens; identical to SEQ ID NO: 903116

SEQ ID NO: 903121 - protein, 84 aa, Homo sapiens
TVCVTRMPNARLNSERPAIQLDKVNLQVYCAWSLLDNFEWNQGYSSRFGLFHVDFEDPARPRVPYTSAKEYAKIIRNNGLEAHL

SEQ ID NO: 903122 - protein, 82 aa, Homo sapiens
ADAPHVLPRCSPRGFAIQLDKVNLQVYCAWSLLDNFEWNQGYSSRFGLFHVDFEDPARPRVPYTSAKEYAKIIRNNGLEAHL

SEQ ID NO: 903123 - protein, 87 aa, Homo sapiens; identical to SEQ ID NO: 903113

SEQ ID NO: 903124 - protein, 296 aa, Homo sapiens
TRSFGQARGCSRYVTLFLTVPKDILSHDIIAGDFRHCKYRKRSATRQRTCSHVKHMTLRVRTHSCMCLIHAEYTTALQAAFIAVDCDVSILETSSPSQIASMSQKQGYPSSRLPEFTEEEKKMIKGTADFFAVQYYTTRLIKYQENKKGELGILQDAEIEFFPDPSWKNVDWIYVVPWGVCKLLKYIKDTYNNPVIYITENGFPQSDPAPLDDTQRWEYFRQTFQELFKAIQLDKVNLQVYCAWSLLDNFEWNQGYSSRFGLFHVDFEDPARPRVPYTSAKEYAKIIRNNGLEAHL

SEQ ID NO: 903125 - protein, 91 aa, Homo sapiens
LITLSSVLLFLFVDAAPQVAFVFPPIQLDKVNLQVYCAWSLLDNFEWNQGYSSRFGLFHVDFEDPARPRVPYTSAKEYAKIIRNNGLEAHL

SEQ ID NO: 903126 - protein, 125 aa, Homo sapiens
GGRRLRPGENSSVAGVDRQCWGTQRTLHSCWPGANLLTAQGWPQQPAVPSVGPAEPTSTRNSRWPASALRPRLFLHTSPQAEGAGSSLSQSREGLTQCRDWPKGSSSTARVDAEAEEAPRASQVC

SEQ ID NO: 903127 - protein, 195 aa, Homo sapiens
QSRRVIVVIVARPLSGRLESKAVRYFSKSAIMAGEEINEDYPVEIHEYLSAFENSIGAVDEMLKTMMSVSRNELLQKLDPLEQAKVDLVSAYTLNSMFWVYLATQGVNPKEHPVKQELERIRVYMNRVKEITDKKKAGKLDRGAASRFVKNALWEPKSKNASKVANNRKQVKVNFLVLMYTYSKSTSFPPPPPAK

SEQ ID NO: 903128 - protein, 195 aa, Homo sapiens; identical to SEQ ID NO: 903127

SEQ ID NO: 903129 - protein, 199 aa, Homo sapiens
QSRRVIVVIVARPLSGRLESKAVRYFSKSAIMAGEEINEDYPVEIHEYLSAFENSIGAVDEMLKTMMSVSRNELLQKLDPLEQAKVDLVSAYTLNSMFWVYLATQGVNPKEHPVKQELERIRVYMNRVKEITDKKKAGKLDRGAASRFVKNALWEPKSKNASKVANNRKQVKVNFLVLMYTYSKSTSFLLLICKFTVNM

SEQ ID NO: 903130 - protein, 193 aa, Homo sapiens
QSRRVIVVIVARPLSGRLESKAVRYFSKSAIMAGEEINEDYPVEIHEYLSAFENSIGAVDEMLKTMMSVSRNELLQKLDPLEQAKVDLVSAYTLNSMFWVYLATQGVNPKEHPVKQELERIRVYMNRVKEITDKKKAGKLDRGAASRFVKNALWEPKSKNASKVANNRKQVKVNFLVLMYTYSKSTSFHHYLY

SEQ ID NO: 903131 - protein, 179 aa, Homo sapiens
RAAGIRHEEGRESAIMAGEEINEDYPVEIHEYLSAFENSIGAVDEMLKTMMSVSRNELLQKLDPLEQAKVDLVSAYTLNSMFWVYLATQGVNPKEHPVKQELERIRVYMNRVKEITDKKKAGKLDRGAASRFVKNALWEPKSKNASKVANNRKQVKVNFLVLMYTYSKSTSFPPPPPAK

SEQ ID NO: 903132 - protein, 191 aa, Homo sapiens
QSRRVIVVIVARPLSGRLESKAVRYFSKSAIMAGEEINEDYPVEIHEYLSAFENSIGAVDEMLKTMMSVSRNELLQKLDPLEQAKVDLVSAYTLNSMFWVYLATQGVNPKEHPVKQELERIRVYMNRVKEITDKKKAGKLDRGAASRFVKNALWEPKSKNASKVANNRKQVKVNFLILINFRWEIRLYVDG

SEQ ID NO: 903133 - protein, 164 aa, Homo sapiens
MAGEEINEDYPVEIHEYLSAFENSIGAVDEMLKTMMSVSRNELLQKLDPLEQAKVDLVSAYTLNSMFWVYLATQGVNPKEHPVKQELERIRVYMNRVKEITDKKKAGKLDRGAASRFVKNALWEPKSKNASKVANNRKQVKVNFLVLMYTYSKSTSFPPPPPAK

SEQ ID NO: 903134 - protein, 168 aa, Homo sapiens
MAGEEINEDYPVEIHEYLSAFENSIGAVDEMLKTMMSVSRNELLQKLDPLEQAKVDLVSAYTLNSMFWVYLATQGVNPKEHPVKQELERIRVYMNRVKEITDKKKAGKLDRGAASRFVKNALWEPKSKNASKVANNRKQVKVNFLVLMYTYSKSTSFLLLICKFTVNM

SEQ ID NO: 903135 - protein, 203 aa, Homo sapiens
MPSPSVSTSAASVLEGVCGRARSTYRTPEEGEEQSWSAIMAGEEINEDYPVEIHEYLSAFENSIGAVDEMLKTMMSVSRNELLQKLDPLEQAKVDLVSAYTLNSMFWVYLATQGVNPKEHPVKQELERIRVYMNRVKEITDKKKAGKLDRGAASRFVKNALWEPKSKNASKVANNRKQVKVNFLVLMYTYSKSTSFPPPPPAK

SEQ ID NO: 903136 - protein, 199 aa, Homo sapiens
MAGEEINEDYPVEIHEYLSAFENSIGAVDEMLKTMMSVSRNELLQKLDPLEQAKVDLVSAYTLNSMFWVYLATQGVNPKEHPVKQELERIRVYMNRVKEITDKKKAGKLDRGAASRFVKNALWEPKSKNASKVANNRKQVKVNFLVLMYTYSKSTSFRHFFPPAREKKIVGGRRVQRVSNKSVSSRQDVKEICAREKNF

SEQ ID NO: 903137 - protein, 1586 aa, Homo sapiens
RCAERLNNLKTSPEAVSGYSFAMAALLGGVHQCPLGIPHAKGKMVVSIAEDLLRTAAQNSRLSLQRTQAGWLLLGALMTLGPSVVRYHLPKMLLLWRNVFPRSLKELEAEKARGDSFTWQVTLEGRAGALCAMRSFVAHCPELLTEDVIRKLMTPIECAMTMMSHIPSVMKAHGAHLKASAAMVRLRLYDILALLPPKTYEGSFNALLRELVAEFTLTDNSANTTTSLLRSLCHYDDSVLLGSWLQETDHKSIEDQLQPNSASGSGALEHDPSSIYLRIPAGEAVPGPLPLGVSVIDASVALFGVVFPHVSYKHRLQMLDHFAECVKQAKGVRQQAVQLNIFTAVLSALKGLAENKSTLGPEEVRKSALTLVMGPLDNPNPILRCAAGEALGRMAQVVGEATFIARMAQYSFDKLKSARDVVSRTGHSLALGCLHRYVGGIGSGQHLKTSVSILLALAQDGTSPEVQTWSLHSLALIVDSSGPMYRGYVEPTLSLVLTLLLTVPPSHTEVHQCLGRCLGAIITTVGPELQGNGATTSTIRSSCLVGCAITQDHSDSLVQAAAISCLQQLHMFAPRHVNLSSLVPSLCVHLCSSHLLLRRAAVACLRQLAQREAAEVCEYAMSLAKNTGDKESSSANVSPFAPGVSSRTDIHCRHQGVNITETGLEGLLFGMLDRETDRKLCSDIHDTLGHMLSSLAVEKLSHWLMLCKDVLAASSDMSTATLLSSGKDEEAEKKDEMDDDTMFTTLGEEDKSKPFVAPRWATRVFAADCLCRIINLCENADQAHFDLALARSAKLRNPTNDLLVLHLSDLIRMAFMAATDHSNQLRMAGLQALEDIIKKFASVPEPEFPGHVILEQYQANVGAALRPAFSQDTPSDIIAKACQVCSTWIGSGVVSDLNDLRRVHNLLVSSLDKVQAGKGSSSQLYRESATTMEKLAVLKAWAEVYVVAMNIKKEAESKPKRAIKNTDDDDDDCGTIDELPPDSLITLVQPELPTLSRLWLAALKDYALLTLPAEFSSQLPPDGGAFYTPETIDTARLHYRNSWAPILHAVALWLNSTGFTCSESTEAAAISGLQKRSTSVNLNQASGAVGSAKSLPEINKDRMHLILGVSIQFLCSPRPEEPIEHVTACLQALHTLLDSPYARVHIAEDQLIGVELLSVLHRLLLTWNPSSVQLLVTGVVQQIVRAAQDYLQEKRNTLNEDDMEKEACTVLGEGGDSGGLIPGKSLVFATMELLMFILVRHMPHLSTKVSDSPSHIATKTRLSEESARLVAATVTILSDLPSLCSPAGCMTILPTILFLIARILKDTAIKSADNQVPPPVSAALQGIKSIVTLSMAKTEAGVQKQWTALIRSTLACILEYSQPEDSVPTPDEVSMLTAIALFLWSASNEIIGVQSLQNGCMNRFKNALNSCDPWVQAKCYQLLLSVFQHSNRALSTPYIHSLAPIVVEKLKAVERNRPASNIELLAVQEGIKVLETLVALGEEQNRVQLLALLVPTLISYLLDENSFASASSASKDLHEFALQNLMHIGPLYPHAFKTVMGAAPELKVRLETAVRASQASKAKAAARQPAPAIHSAPTIKLKTSFF

SEQ ID NO: 903138 - protein, 1497 aa, Homo sapiens
RCAERLNNLKTSPEAVSGYSFAMAALLGGVHQCPLGIPHAKGKMVVSIAEDLLRTAAQNSRLSLQRTQAGWLLLGALMTLGPSVVRYHLPKMLLLWRNVFPRSLKELEAEKARGDSFTWQVTLEGRAGALCAMRSFVAHCPELLTEDVIRKLMTPIECAMTMMSHIPSVMKAHGAHLKASAAMVRLRLYDILALLPPKTYEGSFNALLRELVAEFTLTDNSANTTTSLLRSLCHYDDSVLLGSWLQETDHKSIEDQLQPNSASGSGALEHDPSSIYLRIPAGEAVPGPLPLGVSVIDASVALFGVVFPHVSYKHRLQMLDHFAECVKQAKGVRQQAVQLNIFTAVLSALKGLAENKSTLGPEEVRKSALTLVMGPLDNPNPILRCAAGEALGRMAQVVGEATFIARMAQYSFDKLKSARDVVSRTGHSLALGCLHRYVGGIGSGQHLKTSVSILLALAQDGTSPEVQTWSLHSLALIVDSSGPMYRGYVEPTLSLVLTLLLTVPPSHTEVHQCLGRCLGAIITTVGPELQGNGATTSTIRSSCLVGCAITQDHSDSLVQAAAISCLQQLHMFAPRHVNLSSLVPSLCVHLCSSHLLLRRAAVACLRQLAQREAAEVCEYAMSLAKNTGDKESSSANVSPFAPGVSSRTDIHCRHQGVNITETGLEGLLFGMLDRETDRKLCSDIHDTLGHMLSSLAVEKLSHWLMLCKDVLAASSDMSTATLLSSGKDEEAEKKDEMDDDTMFTTLGEEDKSKPFVAPRWATRVFAADCLCRIINLCENADQAHFDLALARSAKLRNPTNDLLVLHLSDLIRMAFMAATDHSNQLRMAGLQALEDIIKKFASVPEPEFPGHVILEQYQANVGAALRPAFSQDTPSDIIAKACQVCSTWIGSGVVSDLNDLRRVHNLLVSSLDKVQAGKGSSSQLYRESATTMEKLAVLKAWAEVYVVAMNIKKEAESKPKRAIKNTDDDDDDCGTIDELPPDSLITLVQPELPTLSRLWLAALKDYALLTLPAEFSSQLPPDGGAFYTPETIDTARLHYRNSWAPILHAVALWLNSTGFTCSESTEAAAISGLQKRSTSVNLNQASGAVGSAKSLPEINKDRMHLILGVSIQFLCSPRPEEPIEHVTACLQALHTLLDSPYARVHIAEDQLIGVELLSVLHRLLLTWNPSSVQLLVTGVVQQIVRAAQDYLQEKRNTLRCMTILPTILFLIARILKDTAIKSADNQVPPPVSAALQGIKSIVTLSMAKTEAGVQKQWTALIRSTLACILEYSQPEDSVPTPDEVSMLTAIALFLWSASNEIIGVQSLQNGCMNRFKNALNSCDPWVQAKCYQLLLSVFQHSNRALSTPYIHSLAPIVVEKLKAVERNRPASNIELLAVQEGIKVLETLVALGEEQNRVQLLALLVPTLISYLLDENSFASASSASKDLHEFALQNLMHIGPLYPHAFKTVMGAAPELKVRLETAVRASQASKAKAAARQPAPAIHSAPTIKLKTSFF

SEQ ID NO: 903139 - protein, 1421 aa, Homo sapiens
RCAERLNNLKTSPEAVSGYSFAMAALLGGVHQCPLGIPHAKGKMVVSIAEDLLRTAAQNSRLSLQRTQAGWLLLGALMTLGPSVVRYHLPKMLLLWRNVFPRSLKELEAEKARGDSFTWQVTLEGRAGALCAMRSFVAHCPELLTEDVIRKLMTPIECAMTMMSHIPSVMKAHGAHLKASAAMVRLRLYDILALLPPKTYEGSFNALLRELVAEFTLTDNSANTTTSLLRSLCHYDDSVLLGSWLQETDHKSIEDQLQPNSASGSGALEHDPSSIYLRIPAGEAVPGPLPLGVSVIDASVALFGVVFPHVSYKHRLQMLDHFAECVKQAKGVRQQAVQLNIFTAVLSALKGLAENKSTLGPEEVRKSALTLVMGPLDNPNPILRCAAGEALGRMAQVVGEATFIARMAQYSFDKLKSARDVVSRTGHSLALGCLHRYVGGIGSGQHLKTSVSILLALAQDGTSPEVQTWSLHSLALIVDSSGPMYRGYVEPTLSLVLTLLLTVPPSHTEVHQCLGRCLGAIITTVGPELQGNGATTSTIRSSCLVGCAITQDHSDSLVQAAAISCLQQLHMFAPRHVNLSSLVPSLCVHLCSSHLLLRRAAVACLRQLAQREAAEVCEYAMSLAKNTGDKESSSANVSPFAPGVSSRTDIHCRHQGVNITETGLEGLLFGMLDRETDRKLCSDIHDTLGHMLSSLAVEKLSHWLMLCKDVLAASSDMSTATLLSSGKDEEAEKKDEMDDDTMFTTLGEEDKSKPFVAPRWATRVFAADCLCRIINLCENADQAHFDLALARSAKLRNPTNDLLVLHLSDLIRMAFMAATDHSNQLRMAGLQALEDIIKKFASVPEPEFPGHVILEQYQANVGAALRPAFSQDTPSDIIAKACQVCSTWIGSGVVSDLNDLRRVHNLLVSSLDKVQAGKGSSSQLYRESATTMEKLAVLKAWAEVYVVAMNIKKEAESKPKRAIKNTDDDDDDCGTIDELPPDSLITLVQPELPTLSRLWLAALKDYALLTLPAEFSSQLPPDGGAFYTPETIDTARLHYRNSWAPILHAVALWLNSTGFTCSESTEAAAISGLQKRSTSVNLNQASGAVGSAKSLPEINKDRMHLILGVSIQFLCSPRPEEPIEHVTACLQALHTLLDSPYARVHIAEDQLIGVELLSVLHRLLLTWNPSSVQLLVTGVVQQIVRAAQDYLQEKRNTLNEDDMEKEACTVLGEGGDSGGLIPGKSLVFATMELLMFILVRHMPHLSTKVSDSPSHIATKTRLSEESARLVAATVTILSDLPSLCSPAGCMTILPTILFLIARILKDTAIKSADNQVPPPVSAALQGIKSIVTLSMAKTEAGVQKQWTALIRSTLACILEYSQPEDSVPTPDEVSMLTAIALFLWSASNEIIGVQSLQNGCMNRFKNALNSCDPWESSYLLF

SEQ ID NO: 903140 - protein, 1586 aa, Homo sapiens; identical to SEQ ID NO: 903137

SEQ ID NO: 903141 - protein, 1586 aa, Homo sapiens; identical to SEQ ID NO: 903137

SEQ ID NO: 903142 - protein, 1423 aa, Homo sapiens
RCAERLNNLKTSPEAVSGYSFAMAALLGGVHQCPLGIPHAKGKMVVSIAEDLLRTAAQNSRLSLQRTQAGWLLLGALMTLGPSVVRYHLPKMLLLWRNVFPRSLKELEAEKARGDSFTWQVTLEGRAGALCAMRSFVAHCPELLTEDVIRKLMTPIECAMTMMSHIPSVMKAHGAHLKASAAMVRLRLYDILALLPPKTYEGSFNALLRELVAEFTLTDNSANTTTSLLRSLCHYDDSVLLGSWLQETDHKSIEDQLQPNSASGSGALEHDPSSIYLRIPAGEAVPGPLPLGVSVIDASVALFGVVFPHVSYKHRLQMLDHFAECVKQAKGVRQQAVQLNIFTAVLSALKGLAENKSTLGPEEVRKSALTLVMGPLDNPNPILRCAAGEALGRMAQVVGEATFIARMAQYSFDKLKSARDVVSRTGHSLALGCLHRYVGGIGSGQHLKTSVSILLALAQDGTSPEVQTWSLHSLALIVDSSGPMYRGYVEPTLSLVLTLLLTVPPSHTEVHQCLGRCLGAIITTVGPELQGNGATTSTIRSSCLVGCAITQDHSDSLVQAAAISCLQQLHMFAPRHVNLSSLVPSLCVHLCSSHLLLRRAAVACLRQLAQREAAEVCEYAMSLAKNTGDKESSSANVSPFAPGVSSRTDIHCRHQGVNITETGLEGLLFGMLDRETDRKLCSDIHDTLGHMLSSLAVEKLSHWLMLCKDVLAASSDMSTATLLSSGKDEEAEKKDEMDDDTMFTTLGEEDKSKPFVAPRWATRVFAADCLCRIINLCENADQAHFDLALARSAKLRNPTNDLLVLHLSDLIRMAFMAATDHSNQLRMAGLQALEDIIKKFASVPEPEFPGHVILEQYQANVGAALRPAFSQDTPSDIIAKACQVCSTWIGSGVVSDLNDLRRVHNLLVSSLDKVQAGKGSSSQLYRESATTMEKLAVLKAWAEVYVVAMNIKKEAESKPKRAIKNTDDDDDDCGTIDELPPDSLITLVQPELPTLSRLWLAALKDYALLTLPAEFSSQLPPDGGAFYTPETIDTARLHYRNSWAPILHAVALWLNSTGFTCSESTEAAAISGLQKRSTSVNLNQASGAVGSAKSLPEINKDRMHLILGVSIQFLCSPRPEEPIEHVTACLQALHTLLDSPYARVHIAEDQLIGVELLSVLHRLLLTWNPSSVQLLVTGVVQQIVRAAQDYLQEKRNTLNEDDMEKEACTVLGEGGDSGGLIPGKSLVFATMELLMFILVRHMPHLSTKVSDSPSHIATKTRLSEESARLVAATVTILSDLPSLCSPAGCMTILPTILFLIARILKDTAIKSADNQVPPPVSAALQGIKSIVTLSMAKTEAGVQKQWTALIRSTLACILEYSQPEDSVPTPDEVSMLTAIALFLWSASNEIIGVQSLQNGCMNRFKNALNSCDPWVSYTLHRHR

SEQ ID NO: 903143 - protein, 191 aa, Homo sapiens
KGGSIEQESPNIKFIATHGVQAKCYQLLLSVFQHSNRALSTPYIHSLAPIVVEKLKAVERNRPASNIELLAVQEGIKVLETLVALGEEQNRVQLLALLVPTLISYLLDENSFASASSASKDLHEFALQNLMHIGPLYPHAFKTVMGAAPELKVRLETAVRASQASKAKAAARQPAPAIHSAPTIKLKTSFF

SEQ ID NO: 903144 - protein, 985 aa, Homo sapiens
MFLLGADAIGMACLAHTKSSDSEGKQMFNRSHSLDVSPFAPGVSSRTDIHCRHQGVNITETGLEGLLFGMLDRETDRKLCSDIHDTLGHMLSSLAVEKLSHWLMLCKDVLAASSDMSTATLLSSGKDEEAEKKDEMDDDTMFTTLGEEDKSKPFVAPRWATRVFAADCLCRIINLCENADQAHFDLALARSAKLRNPTNDLLVLHLSDLIRMAFMAATDHSNQLRMAGLQALEDIIKKFASVPEPEFPGHVILEQYQANVGAALRPAFSQDTPSDIIAKACQVCSTWIGSGVVSDLNDLRRVHNLLVSSLDKVQAGKGSSSQLYRESATTMEKLAVLKAWAEVYVVAMNIKKEAESKPKRAIKNTDDDDDDCGTIDELPPDSLITLVQPELPTLSRLWLAALKDYALLTLPAEFSSQLPPDGGAFYTPETIDTARLHYRNSWAPILHAVALWLNSTGFTCSESTEAAAISGLQKRSTSVNLNQASGAVGSAKSLPEINKDRMHLILGVSIQFLCSPRPEEPIEHVTACLQALHTLLDSPYARVHIAEDQLIGVELLSVLHRLLLTWNPSSVQLLVTGVVQQIVRAAQDYLQEKRNTLNEDDMEKEACTVLGEGGDSGGLIPGKSLVFATMELLMFILVRHMPHLSTKVSDSPSHIATKTRLSEESARLVAATVTILSDLPSLCSPAGCMTILPTILFLIARILKDTAIKSADNQVPPPVSAALQGIKSIVTLSMAKTEAGVQKQWTALIRSTLACILEYSQPEDSVPTPDEVSMLTAIALFLWSASNEIIGVQSLQNGCMNRFKNALNSCDPWVQAKCYQLLLSVFQHSNRALSTPYIHSLAPIVVEKLKAVERNRPASNIELLAVQEGIKVLETLVALGEEQNRVQLLALLVPTLISYLLDENSFASASSASKDLHEFALQNLMHIGPLYPHAFKTVMGAAPELKVRLETAVRASQASKAKAAARQPAPAIHSAPTIKLKTSFF

SEQ ID NO: 903145 - protein, 1320 aa, Homo sapiens
RCAERLNNLKTSPEAVSGYSFAMAALLGGVHQCPLGIPHAKGKMVVSIAEDLLRTAAQNSRLSLQRTQAGWLLLGALMTLGPSVVRYHLPKMLLLWRNVFPRSLKELEAEKARGDSFTWQVTLEGRAGALCAMRSFVAHCPELLTEDVIRKLMTPIECAMTMMSHIPSVMKAHGAHLKASAAMVRLRLYDILALLPPKTYEGSFNALLRELVAEFTLTDNSANTTTSLLRSLCHYDDSVLLGSWLQETDHKSIEDQLQPNSASGSGALEHDPSSIYLRIPAGEAVPGPLPLGVSVIDASVALFGVVFPHVSYKHRLQMLDHFAECVKQAKGVRQQAVQLNIFTAVLSALKGLAENKSTLGPEEVRKSALTLVMGPLDNPNPILRCAAGEALGRMAQVVGEATFIARMAQYSFDKLKSARDVVSRTGHSLALGCLHRYVGGIGSGQHLKTSVSILLALAQDGTSPEVQTWSLHSLALIVDSSGPMYRGYVEPTLSLVLTLLLTVPPSHTEVHQCLGRCLGAIITTVGPELQGNGATTSTIRSSCLVGCAITQDHSDSLVQAAAISCLQQLHMFAPRHVNLSSLVPSLCVHLCSSHLLLRRAAVACLRQLAQREAAEVCEYAMSLAKNTGDKESSSANVSPFAPGVSSRTDIHCRHQGVNITETGLEGLLFGMLDRETDRKLCSDIHDTLGHMLSSLAVEKLSHWLMLCKDVLAASSDMSTATLLSSGKDEEAEKKDEMDDDTMFTTLGEEDKSKPFVAPRWATRVFAADCLCRIINLCENADQAHFDLALARSAKLRNPTNDLLVLHLSDLIRMAFMAATDHSNQLRMAGLQALEDIIKKFASVPEPEFPGHVILEQYQANVGAALRPAFSQDTPSDIIAKACQVCSTWIGSGVVSDLNDLRRVHNLLVSSLDKVQAGKGSSSQLYRESATTMEKLAVLKAWAEVYVVAMNIKKEAESKPKRAIKNTDDDDDDCGTIDELPPDSLITLVQPELPTLSRLWLAALKDYALLTLPAEFSSQLPPDGGAFYTPETIDTARLHYRNSWAPILHAVALWLNSTGFTCSESTEAAAISGLQKRSTSVNLNQASGAVGSAKSLPEINKDRMHLILGVSIQFLCSPRPEEPIEHVTACLQALHTLLDSPYARVHIAEDQLIGVELLSVLHRLLLTWNPSSVQLLVTGVVQQIVRAAQDYLQEKRNTLNEDDMEKEACTVLGEGGDSGGLIPGKSLVFATMELLMFILVRHMPHLSTKVSDSPSHIATKTRLSEESARLVAATVTILSDLPSLCSPAGSSQMLPASPLSLPAFQSCPFNSLYSFISSNSG

SEQ ID NO: 903146 - protein, 694 aa, Homo sapiens
SLWHQGTCNNKTVEMVLERTKTMLEIVLTHCSAVRVRLPWKKLADFKAGAYVYVVAMNIKKEAESKPKRAIKNTDDDDDDCGTIDELPPDSLITLVQPELPTLSRLWLAALKDYALLTLPAEFSSQLPPDGGAFYTPETIDTARLHYRNSWAPILHAVALWLNSTGFTCSESTEAAAISGLQKRSTSVNLNQASGAVGSAKSLPEINKDRMHLILGVSIQFLCSPRPEEPIEHVTACLQALHTLLDSPYARVHIAEDQLIGVELLSVLHRLLLTWNPSSVQLLVTGVVQQIVRAAQDYLQEKRNTLNEDDMEKEACTVLGEGGDSGGLIPGKSLVFATMELLMFILVRHMPHLSTKVSDSPSHIATKTRLSEESARLVAATVTILSDLPSLCSPAGCMTILPTILFLIARILKDTAIKSADNQVPPPVSAALQGIKSIVTLSMAKTEAGVQKQWTALIRSTLACILEYSQPEDSVPTPDEVSMLTAIALFLWSASNEIIGVQSLQNGCMNRFKNALNSCDPWVQAKCYQLLLSVFQHSNRALSTPYIHSLAPIVVEKLKAVERNRPASNIELLAVQEGIKVLETLVALGEEQNRVQLLALLVPTLISYLLDENSFASASSASKDLHEFALQNLMHIGPLYPHAFKTVMGAAPELKVRLETAVRASQASKAKAAARQPAPAIHSAPTIKLKTSFF

SEQ ID NO: 903147 - protein, 1529 aa, Homo sapiens
RCAERLNNLKTSPEAVSGYSFAMAALLGGVHQCPLGIPHAKGKMVVSIAEDLLRTAAQNSRLSLQRTQAGWLLLGALMTLGPSVVRYHLPKMLLLWRNVFPRSLKELEAEKARGDSFTWQVTLEGRAGALCAMRSFVAHCPELLTEDVIRKLMTPIECAMTMMSHIPSVMKAHGAHLKASAAMVRLRLYDILALLPPKTYEGSFNALLRELVAEFTLTDNSANTTTSLLRSLCHYDDSVLLGSWLQETDHKSIEDQLQPNSASGSGALEHDPSSIYLRIPAGEAVPGPLPLGVSVIDASVALFGVVFPHVSYKHRLQMLDHFAECVKQAKGVRQQAVQLNIFTAVLSALKGLAENKSTLGPEEVRKSALTLVMGPLDNPNPILRCAAGEALGRMAQVVGEATFIARMAQYSFDKLKSARDVVSRTGHSLALGCLHRYVGGIGSGQHLKTSVSILLALAQDGTSPEVQTWSLHSLALIVDSSGPMYRGYVEPTLSLVLTLLLTVPPSHTEVHQCLGRCLGAIITTVGPELQGNGATTSTIRSSCLVGCAITQDHSDSLVQAAAISCLQQLHMFAPRHVNLSSLVPSLCVHLCSSHLLLRRAAVACLRQLAQREAAEVCEYAMSLAKNTGDKESSSANVSPFAPGVSSRTDIHCRHQGVNITETGLEGLLFGMLDRETDRKLCSDIHDTLGHMLSSLAVEKLSHWLMLCKDVLAASSDMSTATLLSSGKDEEAEKKDEMDDDTMFTTLGEEDKSKPFVAPRWATRVFAADCLCRIINLCENADQAHFDLALARSAKLRNPTNDLLVLHLSDLIRMAFMAATDHSNQLRMAGLQALEDIIKKFASVPEPEFPGHVILEQYQANVGAALRPAFSQDTPSDIIAKACQVCSTWIGSGVVSDLNDLRRVHNLLVSSLDKVQAGKGSSSQLYRESATTMEKLAVLKAWAEVYVVAMNIKKEAESKPKRAIKNTDDDDDDCGTIDELPPDSLITLVQPELPTLSRLWLAALKDYALLTLPAEFSSQLPPDGGAFYTPETIDTARLHYRNSWAPILHAVALWLNSTGFTCSESTEAAAISGLQKRSTSVNLNQASGAVGSAKSLPEINKDRMHLILGVSIQFLCSPRPEEPIEHVTACLQALHTLLDSPYARVHIAEDQLIGVELLSVLHRLLLTWNPSSVQLLVTGVVQQIVRAAQDYLQEKRNTLNEDDMEKEACTVLGEGGDSGGLIPGKSLVFATMELLMFILVRHMPHLSTKVSDSPSHIATKTRLSEESARLVAATVTILSDLPSLCSPAGCMTILPTILFLIARILKDTAIKSADNQVPPPVSAALQGIKSIVTLSMAKTEAGVQKQWTALIRSTLACILEYSQPEDSVPTPDEVSMLTAIALFLWSASNEIIGVQSLQNGCMNRFKNALNSCDPWVQAKCYQLLLSVFQHSNRALSTPYIHSLAPIVVEKLKAVERNRPASNIELLAVQEGIKVLETLVALGEEQNILGSQPESTLRSLPPDPILLPPAHNSQAPVIYPPRPPKVLGLQA

SEQ ID NO: 903148 - protein, 1396 aa, Homo sapiens
RCAERLNNLKTSPEAVSGYSFAMAALLGGVHQCPLGIPHAKGKMVVSIAEDLLRTAAQNSRLSLQRTQAGWLLLGALMTLGPSVVRYHLPKMLLLWRNVFPRSLKELEAEKARGDSFTWQVTLEGRAGALCAMRSFVAHCPELLTEDVIRKLMTPIECAMTMMSHIPSVMKAHGAHLKASAAMVRLRLYDILALLPPKTYEGSFNALLRELVAEFTLTDNSANTTTSLLRSLCHYDDSVLLGSWLQETDHKSIEDQLQPNSASGSGALEHDPSSIYLRIPAGEAVPGPLPLGVSVIDASVALFGVVFPHVSYKHRLQMLDHFAECVKQAKGVRQQAVQLNIFTAVLSALKGLAENKSTLGPEEVRKSALTLVMGPLDNPNPILRCAAGEALGRMAQVVGEATFIARMAQYSFDKLKSARDVVSRTGHSLALGCLHRYVGGIGSGQHLKTSVSILLALAQDGTSPEVQTWSLHSLALIVDSSGPMYRGYVEPTLSLVLTLLLTVPPSHTEVHQCLGRCLGAIITTVGPELQGNGATTSTIRSSCLVGCAITQDHSDSLVQAAAISCLQQLHMFAPRHVNLSSLVPSLCVHLCSSHLLLRRAAVACLRQLAQREAAEVCEYAMSLAKNTGDKESSSANVSPFAPGVSSRTDIHCRHQGVNITETGLEGLLFGMLDRETDRKLCSDIHDTLGHMLSSLAVEKLSHWLMLCKDVLAASSDMSTATLLSSGKDEEAEKKDEMDDDTMFTTLGEEDKSKPFVAPRWATRVFAADCLCRIINLCENADQAHFDLALARSAKLRNPTNDLLVLHLSDLIRMAFMAATDHSNQLRMAGLQALEDIIKKFASVPEPEFPGHVILEQYQANVGAALRPAFSQDTPSDIIAKACQVCSTWIGSGVVSDLNDLRRVHNLLVSSLDKVQAGKGSSSQLYRESATTMEKLAVLKAWAEVYVVAMNIKKEAESKPKRAIKNTDDDDDDCGTIDELPPDSLITLVQPELPTLSRLWLAALKDYALLTLPAEFSSQLPPDGGAFYTPETIDTARLHYRNSWAPILHAVALWLNSTGFTCSESTEAAAISGLQKRSTSVNLNQASGAVGSAKSLPEINKDRMHLILGVSIQFLCSPRPEEPIEHVTACLQALHTLLDSPYARVHIAEDQLIGVELLSVLHRLLLTWNPSSVQLLVTGVVQQIVRAAQDYLQEKRNTLNEDDMEKEACTVLGEGGDSGGLIPGKSLVFATMELLMFILVRHMPHLSTKVSDSPSHIATKTRLSEESARLVAATVTILSDLPSLCSPAGCMTILPTILFLIARILKDTAIKSADNQVPPPVSAALQGIKSIVTLSMAKTEAGVQKQWTALIRSTLACILEYSQPGSSQMLPASPLSLPAFQSCPFNSLYSFISSNSG

SEQ ID NO: 903149 - protein, 989 aa, Homo sapiens
MKVVNLKQAILQAWKERWSDYQWAINMKKFFPKGATWDILNLADALLEQAMIGPSPNPLILSYLKYAISSQMVSYSSVLTAISKFDDFSRDLCVQALLDIMDMFCDRLSCHGKAEECIGLCRALLSALHWLLRCTAASAERLREGLEAGTPAAGEKQLAMCLQRLEKTLSSTKNRALLHIAKLEEASSWTAIEHSLLKLGEILANLSNPQLRSQAEQCGTLIRSIPTMLSVHAEQMHKTGFPTVHAVILLEGTMNLTGETQSLVEQLTMVKRMQHIPTPLFVLEIWKACFVGLIESPEGTEELKWTAFTFLKIPQVLVKLKKYSHGDKDFTEDVNCAFEFLLKLTPLLDKADQRCNCDCTNFLLQECGKQGLLSEASVNNLMAKRKADREHAPQQKSGENANIQPNIQLILRAEPTVTNILKTMDADHSKSPEGLLGVLGHMLSGKSLDLLLAAAAATGKLKSFARKFINLNEFTTYGSEESTKPASVRALLFDISFLMLCHVAQTYGSEVILSESRTGAEVPFFETWMQTCMPEEGKILNPDHPCFRPDSTKVESLVALLNNSSEMKLVQMKWHEACLSISAAILEILNAWENGVLAFESIQKITDNIKGKVCSLAVCAVAWLVAHVRMLGLDEREKSLQMIRQLAGPLFSENTLQFYNERVVIMNSILERMCADVLQQTATQIKFPSTGVDTMPYWNLLPPKRPIKEVLTDIFAKVLEKGWVDSRSIHIFDTLLHMGGVYWFCNNLIKELLKETRKEHTLRAVELLYSIFCLDMQQVTLVLLGHILPGLLTDSSKWHSLMDPPGTALAKLAVWCALSSYSSHKGQASTRQKKRHREDIEDYISLFPLDDVQPSKLMRLLSSNEDDANILSSPTDRSMSSSLSASQLHTVNMRDPLNRVLANLFLLISSILGSRTAGPHTQFVQWFMEECVDCLEQGGRGSVLQFMPFTTVSELVKVSAMSSPKVVLAITDLSLPLGRQVAAKAIAAL

SEQ ID NO: 903150 - protein, 1010 aa, Homo sapiens
VPKWRCLPPRTGLCAPFLSPQSWPPPLPPAQSEIMKVVNLKQAILQAWKERWSDYQWAINMKKFFPKGATWDILNLADALLEQAMIGPSPNPLILSYLKYAISSQFDDFSRDLCVQALLDIMDMFCDRLSCHGKAEECIGLCRALLSALHWLLRCTAASAERLREGLEAGTPAAGEKQLAMCLQRLEKTLSSTKNRALLHIAKLEEASSWTAIEHSLLKLGEILANLSNPQLRSQAEQCGTLIRSIPTMLSVHAEQMHKTGFPTVHAVILLEGTMNLTGETQSLVEQLTMVKRMQHIPTPLFVLEIWKACFVGLIESPEGTEELKWTAFTFLKIPQVLVKLKKYSHGDKDFTEDVNCAFEFLLKLTPLLDKADQRCNCDCTNFLLQECGKQGLLSEASVNNLMAKRKADREHAPQQKSGENANIQPNIQLILRAEPTVTNILKTMDADHSKSPEGLLGVLGHMLSGKSLDLLLAAAAATGKLKSFARKFINLNEFTTYGSEESTKPASVRALLFDISFLMLCHVAQTYGSEVILSESRTGAEVPFFETWMQTCMPEEGKILNPDHPCFRPDSTKVESLVALLNNSSEMKLVQMKWHEACLSISAAILEILNAWENGVLAFESIQKITDNIKGKVCSLAVCAVAWLVAHVRMLGLDEREKSLQMIRQLAGPLFSENTLQFYNERVVIMNSILERMCADVLQQTATQIKFPSTGVDTMPYWNLLPPKRPIKEVLTDIFAKVLEKGWVDSRSIHIFDTLLHMGGVYWFCNNLIKELLKETRKEHTLRAVELLYSIFCLDMQQVTLVLLGHILPGLLTDSSKWHSLMDPPGTALAKLAVWCALSSYSSHKGQASTRQKKRHREDIEDYISLFPLDDVQPSKLMRLLSSNEDDANILSSPTDRSMSSSLSASQLHTVNMRDPLNRVLANLFLLISSILGSRTAGPHTQFVQWFMEECVDCLEQGGRGSVLQFMPFTTVSELVKVSAMSSPKVVLAITDLSLPLGRQVAAKAIAAL

SEQ ID NO: 903151 - protein, 1033 aa, Homo sapiens
MKVVNLKQAILQAWKERWSDYQWAINMKKFFPKGATWDILNLADALLEQAMIGPSPNPLILSYLKYAISSQMVSYSSVLTAISKFDDFSRDLCVQALLDIMDMFCDRLSCHGKAEECIGLCRALLSALHWLLRCTAASAERLREGLEAGTPAAGEKQLAMCLQRLEKTLSSTKNRALLHIAKLEEASSWTAIEHSLLKLGEILANLSNPQLRSQAEQCGTLIRSIPTMLSVHAEQMHKTGFPTVHAVILLEGTMNLTGETQSLVEQLTMVKRMQHIPTPLFVLEIWKACFVGLIESPEGTEELKWTAFTFLKIPQVLVKLKKYSHGDKDFTEDVNCAFEFLLKLTPLLDKADQRCNCDCTNFLLQECGKQGLLSEASVNNLMAKRKADREHAPQQKSGENANIQPNIQLILRAEPTVTNILKTMDADHSKSPEGLLGVLGHMLSGKSLDLLLAAAAATGKLKSFARKFINLNEFTTYGSEESTKPASVRALLFDISFLMLCHVAQTYGSEVILSESRTGAEVPFFETWMQTCMPEEGKILNPDHPCFRPDSTKVESLVALLNNSSEMKLVQMKWHEACLSISAAILEILNAWENGVLAFESIQKITDNIKGKVCSLAVCAVAWLVAHVRMLGLDEREKSLQMIRQLAGPLFSENTLQFYNERVVIMNSILERMCADVLQQTATQIKFPSTGVDTMPYWNLLPPKRPIKEVLTDIFAKVLEKGWVDSRSIHIFDTLLHMGGVYWFCNNLIKELLKETRKEHTLRAVELLYSIFCLDMQQVTLVLLGHILPGLLTDSSKWHSLMDPPGTALAKLAVWCALSSYSSHKGQASTRQKKRHREDIEDYISLFPLDDVQPSKLMRLLSSNEDDANILSSPIRSSLGSPCTSYLRWVKVGLGHPRGAPLLHSAGCFPALHLLRPTADRSMSSSLSASQLHTVNMRDPLNRVLANLFLLISSILGSRTAGPHTQFVQWFMEECVDCLEQGGRGSVLQFMPFTTVSELVKVSAMSSPKVVLAITDLSLPLGRQVAAKAIAAL

SEQ ID NO: 903152 - protein, 427 aa, Homo sapiens
ALLRMKLVQMKWHEACLSISAAILEILNAWENGVLAFESIQKITDNIKGKVCSLAVCAVAWLVAHVRMLGLDEREKSLQMIRQLAGPLFSENTLQFYNERVVIMNSILERMCADVLQQTATQIKFPSTGVDTMPYWNLLPPKRPIKEVLTDIFAKVLEKGWVDSRSIHIFDTLLHMGGVYWFCNNLIKELLKETRKEHTLRAVELLYSIFCLDMQQVTLVLLGHILPGLLTDSSKWHSLMDPPGTALAKLAVWCALSSYSSHKGQASTRQKKRHREDIEDYISLFPLDDVQPSKLMRLLSSNEDDANILSSPTDRSMSSSLSASQLHTVNMRDPLNRVLANLFLLISSILGSRTAGPHTQFVQWFMEECVDCLEQGGRGSVLQFMPFTTVSELVKVSAMSSPKVVLAITDLSLPLGRQVAAKAIAAL

SEQ ID NO: 903153 - protein, 225 aa, Homo sapiens
RVHACGKAKALWTKKVSPVYIRILPGLLTDSSKWHSLMDPPGTALAKLAVWCALSSYSSHKGQASTRQKKRHREDIEDYISLFPLDDVQPSKLMRLLSSNEDDANILSSPTDRSMSSSLSASQLHTVNMRDPLNRVLANLFLLISSILGSRTAGPHTQFVQWFMEECVDCLEQGGRGSVLQFMPFTTVSELVKVSAMSSPKVVLAITDLSLPLGRQVAAKAIAAL

SEQ ID NO: 903154 - protein, 167 aa, Homo sapiens
MAPTTTGYPRGKRHREDIEDYISLFPLDDVQPSKLMRLLSSNEDDANILSSPTDRSMSSSLSASQLHTVNMRDPLNRVLANLFLLISSILGSRTAGPHTQFVQWFMEECVDCLEQGGRGSVLQFMPFTTVSELVKVSAMSSPKVVLAITDLSLPLGRQVAAKAIAAL

SEQ ID NO: 903155 - protein, 880 aa, Homo sapiens
MKVVNLKQAILQAWKERWSDYQWAINMKKFFPKGATWDILNLADALLEQAMIGPSPNPLILSYLKYAISSQMVSYSSVLTAISKFDDFSRDLCVQALLDIMDMFCDRLSCHGKAEECIGLCRALLSALHWLLRCTAASAERLREGLEAGTPAAGEKQLAMCLQRLEKTLSSTKNRALLHIAKLEEASSWTAIEHSLLKLGEILANLSNPQLRSQAEQCGTLIRSIPTMLSVHAEQMHKTGFPTVHAVILLEGTMNLTGETQSLVEQLTMVKRMQHIPTPLFVLEIWKACFVGLIESPEGTEELKWTAFTFLKIPQVLVKLKKYSHGDKDFTEDVNCAFEFLLKLTPLLDKADQRCNCDCTNFLLQECGKQGLLSEASVNNLMAKRKADREHAPQQKSGENANIQPNIQLILRAEPTVTNILKTMDADHSKSPEGLLGVLGHMLSGKSLDLLLAAAAATGKLKSFARKFINLNEFTTYGSEESTKPASVRALLFDISFLMLCHVAQTYGSEVILSESRTGAEVPFFETWMQTCMPEEGKILNPDHPCFRPDSTKVESLVALLNNSSEMKLVQMKWHEACLSISAAILEILNAWENGVLAFESIQKITDNIKGKVCSLAVCAVAWLVAHVRMLGLDEREKSLQMIRQLAGPLFSENTLQFYNERVVIMNSILERMCADVLQQTATQIKFPSTGVDTMPYWNLLPPKRPIKEVLTDIFAKVLEKGWVDSRSIHIFDTLLHMGGVYWFCNNLIKELLKETRKEHTLRAVELLYSIFCLDMQQVTLVLLGHILPGLLTDSSKWHSLMDPPGTALAKLAVWCALSSYSSHKGQASTRQKKRHREDIEDYISLFPLDDVQPSKLMRLLSSNEDDANILSSPISISDP

SEQ ID NO: 903156 - protein, 851 aa, Homo sapiens
MKVVNLKQAILQAWKERWSDYQWAINMKKFFPKGATWDILNLADALLEQAMIGPSPNPLILSYLKYAISSQMVSYSSVLTAISKFDDFSRDLCVQALLDIMDMFCDRLSCHGKAEECIGLCRALLSALHWLLRCTAASAERLREGLEAGTPAAGEKQLAMCLQRLEKTLSSTKNRALLHIAKLEEASSWTAIEHSLLKLGEILANLSNPQLRSQAEQCGTLIRSIPTMLSVHAEQMHKTGFPTVHAVILLEGTMNLTGETQSLVEQLTMVKRMQHIPTPLFVLEIWKACFVGLIESPEGTEELKWTAFTFLKIPQVLVKLKKYSHGDKDFTEDVNCAFEFLLKLTPLLDKADQRCNCDCTNFLLQECGKQGLLSEASVNNLMAKRKADREHAPQQKSGENANIQPNIQLILRAEPTVTNILKTMDADHSKSPEGLLGVLGHMLSGKSLDLLLAAAAATGKLKSFARKFINLNEFTTYGSEESTKPASVRALLFDISFLMLCHVAQTYGSEVILSESRTGAEVPFFETWMQTCMPEEGKILNPDHPCFRPDSTKVESLVALLNNSSEMKLVQMKWHEACLSISAAILEILNAWENGVLAFESIQKITDNIKGKVCSLAVCAVAWLVAHVRMLGLDEREKSLQMIRQLAGPLFSENTLQFYNERVVIMNSILERMCADVLQQTATQIKFPSTGVDTMPYWNLLPPKRPIKEVLTDIFAKVLEKGWVDSRSIHIFDTLLHMGGVYWFCNNLIKELLKETRKEHTLRAVELLYSIFCLDMQQVTLVLLGHILPGLLTDSSKWHSLMDPPGTALAKLAVWCALSSYSSHKGQASTRQRKVFPSDNHVGWAGLYIIG

SEQ ID NO: 903157 - protein, 472 aa, Homo sapiens
MKVVNLKQAILQAWKERWSDYQWAINMKKFFPKGATWDILNLADALLEQAMIGPSPNPLILSYLKYAISSQMVSYSSVLTAISKFDDFSRDLCVQALLDIMDMFCDRLSCHGKAEECIGLCRALLSALHWLLRCTAASAERLREGLEAGTPAAGEKQLAMCLQRLEKTLSSTKNRALLHIAKLEEASSWTAIEHSLLKLGEILANLSNPQLRSQAEQCGTLIRSIPTMLSVHAEQMHKTGFPTVHAVILLEGTMNLTGETQSLVEQLTMVKRMQHIPTPLFVLEIWKACFVGLIESPEGTEELKWTAFTFLKIPQVLVKLKKYSHGDKDFTEDVNCAFEFLLKLTPLLDKADQRCNCDCTNFLLQECGKQGLLSEASVNNLMAKRKADREHAPQQKSGENANIQPNIQLILRAEPTVTNILKTMDADHSKSPEGLLGVLGHMLSGKSLDLLLAAAAATGKLKSFARKFINFE

SEQ ID NO: 903158 - protein, 119 aa, Homo sapiens
MSFSLAPFLSPQSWPPPLPPAQSEIMKVVNLKQAILQAWKERWSDYQWAINMKKFFPKGATWDILNLADALLEQAMIGPSPNPLILSYLKYAISSQMVSYSSVLTAISTHIRSTWCKSL

SEQ ID NO: 903159 - protein, 989 aa, Homo sapiens; identical to SEQ ID NO: 903149

SEQ ID NO: 903160 - protein, 989 aa, Homo sapiens; identical to SEQ ID NO: 903149

SEQ ID NO: 903161 - protein, 553 aa, Homo sapiens
RPQSLGWAQQPGGTVQPQVPALAGAAPSPLGWPPPLSQVILSESRTGAEVPFFETWMQTCMPEEGKILNPDHPCFRPDSTKVESLVALLNNSSEMKLVSVARAPTPRVAVGEGQDPLPEPVPCSPVLTSLHTRRQMKWHEACLSISAAILEILNAWENGVLAFESIQKITDNIKGKVCSLAVCAVAWLVAHVRMLGLDEREKSLQMIRQLAGPLFSENTLQFYNERVVIMNSILERMCADVLQQTATQIKFPSTGVDTMPYWNLLPPKRPIKEVLTDIFAKVLEKGWVDSRSIHIFDTLLHMGGVYWFCNNLIKELLKETRKEHTLRAVELLYSIFCLDMQQVTLVLLGHILPGLLTDSSKWHSLMDPPGTALAKLAVWCALSSYSSHKGQASTRQKKRHREDIEDYISLFPLDDVQPSKLMRLLSSNEDDANILSSPTDRSMSSSLSASQLHTVNMRDPLNRVLANLFLLISSILGSRTAGPHTQFVQWFMEECVDCLEQGGRGSVLQFMPFTTVSELVKVSAMSSPKVVLAITDLSLPLGRQVAAKAIAAL

SEQ ID NO: 903162 - protein, 324 aa, Homo sapiens [sequence omitted]

SEQ ID NO: 903163 - protein, 885 aa, Homo sapiens
MKVVNLKQAILQAWKERWSDYQWAINMKKFFPKGATWDILNLADALLEQAMIGPSPNPLILSYLKYAISSQMVSYSSVLTAISKFDDFSRDLCVQALLDIMDMFCDRLSCHGKAEECIGLCRALLSALHWLLRCTAASAERLREGLEAGTPAAGEKQLAMCLQRLEKTLSSTKNRALLHIAKLEEASSWTAIEHSLLKLGEILANLSNPQLRSQAEQCGTLIRSIPTMLSVHAEQMHKTGFPTVHAVILLEGTMNLTGETQSLVEQLTMVKRMQHIPTPLFVLEIWKACFVGLIESPEGTEELKWTAFTFLKIPQVLVKLKKYSHGDKDFTEDVNCAFEFLLKLTPLLDKADQRCNCDCTNFLLQECGKQGLLSEASVNNLMAKRKADREHAPQQKSGENANIQPNIQLILRAEPTVTNILKTMDADHSKSPEGLLGVLGHMLSGKSLDLLLAAAAATGKLKSFARKFINLNEFTTYGSEESTKPASVRALLFDISFLMLCHVAQTYGSEVILSESRTGAEVPFFETWMQTCMPEEGKILNPDHPCFRPDSTKVESLVALLNNSSEMKLVQMKWHEACLSISAAILEILNAWENGVLAFESIQKITDNIKGKVCSLAVCAVAWLVAHVRMLGLDEREKSLQMIRQLAGPLFSENTLQFYNERVVIMNSILERMCADVLQQTATQIKFPSTGVDTMPYWNLLPPKRPIKEVLTDIFAKVLEKGWVDSRSIHIFDTLLHMGGVYWFCNNLIKELLKETRKEHTLRAVELLYSIFCLDMQQVTLVLLGHILPGLLTDSSKWHSLMDPPGTALAKLAVWCALSSYSSHKGQASTRQKKRHREDIEDYISLFPLDDVQPSKLMRLLSSNEDDANILSSPPPAPMSSSPLS

SEQ ID NO: 903164 - protein, 860 aa, Homo sapiens
MKVVNLKQAILQAWKERWSDYQWAINMKKFFPKGATWDILNLADALLEQAMIGPSPNPLILSYLKYAISSQMVSYSSVLTAISKFDDFSRDLCVQALLDIMDMFCDRLSCHGKAEECIGLCRALLSALHWLLRCTAASAERLREGLEAGTPAAGEKQLAMCLQRLEKTLSSTKNRALLHIAKLEEASSWTAIEHSLLKLGEILANLSNPQLRSQAEQCGTLIRSIPTMLSVHAEQMHKTGFPTVHAVILLEGTMNLTGETQSLVEQLTMVKRMQHIPTPLFVLEIWKACFVGLIESPEGTEELKWTAFTFLKIPQVLVKLKKYSHGDKDFTEDVNCAFEFLLKLTPLLDKADQRCNCDCTNFLLQECGKQGLLSEASVNNLMAKRKADREHAPQQKSGENANIQPNIQLILRAEPTVTNILKTMDADHSKSPEGLLGVLGHMLSGKSLDLLLAAAAATGKLKSFARKFINLNEFTTYGSEESTKPASVRALLFDISFLMLCHVAQTYGSEVILSESRTGAEVPFFETWMQTCMPEEGKILNPDHPCFRPDSTKVESLVALLNNSSEMKLVQMKWHEACLSISAAILEILNAWENGVLAFESIQKITDNIKGKVCSLAVCAVAWLVAHVRMLGLDEREKSLQMIRQLAGPLFSENTLQFYNERVVIMNSILERMCADVLQQTATQIKFPSTGVDTMPYWNLLPPKRPIKEVLTDIFAKVLEKGWVDSRSIHIFDTLLHMGGVYWFCNNLIKELLKETRKEHTLRAVELLYSIFCLDMQQVTLVLLGHILPGLLTDSSKWHSLMDPPGTALAKLAVWCALSSYSSHKGQASTRQKKRHREDIEDYIAKLEEACMSLDSTLSP

SEQ ID NO: 903165 - protein, 472 aa, Homo sapiens; identical to SEQ ID NO: 903157

SEQ ID NO: 903166 - protein, 676 aa, Homo sapiens
MKVVNLKQAILQAWKERWSDYQWAINMKKFFPKGATWDILNLADALLEQAMIGPSPNPLILSYLKYAISSQMVSYSSVLTAISKFDDFSRDLCVQALLDIMDMFCDRLSCHGKAEECIGLCRALLSALHWLLRCTAASAERLREGLEAGTPAAGEKQLAMCLQRLEKTLSSTKNRALLHIAKLEEASSWTAIEHSLLKLGEILANLSNPQLRSQAEQCGTLIRSIPTMLSVHAEQMHKTGFPTVHAVILLEGTMNLTGETQSLVEQLTMVKRMQHIPTPLFVLEIWKACFVGLIESPEGTEELKWTAFTFLKIPQVLVKLKKYSHGDKDFTEDVNCAFEFLLKLTPLLDKADQRCNCDCTNFLLQECGKQGLLSEASVNNLMAKRKADREHAPQQKSGENANIQPNIQLILRAEPTVTNILKTMDADHSKSPEGLLGVLGHMLSGKSLDLLLAAAAATGKLKSFARKFINLNEFTTYGSEESTKPASVRALLFDISFLMLCHVAQTYGSEVILSESRTGAEVPFFETWMQTCMPEEGKILNPDHPCFRPDSTKVESLVALLNNSSEMKLVQMKWHEACLSISAAILEILNAWENGVLAFESIQKITDNIKGKVCSLAVCAVAWLVAHVRMLGLDEREKSLQMIRQLAGPLFSENTLQFYNERSVTCLPFSDPSSVL

SEQ ID NO: 903167 - protein, 677 aa, Homo sapiens
AELRIQPRAAANFSGLDQKFLAGQLLPPFISSFPSGSEEAISRHFHPSLATSPPPLIHKGARRRLPGHVGGGEGPTAAARPETRRPEPAPRTRAPAGRPQPSMSAATHSPMMQVASGNGDRDPLPPGWEIKIDPQTGWPFFVDHNSRTTTWNDPRVPSEGPKETPSSANGPSREGSRLPPAREGHPVYPQLRPGYIPIPVLHEGAENRQVHPFHVYPQPGMQRFRTEAAAAAPQRSQSPLRGMPETTQPDKQCGQVAAAAAAQPPASHGPERSQSPAASDCSSSSSSASLPSSGRSSLGSHQLPRGYISIPVIHEQNVTRPAAQPSFHQAQKTHYPAQQGEYQTHQPVYHKIQGDDWEPRPLRAASPFRSSVQGASSREGSPARSSTPLHSPSPIRVHTVVDRPQQPMTHRETAPVSQPENKPESKPGPVGPELPPGHIPIQVIRKEVDSKPVSQKPPPPSEKVEVKVPPAPVPCPPPSPGPSAVPSSPKSVATEERAAPSTAPAEATPPKPGEAEAPPKHPGVLKVEAILEKVQGLEQAVDNFEGKKTDKKYLMIEEYLTKELLALDSVDPEGRADVRQARRDGVRKVQTILEKLEQKAIDVPGQVQVYELQPSNLEADQPLQAIMEMGAVAADKGKKNAGNAEDPHTETQQPEATAAATSNPSSMTDTPGNPAAP

SEQ ID NO: 903168 - protein, 678 aa, Homo sapiens
MAKYEAGVESAEEFSGLDQKFLAGQLLPPFISSFPSGSEEAISRHFHPSLATSPPPLIHKGARRRLPGHVGGGEGPTAAARPETRRPEPAPRTRAPAGRPQPSMSAATHSPMMQVASGNGDRDPLPPGWEIKIDPQTGWPFFVDHNSRTTTWNDPRVPSEGPKETPSSANGPSREGSRLPPAREGHPVYPQLRPGYIPIPVLHEGAENRQVHPFHVYPQPGMQRFRTEAAAAAPQRSQSPLRGMPETTQPDKQCGQVAAAAAAQPPASHGPERSQSPAASDCSSSSSSASLPSSGRSSLGSHQLPRGYISIPVIHEQNVTRPAAQPSFHQAQKTHYPAQQGEYQTHQPVYHKIQGDDWEPRPLRAASPFRSSVQGASSREGSPARSSTPLHSPSPIRVHTVVDRPQQPMTHRETAPVSQPENKPESKPGPVGPELPPGHIPIQVIRKEVDSKPVSQKPPPPSEKVEVKVPPAPVPCPPPSPGPSAVPSSPKSVATEERAAPSTAPAEATPPKPGEAEAPPKHPGVLKVEAILEKVQGLEQAVDNFEGKKTDKKYLMIEEYLTKELLALDSVDPEGRADVRQARRDGVRKVQTILEKLEQKAIDVPGQVQVYELQPSNLEADQPLQAIMEMGAVAADKGKKNAGNAEDPHTETQQPEATAAATSNPSSMTDTPGNPAAP

SEQ ID NO: 903169 - protein, 682 aa, Homo sapiens
RVTRCVLVLIQSQGACISLVVDRQYLAGQLLPPFISSFPSGSEEAISRHFHPSLATSPPPLIHKGARRRLPGHVGGGEGPTAAARPETRRPEPAPRTRAPAGRPQPSMSAATHSPMMQVASGNGDRDPLPPGWEIKIDPQTGWPFFVDHNSRTTTWNDPRVPSEGPKETPSSANGPSREGSRLPPAREGHPVYPQLRPGYIPIPVLHEGAENRQVHPFHVYPQPGMQRFRTEAAAAAPQRSQSPLRGMPETTQPDKQCGQVAAAAAAQPPASHGPERSQSPAASDCSSSSSSASLPSSGRSSLGSHQLPRGYISIPVIHEQNVTRPAAQPSFHQAQKTHYPAQQGEYQTHQPVYHKIQGDDWEPRPLRAASPFRSSVQGASSREGSPARSSTPLHSPSPIRVHTVVDRPQQPMTHRETAPVSQPENKPESKPGPVGPELPPGHIPIQVIRKEVDSKPVSQKPPPPSEKVEVKVPPAPVPCPPPSPGPSAVPSSPKSVATEERAAPSTAPAEATPPKPGEAEAPPKHPGVLKVEAILEKVQGLEQAVDNFEGKKTDKKYLMIEEYLTKELLALDSVDPEGRADVRQARRDGVRKVQTILEKLEQKAIDVPGQVQVYELQPSNLEADQPLQAIMEMGAVAADKGKKNAGNAEDPHTETQQPEATAAATSNPSSMTDTPGNPAAP

SEQ ID NO: 903170 - protein, 677 aa, Homo sapiens; identical to SEQ ID NO: 903167

SEQ ID NO: 903171 - protein, 517 aa, Homo sapiens
MQETPSSANGPSREGSRLPPAREGHPVYPQLRPGYIPIPVLHEGAENRQVHPFHVYPQPGMQRFRTEAAAAAPQRSQSPLRGMPETTQPDKQCGQVAAAAAAQPPASHGPERSQSPAASDCSSSSSSASLPSSGRSSLGSHQLPRGYISIPVIHEQNVTRPAAQPSFHQAQKTHYPAQQGEYQTHQPVYHKIQGDDWEPRPLRAASPFRSSVQGASSREGSPARSSTPLHSPSPIRVHTVVDRPQQPMTHRETAPVSQPENKPESKPGPVGPELPPGHIPIQVIRKEVDSKPVSQKPPPPSEKVEVKVPPAPVPCPPPSPGPSAVPSSPKSVATEERAAPSTAPAEATPPKPGEAEAPPKHPGVLKVEAILEKVQGLEQAVDNFEGKKTDKKYLMIEEYLTKELLALDSVDPEGRADVRQARRDGVRKVQTILEKLEQKAIDVPGQVQVYELQPSNLEADQPLQAIMEMGAVAADKGKKNAGNAEDPHTETQQPEATAAATSNPSSMTDTPGNPAAP

SEQ ID NO: 903172 - protein, 229 aa, Homo sapiens
TKAKYEAGVESAEEKVEVKVPPAPVPCPPPSPGPSAVPSSPKSVATEERAAPSTAPAEATPPKPGEAEAPPKHPGVLKVEAILEKVQGLEQAVDNFEGKKTDKKYLMIEEYLTKELLALDSVDPEGRADVRQARRDGVRKVQTILEKLEQKAIDVPGQVQVYELQPSNLEADQPLQAIMEMGAVAADKGKKNAGNAEDPHTETQQPEATAAATSNPSSMTDTPGNPAAP

SEQ ID NO: 903173 - protein, 677 aa, Homo sapiens; identical to SEQ ID NO: 903167

SEQ ID NO: 903174 - protein, 635 aa, Homo sapiens
AELRIQPRAAANFSGLDQKFLAGQLLPPFISSFPSGSEEAISRHFHPSLATSPPPLIHKGARRRLPGHVGGGEGPTAAARPETRRPEPAPRTRAPAGRPQPSMSAATHSPMMQVASGNGDRDPLPPGWEIKIDPQTGWPFFVDHNSRTTTWNDPRVPSEGPKETPSSANGPSREGSRLPPAREGHPVYPQLRPGYIPIPVLHEGAENRQVHPFHVYPQPGMQRFRTEAAAAAPQRSQSPLRGMPETTQPDKQCGQVAAAAAAQPPASHGPERSQSPAASDCSSSSSSASLPSSGRSSLGSHQLPRGYISIPVIHEQNVTRPAAQPSFHQAQKTHYPAQQGEYQTHQPVYHKIQGDDWEPRPLRAASPFRSSVQGASSREGSPARSSTPLHSPSPIRVHTVVDRPQQPMTHRETAPVSQPENKPESKPGPVGPELPPGHIPIQVIRKEVDSKPVSQKPPPPSEKVEVKVPPAPVPCPPPSPGPSAVPSSPKSVATEERAAPSTAPAEATPPKPGEAEAPPKHPGVLKVEAILEKVQGLEQAVDNFEGKKTDKKYLMIEEYLTKELLALDSVDPEGRADVRQARRDGVRKVQTILEKLDLYVEVSGQHRGMVLRKDSRTLCYHWTFCAMEIQHCGLE

SEQ ID NO: 903175 - protein, 491 aa, Homo sapiens
AELRIQPRAAANFSGLDQKFLAGQLLPPFISSFPSGSEEAISRHFHPSLATSPPPLIHKGARRRLPGHVGGGEGPTAAARPETRRPEPAPRTRAPAGRPQPSMSAATHSPMMQVASGNGDRDPLPPGWEIKIDPQTGWPFFVDHNSRTTTWNDPRVPSEGPKETPSSANGPSREGSRLPPAREGHPVYPQLRPGYIPIPVLHEGAENRQVHPFHVYPQPGMQRFRTEAAAAAPQRSQSPLRGMPETTQPDKQCGQVAAAAAAQPPASHGPERSQSPAASDCSSSSSSASLPSSGRSSLGSHQLPRGYISIPVIHEQNVTRPAAQPSFHQAQKTHYPAQQGEYQTHQPVYHKIQGDDWEPRPLRAASPFRSSVQGASSREGSPARSSTPLHSPSPIRVHTVVDRPQQPMTHRETAPVSQPENKPESKPGPVGPELPPGHIPIQVIRKEVDSKPVSQKPPPPSEKVEVKVPPCSSSSSSASLPSSGRASLGSH

SEQ ID NO: 903176 - protein, 109 aa, Homo sapiens
SLLGSKPLCFPGRAHPLRTVPWARHLFTCRASGSSLQHQRSPSRDRVMAPHHPPASHRAVLQWGRAGIMWLLFVAKERLGRAHCSLPAPDAHRWREQSWDRKPGLPSGA

SEQ ID NO: 903177 - protein, 229 aa, Homo sapiens; identical to SEQ ID NO: 903172

SEQ ID NO: 903178 - protein, 677 aa, Homo sapiens; identical to SEQ ID NO: 903167

SEQ ID NO: 903179 - protein, 270 aa, Homo sapiens [sequence omitted]

SEQ ID NO: 903180 - protein, 368 aa, Homo sapiens
LHSFLEFIDTSHSSSSLLLEHLKTHYPAQQGEYQTHQPVYHKIQGDDWEPRPLRAASPFRSSVQGASSREGSPARSSTPLHSPSPIRVHTVVDRPQQPMTHRETAPVSQPENKPESKPGPVGPELPPGHIPIQVIRKEVDSKPVSQKPPPPSEKVEVKVPPAPVPCPPPSPGPSAVPSSPKSVATEERAAPSTAPAEATPPKPGEAEAPPKHPGVLKVEAILEKVQGLEQAVDNFEGKKTDKKYLMIEEYLTKELLALDSVDPEGRADVRQARRDGVRKVQTILEKLEQKAIDVPGQVQVYELQPSNLEADQPLQAIMEMGAVAADKGKKNAGNAEDPHTETQQPEATAAATSNPSSMTDTPGNPAAP

SEQ ID NO: 903181 - protein, 123 aa, Homo sapiens [sequence omitted]

SEQ ID NO: 903182 - protein, 350 aa, Homo sapiens
AELRIQPRAAANFSGLDQKFLAGQLLPPFISSFPSGSEEAISRHFHPSLATSPPPLIHKGARRRLPGHVGGGEGPTAAARPETRRPEPAPRTRAPAGRPQPSMSAATHSPMMQVASGNGDRDPLPPGWEIKIDPQTGWPFFVDHNSRTTTWNDPRVPSEGPKETPSSANGPSREGSRLPPAREGHPVYPQLRPGYIPIPVLHEGAENRQVHPFHVYPQPGMQRFRTEAAAAAPQRSQSPLRGMPETTQPDKQCGQVAAAAAAQPPASHGPERSQSPAASDCSSSSSSASLPSSGRSSLGSHQLPRGYISIPVIHEQKLGWRQNTNKRAKKENDAFLLYSYSVQIKKLLVV

SEQ ID NO: 903183 - protein, 214 aa, Homo sapiens
AELRIQPRAAANFSGLDQKFLAGQLLPPFISSFPSGSEEAISRHFHPSLATSPPPLIHKGARRRLPGHVGGGEGPTAAARPETRRPEPAPRTRAPAGRPQPSMSAATHSPMMQVASGNGDRDPLPPGWEIKIDPQTGWPFFVDHNSRTTTWNDPRVPSEGPKETPSSANGPSREGSRLPPAREGHPVYPQLRPGYIPIPVLHEGTVFCSSGLEG

SEQ ID NO: 903184 - protein, 840 aa, Homo sapiens [sequence omitted]

SEQ ID NO: 903185 - protein, 840 aa, Homo sapiens [sequence omitted]

SEQ ID NO: 903186 - protein, 881 aa, Homo sapiens
MMSIQEKSKENSSKVTKKSDDKNSETEIQDSQKNLAKKSGPKETIKSQAKSSSESKINQPELETRMSTRSSKAASNDKATKSINKNTVTVRGYSQESTKKKLSQKKLVHENPKANEQLNRRSQRLQQLTEVSRRSLRSREIQGQVQAVKQSLPPTKKEQCSSTQSKSNKTSQKHVKRKVLEVKSDSKEDENLVINEVINSPKGKKRKVEHQTACACSSQCMQGSEKCPQKTTRRDETKPVPVTSEVKRSKMATSVVPKKNEMKKSVHTQVNTNTTLPKSPQPSVPEQSDNELEQAGKSKRGSILQLCEEIAGEIESDNVEVKKESSQMESVKEEKPTEIKLEETSVERQILHQKETNQDVQCNRFFPSRKTKPVKCILNGINSSAKKNSNWTKIKLSKFNSVQHNKLDSQVSPKLGLLRTSFSPPALEMHHPVTQSTFLGTKLHDRNITCQQEKMKEINSEEVKINDITVEINKTTERAPENCHLANEIKPSDPPLDNQMKHSFDSASNKNFSQCLESKLENSPVENVTAASTLLSQAKIDTGENKFPGSAPQQHSILSNQTSKSSDNRETPRNHSLPKCNSHLEITIPKDLKLKEAEKTDEKQLIIDAGQKRFGAVSCNVCGMLYTASNPEDETQHLLFHNQFISAVKYVVLLINHHECGSEEEFITSLFLSMFNFRYTQRSFSFPIRFLEGWKKERILAEYPDGRIIMVLPEDPKYALKKVDEIREMVDNDLGFQQAPLMCYSRTKTLLFISNDKKVVGCLIAEHIQWGYRVIEEKLPVIRSEEEKVRFERQKAWCCSTLPEPAICGISRIWVFSMMRRKKIASRMIECLRSNFIYGSYLSKEEIAFSDPTPDGKLFATQYCGTGQFLVYNFINGQNST

SEQ ID NO: 903187 - protein, 156 aa, Homo sapiens
MQWNVPRTVSRLARRTCLEPHNAGLFGHCQNVKGPLLLYNAESKVVLVQGPQKQWLHLSAAQCVAKERRPLDAHPPQPGVLRHKQGKQHVSFRRVFSSSATAQGTPEKKEEPDPLQDKSISLYQRFKKTFRQYGKVLIPVHLITSGVGLEHFIMQP

SEQ ID NO: 903188 - protein, 156 aa, Homo sapiens; identical to SEQ ID NO: 903187

SEQ ID NO: 903189 - protein, 156 aa, Homo sapiens; identical to SEQ ID NO: 903187

SEQ ID NO: 903190 - protein, 840 aa, Homo sapiens [sequence omitted]

SEQ ID NO: 903191 - protein, 881 aa, Homo sapiens; identical to SEQ ID NO: 903186

SEQ ID NO: 903192 - protein, 156 aa, Homo sapiens; identical to SEQ ID NO: 903187

SEQ ID NO: 903193 - protein, 156 aa, Homo sapiens; identical to SEQ ID NO: 903187

SEQ ID NO: 903194 - protein, 149 aa, Homo sapiens
RRRRKLDTTPDERKEVLRDTLPWLCNLHDILLRDVASGQRVVLACSALKKTYRDILTQGKDGVALKCEESGKEAKQAEMQLLVVHLSGSFEVISGRLLKREGHFMPPELLQSQFETLEPPAAPENFIQISVDKNVSEIIATIMETLKMK

SEQ ID NO: 903195 - protein, 184 aa, Homo sapiens
MAAPGALLVMGVSGSTVGALLASELGWKFYDADDYHPEENRRKMGKGIPLNDQDRIPWLCNLHDILLRDVASGQRVVLACSALKKTYRDILTQGKDGVALKCEESGKEAKQAEMQLLVVHLSGSFEVISGRLLKREGHFMPPELLQSQFETLEPPAAPENFIQISVDKNVSEIIATIMETLKMK

SEQ ID NO: 903196 - protein, 150 aa, Homo sapiens
RAQRGTALTAPAGARAAPPLERRVGRGRRGPEGDGKEPSLGYGGAGRAAGDGRERTLALSPRLEYSGVISARCNLCLLSSGDCHASASGVAGVTGVHHNTQLGFVFLVETGFCRVGRAGPELLASGDPPASASQSAGIIGVSQGLNLTWS

SEQ ID NO: 903197 - protein, 150 aa, Homo sapiens; identical to SEQ ID NO: 903196

SEQ ID NO: 903198 - protein, 148 aa, Homo sapiens
PTLPPRFPPSTPPWPFRDRIPWLCNLHDILLRDVASGQRVVLACSALKKTYRDILTQGKDGVALKCEESGKEAKQAEMQLLVVHLSGSFEVISGRLLKREGHFMPPELLQSQFETLEPPAAPENFIQISVDKNVSEIIATIMETLKMK

SEQ ID NO: 903199 - protein, 189 aa, Homo sapiens
MANRGPAYGLSREVQQKIEKQYDADLEQILIQWITTQCRKDVGRPQPGRENFQNWLKDGTVLCELINALYPEGQAPVKKIQASTMAFKQMEQISQFLQAAERYGINTTDIFQTVDLWEGKNMACVQRTLMNLGGLAVARDDGLFSGDPNWFPKKSKENPRNFSDNQLQEGKNVIGLHDGHQTAGRLRQA

SEQ ID NO: 903200 - protein, 189 aa, Homo sapiens; identical to SEQ ID NO: 903199

SEQ ID NO: 903201 - protein, 189 aa, Homo sapiens; identical to SEQ ID NO: 903199

SEQ ID NO: 903202 - protein, 189 aa, Homo sapiens; identical to SEQ ID NO: 903199

SEQ ID NO: 903203 - protein, 189 aa, Homo sapiens; identical to SEQ ID NO: 903199

SEQ ID NO: 903204 - protein, 189 aa, Homo sapiens; identical to SEQ ID NO: 903199

SEQ ID NO: 903205 - protein, 189 aa, Homo sapiens; identical to SEQ ID NO: 903199

SEQ ID NO: 903206 - protein, 189 aa, Homo sapiens; identical to SEQ ID NO: 903199

SEQ ID NO: 903207 - protein, 189 aa, Homo sapiens; identical to SEQ ID NO: 903199

SEQ ID NO: 903208 - protein, 189 aa, Homo sapiens; identical to SEQ ID NO: 903199

SEQ ID NO: 903209 - protein, 189 aa, Homo sapiens; identical to SEQ ID NO: 903199

SEQ ID NO: 903210 - protein, 189 aa, Homo sapiens; identical to SEQ ID NO: 903199

SEQ ID NO: 903211 - protein, 176 aa, Homo sapiens
MANRGPAYGLSREVQQKIEKQYDADLEQILIQWITTQCRKDVGRPQPGRENFQNWLKDGTQAPVKKIQASTMAFKQMEQISQFLQAAERYGINTTDIFQTVDLWEGKNMACVQRTLMNLGGLAVARDDGLFSGDPNWFPKKSKENPRNFSDNQLQEGKNVIGLHDGHQTAGRLRQA

SEQ ID NO: 903212 - protein, 209 aa, Homo sapiens
MANRGPAYGLSREVQQKIEKQYDADLEQILIQWITTQCRKDVGRPQPGRENFQNWLKDGTLCELINALYPELHSLEDVSGVNAIALSCLQELRDLLHRLKAMVEAQIFFTGACPSGYSALMSSHSTVAILEPVLDLWEGKNMACVQRTLMNLGGLAVARDDGLFSGDPNWFPKKSKENPRNFSDNQLQEGKNVIGLHDGHQTAGRLRQA

SEQ ID NO: 903213 - protein, 252 aa, Homo sapiens
MANRGPAYGLSREVQQKIEKQYDADLEQILIQWITTQCRKDVGRPQPGRENFQNWLKDGTVLCELINALYPEGQAPVKKIQASTMAFKQMEQISQFLQAAERYGINTTDIFQTVDLWEGKNMACVQRTGLGPWALPRNGLIYTGTIYILRSDIPREPQSSQAPFCQGGGFKPVLSPLRCLLASLSPHGLLIHSLPHSHQNWTNWPLPFPWDQNLGASVPHRHALAYSVSPSSPWPVLSLSSVSSVHSMAGSH

SEQ ID NO: 903214 - protein, 189 aa, Homo sapiens; identical to SEQ ID NO: 903199

SEQ ID NO: 903215 - protein, 189 aa, Homo sapiens; identical to SEQ ID NO: 903199

SEQ ID NO: 903216 - protein, 189 aa, Homo sapiens; identical to SEQ ID NO: 903199

SEQ ID NO: 903217 - protein, 196 aa, Homo sapiens
MANRGPAYGLSREVQQKIEKQYDADLEQILIQWITTQCRKDVGRPQPGRENFQNWLKDGTVLCELINALYPEGQAPVKKIQASTMAFKQMEQISQFLQAAERYGINTTDIFQTVDLWEGKNMACVQRTLMNLGGLAVARDDGLFSGDPNWFPKKSKENPRNFSDNQLQEGKAWGGIRGSGVASRSQSCLPETPRGW

SEQ ID NO: 903218 - protein, 132 aa, Homo sapiens
MANRGPAYGLSREVQQKIEKQYDADLEQILIQWITTQCRKDVGRPQPGRENFQNWLKDGTVLCELINALYPEGQAPVKKIQASTMAFKQMEQISQFLQAAERYGINTTDIFQTVDLWEERTWPRYIAGYPSS

SEQ ID NO: 903219 - protein, 58 aa, Homo sapiens
RSGICTEASVVMKIPGWAGRTTCSCSPCLESVRRSPARLNGEQVGGTGVGDMCVLCRK

SEQ ID NO: 903220 - protein, 189 aa, Homo sapiens; identical to SEQ ID NO: 903199

SEQ ID NO: 903221 - protein, 189 aa, Homo sapiens; identical to SEQ ID NO: 903199

SEQ ID NO: 903222 - protein, 189 aa, Homo sapiens; identical to SEQ ID NO: 903199

SEQ ID NO: 903223 - protein, 189 aa, Homo sapiens; identical to SEQ ID NO: 903199

SEQ ID NO: 903224 - protein, 189 aa, Homo sapiens; identical to SEQ ID NO: 903199

SEQ ID NO: 903225 - protein, 189 aa, Homo sapiens; identical to SEQ ID NO: 903199

SEQ ID NO: 903226 - protein, 189 aa, Homo sapiens; identical to SEQ ID NO: 903199

SEQ ID NO: 903227 - protein, 189 aa, Homo sapiens; identical to SEQ ID NO: 903199

SEQ ID NO: 903228 - protein, 189 aa, Homo sapiens; identical to SEQ ID NO: 903199

SEQ ID NO: 903229 - protein, 189 aa, Homo sapiens; identical to SEQ ID NO: 903199

SEQ ID NO: 903230 - protein, 153 aa, Homo sapiens
MANRGPAYGLSREVQQKIEKQYDADLEQILIQWITTQCRKDVGRPQPGRENFQNWLKDGTVLCELINALYPEGQAPVKKIQASTMAFKQMEQISQFLQAAERYGINTTDIFQTVDLWEGKNMACVQRTLMNLGGLAVARDDGLFSGDPNWFPK

SEQ ID NO: 903231 - protein, 271 aa, Homo sapiens
MANRGPAYGLSREVQQKIEKQYDADLEQILIQWITTQCRKDVGRPQPGRENFQNWLKDGTVLCELINALYPEGQAPVKKIQASTMAFKQMEQISQFLQAAERYGINTTDIFQTVDLWEGKNMACVQRTLMNLGGLAVARDDGLFSGDPNWFPKKSKENPRNFSDNQLQEGKNVIGLHDGHQTFCQGGGFKPVLSPLRCLLASLSPHGLLIHSLPHSHQNWTNWPLPFPWDQNLGASVPHRHALAYSVSPSSPWPVLSLSSVSSVHSMAGSH

SEQ ID NO: 903232 - protein, 189 aa, Homo sapiens; identical to SEQ ID NO: 903199

SEQ ID NO: 903233 - protein, 189 aa, Homo sapiens; identical to SEQ ID NO: 903199

SEQ ID NO: 903234 - protein, 169 aa, Homo sapiens
MANRGPAYGLSREVQQKIEKQYDADLEQILIQWITTQCRKDVGRPQPGRENFQNWLKDGTVLCELINALYPEGQAPVKKIQASTMAFKQMEQISQFLQAAERYGINTTDIFQTVDLWEGKNMACVQRTLMNLGGLAVARDDGLFSGDPNWFPKNPEILGILKVTSHAAS

SEQ ID NO: 903235 - protein, 144 aa, Homo sapiens
MANRGPAYGLSREVQQKIEKQYDADLEQILIQWITTQCRKDVGRPQPGRENFQNWLKDGTVLCELINALYPEGQAPVKKIQASTMAFKQMEQISQFLQAAERYGINTTDIFQTVDLWEERTWPVCSGVGCSQRRWIAVSGVDAV

SEQ ID NO: 903236 - protein, 858 aa, Homo sapiens
MSVVGLDVGSQSCYIAVARAGGIETIANEFSDRCTPSVISFGSKNRTIGVAAKNQQITHANNTVSNFKRFHGRAFNDPFIQKEKENLSYDLVPLKNGGVGIKVMYMGEEHLFSVEQITAMLLTKLKETAENSLKKPVTDCVISVPSFFTDAERRSVLDAAQIVGLNCLRLMNDMTAVALNYGIYKQDLPSLDEKPRIVVFVDMGHSAFQVSACAFNKGKLKVLGTAFDPFLGGKNFDEKLVEHFCAEFKTKYKLDAKSKIRALLRLYQECEKLKKLMSSNSTDLPLNIECFMNDKDVSGKMNRSQFEELCAELLQKIEVPLYSLLEQTHLKVEDVSAVEIVGGATRIPAVKERIAKFFGKDISTTLNADEAVARGCALQCAILSPAFKVREFSVTDAVPFPISLIWNHDSEDTEGVHEVFSRNHAAPFSKVLTFLRRGPFELEAFYSDPQGVPYPEAKIGRFVVQNVSAQKDGEKSRVKVKVRVNTHGIFTISTASMVEKVPTEENEMSSEADMECLNQRPPENPDTDKNVQQDNSEAGTQPQVQTDAQQTSQSPPSPELTSEENKIPDADKANEKKVDQPPEAKKPKIKVVNVELPIEANLVWQLGKDLLNMYIETEGKMIMQDKLEKERNDAKNAVEEYVYEFRDKLCGPYEKFICEQDHQNFLRLLTETEDWLYEEGEDQAKQAYVDKLEELMKIGTPVKVRFQEAEERPKMFEELGQRLQHYAKIAADFRNKDEKYNHIDESEMKKVEKSVNEVMEWMNNVMNAQAKKSLDQDPVVRAQEIKTKIKELNNTCEPVVTQPKPKIESPKLERTPNGPNIDKKEEDLEDKNNFGAEPPHQNGECYPNEKNSVNMDLD

SEQ ID NO: 903237 - protein, 858 aa, Homo sapiens; identical to SEQ ID NO: 903236

SEQ ID NO: 903238 - protein, 858 aa, Homo sapiens; identical to SEQ ID NO: 903236

SEQ ID NO: 903239 - protein, 860 aa, Homo sapiens
MATAAVLRGPAAHWVESFQKAREEGSGSGTWRGRWRRRSVISFGSKNRTIGVAAKNQQITHANNTVSNFKRFHGRAFNDPFIQKEKENLSYDLVPLKNGGVGIKVMYMGEEHLFSVEQITAMLLTKLKETAENSLKKPVTDCVISVPSFFTDAERRSVLDAAQIVGLNCLRLMNDMTAVALNYGIYKQDLPSLDEKPRIVVFVDMGHSAFQVSACAFNKGKLKVLGTAFDPFLGGKNFDEKLVEHFCAEFKTKYKLDAKSKIRALLRLYQECEKLKKLMSSNSTDLPLNIECFMNDKDVSGKMNRSQFEELCAELLQKIEVPLYSLLEQTHLKVEDVSAVEIVGGATRIPAVKERIAKFFGKDISTTLNADEAVARGCALQCAILSPAFKVREFSVTDAVPFPISLIWNHDSEDTEGVHEVFSRNHAAPFSKVLTFLRRGPFELEAFYSDPQGVPYPEAKIGRFVVQNVSAQKDGEKSRVKVKVRVNTHGIFTISTASMVEKVPTEENEMSSEADMECLNQRPPENPDTDKNVQQDNSEAGTQPQVQTDAQQTSQSPPSPELTSEENKIPDADKANEKKVDQPPEAKKPKIKVVNVELPIEANLVWQLGKDLLNMYIETEGKMIMQDKLEKERNDAKNAVEEYVYEFRDKLCGPYEKFICEQDHQNFLRLLTETEDWLYEEGEDQAKQAYVDKLEELMKIGTPVKVRFQEAEERPKMFEELGQRLQHYAKIAADFRNKDEKYNHIDESEMKKVEKSVNEVMEWMNNVMNAQAKKSLDQDPVVRAQEIKTKIKELNNTCEPVVTQPKPKIESPKLERTPNGPNIDKKEEDLEDKNNFGAEPPHQNGECYPNEKNSVNMDLD

SEQ ID NO: 903240 - protein, 593 aa, Homo sapiens
MSVVGLDVGSQSCYIAVARAGGIETIANEFSDRCTPSVISFGSKNRTIGVAAKNQQITHANNTVSNFKRFHGRAFNDPFIQKEKENLSYDLVPLKNGGVGIKVMYMGEEHLFSVEQITAMLLTKLKETAENSLKKPVTDCVISVPSFFTDAERRSVLDAAQIVGLNCLRLMNDMTAVALNYGIYKQDLPSLDEKPRIVVFVDMGHSAFQVSACAFNKGKLKVLGTAFDPFLGGKNFDEKLVEHFCAEFKTKYKLDAKSKIRALLRLYQECEKLKKLMSSNSTDLPLNIECFMNDKDVSGKMNRSQFEELCAELLQKIEVPLYSLLEQTHLKVEDVSAVEIVGGATRIPAVKERIAKFFGKDISTTLNADEAVARGCALQCAILSPAFKVREFSVTDAVPFPISLIWNHDSEDTEGVHEVFSRNHAAPFSKVLTFLRRGPFELEAFYSDPQGVPYPEAKIGRFVVQNVSAQKDGEKSRVKVKVRVNTHGIFTISTASMVEKVPTEENEMSSEADMECLNQRPPENPDTDKNVQQDNSEAGTQPQVQTDAQQTSQSPPSPELTSEENKIPDADKANEKKVDQPPEAKKPIRERPS

SEQ ID NO: 903241 - protein, 570 aa, Homo sapiens
MLVLTFLKTSFYLLRSQFEELCAELLQKIEVPLYSLLEQTHLKVEDVSAVEIVGGATRIPAVKERIAKFFGKDISTTLNADEAVARGCALQCAILSPAFKVREFSVTDAVPFPISLIWNHDSEDTEGVHEVFSRNHAAPFSKVLTFLRRGPFELEAFYSDPQGVPYPEAKIGRFVVQNVSAQKDGEKSRVKVKVRVNTHGIFTISTASMVEKVPTEENEMSSEADMECLNQRPPENPDTDKNVQQDNSEAGTQPQVQTDAQQTSQSPPSPELTSEENKIPDADKANEKKVDQPPEAKKPKIKVVNVELPIEANLVWQLGKDLLNMYIETEGKMIMQDKLEKERNDAKNAVEEYVYEFRDKLCGPYEKFICEQDHQNFLRLLTETEDWLYEEGEDQAKQAYVDKLEELMKIGTPVKVRFQEAEERPKMFEELGQRLQHYAKIAADFRNKDEKYNHIDESEMKKVEKSVNEVMEWMNNVMNAQAKKSLDQDPVVRAQEIKTKIKELNNTCEPVVTQPKPKIESPKLERTPNGPNIDKKEEDLEDKNNFGAEPPHQNGECYPNEKNSVNMDLD

SEQ ID NO: 903242 - protein, 858 aa, Homo sapiens; identical to SEQ ID NO: 903236

SEQ ID NO: 903243 - protein, 851 aa, Homo sapiens
MSVVGLDVGSQSCYIAVARAGGIETIANEFSDRCTPSVISFGSKNRTIGVAAKNQQITHANNTVSNFKRFHGRAFNDPFIQKEKENLSYDLVPLKNGGVGIKVMYMGEEHLFSVEQITAMLLTKLKETAENSLKKPVTDCVISVPSFFTDAERRSVLDAAQIVGLNCLRLMNDMTAVALNYGIYKQDLPSLDEKPRIVVFVDMGHSAFQVSACAFNKGKLKVLGTAFDPFLGGKNFDEKLVEHFCAEFKTKYKLDAKSKIRALLRLYQECEKLKKLMSSNSTDLPLNIECFMNDKDVSGKMNRSQFEELCAELLQKIEVPLYSLLEQTHLKVEDVSAVEIVGGATRIPAVKERIAKFFGKDISTTLNADEAVARGCALQCAILSPAFKVREFSVTDAVPFPISLIWNHDSEDTEGVHEVFSRNHAAPFSKVLTFLRRGPFELEAFYSDPQGVPYPEAKIGRFVVQNVSAQKDGEKSRVKVKVRVNTHGIFTISTASMVEKVPTEENEMSSEADMECLNQRPPENPDTDKNVQQDNSEAGTQPQVQTDAQQTSQSPPSPELTSEENKIPDADKANEKKVDQPPEAKKPKIKVVNVELPIEANLVWQLGKDLLNMYIETEGKMIMQDKLEKERNDAKNAVEEYVYEFRDKLCGPYEKFICEQDHQNFLRLLTETEDWLYEEGEDQAKQAYVDKLEELMKIGTPVKVRFQEAEERPKMFEELGQRLQHYAKIAADFRNKDEKYNHIDESEMKKVEKSVNEVMEWMNNVMNAQAKKSLDQDPVVRAQEIKTKIKELNNTCEPVVTQPKPKIESPKLERTPNGPNIDKKEEDLEDKNNFGAEPPHQNDSCGIVNSY

SEQ ID NO: 903244 - protein, 826 aa, Homo sapiens
MSVVGLDVGSQSCYIAVARAGGIETIANEFSDRCTPSVISFGSKNRTIGVAAKNQQITHANNTVSNFKRFHGRAFNDPFIQKEKENLSYDLVPLKNGGVGIKVMYMGEEHLFSVEQITAMLLTKLKETAENSLKKPVTDCVISVPSFFTDAERRSVLDAAQIVGLNCLRLMNDMTAVALNYGIYKQDLPSLDEKPRIVVFVDMGHSAFQVSACAFNKGKLKVLGTAFDPFLGGKNFDEKLVEHFCAEFKTKYKLDAKSKIRALLRLYQECEKLKKLMSSNSTDLPLNIECFMNDKDVSGKMNRSQFEELCAELLQKIEVPLYSLLEQTHLKVEDVSAVEIVGGATRIPAVKERIAKFFGKDISTTLNADEAVARGCALQCAILSPAFKVREFSVTDAVPFPISLIWNHDSEDTEGVHEVFSRNHAAPFSKVLTFLRRGPFELEAFYSDPQGVPYPEAKIGRFVVQNVSAQKDGEKSRVKVKVRVNTHGIFTISTASMVEKVPTEENEMSSEADMECLNQRPPENPDTDKNVQQDNSEAGTQPQVQTDAQQTSQSPPSPELTSEENKIPDADKANEKKVDQPPEAKKPKIKVVNVELPIEANLVWQLGKDLLNMYIETEGKMIMQDKLEKERNDAKNAVEEYVYEFRDKLCGPYEKFICEQDHQNFLRLLTETEDWLYEEGEDQAKQAYVDKLEELMKIGTPVKVRFQEAEERPKMFEELGQRLQHYAKIAADFRNKDEKYNHIDESEMKKVEKSVNEVMEWMNNVMNAQAKKSLDQDPVVRAQEIKTKIKVSVTVSCLLLGSLTDSSCNHLNLQHSHFSCKSFTSS

SEQ ID NO: 903245 - protein, 88 aa, Homo sapiens
RGRATGCERRQRVLRKKQNQELNNTCEPVVTQPKPKIESPKLERTPNGPNIDKKEEDLEDKNNFGAEPPHQNGECYPNEKNSVNMDLD

SEQ ID NO: 903246 - protein, 537 aa, Homo sapiens
MSVVGLDVGSQSCYIAVARAGGIETIANEFSDRCTPSVISFGSKNRTIGVAAKNQQITHANNTVSNFKRFHGRAFNDPFIQKEKENLSYDLVPLKNGGVGIKVMYMGEEHLFSVEQITAMLLTKLKETAENSLKKPVTDCVISVPSFFTDAERRSVLDAAQIVGLNCLRLMNDMTAVALNYGIYKQDLPSLDEKPRIVVFVDMGHSAFQVSACAFNKGKLKVLGTAFDPFLGGKNFDEKLVEHFCAEFKTKYKLDAKSKIRALLRLYQECEKLKKLMSSNSTDLPLNIECFMNDKDVSGKMNRSQFEELCAELLQKIEVPLYSLLEQTHLKVEDVSAVEIVGGATRIPAVKERIAKFFGKDISTTLNADEAVARGCALQCAILSPAFKVREFSVTDAVPFPISLIWNHDSEDTEGVHEVFSRNHAAPFSKVLTFLRRGPFELEAFYSDPQGVPYPEAKIGRFVVQNVSAQKDGEKSRVKVKVRVNTHGIFTISTASMVEKVPTEENEMSSEADMECLNQRPPENPDTDVSLWINLCV

SEQ ID NO: 903247 - protein, 513 aa, Homo sapiens
MSVVGLDVGSQSCYIAVARAGGIETIANEFSDRCTPSVISFGSKNRTIGVAAKNQQITHANNTVSNFKRFHGRAFNDPFIQKEKENLSYDLVPLKNGGVGIKVMYMGEEHLFSVEQITAMLLTKLKETAENSLKKPVTDCVISVPSFFTDAERRSVLDAAQIVGLNCLRLMNDMTAVALNYGIYKQDLPSLDEKPRIVVFVDMGHSAFQVSACAFNKGKLKVLGTAFDPFLGGKNFDEKLVEHFCAEFKTKYKLDAKSKIRALLRLYQECEKLKKLMSSNSTDLPLNIECFMNDKDVSGKMNRSQFEELCAELLQKIEVPLYSLLEQTHLKVEDVSAVEIVGGATRIPAVKERIAKFFGKDISTTLNADEAVARGCALQCAILSPAFKVREFSVTDAVPFPISLIWNHDSEDTEGVHEVFSRNHAAPFSKVLTFLRRGPFELEAFYSDPQGVPYPEAKIAKIESPKLERTPNGPNIDKKEEDLEDKNNFGAEPPHQNGECYPNEKNSVNMDLD

SEQ ID NO: 903248 - protein, 305 aa, Homo sapiens
MSVVGLDVGSQSCYIAVARAGGIETIANEFSDRCTPSVISFGSKNRTIGVAAKNQQITHANNTVSNFKRFHGRAFNDPFIQKEKENLSYDLVPLKNGGVGIKVMYMGEEHLFSVEQITAMLLTKLKETAENSLKKPVTDCVISVPSFFTDAERRSVLDAAQIVGLNCLRLMNDMTAVALNYGIYKQDLPSLDEKPRIVVFVDMGHSAFQVSACAFNKGKLKVLGTAFDPFLGGKNFDEKLVEHFCAEFKTKYKLDAKSKIRALLRLYQECEKLKKLMSSNSTFTARSLYRPIKHVSPQRLNRPLL

SEQ ID NO: 903249 - protein, 110 aa, Homo sapiens
TITRERRLSRSERICISRCAILSPAFKVREFSVTDAVPFPISLIWNHDSEDTEGVHEVFSRNHAAPFSKVLTFLRRGPFELEAFYSDPQGVPYPEAKIVGKEFIVYILLF

SEQ ID NO: 903250 - protein, 814 aa, Homo sapiens
MSVVGLDVGSQSCYIAVARAGGIETIANEFSDRCTPSVISFGSKNRTIGVAAKNQQITHANNTVSNFKRFHGRAFNDPFIQKEKENLSYDLVPLKNGGVGIKVMYMGEEHLFSVEQITAMLLTKLKETAENSLKKPVTDCVISVPSFFTDAERRSVLDAAQIVGLNCLRLMNDMTAVALNYGIYKQDLPSLDEKPRIVVFVDMGHSAFQVSACAFNKGKLKVLGTAFDPFLGGKNFDEKLVEHFCAEFKTKYKLDAKSKIRALLRLYQECEKLKKLMSSNSTDLPLNIECFMNDKDVSGKMNRSQFEELCAELLQKIEVPLYSLLEQTHLKVEDVSAVEIVGGATRIPAVKERIAKFFGKDISTTLNADEAVARGCALQCAILSPAFKVREFSVTDAVPFPISLIWNHDSEDTEGVHEVFSRNHAAPFSKVLTFLRRGPFELEAFYSDPQGVPYPEAKIGRFVVQNVSAQKDGEKSRVKVKVRVNTHGIFTISTASMVEKVPTEENEMSSEADMECLNQRPPENPDTDANEKKVDQPPEAKKPKIKVVNVELPIEANLVWQLGKDLLNMYIETEGKMIMQDKLEKERNDAKNAVEEYVYEFRDKLCGPYEKFICEQDHQNFLRLLTETEDWLYEEGEDQAKQAYVDKLEELMKIGTPVKVRFQEAEERPKMFEELGQRLQHYAKIAADFRNKDEKYNHIDESEMKKVEKSVNEVMEWMNNVMNAQAKKSLDQDPVVRAQEIKTKIKELNNTCEPVVTQPKPKIESPKLERTPNGPNIDKKEEDLEDKNNFGAEPPHQNGECYPNEKNSVNMDLD

SEQ ID NO: 903251 - protein, 817 aa, Homo sapiens
MSVVGLDVGSQSCYIAVARAGGIETIANEFSDRCTPSVISFGSKNRTIGVAAKNQQITHANNTVSNFKRFHGRAFNDPFIQKEKENLSYDLVPLKNGGVGIKVPSFFTDAERRSVLDAAQIVGLNCLRLMNDMTAVALNYGIYKQDLPSLDEKPRIVVFVDMGHSAFQVSACAFNKGKLKVLGTAFDPFLGGKNFDEKLVEHFCAEFKTKYKLDAKSKIRALLRLYQECEKLKKLMSSNSTDLPLNIECFMNDKDVSGKMNRSQFEELCAELLQKIEVPLYSLLEQTHLKVEDVSAVEIVGGATRIPAVKERIAKFFGKDISTTLNADEAVARGCALQCAILSPAFKVREFSVTDAVPFPISLIWNHDSEDTEGVHEVFSRNHAAPFSKVLTFLRRGPFELEAFYSDPQGVPYPEAKIGRFVVQNVSAQKDGEKSRVKVKVRVNTHGIFTISTASMVEKVPTEENEMSSEADMECLNQRPPENPDTDKNVQQDNSEAGTQPQVQTDAQQTSQSPPSPELTSEENKIPDADKANEKKVDQPPEAKKPKIKVVNVELPIEANLVWQLGKDLLNMYIETEGKMIMQDKLEKERNDAKNAVEEYVYEFRDKLCGPYEKFICEQDHQNFLRLLTETEDWLYEEGEDQAKQAYVDKLEELMKIGTPVKVRFQEAEERPKMFEELGQRLQHYAKIAADFRNKDEKYNHIDESEMKKVEKSVNEVMEWMNNVMNAQAKKSLDQDPVVRAQEIKTKIKELNNTCEPVVTQPKPKIESPKLERTPNGPNIDKKEEDLEDKNNFGAEPPHQNGECYPNEKNSVNMDLD

SEQ ID NO: 903252 - protein, 755 aa, Homo sapiens
MYMGEEHLFSVEQITAMLLTKLKETAENSLKKPVTDCVISVPSFFTDAERRSVLDAAQIVGLNCLRLMNDMTAVALNYGIYKQDLPSLDEKPRIVVFVDMGHSAFQVSACAFNKGKLKVLGTAFDPFLGGKNFDEKLVEHFCAEFKTKYKLDAKSKIRALLRLYQECEKLKKLMSSNSTDLPLNIECFMNDKDVSGKMNRSQFEELCAELLQKIEVPLYSLLEQTHLKVEDVSAVEIVGGATRIPAVKERIAKFFGKDISTTLNADEAVARGCALQCAILSPAFKVREFSVTDAVPFPISLIWNHDSEDTEGVHEVFSRNHAAPFSKVLTFLRRGPFELEAFYSDPQGVPYPEAKIGRFVVQNVSAQKDGEKSRVKVKVRVNTHGIFTISTASMVEKVPTEENEMSSEADMECLNQRPPENPDTDKNVQQDNSEAGTQPQVQTDAQQTSQSPPSPELTSEENKIPDADKANEKKVDQPPEAKKPKIKVVNVELPIEANLVWQLGKDLLNMYIETEGKMIMQDKLEKERNDAKNAVEEYVYEFRDKLCGPYEKFICEQDHQNFLRLLTETEDWLYEEGEDQAKQAYVDKLEELMKIGTPVKVRFQEAEERPKMFEELGQRLQHYAKIAADFRNKDEKYNHIDESEMKKVEKSVNEVMEWMNNVMNAQAKKSLDQDPVVRAQEIKTKIKELNNTCEPVVTQPKPKIESPKLERTPNGPNIDKKEEDLEDKNNFGAEPPHQNGECYPNEKNSVNMDLD

SEQ ID NO: 903253 - protein, 851 aa, Homo sapiens; identical to SEQ ID NO: 903243

SEQ ID NO: 903254 - protein, 858 aa, Homo sapiens; identical to SEQ ID NO: 903236

SEQ ID NO: 903255 - protein, 163 aa, Homo sapiens
MKIGTPVKVRFQEAEERPKMFEELGQRLQHYAKIAADFRNKDEKYNHIDESEMKKVEKSVNEVMEWMNNVMNAQAKKSLDQDPVVRAQEIKTKIKELNNTCEPVVTQPKPKIESPKLERTPNGPNIDKKEEDLEDKNNFGAEPPHQNGECYPNEKNSVNMDLD

SEQ ID NO: 903256 - protein, 624 aa, Homo sapiens
MSVVGLDVGSQSCYIAVARAGGIETIANEFSDRCTPSVISFGSKNRTIGVAAKNQQITHANNTVSNFKRFHGRAFNDPFIQKEKENLSYDLVPLKNGGVGIKVMYMGEEHLFSVEQITAMLLTKLKETAENSLKKPVTDCVISVPSFFTDAERRSVLDAAQIVGLNCLRLMNDMTAVALNYGIYKQDLPSLDEKPRIVVFVDMGHSAFQVSACAFNKGKLKVLGTAFDPFLGGKNFDEKLVEHFCAEFKTKYKLDAKSKIRALLRLYQECEKLKKLMSSNSTDLPLNIECFMNDKDVSGKMNRSQFEELCAELLQKIEVPLYSLLEQTHLKVEDVSAVEIVGGATRIPAVKERIAKFFGKDISTTLNADEAVARGCALQCAILSPAFKVREFSVTDAVPFPISLIWNHDSEDTEGVHEVFSRNHAAPFSKVLTFLRRGPFELEAFYSDPQGVPYPEAKIGRFVVQNVSAQKDGEKSRVKVKVRVNTHGIFTISTASMVEKVPTEENEMSSEADMECLNQRPPENPDTDKNVQQDNSEAGTQPQVQTDAQQTSQSPPSPELTSEENKIPDADKANEKKVDQPPEAKKPKIKVVNVELPIEANLVWQLGKDLLNMYIETELDDNED

SEQ ID NO: 903257 - protein, 513 aa, Homo sapiens; identical to SEQ ID NO: 903247

SEQ ID NO: 903258 - protein, 352 aa, Homo sapiens
MEGISIYTSDNYTEEMGSGDYDSMKEPCFREENANFNKIFLPTIYSIIFLTGIVGNGLVILVMGYQKKLRSMTDKYRLHLSVADLLFVITLPFWAVDAVANWYFGNFLCKAVHVIYTVNLYSSVLILAFISLDRYLAIVHATNSQRPRKLLAEKVVYVGVWIPALLLTIPDFIFANVSEADDRYICDRFYPNDLWVVVFQFQHIMVGLILPGIVILSCYCIIISKLSHSKGHQKRKALKTTVILILAFFACWLPYYIGISIDSFILLEIIKQGCEFENTVHKWISITEALAFFHCCLNPILYAFLGAKFKTSAQHALTSVSRGSSLKILSKGKRGGHSSVSTESESSSFHSS

SEQ ID NO: 903259 - protein, 352 aa, Homo sapiens; identical to SEQ ID NO: 903258

SEQ ID NO: 903260 - protein, 334 aa, Homo sapiens
MEGISIYTSDNYTEEMGSGDYDSMKEPCFREENANFNNGLVILVMGYQKKLRSMTDKYRLHLSVADLLFVITLPFWAVDAVANWYFGNFLCKAVHVIYTVNLYSSVLILAFISLDRYLAIVHATNSQRPRKLLAEKVVYVGVWIPALLLTIPDFIFANVSEADDRYICDRFYPNDLWVVVFQFQHIMVGLILPGIVILSCYCIIISKLSHSKGHQKRKALKTTVILILAFFACWLPYYIGISIDSFILLEIIKQGCEFENTVHKWISITEALAFFHCCLNPILYAFLGAKFKTSAQHALTSVSRGSSLKILSKGKRGGHSSVSTESESSSFHSS

SEQ ID NO: 903261 - protein, 356 aa, Homo sapiens
MSIPLPLLQIYTSDNYTEEMGSGDYDSMKEPCFREENANFNKIFLPTIYSIIFLTGIVGNGLVILVMGYQKKLRSMTDKYRLHLSVADLLFVITLPFWAVDAVANWYFGNFLCKAVHVIYTVNLYSSVLILAFISLDRYLAIVHATNSQRPRKLLAEKVVYVGVWIPALLLTIPDFIFANVSEADDRYICDRFYPNDLWVVVFQFQHIMVGLILPGIVILSCYCIIISKLSHSKGHQKRKALKTTVILILAFFACWLPYYIGISIDSFILLEIIKQGCEFENTVHKWISITEALAFFHCCLNPILYAFLGAKFKTSAQHALTSVSRGSSLKILSKGKRGGHSSVSTESESSSFHSS

SEQ ID NO: 903262 - protein, 309 aa, Homo sapiens
MEGISIYTSDNYTEEMGSGDYDSMKEPCFREENANFNKIFLPTIYSIIFLTGIVGNGLVILVMGYQKKLRSMTDKYRLHLSVADLLFVITLPFWAVDAVANWYFGNFLCKAVHVIYTVNLYSSVLILAFISLDRYLAIVHATNSQRPRKLLAEKVVYVGVWIPALLLTIPDFIFANVSEADDRYICDRFYPNDLWVVVFQFQHIMVGLILPYYIGISIDSFILLEIIKQGCEFENTVHKWISITEALAFFHCCLNPILYAFLGAKFKTSAQHALTSVSRGSSLKILSKGKRGGHSSVSTESESSSFHSS

SEQ ID NO: 903263 - protein, 350 aa, Homo sapiens
MHCILSRRYIIPIIIYIQLVLTYSRFDVHTHCLYRIISYPNYQNYIIIFILKIILSSSSLRPESLQPLQLTLLSPFLVSGNPLLFVITLPFWAVDAVANWYFGNFLCKAVHVIYTVNLYSSVLILAFISLDRYLAIVHATNSQRPRKLLAEKVVYVGVWIPALLLTIPDFIFANVSEADDRYICDRFYPNDLWVVVFQFQHIMVGLILPGIVILSCYCIIISKLSHSKGHQKRKALKTTVILILAFFACWLPYYIGISIDSFILLEIIKQGCEFENTVHKWISITEALAFFHCCLNPILYAFLGAKFKTSAQHALTSVSRGSSLKILSKGKRGGHSSVSTESESSSFHSS

SEQ ID NO: 903264 - protein, 91 aa, Homo sapiens
SLSAVGEGARVPPNPARRPRPPAPALAPAEPRNFPGARAKVSAKCCPSCRDGAAEPARGARRGTRAPPERRPQEAAPRKAAADRRAQRQTR

SEQ ID NO: 903265 - protein, 455 aa, Homo sapiens
FPFGRGGGGSCPPQPSPEAASARARSGPRGAAQLPGSPGQSERKVLPKLPGWSCRAGPRRSPWNSRATRTATSRSSSTKGSRGSPRSATNKSRAEPLICAQGTQHGALGTITAVPVTGPQVSSLQRLAGQGAAVLPQVRPKTLIPDSLPVAPGRDRPPKQPPTFQKATVVSVKNPSPALPTANNTVSHVPAPGSQPQALAEPAALASPLSSAGVAYAIISTSPSNAAAMAPSTAVSVVSDSIKVQPLLISADNKVIIIQPQVQTQPESTAESRPPTEEPSQGAQATKKKKEDRPPTQENPEKIAFMVALGLVTTEHLEEIQSKRQERKRRSTANPAYSGLLETERKRLASNYLNNPLFLTARANEDPCWKNEITHDEHCAACKRGANLQPCGTCPGAYHLSCLEPPLKTAPKGVWVCPRCQQKALKKDEGVPWTGMLAIVHSYVTHHPWTACGPS

SEQ ID NO: 903266 - protein, 528 aa, Homo sapiens
MELQSRPEALAVELARHQNGDLKKQLHERQPRIAALSDKQALGTITAVPVTGPQVSSLQRLAGQGAAVLPQVRPKTLIPDSLPVAPGRDRPPKQPPTFQKATVVSVKNPSPALPTANNTVSHVPAPGSQPQALAEPAALASPLSSAGVAYAIISTSPSNAAAMAPSTAVSVVSDSIKVQPLLISADNKPPPRLLSSPHPATHHCPLHPSSLPLTPPSPSLSPSPLHGIFQVIIIQPQVQTQPESTAESRPPTEEPSQGAQATKKKKEDRPPTQENPEKIAFMVALGLVTTEHLEEIQSKRQERKRRSTANPAYSGLLETERKRLASNYLNNPLFLTARANEDPCWKNEITHDEHCAACKRGANLQPCGTCPGAYHLSCLEPPLKTAPKGVWVCPRCQQKALKKDEGVPWTGMLAIVHSYVTIKEEEKQKLLQRGSELQNEHQQLEERDRRLASAVQKCLELKTSLLARQRGTQSSLDRLRALLRLIQGEQLLQVTMTTTSPAPLLAGPWTKPSVAATHPTVQHPQGHN

SEQ ID NO: 903267 - protein, 261 aa, Homo sapiens
MAESHLQSSLITASQFFEIWLHFDADGSGYLEGKELQNLIQELQQARKKAGLELSPEMKTFVDQYGQRDDGKIGIVELAHVLPTEENFLLLFRCQQLKSCEEFMKTWRKYDTDHSGFIETEELKNFLKDLLEKANKTVDDTKLAEYTDLMLKLFDSNNDGKLELTEMARLLPVQENFLLKFQGIKMCGKEFNKAFELYDQDGNGYIDENELDALLKDLCEKNKQDLDINNITTYKKNIMALSDGGKLYRTDLALILCAGDN

SEQ ID NO: 903268 - protein, 261 aa, Homo sapiens; identical to SEQ ID NO: 903267

SEQ ID NO: 903269 - protein, 291 aa, Homo sapiens
LFTRTHMKFGAVTQIRDLPWEINPLSSCSLLCEKDPPTTSGPQTDQPKKHLTNFKSGSGYLEGKELQNLIQELQQARKKAGLELSPEMKTFVDQYGQRDDGKIGIVELAHVLPTEENFLLLFRCQQLKSCEEFMKTWRKYDTDHSGFIETEELKNFLKDLLEKANKTVDDTKLAEYTDLMLKLFDSNNDGKLELTEMARLLPVQENFLLKFQGIKMCGKEFNKAFELYDQDGNGYIDENELDALLKDLCEKNKQDLDINNITTYKKNIMALSDGGKLYRTDLALILCAGDN

SEQ ID NO: 903270 - protein, 156 aa, Homo sapiens
FLPTPLTIVFSSPTTKTPYNFLKDLLEKANKTVDDTKLAEYTDLMLKLFDSNNDGKLELTEMARLLPVQENFLLKFQGIKMCGKEFNKAFELYDQDGNGYIDENELDALLKDLCEKNKQDLDINNITTYKKNIMALSDGGKLYRTDLALILCAGDN

SEQ ID NO: 903271 - protein, 248 aa, Homo sapiens [sequence omitted]

SEQ ID NO: 903272 - protein, 435 aa, Homo sapiens
MAAHLLPICALFLTLLDMAQGFRGPLLPNRPFTTVWNANTQWCLERHGVDVDVSVFDVVANPGQTFRGPDMTIFYSSQLGTYPYYTPTGEPVFGGLPQNASLIAHLARTFQDILAAIPAPDFSGLAVIDWEAWRPRWAFNWDTKDIYRQRSRALVQAQHPDWPAPQVEAVAQDQFQGAARAWMAGTLQLGRALRPRGLWGFYGFPDCYNYDFLSPNYTGQCPSGIRAQNDQLGWLWGQSRALYPSIYMPAVLEGTGKSQMYVQHRVAEAFRVAVAAGDPNLPVLPYVQIFYDTTNHFLPLDELEHSLGESAAQGAAGVVLWVSWENTRTKESCQAIKEYMDTTLGPFILNVTSGALLCSQALCSGHGRCVRRTSHPKALLLLNPASFSIQLTPGGGPLSLRGALSLEDQAQMAVEFKCRCYPGWQAPWCERKSMW

SEQ ID NO: 903273 - protein, 475 aa, Homo sapiens
VSGAAGVESGQALLRPPSWGQEIWRIRPFSPKVVLDQSRAMAAHLLPICALFLTLLDMAQGFRGPLLPNRPFTTVWNANTQWCLERHGVDVDVSVFDVVANPGQTFRGPDMTIFYSSQLGTYPYYTPTGEPVFGGLPQNASLIAHLARTFQDILAAIPAPDFSGLAVIDWEAWRPRWAFNWDTKDIYRQRSRALVQAQHPDWPAPQVEAVAQDQFQGAARAWMAGTLQLGRALRPRGLWGFYGFPDCYNYDFLSPNYTGQCPSGIRAQNDQLGWLWGQSRALYPSIYMPAVLEGTGKSQMYVQHRVAEAFRVAVAAGDPNLPVLPYVQIFYDTTNHFLPLDELEHSLGESAAQGAAGVVLWVSWENTRTKESCQAIKEYMDTTLGPFILNVTSGALLCSQALCSGHGRCVRRTSHPKALLLLNPASFSIQLTPGGGPLSLRGALSLEDQAQMAVEFKCRCYPGWQAPWCERKSMW

SEQ ID NO: 903274 - protein, 445 aa, Homo sapiens
VSGAAGVESGQALLRPPSWGQEIWRIRPFSPKVVLDQSRAMAAHLLPICALFLTLLDMAQGFRGPLLPNRPFTTVWNANTQWCLERHGVDVDVSVFDVVANPGQTFRGPDMTIFYSSQLGTYPYYTPTGEPVFGGLPQNASLIAHLARTFQDILAAIPAPDFSGLAVIDWEAWRPRWAFNWDTKDIYRQRSRALVQAQHPDWPAPQVEAVAQDQFQGAARAWMAGTLQLGRALRPRGLWGFYGFPDCYNYDFLSPNYTGQCPSGIRAQNDQLGWLWGQSRALYPSIYMPAVLEGTGKSQMYVQHRVAEAFRVAVAAGDPNLPVLPYVQIFYDTTNHFLPLESCQAIKEYMDTTLGPFILNVTSGALLCSQALCSGHGRCVRRTSHPKALLLLNPASFSIQLTPGGGPLSLRGALSLEDQAQMAVEFKCRCYPGWQAPWCERKSMW

SEQ ID NO: 903275 - protein, 409 aa, Homo sapiens
VSGAAGVESGQALLRPPSWGQEIWRIRPFSPKVVLDQSRAMAAHLLPICALFLTLLDMAQGFRGPLLPNRPFTTVWNANTQWCLERHGVDVDVSVFDVVANPGQTFRGPDMTIFYSSQLGTYPYYTPTGEPVFGGLPQNASLIAHLARTFQDILAAIPAPDFSGLAVIDWEAWRPRWAFNWDTKDIYRQRSRALVQAQHPDWPAPQVEAVAQDQFQGAARAWMAGTLQLGRALRPRGLWGFYGFPDCYNYDFLSPNYTGQCPSGIRAQNDQLGWLWGQSRALYPSIYMPAVLEGTGKSQMYVQHRVAEAFRVAVAAGDPNLPVLPYVQIFYDTTNHFLPLDELEHSLGESAAQGAAGVVLWVSWENTRTKTGALHPERDQWGPSLQSSPVLRPWPLCPPHQPPQSPPPP

SEQ ID NO: 903276 - protein, 735 aa, Homo sapiens
MLVHLFRVGIRGGPFPGRLLPPLRFQTFSAVRNTWRNGKTGQLHKAEGEYSDGYRSSSLLRAVAHLRSQLWAHLPRAPLAPRWSPSAWCWVGGALLGPMVLSKHPHLCLVALCEAEEAPPASSTPHVVGSRFNWKLFWQFLHPHLLVLGVAVVLALGAALVNVQIPLLLGQLVEVVAKYTRDHVGSFMTESQNLSTHLLILYGVQGLLTFGYLVLLSHVGERMAVDMRRALFSSLLRQDITFFDANKTGQLVSRLTTDVQEFKSSFKLVISQGLRSCTQVAGCLVSLSMLSTRLTLLLMVATPALMGVGTLMGSGLRKLSRQCQEQIARAMGVADEALGNVRTVRAFAMEQREEERYGAELEACRCRAEELGRGIALFQGLSNIAFNCMVLGTLFIGGSLVAGQQLTGGDLMSFLVASQTVQRSMANLSVLFGQVVRGLSAGARVFEYMALNPCIPLSGGCCVPKEQLRGSVTFQNVCFSYPCRPGFEVLKDFTLTLPPGKIVALVGQSGGGKTTVASLLERFYDPTAGVVMLDGRDLRTLDPSWLRGQVVGFISQEPVLFGTTIMENIRFGKLEASDEEVYTAAREANAHEFITSFPEGYNTVVGERGTTLSGGQKQRLAIARALIKQPTVLILDEATSALDAESERVVQEALDRASAGRTVLVIAHRLSTVRGAHCIVVMADGRVWEAGTHEELLKKGGLYAELIRRQALDAPRTAAPPPKKPEGPRSHQHKS

SEQ ID NO: 903277 - protein, 635 aa, Homo sapiens
RALSGMRVKLLLPAAPVLPRQHAGAFISGRDSGWPIPRQAATAPPLPDILSCQLALGAALVNVQIPLLLGQLVEVVAKYTRDHVGSFMTESQNLSTHLLILYGVQGLLTFGYLVLLSHVGERMAVDMRRALFSSLLRQDITFFDANKTGQLVSRLTTDVQEFKSSFKLVISQGLRSCTQVAGCLVSLSMLSTRLTLLLMVATPALMGVGTLMGSGLRKLSRQCQEQIARAMGVADEALGNVRTVRAFAMEQREEERYGAELEACRCRAEELGRGIALFQGLSNIAFNCMVLGTLFIGGSLVAGQQLTGGDLMSFLVASQTVQRSMANLSVLFGQVVRGLSAGARVFEYMALNPCIPLSGGCCVPKEQLRGSVTFQNVCFSYPCRPGFEVLKDFTLTLPPGKIVALVGQSGGGKTTVASLLERFYDPTAGVVMLDGRDLRTLDPSWLRGQVVGFISQEPVLFGTTIMENIRFGKLEASDEEVYTAAREANAHEFITSFPEGYNTVVGERGTTLSGGQKQRLAIARALIKQPTVLILDEATSALDAESERVVQEALDRASAGRTVLVIAHRLSTVRGAHCIVVMADGRVWEAGTHEELLKKGGLYAELIRRQALDAPRTAAPPPKKPEGPRSHQHKS

SEQ ID NO: 903278 - protein, 431 aa, Homo sapiens [sequence omitted]

SEQ ID NO: 903279 - protein, 407 aa, Homo sapiens [sequence omitted]

SEQ ID NO: 903280 - protein, 718 aa, Homo sapiens
MLVHLFRVGIRGGPFPGRLLPPLRFQTFSAVRYSDGYRSSSLLRAVAHLRSQLWAHLPRAPLAPRWSPSAWCWVGGALLGPMVLSKHPHLCLVALCEAEEAPPASSTPHVVGSRFNWKLFWQFLHPHLLVLGVAVVLALGAALVNVQIPLLLGQLVEVVAKYTRDHVGSFMTESQNLSTHLLILYGVQGLLTFGYLVLLSHVGERMAVDMRRALFSSLLRQDITFFDANKTGQLVSRLTTDVQEFKSSFKLVISQGLRSCTQVAGCLVSLSMLSTRLTLLLMVATPALMGVGTLMGSGLRKLSRQCQEQIARAMGVADEALGNVRTVRAFAMEQREEERYGAELEACRCRAEELGRGIALFQGLSNIAFNCMVLGTLFIGGSLVAGQQLTGGDLMSFLVASQTVQRSMANLSVLFGQVVRGLSAGARVFEYMALNPCIPLSGGCCVPKEQLRGSVTFQNVCFSYPCRPGFEVLKDFTLTLPPGKIVALVGQSGGGKTTVASLLERFYDPTAGVVMLDGRDLRTLDPSWLRGQVVGFISQEPVLFGTTIMENIRFGKLEASDEEVYTAAREANAHEFITSFPEGYNTVVGERGTTLSGGQKQRLAIARALIKQPTVLILDEATSALDAESERVVQEALDRASAGRTVLVIAHRLSTVRGAHCIVVMADGRVWEAGTHEELLKKGGLYAELIRRQALDAPRTAAPPPKKPEGPRSHQHKS

SEQ ID NO: 903281 - protein, 693 aa, Homo sapiens
MLVHLFRVGIRGGPFPGRLLPPLRFQTFSAVRYSDGYRSSSLLRAVAHLRSQLWAHLPRAPLAPRWSPSAWCWVGGALLGPMVLSKHPHLCLVALCEAEEAPPASSTPHVVGSRFNWKLFWQFLHPHLLVLGVAVVLALGAALVNVQIPLLLGQLVEVVAKYTRDHVGSFMTESQNLSTHLLILYGVQGLLTFGYLVLLSHVGERMAVDMRRALFSSLLRQDITFFDANKTGQLVSRLTTDVQEFKSSFKLVISQGLRSCTQVAGCLVSLSMLSTRLTLLLMVATPALMGVGTLMGSGLRKLSRQCQEQIARAMGVADEALGNVRTVRAFAMEQREEERYGAELEACRCRAEELGRGIALFQGLSNIAFNCMVLGTLFIGGSLVAGQQLTGGDLMSFLVASQTVQRSMANLSVLFGQVVRGLSAGARVFEYMALNPCIPLSGGCCVPKEQLRGSVTFQNVCFSYPCRPGFEVLKDFTLTLPPGKIVALVGQSGGGKTTVASLLERFYDPTAGVVMLDGRDLRTLDPSWLRGQVVGFISQEPVLFGTTIMENIRFGKLEASDEEVYTAAREANAHEFITSFPEGYNTVVGERGTTLSGGQKQRLAIARALIKQPTVLILDEATSALDAESERVVQEALDRASAGRTVLAGTHEELLKKGGLYAELIRRQALDAPRTAAPPPKKPEGPRSHQHKS

SEQ ID NO: 903282 - protein, 746 aa, Homo sapiens
MLVHLFRVGIRGGPFPGRLLPPLRFQTFSAVRYSDGYRSSSLLRAVAHLRSQLWAHLPRAPLAPRWSPSAWCWVGGALLGPMVLSKHPHLCLVALCEAEEAPPASSTPHVVGSRFNWKLFWQFLHPHLLVLGVAVVLALGAALVNVQIPLLLGQLVEVVAKYTRDHVGSFMTESQNLSTHLLILYGVQGLLTFGYLVLLSHVGERMAVDMRRALFSSLLRQDITFFDANKTGQLVSRLTTDVQEFKSSFKLVISQGLRSCTQVAGCLVSLSMLSTRLTLLLMVATPALMGVGTLMGSGLRKLSRQCQEQIARAMGVADEALGNVRTVRAFAMEQREEERYGAELEACRCRAEELGRGIALFQGLSNIAFNCMVLGTLFIGGSLVAGQQLTGGDLMSFLVASQTVQRSMANLSVLFGQVVRGLSAGARVFEYMALNPCIPLSGGCCVPKEQLRGSVTFQNVCFSYPCRPGFEVLKDFTLTLPPGKIVALVGQSGGGKTTVASLLERFYDPTAGVVMLDGRDLRTLDPSWLRGQVVGFISQEPVLFGTTIMENIRFGKLEASDEEVYTAAREANAHEFITSFPEGYNTVVGERGTTLSGGQKQRLAIARALIKQPTVLILDEATSALDAESERVVQEALDRASAGRTVLVIAHRLSTVRGAHCIVVMADGRVWEAGTHEELLKKGGLYAELIRRQALDAPRTAAPPPKVWSLPSISVRAGAQPGGAYWGLSPQEGQHVESRCGCSCSQ

SEQ ID NO: 903283 - protein, 120 aa, Homo sapiens [sequence omitted]

SEQ ID NO: 903284 - protein, 360 aa, Homo sapiens
MVPAAGRRPPRVMRLLGWWQVLLWVLGLPVRGVEVAEESGRLWSEEQPAHPLQVGAVYLGEEELLHDPMGQDRAAEEANAVLGLDTQGDHMVMLSVIPGEAEDKVSSEPSGVTCGAGGAEDSRCNVRESLFSLDGAGAHFPDREEEYYTEPEVAESDAAPTEDSNNTESLKSPKVNCEERNITGLENFTLKILNMSQDLMDFLNPNGSDCTLVLFYTPWCRFSASLAPHFNSLPRAFPALHFLALDASQHSSLSTRFGTVAVPNILLFQGAKPMARFNHTDRTLETLKIFIFNQTGIEAKKNVVVTQADQIGPLPSTLIKSVDWLLVFSLFFLISFIMYATIRTESIRWLIPGQEQEHVE

SEQ ID NO: 903285 - protein, 360 aa, Homo sapiens; identical to SEQ ID NO: 903284

SEQ ID NO: 903286 - protein, 360 aa, Homo sapiens; identical to SEQ ID NO: 903284

SEQ ID NO: 903287 - protein, 360 aa, Homo sapiens; identical to SEQ ID NO: 903284

SEQ ID NO: 903288 - protein, 256 aa, Homo sapiens
MVPAAGRRPPRVMRLLGWWQVLLWVLGLPVRGVEVAEESGRLWSEEQPAHPLQVGAVYLGEEELLHDPMGQDRAAEEANAVLGLDTQGDHMVMLSVIPGEAEDKVSSEPSGVTCGAGGAEDSRCNVRESLFSLDGAGAHFPDREEEYYTEPEVAESDAAPTEDSNNTESLKSPKVNCEERNITGLENFTLKILNMSQDLMDFLNPNGSDCTLVLFYTPWCRFSASLAPHFNSLPRAFPALHFLALDASQHSRQELN

SEQ ID NO: 903289 - protein, 360 aa, Homo sapiens; identical to SEQ ID NO: 903284

SEQ ID NO: 903290 - protein, 360 aa, Homo sapiens; identical to SEQ ID NO: 903284

SEQ ID NO: 903291 - protein, 379 aa, Homo sapiens
MAARGRARAPRLSSPSLPPAGSTTRVAVRRLPLGLGNGPGCRSTTAPRHAAPRLVASIAVGAGTSRPRRGGCRGKWSLMVRGLLHDPMGQDRAAEEANAVLGLDTQGDHMVMLSVIPGEAEDKVSSEPSGVTCGAGGAEDSRCNVRESLFSLDGAGAHFPDREEEYYTEPEVAESDAAPTEDSNNTESLKSPKVNCEERNITGLENFTLKILNMSQDLMDFLNPNGSDCTLVLFYTPWCRFSASLAPHFNSLPRAFPALHFLALDASQHSSLSTRFGTVAVPNILLFQGAKPMARFNHTDRTLETLKIFIFNQTGIEAKKNVVVTQADQIGPLPSTLIKSVDWLLVFSLFFLISFIMYATIRTESIRWLIPGQEQEHVE

SEQ ID NO: 903292 - protein, 332 aa, Homo sapiens [sequence omitted]

SEQ ID NO: 903293 - protein, 323 aa, Homo sapiens
MVPAAGRRPPRVMRLLGWWQVLLWVLGLPVRGVEVAEESGRLWSEEQPAHPLQVGAVYLGEEELLHDPMGQDRAAEEANAVLGLDTQGDHMVMLSVIPGEAEDKVSSEPSGVTCGAGGAEDSRCNVRESLFSLDGAGAHFPDREEEYYTEPEVAESDAAPTEDSNNTESLKSPKVNCEERNITGLENFTLKILNMSQDLMDFLNPNGSDCTLVLFYTPWCRFSASLAPHFNSLPRAFPALHFLALDASQHSSLSTRFGTVAVPNILLFQGGATAPGLNKLFEKLFLKDSLNSDMTANYLIINYFYTNCFQGFRVVECLFHKAP

SEQ ID NO: 903294 - protein, 258 aa, Homo sapiens
MFAQQMQLMLQNAQMSSLGSFPMTPSIPANPPMAFNPYIPHPGMGLVPAELVPNTPVLIPGNPPLAMPGAVGPKLMRSDKLEVCREFQRGNCTRGENDCRYAHPTDASMIEASDNTVTICMDYIKGRCSREKCKYFHPPAHLQARLKAAHHQMNHSAASAMALQPGTLQLIPKRSALEKPNGATPVFNPTVFHCQQALTNLQLPQPAFIPAGPILCMAPASNIVPMMHGATPTTVSAATTPATSVPFAAPTTGNQLKF

SEQ ID NO: 903295 - protein, 246 aa, Homo sapiens
MFAQQMQLMLQNAQMSSLGSFPMTPSIPANPPMAFNPYIPHPGMGLVPAELVPNTPVLIPGNPPLAMPGAVGPKLMRSDKLEVCREFQRGNCTRGENDCRYAHPTDASMIEASDNTVTICMDYIKGRCSREKCKYFHPPAHLQARLKAAHHQMNHSAASAMALQPGTLQLIPKRSALEKPNGATPVFNPTVFHCQQALTNLQLPQPAFIPAVPMMHGATPTTVSAATTPATSVPFAAPTTGNQLKF

SEQ ID NO: 903296 - protein, 273 aa, Homo sapiens
MFAQQMQLMLQNAQMSSLGSFPMTPSIPANPPMAFNPYIPHPGMGLVPAELVPNTPVLIPGNPPLAMPGAVGPKLMRSDKLEVCREFQRGNCTRGENDCRYAHPTDASMIEASDNTVTICMDYIKGRCSREKCKYFHPPAHLQARLKAAHHQMNHSAASAMALQPGTLQLIPKRSALEKPNGATPVFNPTVFHCQQALTNLQLPQPAFIPAGPILCMAPASNIVPMMHGATPTTVSAATTPATSVPFAAPTTGNQIPQLSIDELNSSMFVSQM

SEQ ID NO: 903297 - protein, 304 aa, Homo sapiens
MERASKNLKGRCTRENCKYLHPPPHLKTQLEINGRNNLIQQKTAAAMFAQQMQLMLQNAQMSSLGSFPMTPSIPANPPMAFNPYIPHPGMGLVPAELVPNTPVLIPGNPPLAMPGAVGPKLMRSDKLEVCREFQRGNCTRGENDCRYAHPTDASMIEASDNTVTICMDYIKGRCSREKCKYFHPPAHLQARLKAAHHQMNHSAASAMALQPGTLQLIPKRSALEKPNGATPVFNPTVFHCQQALTNLQLPQPAFIPAGPILCMAPASNIVPMMHGATPTTVSAATTPATSVPFAAPTTGNQLKF

SEQ ID NO: 903298 - protein, 265 aa, Homo sapiens
MQADQGRCTRENCKYLHPPPHLKTQLEINGRNNLIQQKTAAAMFAQQMQLMLQNAQMSSLGSFPMTPSIPANPPMAFNPYIPHPGMGLVPAELVPNTPVLIPGNPPLAMPGAVGPKLMRSDKLEVCREFQRGNCTRGENDCRYAHPTDASMIEASDNTVTICMDYIKGRCSREKCKYFHPPAHLQARLKAAHHQMNHSAASAMALTNLQLPQPAFIPAGPILCMAPASNIVPMMHGATPTTVSAATTPATSVPFAAPTTGNQLKF

SEQ ID NO: 903299 - protein, 135 aa, Homo sapiens
VSDLLTWLPFLAGCPNALMPRVLAGLPANHAAAAAARSCLGAACAPATAGGADAAPDRRKAIPRPRLPAARLDAAASGGRGLRSLPARRVRRAAGLPGGQGARRVRLLLGMRQPRGPALRPGPQCSLLRALRRAA

SEQ ID NO: 903300 - protein, 199 aa, Homo sapiens
LACPGSLSQRQFLLPNPGWKRAALGAAHNSASGLDTGSRFQGAHRSRIRGVAHTRDVRFQERRPRVARPEGGRGSVAPYISHLQDFKYSSLEIPGMRFLLAPTRRSGVRTNRGRKGPSDQLLPSRGFQVSAGLFSLLLAEPGWAYLSPPSRAGCEEEARGGCLKMTLTPSSGCREEEGRFARLLVTAKAPKKCCAAVLV

SEQ ID NO: 903301 - protein, 304 aa, Homo sapiens
MLPPPRPAAALALPVLLLLLVVLTPPPTGARPSPGPDYLRRGWMRLLAEGEGCAPCRPEECAAPRGCLAGRVRDACGCCWECANLEGQLCDLDPSAHFYGHCGEQLECRLDTGGDLSRGEVPEPLCACRSQSPLCGSDGHTYSQICRLQEAARARPDANLTVAHPGPCESGPQIVSHPYDTWNVTGQDVIFGCEVFAYPMASIEWRKDGLDIQLPGDDPHISVQFRGGPQRFEVTGWLQIQAVRPSDEGTYRCLGRNALGQVEAPASLTVLTPDQLNSTGIPQLRSLNLVPEEEAESEENDDYY

SEQ ID NO: 903302 - protein, 145 aa, Homo sapiens [sequence omitted]

SEQ ID NO: 903303 - protein, 104 aa, Homo sapiens [sequence omitted]

SEQ ID NO: 903304 - protein, 304 aa, Homo sapiens; identical to SEQ ID NO: 903301

SEQ ID NO: 903305 - protein, 304 aa, Homo sapiens; identical to SEQ ID NO: 903301

SEQ ID NO: 903306 - protein, 104 aa, Homo sapiens [sequence omitted]

SEQ ID NO: 903307 - protein, 304 aa, Homo sapiens; identical to SEQ ID NO: 903301

SEQ ID NO: 903308 - protein, 794 aa, Homo sapiens
MDRGTLPLAVALLLASCSLSPTSLAETVHCDLQPVGPERGEVTYTTSQVSKGCVAQAPNAILEVHVLFLEFPTGPSQLELTLQASKQNGTWPREVLLVLSVNSSVFLHLQALGIPLHLAYNSSLVTFQEPPGVNTTELPSFPKTQILEWAAERGPITSAAELNDPQSILLRLGQAQGSLSFCMLEASQDMGRTLEWRPRTPALVRGCHLEGVAGHKEAHILRVLPGHSAGPRTVTVKVELSCAPGDLDAVLILQGPPYVSWLIDANHNMQIWTTGEYSFKIFPEKNIRGFKLPDTPQGLLGEARMLNASIVASFVELPLASIVSLHASSCGGRLQTSPAPIQTTPPKDTCSPELLMSLIQTKCADDAMTLVLKKELVAHLKCTITGLTFWDPSCEAEDRGDKFVLRSAYSSCGMQVSASMISNEAVVNILSSSSPQRKKVHCLNMDSLSFQLGLYLSPHFLQASNTIEPGQQSFVQVRVSPSVSEFLLQLDSCHLDLGPEGGTVELIQGRAAKGNCVSLLSPSPEGDPRFSFLLHFYTVPIPKTGTLSCTVALRPKTGSQDQEVHRTVFMRLNIISPDLSGCTSKGLVLPAVLGITFGAFLIGALLTAALWYIYSHTREYPRPPQLSMPGPSIHPGEPSEASEGLRGPGRTLTSAPAPAPAPRFPQQAGARGGGGCPGLLGEQQHQPQHREHPEHPLLHQQHGIAPAPRARPAGETEQPPAGSTGVNSPWEPVLHSTQNGACSPRLPFPPPSQRPAASAATGLEHLGVPPPHRTFNPVGLGYGCPGDRPLATLL

SEQ ID NO: 903309 - protein, 658 aa, Homo sapiens
MDRGTLPLAVALLLASCSLSPTSLAETVHCDLQPVGPERGEVTYTTSQVSKGCVAQAPNAILEVHVLFLEFPTGPSQLELTLQASKQNGTWPREVLLVLSVNSSVFLHLQALGIPLHLAYNSSLVTFQEPPGVNTTELPSFPKTQILEWAAERGPITSAAELNDPQSILLRLGQAQGSLSFCMLEASQDMGRTLEWRPRTPALVRGCHLEGVAGHKEAHILRVLPGHSAGPRTVTVKVELSCAPGDLDAVLILQGPPYVSWLIDANHNMQIWTTGEYSFKIFPEKNIRGFKLPDTPQGLLGEARMLNASIVASFVELPLASIVSLHASSCGGRLQTSPAPIQTTPPKDTCSPELLMSLIQTKCADDAMTLVLKKELVAHLKCTITGLTFWDPSCEAEDRGDKFVLRSAYSSCGMQVSASMISNEAVVNILSSSSPQRKKVHCLNMDSLSFQLGLYLSPHFLQASNTIEPGQQSFVQVRVSPSVSEFLLQLDSCHLDLGPEGGTVELIQGRAAKGNCVSLLSPSPEGDPRFSFLLHFYTVPIPKTGTLSCTVALRPKTGSQDQEVHRTVFMRLNIISPDLSGCTSKGLVLPAVLGITFGAFLIGALLTAALWYIYSHTRSPSKREPVVAVAAPASSESSSTNHSIGSTQSTPCSTSSMA

SEQ ID NO: 903310 - protein, 488 aa, Homo sapiens
MDRGTLPLAVALLLASCSLSPTSLAETVHCDLQPVGPERGEVTYTTSQVSKGCVAQAPNAILEVHVLFLEFPTGPSQLELTLQASKQNGTWPREVLLVLSVNSSVFLHLQALGIPLHLAYNSSLVTFQEPPGVNTTELPSFPKTQILEWAAERGPITSAAELNDPQSILLRLGQAQGSLSFCMLEASQDMGRTLEWRPRTPALVRGCHLEGVAGHKEAHILRVLPGHSAGPRTVTVKVELSCAPGDLDAVLILQGPPYVSWLIDANHNMQIWTTGEYSFKIFPEKNIRGFKLPDTPQGLLGEARMLNASIVASFVELPLASIVSLHASSCGGRLQTSPAPIQTTPPKDTCSPELLMSLIQTKCADDAMTLVLKKELVAHLKCTITGLTFWDPSCEAEDRGDKFVLRSAYSSCGMQVSASMISNEAVVNILSSSSPQRKKVHCLNMDSLSFQLGLYLSPHFLQASSESSSTNHSIGSTQSTPCSTSSMA

SEQ ID NO: 903311 - protein, 705 aa, Homo sapiens
MDRGTLPLAVALLLASCSLSPTSLAETVHCDLQPVGPERGEVTYTTSQVSKGCVAQAPNAILEVHVLFLEFPTGPSQLELTLQASKQNGTWPREVLLVLSVNSSVFLHLQALGIPLHLAYAGSTHHMLGVRVTLACQDPVMGPGPSTKQTNLSQCVLRVKHCARMGKNSSLVTFQEPPGVNTTELPSFPKTQILEWAAERGPITSAAELNDPQSILLRLGQAQGSLSFCMLEASQDMGRTLEWRPRTPALVRGCHLEGVAGHKEAHILRVLPGHSAGPRTVTVKVELSCAPGDLDAVLILQGPPYVSWLIDANHNMQIWTTGEYSFKIFPEKNIRGFKLPDTPQGLLGEARMLNASIVASFVELPLASIVSLHASSCGGRLQTSPAPIQTTPPKDTCSPELLMSLIQTKCADDAMTLVLKKELVAHLKCTITGLTFWDPSCEAEDRGDKFVLRSAYSSCGMQVSASMISNEAVVNILSSSSPQRKKVHCLNMDSLSFQLGLYLSPHFLQASNTIEPGQQSFVQVRVSPSVSEFLLQLDSCHLDLGPEGGTVELIQGRAAKGNCVSLLSPSPEGDPRFSFLLHFYTVPIPKTGTLSCTVALRPKTGSQDQEVHRTVFMRLNIISPDLSGCTSKGLVLPAVLGITFGAFLIGALLTAALWYIYSHTRSPSKREPVVAVAAPASSESSSTNHSIGSTQSTPCSTSSMA

SEQ ID NO: 903312 - protein, 436 aa, Homo sapiens
HPRLSPRRPRTVTVKVELSCAPGDLDAVLILQGPPYVSWLIDANHNMQIWTTGEYSFKIFPEKNIRGFKLPDTPQGLLGEARMLNASIVASFVELPLASIVSLHASSCGGRLQTSPAPIQTTPPKDTCSPELLMSLIQTKCADDAMTLVLKKELVAHLKCTITGLTFWDPSCEAEDRGDKFVLRSAYSSCGMQVSASMISNEAVVNILSSSSPQRKKVHCLNMDSLSFQLGLYLSPHFLQASNTIEPGQQSFVQVRVSPSVSEFLLQLDSCHLDLGPEGGTVELIQGRAAKGNCVSLLSPSPEGDPRFSFLLHFYTVPIPKTGTLSCTVALRPKTGSQDQEVHRTVFMRLNIISPDLSGCTSKGLVLPAVLGITFGAFLIGALLTAALWYIYSHTRSPSKREPVVAVAAPASSESSSTNHSIGSTQSTPCSTSSMA

SEQ ID NO: 903313 - protein, 345 aa, Homo sapiens
LLEDPCNCFGSLHASSCGGRLQTSPAPIQTTPPKDTCSPELLMSLIQTKCADDAMTLVLKKELVAHLKCTITGLTFWDPSCEAEDRGDKFVLRSAYSSCGMQVSASMISNEAVVNILSSSSPQRKKVHCLNMDSLSFQLGLYLSPHFLQASNTIEPGQQSFVQVRVSPSVSEFLLQLDSCHLDLGPEGGTVELIQGRAAKGNCVSLLSPSPEGDPRFSFLLHFYTVPIPKTGTLSCTVALRPKTGSQDQEVHRTVFMRLNIISPDLSGCTSKGLVLPAVLGITFGAFLIGALLTAALWYIYSHTRSPSKREPVVAVAAPASSESSSTNHSIGSTQSTPCSTSSMA

SEQ ID NO: 903314 - protein, 175 aa, Homo sapiens
RLVRGLGGVLIDANHNMQIWTTGEYSFKIFPEKNIRGFKLPDTPQGLLGEARMLNASIVASFVELPLASIVSLHASSCGGRLQTSPAPIQTTPPKDTCSPELLMSLIQTKCADDAMTLVLKKELVAHLKCTITGLTFWASTSAHTSSRPPTPSSRGSRALCRSECPHPSPSSCSS

SEQ ID NO: 903315 - protein, 175 aa, Homo sapiens
MDRGTLPLAVALLLASCSLSPTSLAETVHCDLQPVGPERGEVTYTTSQVSKGCVAQAPNAILEVHVLFLEFPTGPSQLELTLQASKQNGTWPREVLLVLSVNSSVFLHLQALGIPLHLAYNSSLVTFQEPPGVNTTELPSFPKTQILEWAAERGPITPPAAWHSPGPPRSPSRRD

SEQ ID NO: 903316 - protein, 167 aa, Homo sapiens
MPGPSIHPGEPSEASEGLRGPGRTLTSAPAPAPAPRFPQQAGARGGGGCPGLLGEQQHQPQHREHPEHPLLHQQHGIAPAPRARPAGETEQPPAGSTGVNSPWEPVLHSTQNGACSPRLPFPPPSQRPAASAATGLEHLGVPPPHRTFNPVGLGYGCPGDRPLATLL

SEQ ID NO: 903317 - protein, 173 aa, Homo sapiens
MDRGTLPLAVALLLASCSLSPTSLAETVHCDLQPVGPERGEVTYTTSQVSKGCVAQAPNAILEVHVLFLEFPTGPSQLELTLQASKQNGTWPREVLLVLSVNSSVFLHLQALGIPLHLAYAGSTHHMLGVRVTLACQDPVMGPGPSTKSDKSLSVRTTCQALCKDGQGRRCPL

SEQ ID NO: 903318 - protein, 62 aa, Homo sapiens
MLEASQDMGRTLEWRPRTPALVRGCHLEGVAGHKEAHILRVLPGHSAGYGSRPAPDTSPHPE

SEQ ID NO: 903319 - protein, 658 aa, Homo sapiens; identical to SEQ ID NO: 903309

SEQ ID NO: 903320 - protein, 476 aa, Homo sapiens
MLEASQDMGRTLEWRPRTPALVRGCHLEGVAGHKEAHILRVLPGHSAGPRTVTVKVELSCAPGDLDAVLILQGPPYVSWLIDANHNMQIWTTGEYSFKIFPEKNIRGFKLPDTPQGLLGEARMLNASIVASFVELPLASIVSLHASSCGGRLQTSPAPIQTTPPKDTCSPELLMSLIQTKCADDAMTLVLKKELVAHLKCTITGLTFWDPSCEAEDRGDKFVLRSAYSSCGMQVSASMISNEAVVNILSSSSPQRKKVHCLNMDSLSFQLGLYLSPHFLQASNTIEPGQQSFVQVRVSPSVSEFLLQLDSCHLDLGPEGGTVELIQGRAAKGNCVSLLSPSPEGDPRFSFLLHFYTVPIPKTGTLSCTVALRPKTGSQDQEVHRTVFMRLNIISPDLSGCTSKGLVLPAVLGITFGAFLIGALLTAALWYIYSHTRSPSKREPVVAVAAPASSESSSTNHSIGSTQSTPCSTSSMA

SEQ ID NO: 903321 - protein, 345 aa, Homo sapiens
KKPNFLVQSCAAARDDCGGRLQTSPAPIQTTPPKDTCSPELLMSLIQTKCADDAMTLVLKKELVAHLKCTITGLTFWDPSCEAEDRGDKFVLRSAYSSCGMQVSASMISNEAVVNILSSSSPQRKKVHCLNMDSLSFQLGLYLSPHFLQASNTIEPGQQSFVQVRVSPSVSEFLLQLDSCHLDLGPEGGTVELIQGRAAKGNCVSLLSPSPEGDPRFSFLLHFYTVPIPKTGTLSCTVALRPKTGSQDQEVHRTVFMRLNIISPDLSGCTSKGLVLPAVLGITFGAFLIGALLTAALWYIYSHTRSPSKREPVVAVAAPASSESSSTNHSIGSTQSTPCSTSSMA

SEQ ID NO: 903322 - protein, 560 aa, Homo sapiens
MDRGTLPLAVALLLASCSLSPTSLAETVHCDLQPVGPERGEVTYTTSQVSKGCVAQAPNAILEVHVLFLEFPTGPSQLELTLQASKQNGTWPREVLLVLSVNSSVFLHLQALGIPLHLAYNSSLVTFQEPPGVNTTELPSFPKTQILEWAAERGPITSAAELNDPQSILLRLGQAQGSLSFCMLEASQDMGRTLEWRPRTPALVRGCHLEGVAGHKEAHILRVLPGHSAGPRTVTVKVELSCAPGDLDAVLILQGPPYVSWLIDANHNMQIWTTGEYSFKIFPEKNIRGFKLPDTPQGLLGEARMLNASIVASFVELPLASIVSLHASSCGGRLQTSPAPIQTTPPKDTCSPELLMSLIQTKCADDAMTLVLKKELVAHLKCTITGLTFWDPSCEAEDRGDKFVLRSAYSSCGMQVSASMISNEAVVNILSSSSPQRVEMDSHVLTHLAQGLLLGRGLFLAWEGAGLGKLLASHVCLECLGLPFCMTGAGLLRVTLSVSQVRGLSTYWLCGLGQVTLVFWAQRWPKKGLCATGCFWAANEVLCGSSSHSLAAGASLINIS

SEQ ID NO: 903323 - protein, 267 aa, Homo sapiens
RRGLALSPRLECNDVISAHCSLLLSGSSDSCASAFPVAGTMGVCHHTYLACLSPLGPPSSWNFLSAFLPTMTPEEMRLPEQEGDSVRVSPSVSEFLLQLDSCHLDLGPEGGTVELIQGRAAKGNCVSLLSPSPEGDPRFSFLLHFYTVPIPKTGTLSCTVALRPKTGSQDQEVHRTVFMRLNIISPDLSGCTSKGLVLPAVLGITFGAFLIGALLTAALWYIYSHTRSPSKREPVVAVAAPASSESSSTNHSIGSTQSTPCSTSSMA

SEQ ID NO: 903324 - protein, 355 aa, Homo sapiens
MDRGTLPLAVALLLASCSLSPTSLAETVHCDLQPVGPERGEVTYTTSQVSKGCVAQAPNAILEVHVLFLEFPTGPSQLELTLQASKQNGTWPREVLLVLSVNSSVFLHLQALGIPLHLAYNSSLVTFQEPPGVNTTELPSFPKTQILEWAAERGPITSAAELNDPQSILLRLGQAQGSLSFCMLEASQDMGRTLEWRPRTPALVRGCHLEGVAGHKEAHILRVLPGHSAGPRTVTVKVELSCAPGDLDAVLILQGPPYVSWLIDANHNMQIWTTGEYSFKIFPEKNIRGFKLPDTPQGLLGEARMLNASIVASFVELPLASIVSLHASSCGGKLYLTRSCTSPVAVPHPELYLTR

SEQ ID NO: 903325 - protein, 107 aa, Homo sapiens
AVVAGIALMWPQPRLPPRPAMSEETRQSKLAAAKKKLREYQQRNSPGVPTGAKKKKKIKNGSNPETTTSGGCHSPEDVSLGWPGSWGQGAQGAVEGNCYDCGRTVGY

SEQ ID NO: 903326 - protein, 1010 aa, Homo sapiens
AVVAGIALMWPQPRLPPRPAMSEETRQSKLAAAKKKLREYQQRNSPGVPTGAKKKKKIKNGSNPETTTSGGCHSPEDTPKDNAATLQPSDDTVLPGGVPSPGASLTSMAASQNHDADNVPNLMDETKTFSSTESLRQLSQQLNGLVCESATCVNGEGPASSANLKDLESRYQQLAVALDSSYVTNKQLNITIEKLKQQNQEITDQLEEEKKECHQKQGALREQLQVHIQTIGILVSEKAELQTALAHTQHAARQKEGESEDLASRLQYSRRRVGELERALSAVSTQQKKADRYNKELTKERDALRLELYKNTQSNEDLKQEKSELEEKLRVLVTEKAGMQLNLEELQKKLEMTELLLQQFSSRCEAPDANQQLQQAMEERAQLEAHLGQVMESVRQLQMERDKYAENLKGESAMWRQRMQQMSEQVHTLREEKECSMSRVQELETSLAELRNQMAEPPPPEPPAGPSEVEQQLQAEAEHLRKELEGLAGQLQAQVQDNEGLSRLNREQEERLLELERAAELWGEQAEARRQILETMQNDRTTISRALSQNRELKEQLAELQSGFVKLTNENMEITSALQSEQHVKRELGKKLGELQEKLSELKETVELKSQEAQSLQQQRDQYLGHLQQYVAAYQQLTSEKEVLHNQLLLQTQLVDQLQQQEAQGKAVAEMARQELQETQERLEAATQQNQQLRAQLSLMAHPGEGDGLDREEEEDEEEEEEEAVAVPQPMPSIPEDLESREAMVAFFNSAVASAEEEQARLRGQLKEQRVRCRRLAHLLASAQKEPEAAAPAPGTGGDSVCGETHRALQGAMEKLQSRFMELMQEKADLKERVEELEHRCIQLSGETDTIGEYIALYQSQRAVLKERHREKEEYISRLAQDKEEMKVKLLELQELVLRLVGDRNEWHGRFLAAAQNPADEPTSGAPAPQELGAANQQGDLCEVSLAGSVEPAQGEAREGSPRDNPTAQQIMQLLREMQNPRERPGLGSNPCIPFFYRADENDEVKITVI

SEQ ID NO: 903327 - protein, 1010 aa, Homo sapiens
AVVAGIALMWPQPRLPPRPAMSEETRQSKLAAAKKKLREYQQRNSPGVPTGAKKKKKIKNGSNPETTTSGGCHSPEDIQDILKVLVSDLNRSNGVALPPLDKWKTPKDNAATLQPSDDTVLPGGVPSPGASLTSMAASQNHDADNVPNLMDETKTFSSTESLRQLSQQLNGLVCESATCVNGEGPASSANLKDLEKQQNQEITDQLEEEKKECHQKQGALREQLQVHIQTIGILVSEKAELQTALAHTQHAARQKEGESEDLASRLQYSRRRVGELERALSAVSTQQKKADRYNKELTKERDALRLELYKNTQSNEDLKQEKSELEEKLRVLVTEKAGMQLNLEELQKKLEMTELLLQQFSSRCEAPDANQQLQQAMEERAQLEAHLGQVMESVRQLQMERDKYAENLKGESAMWRQRMQQMSEQVHTLREEKECSMSRVQELETSLAELRNQMAEPPPPEPPAGPSEVEQQLQAEAEHLRKELEGLAGQLQAQVQDNEGLSRLNREQEERLLELERAAELWGEQAEARRQILETMQNDRTTISRALSQNRELKEQLAELQSGFVKLTNENMEITSALQSEQHVKRELGKKLGELQEKLSELKETVELKSQEAQSLQQQRDQYLGHLQQYVAAYQQLTSEKEVLHNQLLLQTQLVDQLQQQEAQGKAVAEMARQELQETQERLEAATQQNQQLRAQLSLMAHPGEGDGLDREEEEDEEEEEEEAVAVPQPMPSIPEDLESREAMVAFFNSAVASAEEEQARLRGQLKEQRVRCRRLAHLLASAQKEPEAAAPAPGTGGDSVCGETHRALQGAMEKLQSRFMELMQEKADLKERVEELEHRCIQLSGETDTIGEYIALYQSQRAVLKERHREKEEYISRLAQDKEEMKVKLLELQELVLRLVGDRNEWHGRFLAAAQNPADEPTSGAPAPQELGAANQQGDLCEVSLAGSVEPAQGEAREGSPRDNPTAQQIMQLLREMQNPRERPGLGSNPCIPFFYRADENDEVKITVI

SEQ ID NO: 903328 - protein, 914 aa, Homo sapiens
MIKIVRVSTPKDNAATLQPSDDTVLPGGVPSPGASLTSMAASQNHDADNVPNLMDETKTFSSTESLRQLSQQLNGLVCESATCVNGEGPASSANLKDLEKQQNQEITDQLEEEKKECHQKQGALREQLQVHIQTIGILVSEKAELQTALAHTQHAARQKEGESEDLASRLQYSRRRVGELERALSAVSTQQKKADRYNKELTKERDALRLELYKNTQSNEDLKQEKSELEEKLRVLVTEKAGMQLNLEELQKKLEMTELLLQQFSSRCEAPDANQQLQQAMEERAQLEAHLGQVMESVRQLQMERDKYAENLKGESAMWRQRMQQMSEQVHTLREEKECSMSRVQELETSLAELRNQMAEPPPPEPPAGPSEVEQQLQAEAEHLRKELEGLAGQLQAQVQDNEGLSRLNREQEERLLELERAAELWGEQAEARRQILETMQNDRTTISRALSQNRELKEQLAELQSGFVKLTNENMEITSALQSEQHVKRELGKKLGELQEKLSELKETVELKSQEAQSLQQQRDQYLGHLQQYVAAYQQLTSEKEVLHNQLLLQTQLVDQLQQQEAQGKAVAEMARQELQETQERLEAATQQNQQLRAQLSLMAHPGEGDGLDREEEEDEEEEEEEAVAVPQPMPSIPEDLESREAMVAFFNSAVASAEEEQARLRGQLKEQRVRCRRLAHLLASAQKEPEAAAPAPGTGGDSVCGETHRALQGAMEKLQSRFMELMQEKADLKERVEELEHRCIQLSGETDTIGEYIALYQSQRAVLKERHREKEEYISRLAQDKEEMKVKLLELQELVLRLVGDRNEWHGRFLAAAQNPADEPTSGAPAPQELGAANQQGDLCEVSLAGSVEPAQGEAREGSPRDNPTAQQIMQLLREMQNPRERPGLGSNPCIPFFYRADENDEVKITVI

SEQ ID NO: 903329 - protein, 1010 aa, Homo sapiens; identical to SEQ ID NO: 903326

SEQ ID NO: 903330 - protein, 1010 aa, Homo sapiens; identical to SEQ ID NO: 903326

SEQ ID NO: 903331 - protein, 1010 aa, Homo sapiens; identical to SEQ ID NO: 903326

SEQ ID NO: 903332 - protein, 1132 aa, Homo sapiens
AVVAGIALMWPQPRLPPRPAMSEETRQSKLAAAKKKLREYQQRNSPGVPTGAKKKKKIKNGSNPETTTSGGCHSPEDIQDILKVLVSDLNRSNGVALPPLDKWKTPKDNAATLQPSDDTVLPGGVPSPGASLTSMAASQNHDADNVPNLMDETKTFSSTESLRQLSQQLNGLVCESATCVNGEGPASSANLKDLESRYQQLAVALDSSYVTNKQLNITIEKLKQQNQEITDQLEEEKKECHQKQGALREQLQVHIQTIGILVSEKAELQTALAHTQHAARQKEGESEDLASRLQYSRRRVGELERALSAVSTQQKKADRYNKELTKERDALRLELYKNTQSNEDLKQEKSELEEKLRVLVTEKAGMQLNLEELQKKLEMTELLLQQFSSRCEAPDANQQLQQAMEERAQLEAHLGQVMESVRQLQMERDKYAENLKGESAMWRQRMQQMSEQVHTLREEKECSMSRVQELETSLAELRNQMGNWGWGDLGAGMVSEGCGGGLECPRELGGWNGFEAEGKRSVPGDGKSRHLHEPQCPISKDEGVPVVSHPQLSLSESGLEDWLTSGCEESSAGRPSLGSLRGEPPAGPSEVEQQLQAEAEHLRKELEGLAGQLQAQVQDNEGLSRLNREQEERLLELERAAELWGEQAEARRQILETMQNDRTTISRALSQNRELKEQLAELQSGFVKLTNENMEITSALQSEQHVKRELGKKLGELQEKLSELKETVELKSQEAQSLQQQRDQYLGHLQQYVAAYQQLTSEKEVLHNQLLLQTQLVDQLQQQEAQGKAVAEMARQELQETQERLEAATQQNQQLRAQLSLMAHPGEGDGLDREEEEDEEEEEEEAVAVPQPMPSIPEDLESREAMVAFFNSAVASAEEEQARLRGQLKEQRVRCRRLAHLLASAQKEPEAAAPAPGTGGDSVCGETHRALQGAMEKLQSRFMELMQEKADLKERVEELEHRCIQLSGETDTIGEYIALYQSQRAVLKERHREKEEYISRLAQDKEEMKVKLLELQELVLRLVGDRNEWHGRFLAAAQNPADEPTSGAPAPQELGAANQQGDLCEVSLAGSVEPAQGEAREGSPRDNPTAQQIMQLLREMQNPRERPGLGSNPCIPFFYRADENDEVKITVI

SEQ ID NO: 903333 - protein, 757 aa, Homo sapiens
MEERAQLEAHLGQVMESVRQLQMERDKYAENLKGESAMWRQRMQQMSEQVHTLREEKECSMSRVQELETSLAELRNQMGNWGWGDLGAGMVSEGCGGGLECPRELGGWNGFEAEGKRSVPGDGKSRHLHEPQCPISKDEGVPVVSHPQLSLSESGLEDWLTSGCEESSAGRPSLGSLRGGMDQEEGFFENARGFYCLRPFSAEPPPPEPPAGPSEVEQQLQAEAEHLRKELEGLAGQLQAQVQDNEGLSRLNREQEERLLELERAAELWGEQAEARRQILETMQNDRTTISRALSQNRELKEQLAELQSGFVKLTNENMEITSALQSEQHVKRELGKKLGELQEKLSELKETVELKSQEAQSLQQQRDQYLGHLQQYVAAYQQLTSEKEVLHNQLLLQTQLVDQLQQQEAQGKAVAEMARQELQETQERLEAATQQNQQLRAQLSLMAHPGEGDGLDREEEEDEEEEEEEAVAVPQPMPSIPEDLESREAMVAFFNSAVASAEEEQARLRGQLKEQRVRCRRLAHLLASAQKEPEAAAPAPGTGGDSVCGETHRALQGAMEKLQSRFMELMQEKADLKERVEELEHRCIQLSGETDTIGEYIALYQSQRAVLKERHREKEEYISRLAQDKEEMKVKLLELQELVLRLVGDRNEWHGRFLAAAQNPADEPTSGAPAPQELGAANQQGDLCEVSLAGSVEPAQGEAREGSPRDNPTAQQIMQLLREMQNPRERPGLGSNPCIPFFYRADENDEVKITVI

SEQ ID NO: 903334 - protein, 691 aa, Homo sapiens
MIKIVRVSTPKDNAATLQPSDDTVLPGGVPSPGASLTSMAASQNHDADNVPNLMDETKTFSSTESLRQLSQQLNGLVCESATCVNGEGPASSANLKDLEKQQNQEITDQLEEEKKECHQKQGALREQLQVHIQTIGILVSEKAELQTALAHTQHAARQKEGESEDLASRLQYSRRRVGELERALSAVSTQQKKADRYNKELTKEEQAEARRQILETMQNDRTTISRALSQNRELKEQLAELQSGFVKLTNENMEITSALQSEQHVKRELGKKLGELQEKLSELKETVELKSQEAQSLQQQRDQYLGHLQQYVAAYQQLTSEKEVLHNQLLLQTQLVDQLQQQEAQGKAVAEMARQELQETQERLEAATQQNQQLRAQLSLMAHPGEGDGLDREEEEDEEEEEEEAVAVPQPMPSIPEDLESREAMVAFFNSAVASAEEEQARLRGQLKEQRVRCRRLAHLLASAQKEPEAAAPAPGTGGDSVCGETHRALQGAMEKLQSRFMELMQEKADLKERVEELEHRCIQLSGETDTIGEYIALYQSQRAVLKERHREKEEYISRLAQDKEEMKVKLLELQELVLRLVGDRNEWHGRFLAAAQNPADEPTSGAPAPQELGAANQQGDLCEVSLAGSVEPAQGEAREGSPRDNPTAQQIMQLLREMQNPRERPGLGSNPCIPFFYRADENDEVKITVI

SEQ ID NO: 903335 - protein, 230 aa, Homo sapiens
MLTRLPVERCRAPQRERRRSLCGETHRALQGAMEKLQSRFMELMQEKADLKERVEELEHRCIQLSGETDTIGEYIALYQSQRAVLKERHREKEEYISRLAQDKEEMKVKLLELQELVLRLVGDRNEWHGRFLAAAQNPADEPTSGAPAPQELGAANQQGDLCEVSLAGSVEPAQGEAREGSPRDNPTAQQIMQLLREMQNPRERPGLGSNPCIPFFYRADENDEVKITVI

SEQ ID NO: 903336 - protein, 437 aa, Homo sapiens
AVVAGIALMWPQPRLPPRPAMSEETRQSKLAAAKKKLREYQQRNSPGVPTGAKKKKKIKNGSNPETTTSGGCHSPEDIQDILKVLVSDLNRSNGVALPPLDKWKTPKDNAATLQPSDDTVLPGGVPSPGASLTSMAASQNHDADNVPNLMDETKTFSSTESLRQLSQQLNGLVCESATCVNGEGPASSANLKDLESRYQQLAVALDSSYVTNKQLNITIEKLKQQNQEITDQLEEEKKECHQKQGALREQLQVHIQTIGILVSEKAELQTALAHTQHAARQKEGESEDLASRLQYSRRRVGELERALSAVSTQQKKADRYNKELTKERDALRLELYKNTQSNEDLKQEKSELEEKLRVLVTEKAGMQLNLEELQKKLEMTELLLQQFSSRCEAPDANQQLQQAMEERAQLEAHLGQVMESVRQLQMERDKYAEVAVG

SEQ ID NO: 903337 - protein, 843 aa, Homo sapiens
AVVAGIALMWPQPRLPPRPAMSEETRQSKLAAAKKKLREYQQRNSPGVPTGAKKKKKIKNGSNPETTTSGGCHSPEDIQDILKVLVSDLNRSNGVALPPLDKWKTPKDNAATLQPSDDTVLPGGVPSPGASLTSMAASQNHDADNVPNLMDETKTFSSTESLRQLSQQLNGLVCESATCVNGEGPASSANLKDLESRYQQLAVALDSSYVTNKQLNITIEKLKQQNQEITDQLEEEKKECHQKQGALREQLQVHIQTIGILVSEKAELQTALAHTQHAARQKEGESEDLASRLQYSRRRVGELERALSAVSTQQKKADRYNKELTKERDALRLELYKNTQSNEDLKQEKSELEEKLRVLVTEKAGMQLNLEELQKKLEMTELLLQQFSSRCEAPDANQQLQQAMEERAQLEAHLGQVMESVRQLQMERDKYAENLKGESAMWRQRMQQMSEQVHTLREEKECSMSRVQELETSLAELRNQMAEPPPPEPPAGPSEVEQQLQAEAEHLRKELEGLAGQLQAQVQDNEGLSRLNREQEERLLELERAAELWGEQAEARRQILETMQNDRTTISRALSQNRELKEQLAELQSGFVKLVLLPHLESPPSSLALQTFVFPPVKWGSVALTGNGTSGGICEPEPCSDGCGGEGMIFLTCLHPSRCHGRQTPRQQVLGSPAAVGGRCLLLSVQTNENMEITSALQSEQHVKRELGKKLGELQEKLSELKETVELKSQEAQSLQQQRDQYLGHLQQYVAAYQQLTSEKEVLHNQLLLQTQLVDQLQQQEAQGKAVAEMARQELQETQERLEAATQQNQQLRAQLSLMAHPGEGTGTCSQEEERAPGRRGDC

SEQ ID NO: 903338 - protein, 424 aa, Homo sapiens
AVVAGIALMWPQPRLPPRPAMSEETRQSKLAAAKKKLREYQQRNSPGVPTGAKKKKKIKNGSNPETTTSGGCHSPEDIQDILKVLVSDLNRSNGVALPPLDKWKTPKDNAATLQPSDDTVLPGGVPSPGASLTSMAASQNHDADNVPNLMDETKTFSSTESLRQLSQQLNGLVCESATCVNGEGPASSANLKDLESRYQQLAVALDSSYVTNKQLNITIEKLKQQNQEITDQLEEEKKECHQKQGALREQLQVHIQTIGILVSEKAELQTALAHTQHAARQKEGESEDLASRLQYSRRRVGELERALSAVSTQQKKADRYNKELTKERDALRLELYKNTQSNEDLKQEKSELEEKLRVLVTEKAGMQLNLEELQKKLEMTELLLQQFSSRCEAPDANQQLQQAMEERAQLEAHLGQVRLCRGGM

SEQ ID NO: 903339 - protein, 204 aa, Homo sapiens
QLDSERVPSRLPSDRALSQNRELKEQLAELQSGFVKLTNENMEITSALQSEQHVKRELGKKLGELQEKLSELKETVELKSQEAQSLQQQRDQYLGHLQQYVAAYQQLTSEKEVLHNQLLLQTQLVDQLQQQEAQGKAVAEMARQELQETQERLEAATQQNQQLRAQLSLMAHPGEGDGLDREEEEDEEEEEEESEAVWRLALAR

SEQ ID NO: 903340 - protein, 1037 aa, Homo sapiens
AVVAGIALMWPQPRLPPRPAMSEETRQSKLAAAKKKLREYQQRNSPGVPTGAKKKKKIKNGSNPETTTSGGCHSPEDIQDILKVLVSDLNRSNGVALPPLDKWKTPKDNAATLQPSDDTVLPGGVPSPGASLTSMAASQNHDADNVPNLMDETKTFSSTESLRQLSQQLNGLVCESATCVNGEGPASSANLKDLESRYQQLAVALDSSYVTNKQLNITIEKLKQQNQEITDQLEEEKKECHQKQGALREQLQVHIQTIGILVSEKAELQTALAHTQHAARQKEGESEDLASRLQYSRRRVGELERALSAVSTQQKKADRYNKELTKERDALRLELYKNTQSNEDLKQEKSELEEKLRVLVTEKAGMQLNLEELQKKLEMTELLLQQFSSRCEAPDANQQLQQAMEERAQLEAHLGQVMESVRQLQMERDKYAENLKGESAMWRQRMQQMSEQVHTLREEKECSMSRVQELETSLAELRNQMAEPPPPEPPAGPSEVEQQLQAEAEHLRKELEGLAGQLQAQVQDNEGLSRLNREQEERLLELERAAELWGEQAEARRQILETMQNDRTTISRALSQNRELKEQLAELQSGFVKLTNENMEITSALQSEQHVKRELGKKLGELQEKLSELKETVELKSQEAQSLQQQRDQYLGHLQQYVAAYQQLTSEKEVLHNQLLLQTQLVDQLQQQEAQGKAVAEMARQELQETQERLEAATQQNQQLRAQLSLMAHPGEGDGLDREEEEDEEEEEEEAVAVPQPMPSIPEDLESREAMVAFFNSAVASAEEEQARLRGQLKEQRVRCRRLAHLLASAQKEPEAAAPAPGTGGDSVCGETHRALQGAMEKLQSRFMELMQEKADLKERVEELEHRCIQLSGETDTIGEYIALYQSQRAVLKERHREKEEYISRLAQDKEEMKVKLLELQELVLRLVGDRNEWHGRFLAAAQNPADEPTSGAPAPQELGAANQQGDLCEVSLAGSVEPAQGEAREGSPRDNPTAQQIMQLLREMQNPRERPGLGSNPCIPFFYRADENDEVKITVI

SEQ ID NO: 903341 - protein, 859 aa, Homo sapiens
AVVAGIALMWPQPRLPPRPAMSEETRQSKLAAAKKKLREYQQRNSPGVPTGAKKKKKIKNGSNPETTTSGGCHSPEDTPKDNAATLQPSDDTVLPGGVPSPGASLTSMAASQNHDADNVPNLMDETKALSAVSTQQKKADRYNKELTKERDALRLELYKNTQSNEDLKQEKSELEEKLRVLVTEKAGMQLNLEELQKKLEMTELLLQQFSSRCEAPDANQQLQQAMEERAQLEAHLGQVMESVRQLQMERDKYAENLKGESAMWRQRMQQMSEQVHTLREEKECSMSRVQELETSLAELRNQMAEPPPPEPPAGPSEVEQQLQAEAEHLRKELEGLAGQLQAQVQDNEGLSRLNREQEERLLELERAAELWGEQAEARRQILETMQNDRTTISRALSQNRELKEQLAELQSGFVKLTNENMEITSALQSEQHVKRELGKKLGELQEKLSELKETVELKSQEAQSLQQQRDQYLGHLQQYVAAYQQLTSEKEVLHNQLLLQTQLVDQLQQQEAQGKAVAEMARQELQETQERLEAATQQNQQLRAQLSLMAHPGEGDGLDREEEEDEEEEEEEAVAVPQPMPSIPEDLESREAMVAFFNSAVASAEEEQARLRGQLKEQRVRCRRLAHLLASAQKEPEAAAPAPGTGGDSVCGETHRALQGAMEKLQSRFMELMQEKADLKERVEELEHRCIQLSGETDTIGEYIALYQSQRAVLKERHREKEEYISRLAQDKEEMKVKLLELQELVLRLVGDRNEWHGRFLAAAQNPADEPTSGAPAPQELGAANQQGDLCEVSLAGSVEPAQGEAREGSPRDNPTAQQIMQLLREMQNPRERPGLGSNPCIPFFYRADENDEVKITVI

SEQ ID NO: 903342 - protein, 808 aa, Homo sapiens
FRPVLWRMFLSFFFSTCLGFLPKVHIQTIGILVSEKAELQTALAHTQHAARQKEGESEDLASRLQYSRRRVGELERALSAVSTQQKKADRYNKELTKERDALRLELYKNTQSNEDLKQEKSELEEKLRVLVTEKAGMQLNLEELQKKLEMTELLLQQFSSRCEAPDANQQLQQAMEERAQLEAHLGQVMESVRQLQMERDKYAENLKGESAMWRQRMQQMSEQVHTLREEKECSMSRVQELETSLAELRNQMAEPPPPEPPAGPSEVEQQLQAEAEHLRKELEGLAGQLQAQVQDNEGLSRLNREQEERLLELERAAELWGEQAEARRQILETMQNDRTTISRALSQNRELKEQLAELQSGFVKLTNENMEITSALQSEQHVKRELGKKLGELQEKLSELKETVELKSQEAQSLQQQRDQYLGHLQQYVAAYQQLTSEKEVLHNQLLLQTQLVDQLQQQEAQGKAVAEMARQELQETQERLEAATQQNQQLRAQLSLMAHPGEGDGLDREEEEDEEEEEEEAVAVPQPMPSIPEDLESREAMVAFFNSAVASAEEEQARLRGQLKEQRVRCRRLAHLLASAQKEPEAAAPAPGTGGDSVCGETHRALQGAMEKLQSRFMELMQEKADLKERVEELEHRCIQLSGETDTIGEYIALYQSQRAVLKERHREKEEYISRLAQDKEEMKVKLLELQELVLRLVGDRNEWHGRFLAAAQNPADEPTSGAPAPQELGAANQQGDLCEVSLAGSVEPAQGEAREGSPRDNPTAQQIMQLLREMQNPRERPGLGSNPCIPFFYRADENDEVKITVI

SEQ ID NO: 903343 - protein, 1010 aa, Homo sapiens; identical to SEQ ID NO: 903326

SEQ ID NO: 903344 - protein, 1160 aa, Homo sapiens
AVVAGIALMWPQPRLPPRPAMSEETRQSKLAAAKKKLREYQQRNSPGVPTGAKKKKKIKNGSNPETTTSGGCHSPEDIQDILKVLVSDLNRSNGVALPPLDKWKTPKDNAATLQPSDDTVLPGGVPSPGASLTSMAASQNHDADNVPNLMDETKTFSSTESLRQLSQQLNGLVCESATCVNGEGPASSANLKDLESRYQQLAVALDSSYVTNKQLNITIEKLKQQNQEITDQLEEEKKECHQKQGALREQLQVHIQTIGILVSEKAELQTALAHTQHAARQKEGESEDLASRLQYSRRRVGELERALSAVSTQQKKADRYNKELTKERDALRLELYKNTQSNEDLKQEKSELEEKLRVLVTEKAGMQLNLEELQKKLEMTELLLQQFSSRCEAPDANQQLQQAMEERAQLEAHLGQVMESVRQLQMERDKYAENLKGESAMWRQRMQQMSEQVHTLREEKECSMSRVQELETSLAELRNQMGNWGWGDLGAGMVSEGCGGGLECPRELGGWNGFEAEGKRSVPGDGKSRHLHEPQCPISKDEGVPVVSHPQLSLSESGLEDWLTSGCEESSAGRPSLGSLRGGMDQEEGFFENARGFYCLRPFSAEPPPPEPPAGPSEVEQQLQAEAEHLRKELEGLAGQLQAQVQDNEGLSRLNREQEERLLELERAAELWGEQAEARRQILETMQNDRTTISRALSQNRELKEQLAELQSGFVKLTNENMEITSALQSEQHVKRELGKKLGELQEKLSELKETVELKSQEAQSLQQQRDQYLGHLQQYVAAYQQLTSEKEVLHNQLLLQTQLVDQLQQQEAQGKAVAEMARQELQETQERLEAATQQNQQLRAQLSLMAHPGEGDGLDREEEEDEEEEEEEAVAVPQPMPSIPEDLESREAMVAFFNSAVASAEEEQARLRGQLKEQRVRCRRLAHLLASAQKEPEAAAPAPGTGGDSVCGETHRALQGAMEKLQSRFMELMQEKADLKERVEELEHRCIQLSGETDTIGEYIALYQSQRAVLKERHREKEEYISRLAQDKEEMKVKLLELQELVLRLVGDRNEWHGRFLAAAQNPADEPTSGAPAPQELGAANQQGDLCEVSLAGSVEPAQGEAREGSPRDNPTAQQIMQLLREMQNPRERPGLGSNPCIPFFYRADENDEVKITVI

SEQ ID NO: 903345 - protein, 1128 aa, Homo sapiens
AVVAGIALMWPQPRLPPRPAMSEETRQSKLAAAKKKLREYQQRNSPGVPTGAKKKKKIKNGSNPETTTSGGCHSPEDIQDILKVLVSDLNRSNGVALPPLDKWKTPKDNAATLQPSDDTVLPGGVPSPGASLTSMAASQNHDADNVPNLMDETKTFSSTESLRQLSQQLNGLVCESATCVNGEGPASSANLKDLESRYQQLAVALDSSYVTNKQLNITIEKLKQQNQEITDQLEEEKKECHQKQGALREQLQVHIQTIGILVSEKAELQTALAHTQHAARQKEGESEDLASRLQYSRRRVGELERALSAVSTQQKKADRYNKELTKERDALRLELYKNTQSNEDLKQEKSELEEKLRVLVTEKAGMQLNLEELQKKLEMTELLLQQFSSRCEAPDANQQLQQAMEERAQLEAHLGQVMESVRQLQMERDKYAENLKGESAMWRQRMQQMSEQVHTLREEKECSMSRVQELETSLAELRNQMAEPPPPEPPAGPSEVEQQLQAEAEHLRKELEGLAGQLQAQVQDNEGLSRLNREQEERLLELERAAELWGEQAEARRQILETMQNDRTTISRALSQNRELKEQLAELQSGFVKLVRCPPGEPALLPSPPDLCFPTCKVGQCSPHLKWYFWRHLCARALLRWLWGRGDDFSNLPPPFPVPWEADTKAASSGVSSCSGWPLMLLSVQTNENMEITSALQSEQHVKRELGKKLGELQEKLSELKETVELKSQEAQSLQQQRDQYLGHLQQYVAAYQQLTSEKEVLHNQLLLQTQLVDQLQQQEAQGKAVAEMARQELQETQERLEAATQQNQQLRAQLSLMAHPGEGDGLDREEEEDEEEEEEEAVAVPQPMPSIPEDLESREAMVAFFNSAVASAEEEQARLRGQLKEQRVRCRRLAHLLASAQKEPEAAAPAPGTGGDSVCGETHRALQGAMEKLQSRFMELMQEKADLKERVEELEHRCIQLSGETDTIGEYIALYQSQRAVLKERHREKEEYISRLAQDKEEMKVKLLELQELVLRLVGDRNEWHGRFLAAAQNPADEPTSGAPAPQELGAANQQGDLCEVSLAGSVEPAQGEAREGSPRDNPTAQQIMQLLREMQNPRERPGLGSNPCIPFFYRADENDEVKITVI

SEQ ID NO: 903346 - protein, 568 aa, Homo sapiens
MIKIVRVSTPKDNAATLQPSDDTVLPGGVPSPGASLTSMAASQNHDADNVPNLMDETKTFSSTESLRQLSQQLNGLVCESATCVNGEGPASSANLKDLEKQQNQEITDQLEEEKKECHQKQGALREQLQVHIQTIGILVSEKAELQTALAHTQHAARQKEGESEDLASRLQYSRRRVGELERALSAVSTQQKKADRYNKELTKEEQAEARRQILETMQNDRTTISRALSQNRELKEQLAELQSGFVKLTNENMEITSALQSEQHVKRELGKKLGELQEKLSELKETVELKSQEAQSLQQQRDQYLGHLQQYVAAYQQLTSEKEVLHNQLLLQTQLVDQLQQQEAQGKAVAEMARQELQETQERLEAATQQNQQLRAQLSLMAHPGEGDGLDREEEEDEEEEEEEAVAVPQPMPSIPEDLESREAMVAFFNSAVASAEEEQARLRGQLKEQRVRCRRLAHLLASAQKEPEAAAPAPGTGGDSVCGETHRALQGAMEKLQSRFMELMQEKADLKERAREGSPRDNPTAQQIMQLLREMQNPRERPGLGSNPCIPFFYRADENDEVKITVI

SEQ ID NO: 903347 - protein, 197 aa, Homo sapiens
LGRGRVFNRPRCRRRILKERVEELEHRCIQLSGETDTIGEYIALYQSQRAVLKERHREKEEYISRLAQDKEEMKVKLLELQELVLRLVGDRNEWHGRFLAAAQNPADEPTSGAPAPQELGAANQQGDLCEVSLAGSVEPAQGEAREGSPRDNPTAQQIMQLLREMQNPRERPGLGSNPCIPFFYRADENDEVKITVI

SEQ ID NO: 903348 - protein, 751 aa, Homo sapiens
AVVAGIALMWPQPRLPPRPAMSEETRQSKLAAAKKKLREYQQRNSPGVPTGAKKKKKIKNGSNPETTTSGGCHSPEDIQDILKVLVSDLNRSNGVALPPLDKWKTPKDNAATLQPSDDTVLPGGVPSPGASLTSMAASQNHDADNVPNLMDETKTFSSTESLRQLSQQLNGLVCESATCVNGEGPASSANLKDLESRYQQLAVALDSSYVTNKQLNITIEKLKQQNQEITDQLEEEKKECHQKQGALREQLQVHIQTIGILVSEKAELQTALAHTQHAARQKEGESEDLASRLQYSRRRVGELERALSAVSTQQKKADRYNKELTKERDALRLELYKNTQSNEDLKQEKSELEEKLRVLVTEKAGMQLNLEELQKKLEMTELLLQQFSSRCEAPDANQQLQQAMEERAQLEAHLGQVMESVRQLQMERDKYAENLKGESAMWRQRMQQMSEQVHTLREEKECSMSRVQELETSLAELRNQMAEPPPPEPPAGPSEVEQQLQAEAEHLRKELEGLAGQLQAQVQDNEGLSRLNREQEERLLELERAAELWGEQAEARRQILETMQNDRTTISRALSQNRELKEQLAELQSGFVKLTNENMEITSALQSEQHVKRELGKKLGELQEKLSELKETVELKSQEAQSLQQQRDQYLGHLQQYVAAYQQLTSEKEVLHNQLLLQTQLVDQLQQQEAQGKAVAEMARQELQETQERLEAATQQNQQLRAQLSLMAHPGEGTGTCSQEEERAPGRRGDC

SEQ ID NO: 903349 - protein, 130 aa, Homo sapiens
PHGLLTLTKAIFPSGGLPSSYTERQLRQDSGANCRPGEGTGCWGGPASPVYILYLCNILYIPGVGPPPVSYLAEVGAGTWGGGSNNYLGLGNLFIDSIGQRKEAGMGSWRPGDATPVYFAFYFGINGFSH

SEQ ID NO: 903350 - protein, 141 aa, Homo sapiens
MPARGASSRGRSDLSTCLEENGAGTPLPSPQLEPDLKQNPNRCTQKTPLGHASRLAEVSPVCPSLTLARSGCGSTRDSGRPHFPPMALGIPRIPAQVGKRTGACGGRVLRWSGVCGTTEKTKEVFPPATGNFFGRFSLLLG

SEQ ID NO: 903351 - protein, 585 aa, Homo sapiens
MASPGSGFWSFGSEDGSGDSENPGTARAWCQVAQKFTGGIGNKLCALLYGDAEKPAESGGSQPPRAAARKAACACDQKPCSCSKVDVNYAFLHATDLLPACDGERPTLAFLQDVMNILLQYVVKSFDRSTKVIDFHYPNELLQEYNWELADQPQNLEEILMHCQTTLKYAIKTGHPRYFNQLSTGLDMVGLAADWLTSTANTNMFTYEIAPVFVLLEYVTLKKMREIIGWPGGSGDGIFSPGGAISNMYAMMIARFKMFPEVKEKGMAALPRLIAFTSEHSHFSLKKGAAALGIGTDSVILIKCDERGKMIPSDLERRILEAKQKGFVPFLVSATAGTTVYGAFDPLLAVADICKKYKIWMHVDAAWGGGLLMSRKHKWKLSGVERANSVTWNPHKMMGVPLQCSALLVREEGLMQNCNQMHASYLFQQDKHYDLSYDTGDKALQCGRHVDVFKLWLMWRAKGTTGFEAHVDKCLELAEYLYNIIKNREGYEMVFDGKPQHTNVCFWYIPPSLRTLEDNEERMSRLSKVAPVIKARMMEYGTTMVSYQPLGDKVNFFRMVISNPAATHQDIDFLIEEIERLGQDL

SEQ ID NO: 903352 - protein, 163 aa, Homo sapiens
MPARGASSRGRSDLSTCLEENGAGTPLPSPQLEPDLKQNPNRCTQKTPLGHASRLAEVSPVCPSLTLARSGCGSTRDSGRPHFPPLARPRTRWHASHPLTLTPAGVHGLPRILTTQLPPSLVFFSSAAPSFIPTGLPFPQMLWGSPRFPESGLRGPLGSPGLF

SEQ ID NO: 903353 - protein, 188 aa, Homo sapiens
MASPGSGFWSFGSEDGSGDSENPGTARAWCQVAQKFTGGIGNKLCALLYGDAEKPAESGGSQPPRAAARKAACACDQKPCSCSKVDVNYAFLHATDLLPACDGERPTLAFLQDVMNILLQYVVKSFDRSTKVIDFHYPNELLQEYNWELADQPQNLEEILMHCQTTLKYAIKTGIVSSKIIKLFFRLQ

SEQ ID NO: 903354 - protein, 585 aa, Homo sapiens; identical to SEQ ID NO: 903351

SEQ ID NO: 903355 - protein, 600 aa, Homo sapiens
CPLYITITITWFRVDPKLQNSGFWSFGSEDGSGDSENPGTARAWCQVAQKFTGGIGNKLCALLYGDAEKPAESGGSQPPRAAARKAACACDQKPCSCSKVDVNYAFLHATDLLPACDGERPTLAFLQDVMNILLQYVVKSFDRSTKVIDFHYPNELLQEYNWELADQPQNLEEILMHCQTTLKYAIKTGHPRYFNQLSTGLDMVGLAADWLTSTANTNMFTYEIAPVFVLLEYVTLKKMREIIGWPGGSGDGIFSPGGAISNMYAMMIARFKMFPEVKEKGMAALPRLIAFTSEHSHFSLKKGAAALGIGTDSVILIKCDERGKMIPSDLERRILEAKQKGFVPFLVSATAGTTVYGAFDPLLAVADICKKYKIWMHVDAAWGGGLLMSRKHKWKLSGVERANSVTWNPHKMMGVPLQCSALLVREEGLMQNCNQMHASYLFQQDKHYDLSYDTGDKALQCGRHVDVFKLWLMWRAKGTTGFEAHVDKCLELAEYLYNIIKNREGYEMVFDGKPQHTNVCFWYIPPSLRTLEDNEERMSRLSKVAPVIKARMMEYGTTMVSYQPLGDKVNFFRMVISNPAATHQDIDFLIEEIERLGQDL

SEQ ID NO: 903356 - protein, 134 aa, Homo sapiens
TYFISSGFKILRDVISALIVGFDFDGTPRLYQTDPSGTYHAWKANAIGRGAKSVREFLEKNYTDEAIETDDLTIKLVIKALLEVVQSGGKNIELAVMRRDQSLKILNPEEIEKYVAEIEKEKEENEKKKQKKAS

SEQ ID NO: 903357 - protein, 248 aa, Homo sapiens
MSYDRAITVFSPDGHLFQVEYAQEAVKKGSTAVGVRGRDIVVLGVEKKSVAKLQDERTVRKICALDDNVCMAFAGLTADARIVINRARVECQSHRLTVEDPVTVEYITRYIASLKQRYTQSNGRRPFGISALIVGFDFDGTPRLYQTDPSGTYHAWKANAIGRGAKSVREFLEKNYTDEAIETDDLTIKLVIKALLEVVQSGGKNIELAVMRRDQSLKILNPEEIEKYVAEIEKEKEENEKKKQKKAS

SEQ ID NO: 903358 - protein, 248 aa, Homo sapiens; identical to SEQ ID NO: 903357

SEQ ID NO: 903359 - protein, 248 aa, Homo sapiens; identical to SEQ ID NO: 903357

SEQ ID NO: 903360 - protein, 248 aa, Homo sapiens; identical to SEQ ID NO: 903357

SEQ ID NO: 903361 - protein, 276 aa, Homo sapiens
MSYDRAITVFSPDGHLFQVEYAQEAVKKGSTAVGVRGRDIVVLGVEKKSVAKLQDERTVRKICALDDNVCMAFAGLTADARIVINRARVECQSHRLTVEDPVTVEYITRYIASLKQRYTQSNGRRPFGISALIVGFDFDGTPRLYQTDPSGTYHAWKANAIGRGAKSVREFLEKNYTDEAIETDDLTIKLVIKALLEVVQSGGKNIELAVMRRDQSLKILNPEEIEKYVAEIEKEKEENEKTLLLARPRGPLSERTRSLIDNHIRCVRRARGAPRE

SEQ ID NO: 903362 - protein, 248 aa, Homo sapiens; identical to SEQ ID NO: 903357

SEQ ID NO: 903363 - protein, 217 aa, Homo sapiens
MVGVRGRDIVVLGVEKKSVAKLQDERTVRKICALDDNVCMAFAGLTADARIVINRARVECQSHRLTVEDPVTVEYITRYIASLKQRYTQSNGRRPFGISALIVGFDFDGTPRLYQTDPSGTYHAWKANAIGRGAKSVREFLEKNYTDEAIETDDLTIKLVIKALLEVVQSGGKNIELAVMRRDQSLKILNPEEIEKYVAEIEKEKEENEKKKQKKAS

SEQ ID NO: 903364 - protein, 237 aa, Homo sapiens
MSYDRAITVFSPDGHLFQVEYAQEAVKKGSTAVGVRGRDIVVLGVEKKSVAKLQDERTVRKICALDDNVCMAFAGLTADARIVINRARVECQSHRLTVEDPVTVEYITRYIASLKQRYTQSNGRRPFGISALIVGFDFDGTPRLYQTDPSGTYHAWKANAIGRGAKSVREFLEKNYTDEAIETDDLTIKLVIKALLEVVQSGGKNIELAVMRRDQSLKVITKFVCFLYLSVFSHDQG

SEQ ID NO: 903365 - protein, 149 aa, Homo sapiens
MSYDRAITVFSPDGHLFQVEYAQEAVKKGSTAVGVRGRDIVVLGVEKKSVAKLQDERTVRKICALDDNVCMAFAGLTADARIVINRARVECQSHRLTVEDPVTVEYITRYIASLKQVGACPLACSPLAAGQSRLRHGGSCHVTSGESEN

SEQ ID NO: 903366 - protein, 276 aa, Homo sapiens
MSYDRAITVFSPDGHLFQVEYAQEAVKKGSTAVGVRGRDIVVLGVEKKSVAKLQDERTVRKICALDDNVCMAFAGLTADARIVINRARVECQSHRLTVEDPVTVEYITRYIASLKQVGACPLACSPLAAGQHGSAMEGPAMSLQRYTQSNGRRPFGISALIVGFDFDGTPRLYQTDPSGTYHAWKANAIGRGAKSVREFLEKNYTDEAIETDDLTIKLVIKALLEVVQSGGKNIELAVMRRDQSLKILNPEEIEKYVAEIEKEKEENEKKKQKKAS

SEQ ID NO: 903367 - protein, 203 aa, Homo sapiens
MSYDRAITVFSPDGHLFQVEYAQEAVKKGSTAVGVRGRDIVVLGVEKKSVAKLQDERTVRKICALDDNVCMAFAGLTADARIVINRARVECQSHRLTVEDPVTVEYITRYIASLKQRYTQSNGRRPFGISALIVGFDFDGTPRLYQTDPSGTYHAWKANAIGRGAKSVREFLEKNYTDEAIETDDLTIKLVIKALLEILILKN

SEQ ID NO: 903368 - protein, 145 aa, Homo sapiens
MSYDRAITVFSPDGHLFQVEYAQEAVKKGSTAVGVRGRDIVVLGVEKKSVAKLQDERTVRKICALDDNVCMAFAGLTADARIVINRARVECQSHRLTVEDPVTVEYITRYIASLKQRYTQSNGRRPFGISALIPRAHTMPGRPMP

SEQ ID NO: 903369 - protein, 134 aa, Homo sapiens; identical to SEQ ID NO: 903356

SEQ ID NO: 903370 - protein, 149 aa, Homo sapiens; identical to SEQ ID NO: 903365

SEQ ID NO: 903371 - protein, 103 aa, Homo sapiens [sequence omitted]

SEQ ID NO: 903372 - protein, 248 aa, Homo sapiens; identical to SEQ ID NO: 903357

SEQ ID NO: 903373 - protein, 248 aa, Homo sapiens; identical to SEQ ID NO: 903357

SEQ ID NO: 903374 - protein, 248 aa, Homo sapiens; identical to SEQ ID NO: 903357

SEQ ID NO: 903375 - protein, 248 aa, Homo sapiens; identical to SEQ ID NO: 903357

SEQ ID NO: 903376 - protein, 361 aa, Homo sapiens
MSYDRAITVFSPDGHLFQVEYAQEAVKKGSTAVGVRGRDIVVLGVEKKSVAKLQDERTVRKICALDDNVCMAFAGLTADARIVINRARVECQSHRLTVEDPVTVEYITRYIASLKQRYTQSNGRRPFGISALIVGFDFDGTPRLYQTDPSGTYHAWKANAIGRGAKSVREFLEKNYTDEAIETDDLTIKLVIKALLEVVQSGGKNIELAVMRRDQSLKILNPEEIEKYVAEIEKEKEENEKTLLCGARALGPSEKVSIKPLPRWARPGGAPEVKQWRPLWRHKRGCPKRESRPPRGRTKQTSEGAWGDSLSTAYIKKERARRGEGKHPAKTRRCSLMREQKSLAESSTEEISPEETGPYQN

SEQ ID NO: 903377 - protein, 248 aa, Homo sapiens; identical to SEQ ID NO: 903357

SEQ ID NO: 903378 - protein, 248 aa, Homo sapiens
MSYDRAITVFSPDGHLFQVEYAQEAVKKGSTAVGVRGRDIVVLGVEKKSVAKLQDERTVRKICALDDNVCMAFAGLTADARIVINRARVECQSHRLTVEDPVTVEYITRYIASLKQRYTQSNGRRPFGISALIVGFDFDGTPRLYQTDPSGTYHAWKANAIGRGAKSVREFLEKNYTDEAIETDDLTIKLVIKALLEVVQSGGKNIELAVMRRDQSLKENVFLRLPIRQREDSHLPLIRWSTRVLWAC

SEQ ID NO: 903379 - protein, 227 aa, Homo sapiens
MSYDRAITVFSPDGHLFQVEYAQEAVKKGSTAVGVRGRDIVVLGVEKKSVAKLQDERTVRKICALDDNVCMAFAGLTADARIVINRARVECQSHRLTVEDPVTVEYITRYIASLKQRYTQSNGRRPFGISALIVGFDFDGTPRLYQTDPSGTYHAWKANAIGRGAKSVREFLEKNYTDEAIETDDLTIKLVIKALLEILNPEEIEKYVAEIEKEKEENEKKKQKKAS

SEQ ID NO: 903380 - protein, 215 aa, Homo sapiens
MSYDRAITVFSPDGHLFQVEYAQEAVKKGSTAVGVRGRDIVVLGVEKKSVAKLQDERTVRKICALDDNVCMAFAGLTADARIVINRARVECQSHRLTVEDPVTVEYITRYIASLKQRYTQSNGRRPFGISALIVGFDFDGTPRLYQTDPSGTYHAWKANAIGRGAKSVREFLEKNYTDEAIETDDLTIKLVIKALLEVSLHLESRQGGEDTTFWW

SEQ ID NO: 903381 - protein, 156 aa, Homo sapiens
ALLGSIRVETHDEGRDAKRPAPIALRITLLQTGDERVMYSTVGFDFDGTPRLYQTDPSGTYHAWKANAIGRGAKSVREFLEKNYTDEAIETDDLTIKLVIKALLEVVQSGGKNIELAVMRRDQSLKILNPEEIEKYVAEIEKEKEENEKKKQKKAS

SEQ ID NO: 903382 - protein, 109 aa, Homo sapiens
SSDGDSRLPLEAHTMPWKANAIGRGAKSVREFLEKNYTDEAIETDDLTIKLVIKALLEVVQSGGKNIELAVMRRDQSLKILNPEEIEKYVAEIEKEKEENEKKKQKKAS

SEQ ID NO: 903383 - protein, 139 aa, Homo sapiens
MSPSPPMAQMRHSQSLQMMEEKTPGCQVCPLSGTPSPSLTARVPSQPQHGGYAGAVSLLRYNQLPETTSPLQPLSKVPGQRSPSLAHPGQLTEGCPPWRGASPLPTGPRPCPGFSPGQSRQDGEVPCQPVLWWGSCSLK

SEQ ID NO: 903384 - protein, 142 aa, Homo sapiens
MGLKLNGRYISLILAVQIAYLVQAVRAAGKCDAVFKGFSDCLLKLGDSMANYPQGLDDKTNIKTVCTYWEDFHSCTVTALTDCQEGAKDMWDKLRKESKNLNIQGSLFELCGSGNGAAGSLLPAFPVLLVSLSAALATWLSF

SEQ ID NO: 903385 - protein, 142 aa, Homo sapiens; identical to SEQ ID NO: 903384

SEQ ID NO: 903386 - protein, 169 aa, Homo sapiens
ARCSRDPFCHLKMEDRIARAVTGLAGEVLGDEGGSEEKGNKRDEGAYLVQAVRAAGKCDAVFKGFSDCLLKLGDSMANYPQGLDDKTNIKTVCTYWEDFHSCTVTALTDCQEGAKDMWDKLRKESKNLNIQGSLFELCGSGNGAAGSLLPAFPVLLVSLSAALATWLSF

SEQ ID NO: 903387 - protein, 142 aa, Homo sapiens; identical to SEQ ID NO: 903384

SEQ ID NO: 903388 - protein, 133 aa, Homo sapiens
MATAARPQPAYLVQAVRAAGKCDAVFKGFSDCLLKLGDSMANYPQGLDDKTNIKTVCTYWEDFHSCTVTALTDCQEGAKDMWDKLRKESKNLNIQGSLFELCGSGNGAAGSLLPAFPVLLVSLSAALATWLSF

SEQ ID NO: 903389 - protein, 142 aa, Homo sapiens; identical to SEQ ID NO: 903384

SEQ ID NO: 903390 - protein, 133 aa, Homo sapiens; identical to SEQ ID NO: 903388

SEQ ID NO: 903391 - protein, 255 aa, Homo sapiens
MPECDWRQPSGGDGGWDLSLLTGERDSDGRRLTEPSGYLTDGPINYKYKTKCTWLIEGYPNAVLRLRFNHFATECSWDHMYVYDGDSIYAPLIAVLSGLIVPEIRGNETVPEVVTTSGYALLHFFSDAAYNLTGFNIFYSINSCPNNCSGHGKCTTSVSVPSQVYCECDKYWKGEACDIPYCKANCGSPDHGYCDLTGEKLCVCNDSWQGPDCSLNVPSTESYWILPNVKPFSPSVGRASHKAVLHGKFMWVIGG

SEQ ID NO: 903392 - protein, 265 aa, Homo sapiens
DHGYCDLTGEKLCVCNDISAGPDTPVKVTSTESYWIPPHVKPFSPSVGRASHKAVLHGKFMWVIGGYTFNYSSFQMVLKLTEPSGYLTDGPINYKYKTKCTWLIEGYPNAVLRLRFNHFATECSWDHMYVYDGDSIYAPLIAVLSGLIVPEIRGNETVPEVVTTSGYALLHFFSDAAYNLTGFNIFYSINSCPNNCSGHGKCTTSVSVPSQVYCECDKYWKGEACDIPYCKANCGSPDHGYCDLTGEKLCVCNDSWQGKHVWCDG

SEQ ID NO: 903393 - protein, 110 aa, Homo sapiens
AELARAAGEAGPRAGSPPPAGQVPSGAPGAVCASRSPPPAGSGTPRLWGRPAKDKVGRLGGDARVRLEAAERRRRRLGSVPPDRGAGLGRAPGFRQGIKMFFKCFLRIED

SEQ ID NO: 903394 - protein, 227 aa, Homo sapiens
AELARAAGEAGPRAGSPPPAGQVPSGAPGAVCASRSPPPAGSGTPRLWGRPAKDKVGRLGGDARVRLEAAERRRRRLGSVPPDRGAGLGRAPVRRRRSGGGEVFCGRNSLQQHPCRRPRAQSRRAGAPGKMETGGRARTGTPQPAAPGVWRARPAGGGGGGASSWLLDGNSWLLCYGFLYLALYAQVSQSKPCERTGSCFSGRCVNSTCLCDPGWVGDQCQHCQGRF

SEQ ID NO: 903395 - protein, 690 aa, Homo sapiens
RRTRSPAPAEISAGTEPGFLSNRDCDAFGLAGRCFLSHFLLGPASAAAVPQFAPGGGRAAVPSAVRPRGCHRPSESSGAAEGFATEGGGGLREEEAEEAEEEGRKMAAVELEWIPETLYNTAISAVVDNYIRSRRDIRSLPENIQFDVYYKLYQQGRLCQLGSEFCELEVFAKVLRALDKRHLLHHCFQALMDHGVKVASVLAYSFSRRCSYIAESDAAVKEKAIQVGFVLGGFLSDAGWYSDAEKVFLSCLQLCTLHDEMLHWFRAVECCVRLLHVRNGNCKYHLGEETFKLAQTYMDKLSKHGQQANKAALYGELCALLFAKSHYDEAYKWCIEAMKEITAGLPVKVVVDVLRQASKACVVKREFKKAEQLIKHAVYLARDHFGSKHPKYSDTLLDYGFYLLNVDNICQSVAIYQAALDIRQSVFGGKNIHVATAHEDLAYSSYVHQYSSGKFDNALFHAERAIGIITHILPEDHLLLASSKRVKALILEEIAIDCHNKETEQRLLQEAHDLHLSSLQLAKKAFGEFNVQTAKHYGNLGRLYQSMRKFKEAEEMHIKAIQIKEQLLGQEDYEVALSVGHLASLYNYDMNQYENAEKLYLRSIAIGKKLFGEGYSGLEYDYRGLIKLYNSIGNYEKVFEYHNVLSNWNRLRDRQYSVTDALEDVSTSPQSTEEVVQSFLISQNVEGPSC

SEQ ID NO: 903396 - protein, 690 aa, Homo sapiens; identical to SEQ ID NO: 903395

SEQ ID NO: 903397 - protein, 690 aa, Homo sapiens; identical to SEQ ID NO: 903395

SEQ ID NO: 903398 - protein, 353 aa, Homo sapiens [sequence omitted]

SEQ ID NO: 903399 - protein, 68 aa, Homo sapiens
PEFKYDLTYEFGPLEAQEFGHRGLASKRKPNSRRTPPINPGVTYMDATPHPSVNCSLMSRGTSLLITK

SEQ ID NO: 903400 - protein, 244 aa, Homo sapiens
RRTRSPAPAEISAGTEPGFLSNRDCDAFGLAGRCFLSHFLLGPASAAAVPQFAPGGGRAAVPSAVRPRGCHRPSESSGAAEGFATEGGGGLREEEAEEAEEEGRKMAAVELEWIPETLYNTAISAVVDNYIRSRRDIRSLPENIQFDVYYKLYQQGRLCQLGSEFCELEVFAKVLRALDKRHLLHHCFQALMDHGVKVASVLAYSFSRRCSYIAESDAAVKEKAIQVGFVLVASFCCWLCGFSV

SEQ ID NO: 903401 - protein, 690 aa, Homo sapiens; identical to SEQ ID NO: 903395

SEQ ID NO: 903402 - protein, 241 aa, Homo sapiens
RRTRSPAPAEISAGTEPGFLSNRDCDAFGLAGRCFLSHFLLGPASAAAVPQFAPGGGRAAVPSAVRPRGCHRPSESSGAAEGFATEGGGGLREEEAEEAEEEGRKMAAVELEWIPETLYNNGNSSVVCGHNILSRLARRDMRLCCARESLAVLDCLTTMLYQQGRLCQLGSEFCELEVFAKVLRALDKRHLLHHCFQALMDHGVKVASVLAYSFSRRCSYIAESDAAVKEKAIQVGFVLGK

SEQ ID NO: 903403 - protein, 690 aa, Homo sapiens; identical to SEQ ID NO: 903395

SEQ ID NO: 903404 - protein, 324 aa, Homo sapiens
MCLYTLYPNNFVSFYRDHFGSKHPKYSDTLLDYGFYLLNVDNICQSVAIYQAALDIRQSVFGGKNIHVATAHEDLAYSSYVHQYSSGKFDNALFHAERAIGIITHILPEDHLLLASSKRVKALILEEIAIDCHNKETEQRLLQEAHDLHLSSLQLAKKAFGEFNVQTAKHYGNLGRLYQSMRKFKEAEEMHIKAIQIKEQLLGQEDYEVALSVGHLASLYNYDMNQYENAEKLYLRSIAIGKKLFGEGYSGLEYDYRGLIKLYNSIGNYEKVFEYHNVLSNWNRLRDRQYSVTDALEDVSTSPQSTEEVVQSFLISQNVEGPSC

SEQ ID NO: 903405 - protein, 401 aa, Homo sapiens
RRTRSPAPAEISAGTEPGFLSNRDCDAFGLAGRCFLSHFLLGPASAAAVPQFAPGGGRAAVPSAVRPRGCHRPSESSGAAEGFATEGGGGLREEEAEEAEEEGRKMAAVELEWIPETLYNTAISAVVDNYIRSRRDIRSLPENIQFDVYYKLYQQGRLCQLGSEFCELEVFAKVLRALDKRHLLHHCFQALMDHGVKVASVLAYSFSRRCSYIAESDAAVKEKAIQVGFVLGGFLSDAGWYSDAEKVFLSCLQLCTLHDEMLHWFRAVECCVRLLHVRNGNCKYHLGEETFKLAQTYMDKLSKHGQQANKAALYGELCALLFAKSHYDEAYKWCIEAMKEITAGLPVKVVVDVLRQASKACVVKREFKKAEKKKRGPKPSTQKRKMDGAPDGRGRKKKLKL

SEQ ID NO: 903406 - protein, 779 aa, Homo sapiens
MEEKDYSEADGLSERTTPSKAQKSPQKIAKKYKSAICRVTLLDASEYECEVEKHGRGQVLFDLVCEHLNLLEKDYFGLTFCDADSQKNWLDPSKEIKKQIRSSPWNFAFTVKFYPPDPAQLTEDITRYYLCLQLRADIITGRLPCSFVTHALLGSYAVQAELGDYDAEEHVGNYVSELRFAPNQTRELEERIMELHKTYRGMTPGEAEIHFLENAKKLSMYGVDLHHAKDSEGIDIMLGVCANGLLIYRDRLRINRFAWPKILKISYKRSNFYIKIRPGEYEQFESTIGFKLPNHRSAKRLWKVCIEHHTFFRLVSPEPPPKGFLVMGSKFRYSGRTQAQTRQASALIDRPAPFFERSSSKRYTMSRSLDGAEFSRPASVSENHDAGPDGDKRDEDGESGGQRSEAEEGEVRTPTKIKELKFLDKPEDVLLKHQASINELKRTLKEPNSKLIHRDRDWERERRLPSSPASPSPKGTPEKANERAGLREGSEEKVKPPRPRAPESDTGDEDQDQERDTVFLKDNHLAIERKCSSITVSSTSSLEAEVDFTVIGDYHGSAFEDFSRSLPELDRDKSDSDTEGLLFSRDLNKGAPSQDDESGGIEDSPDRGACSTPDMPQFEPVKTETMTVSSLAIRKKIEPEAVLQTRVSAMDNTQENSLKSGKGAAAMIPGPQTVATEIRSLSPIIGKDVLTSTYGATAETLSTSTTTHVTKTVKGGFSETRIEKRIIITGDEDVDQDQALALAIKEAKLQHPDMLVTKAVVYRETDPSPEERDKKPQES

SEQ ID NO: 903407 - protein, 92 aa, Homo sapiens
RVGPCLLIPLCWKVDSEARMEPPFPTVVLALRRSHDLHLHYWWMIDIDQDQALALAIKEAKLQHPDMLVTKAVVYRETDPSPEERDKKPQES

SEQ ID NO: 903408 - protein, 836 aa, Homo sapiens
SGVGIHQRAGVSPNRLLRRARRDPAPPRPAACLPEEPRGPPLAQPARHGEPRAQSLDMEEKDYSEADGLSERTTPSKAQKSPQKIAKKYKSAICRVTLLDASEYECEVEKHGRGQVLFDLVCEHLNLLEKDYFGLTFCDADSQKNWLDPSKEIKKQIRSSPWNFAFTVKFYPPDPAQLTEDITRYYLCLQLRADIITGRLPCSFVTHALLGSYAVQAELGDYDAEEHVGNYVSELRFAPNQTRELEERIMELHKTYRGMTPGEAEIHFLENAKKLSMYGVDLHHAKDSEGIDIMLGVCANGLLIYRDRLRINRFAWPKILKISYKRSNFYIKIRPGEYEQFESTIGFKLPNHRSAKRLWKVCIEHHTFFRLVSPEPPPKGFLVMGSKFRYSGRTQAQTRQASALIDRPAPFFERSSSKRYTMSRSLDGAEFSRPASVSENHDAGPDGDKRDEDGESGGQRSEAEEGEVRTPTKIKELKFLDKPEDVLLKHQASINELKRTLKEPNSKLIHRDRDWERERRLPSSPASPSPKGTPEKANERAGLREGSEEKVKPPRPRAPESDTGDEDQDQERDTVFLKDNHLAIERKCSSITVSSTSSLEAEVDFTVIGDYHGSAFEDFSRSLPELDRDKSDSDTEGLLFSRDLNKGAPSQDDESGGIEDSPDRGACSTPDMPQFEPVKTETMTVSSLAIRKKIEPEAVLQTRVSAMDNTQENSLKSGKGAAAMIPGPQTVATEIRSLSPIIGKDVLTSTYGATAETLSTSTTTHVTKTVKGGFSETRIEKRIIITGDEDVDQDQALALAIKEAKLQHPDMLVTKAVVYRETDPSPEERDKKPQES

SEQ ID NO: 903409 - protein, 887 aa, Homo sapiens
RPLLLGGPGSPPPPPGEPAGAGRSGERGCGGRARRGLSAVGGRAGASARESGAFLRSSSAPRSPPGQPPDTRTASQTAPGSRAAAARCLTDRSSCPRGAGVDRGGSLDMEEKDYSEADGLSERTTPSKAQKSPQKIAKKYKSAICRVTLLDASEYECEVEKHGRGQVLFDLVCEHLNLLEKDYFGLTFCDADSQKNWLDPSKEIKKQIRSSPWNFAFTVKFYPPDPAQLTEDITRYYLCLQLRADIITGRLPCSFVTHALLGSYAVQAELGDYDAEEHVGNYVSELRFAPNQTRELEERIMELHKTYRGMTPGEAEIHFLENAKKLSMYGVDLHHAKDSEGIDIMLGVCANGLLIYRDRLRINRFAWPKILKISYKRSNFYIKIRPGEYEQFESTIGFKLPNHRSAKRLWKVCIEHHTFFRLVSPEPPPKGFLVMGSKFRYSGRTQAQTRQASALIDRPAPFFERSSSKRYTMSRSLDGAEFSRPASVSENHDAGPDGDKRDEDGESGGQRSEAEEGEVRTPTKIKELKFLDKPEDVLLKHQASINELKRTLKEPNSKLIHRDRDWERERRLPSSPASPSPKGTPEKANERAGLREGSEEKVKPPRPRAPESDTGDEDQDQERDTVFLKDNHLAIERKCSSITVSSTSSLEAEVDFTVIGDYHGSAFEDFSRSLPELDRDKSDSDTEGLLFSRDLNKGAPSQDDESGGIEDSPDRGACSTPDMPQFEPVKTETMTVSSLAIRKKIEPEAVLQTRVSAMDNTQENSLKSGKGAAAMIPGPQTVATEIRSLSPIIGKDVLTSTYGATAETLSTSTTTHVTKTVKGGFSETRIEKRIIITGDEDVDQDQALALAIKEAKLQHPDMLVTKAVVYRETDPSPEERDKKPQES

SEQ ID NO: 903410 - protein, 779 aa, Homo sapiens; identical to SEQ ID NO: 903406

SEQ ID NO: 903411 - protein, 841 aa, Homo sapiens
MTTETGPDSEVKKAQEEAPQQPEAAAAVTTPVTPAGHGHPEANSNEKHPSQQDTRPAEQSLDMEEKDYSEADGLSERTTPSKAQKSPQKIAKKYKSAICRVTLLDASEYECEVEKHGRGQVLFDLVCEHLNLLEKDYFGLTFCDADSQKNWLDPSKEIKKQIRSSPWNFAFTVKFYPPDPAQLTEDITRYYLCLQLRADIITGRLPCSFVTHALLGSYAVQAELGDYDAEEHVGNYVSELRFAPNQTRELEERIMELHKTYRGMTPGEAEIHFLENAKKLSMYGVDLHHAKDSEGIDIMLGVCANGLLIYRDRLRINRFAWPKILKISYKRSNFYIKIRPGEYEQFESTIGFKLPNHRSAKRLWKVCIEHHTFFRLVSPEPPPKGFLVMGSKFRYSGRTQAQTRQASALIDRPAPFFERSSSKRYTMSRSLDGAEFSRPASVSENHDAGPDGDKRDEDGESGGQRSEAEEGEVRTPTKIKELKFLDKPEDVLLKHQASINELKRTLKEPNSKLIHRDRDWERERRLPSSPASPSPKGTPEKANERAGLREGSEEKVKPPRPRAPESDTGDEDQDQERDTVFLKDNHLAIERKCSSITVSSTSSLEAEVDFTVIGDYHGSAFEDFSRSLPELDRDKSDSDTEGLLFSRDLNKGAPSQDDESGGIEDSPDRGACSTPDMPQFEPVKTETMTVSSLAIRKKIEPEAVLQTRVSAMDNTQENSLKSGKGAAAMIPGPQTVATEIRSLSPIIGKDVLTSTYGATAETLSTSTTTHVTKTVKGGFSETRIEKRIIITGDEDVDQDQALALAIKEAKLQHPDMLVTKAVVYRETDPSPEERDKKPQES

SEQ ID NO: 903412 - protein, 818 aa, Homo sapiens
GSTHASAFRCYLGLAEHGCLTDRSSCPRGAGVDRGGSLDMEEKDYSEADGLSERTTPSKAQKSPQKIAKKYKSAICRVTLLDASEYECEVEKHGRGQVLFDLVCEHLNLLEKDYFGLTFCDADSQKNWLDPSKEIKKQIRSSPWNFAFTVKFYPPDPAQLTEDITRYYLCLQLRADIITGRLPCSFVTHALLGSYAVQAELGDYDAEEHVGNYVSELRFAPNQTRELEERIMELHKTYRGMTPGEAEIHFLENAKKLSMYGVDLHHAKDSEGIDIMLGVCANGLLIYRDRLRINRFAWPKILKISYKRSNFYIKIRPGEYEQFESTIGFKLPNHRSAKRLWKVCIEHHTFFRLVSPEPPPKGFLVMGSKFRYSGRTQAQTRQASALIDRPAPFFERSSSKRYTMSRSLDGAEFSRPASVSENHDAGPDGDKRDEDGESGGQRSEAEEGEVRTPTKIKELKFLDKPEDVLLKHQASINELKRTLKEPNSKLIHRDRDWERERRLPSSPASPSPKGTPEKANERAGLREGSEEKVKPPRPRAPESDTGDEDQDQERDTVFLKDNHLAIERKCSSITVSSTSSLEAEVDFTVIGDYHGSAFEDFSRSLPELDRDKSDSDTEGLLFSRDLNKGAPSQDDESGGIEDSPDRGACSTPDMPQFEPVKTETMTVSSLAIRKKIEPEAVLQTRVSAMDNTQENSLKSGKGAAAMIPGPQTVATEIRSLSPIIGKDVLTSTYGATAETLSTSTTTHVTKTVKGGFSETRIEKRIIITGDEDVDQDQALALAIKEAKLQHPDMLVTKAVVYRETDPSPEERDKKPQES

SEQ ID NO: 903413 - protein, 836 aa, Homo sapiens; identical to SEQ ID NO: 903408

SEQ ID NO: 903414 - protein, 836 aa, Homo sapiens; identical to SEQ ID NO: 903408

SEQ ID NO: 903415 - protein, 836 aa, Homo sapiens; identical to SEQ ID NO: 903408

SEQ ID NO: 903416 - protein, 439 aa, Homo sapiens
SGVGIHQRAGVSPNRLLRRARRDPAPPRPAACLPEEPRGPPLAQPARHGEPRAQSLDMEEKDYSEADGLSERTTPSKAQKSPQKIAKKYKSAICRVTLLDASEYECEVEKHGRGQVLFDLVCEHLNLLEKDYFGLTFCDADSQKNWLDPSKEIKKQIRSSPWNFAFTVKFYPPDPAQLTEDITRYYLCLQLRADIITGRLPCSFVTHALLGSYAVQAELGDYDAEEHVGNYVSELRFAPNQTRELEERIMELHKTYRGMTPGEAEIHFLENAKKLSMYGVDLHHAKDSEGIDIMLGVCANGLLIYRDRLRINRFAWPKILKISYKRSNFYIKIRPGEYEQFESTIGFKLPNHRSAKRLWKVCIEHHTFFRLVSPEPPPKGFLVMGSKFRYSGRTQAQTRQASALIDRPASWFSLTEAGRENISSIKAAGHGVPFAGRTL

SEQ ID NO: 903417 - protein, 939 aa, Homo sapiens
RSRHPSAGGGVAEQAAPQSPPRPRAAPPRGLPARGAEGAAPRPTCPTWGTPGPGVLVTMTTETGPDSEVKKAQEEAPQQPEAAAAVTTPVTPAGHGHPEANSNEKHPSQQDTRPAEQSLDMEEKDYSEADGLSERTTPSKAQKSPQKIAKKYKSAICRVTLLDASEYECEVEKHGRGQVLFDLVCEHLNLLEKDYFGLTFCDADSQKNWLDPSKEIKKQIRSSPWNFAFTVKFYPPDPAQLTEDITRYYLCLQLRADIITGRLPCSFVTHALLGSYAVQAELGDYDAEEHVGNYVSELRFAPNQTRELEERIMELHKTYRGMTPGEAEIHFLENAKKLSMYGVDLHHAKDSEGIDIMLGVCANGLLIYRDRLRINRFAWPKILKISYKRSNFYIKIRPGEYEQFESTIGFKLPNHRSAKRLWKVCIEHHTFFRLVSPEPPPKGFLVMGSKFRYSGRTQAQTRQASALIDRPAPFFERSSSKRYTMSRSLDGAEFSRPASVSENHDAGPDGDKRDEDGESGGQRSEAEEGEVRTPTKIKELKPEQETTPRHKQEFLDKPEDVLLKHQASINELKRTLKEPNSKLIHRDRDWERERRLPSSPASPSPKGTPEKANERAGLREGSEEKVKPPRPRAPESDTGDEDQDQERDTVFLKDNHLAIERKCSSITVSSTSSLEAEVDFTVIGDYHGSAFEDFSRSLPELDRDKSDSDTEGLLFSRDLNKGAPSQDDESGGIEDSPDRGACSTPDMPQFEPVKTETMTVSSLAIRKKIEPEAVLQTRVSAMDNTQQVDGSASVGREFIATTPSITTETISTTMENSLKSGKGAAAMIPGPQTVATEIRSLSPIIGKDVLTSTYGATAETLSTSTTTHVTKTVKGGFSETRIEKRIIITGDEDVDQDQALALAIKEAKLQHPDMLVTKAVVYRETDPSPEERDKKPQES

SEQ ID NO: 903418 - protein, 94 aa, Homo sapiens
VQQVSFRLPCEHRALNMLPLTARAGNSILTSHLPSVALPTWPLVPFSAFLGQHPASHLYLLLTTSLPCWWPTQLPWPPLGRVCVLWAPCWTKPI

SEQ ID NO: 903419 - protein, 836 aa, Homo sapiens; identical to SEQ ID NO: 903408

SEQ ID NO: 903420 - protein, 841 aa, Homo sapiens; identical to SEQ ID NO: 903411

SEQ ID NO: 903421 - protein, 841 aa, Homo sapiens; identical to SEQ ID NO: 903411

SEQ ID NO: 903422 - protein, 835 aa, Homo sapiens
SGVGIHQRAGVSPNRLLRRARRDPAPPRPAACLPEEPRGPPLAQPARHGEPRAQSLDMEEKDYSEADGLSERTTPSKAQKSPQKIAKKYKSAICRVTLLDASEYECEVEKHGRGQVLFDLVCEHLNLLEKDYFGLTFCDADSQKNWLDPSKEIKKQIRSSPWNFAFTVKFYPPDPAQLTEDITRYYLCLQLRADIITGRLPCSFVTHALLGSYAVQAELGDYDAEEHVGNYVSELRFAPNQTRELEERIMELHKTYRGMTPGEAEIHFLENAKKLSMYGVDLHHAKDSEGIDIMLGVCANGLLIYRDRLRINRFAWPKILKISYKRSNFYIKIRPGEYEQFESTIGFKLPNHRSAKRLWKVCIEHHTFFRLVSPEPPPKGFLVMGSKFRYSGRTQAQTRQASALIDRPAPFFERSSSKRYTMSRSLDGAEFSRPASVSENHDAGPDGDKRDEDGESGGQRSEAEEGEVRTPTKIKELKFLDKPEDVLLKHQASINELKRTLKEPNSKLIHRDRDWERERRLPSSPASPSPKGTPEKANERAGLREGSEEKVKPPRPRAPESDTGDEDQDQERDTVFLKDNHLAIERKCSSITVSSTSSLEAEVDFTVIGDYHGSAFEDFSRSLPELDRDKSDSDTEGLLFSRDLNKGAPSQDDESGGIEDSPDRGACSTPDMPQFEPVKTETMTVSSLAIRKKIEPEAVLQTRVSAMDNTQQVDGSASVGREFIATTPSITTETISTTMIIGKDVLTSTYGATAETLSTSTTTHVTKTVKGGFSETRIEKRIIITGDEDVDQDQALALAIKEAKLQHPDMLVTKAVVYRETDPSPEERDKKPQES

SEQ ID NO: 903423 - protein, 162 aa, Homo sapiens
RPLLLGGPGSPPPPPGEPAGAGRSGERGCGGRARRGLSAVGGRAGASARESGAFLRSSSAPRSPPGQPPDTRTASQTAPTAETLSTSTTTHVTKTVKGGFSETRIEKRIIITGDEDVDQDQALALAIKEAKLQHPDMLVTKAVVYRETDPSPEERDKKPQES

SEQ ID NO: 903424 - protein, 836 aa, Homo sapiens; identical to SEQ ID NO: 903408

SEQ ID NO: 903425 - protein, 361 aa, Homo sapiens
SGVGIHQRAGVSPNRLLRRARRDPAPPRPAACLPEEPRGPPLAQPARHGEPRAQSLDMEEKDYSEADGLSERTTPSKAQKSPQKIAKKYKSAICRVTLLDASEYECEVEKHGRGQVLFDLVCEHLNLLEKDYFGLTFCDADSQKNWLDPSKEIKKQIRSSPWNFAFTVKFYPPDPAQLTEDITRYYLCLQLRADIITGRLPCSFVTHALLGSYAVQAELGDYDAEEHVGNYVSELRFAPNQTRELEERIMELHKTYRGMTPGEAEIHFLENAKKLSMYGVDLHHAKDSEGIDIMLGVCANGLLIYRDRLRINRFAWPKILKISYKRSNFYIKIRPGEGQAILRSQKPVMVKRKRTRPTKSS

SEQ ID NO: 903426 - protein, 116 aa, Homo sapiens
MSFPIKKKMTSCPVSSASDSVISGHTLQGASGNASSSKEQSTSHSKVNSHQSASFFPSSPGLPVAGNSGFVQDYTTSKLGWGSNLHPFLCASSLVKFPLSRVSKQDCHGCCQEVPG

SEQ ID NO: 903427 - protein, 116 aa, Homo sapiens; identical to SEQ ID NO: 903426

SEQ ID NO: 903428 - protein, 254 aa, Homo sapiens
SRNKVGVGEPAEGSLRWSKMAVELGVLLVRPRPGTGLGRVMRTLLLVLWLATRGSALYFHIGETEKKCFIEEIPDETMVIGNYRTQLYDKQREEYQPATPGLGMFVEVKDPEDKVILARQYGSEGRFTFTSHTPGEHQICLHSNSTKFSLFAGGMLRVHLDIQVGEHANDYAEIAAKDKLSELQLRVRQLVEQVEQIQKEQNYQRWREERFRQTSESTNQRVLWWSILQTLILVAIGVWQMRHLKSFFEAKKLV

SEQ ID NO: 903429 - protein, 249 aa, Homo sapiens
RGAAGCGCAGRWSKMAVELGVLLVRPRPGTGLGRVMRTLLLVLWLATRGSALYFHIGETEKKCFIEEIPDETMVIGNYRTQLYDKQREEYQPATPGLGMFVEVKDPEDKVILARQYGSEGRFTFTSHTPGEHQICLHSNSTKFSLFAGGMLRVHLDIQVGEHANDYAEIAAKDKLSELQLRVRQLVEQVEQIQKEQNYQRWREERFRQTSESTNQRVLWWSILQTLILVAIGVWQMRHLKSFFEAKKLV

SEQ ID NO: 903430 - protein, 202 aa, Homo sapiens
ETASPCPGGRGTHATSRSSDLGSPCFPQGNYRTQLYDKQREEYQPATPGLGMFVEVKDPEDKVILARQYGSEGRFTFTSHTPGEHQICLHSNSTKFSLFAGGMLRVHLDIQVGEHANDYAEIAAKDKLSELQLRVRQLVEQVEQIQKEQNYQRWREERFRQTSESTNQRVLWWSILQTLILVAIGVWQMRHLKSFFEAKKLV

SEQ ID NO: 903431 - protein, 183 aa, Homo sapiens
VPRSMAMVIGNYRTQLYDKQREEYQPATPGLGMFVEVKDPEDKVILARQYGSEGRFTFTSHTPGEHQICLHSNSTKFSLFAGGMLRVHLDIQVGEHANDYAEIAAKDKLSELQLRVRQLVEQVEQIQKEQNYQRWREERFRQTSESTNQRVLWWSILQTLILVAIGVWQMRHLKSFFEAKKLV

SEQ ID NO: 903432 - protein, 232 aa, Homo sapiens
RGAAGCGCAGRWSKMAVELGVLLVRPRPGTGLGRVMRTLLLVLWLATRGSALYFHIGETEKKCFIEEIPDETMVIGNYRTQLYDKQREEYQPATPGLGMFVEVKDPEDKVILARQYGSEGRFTFTSHTPGEHQICLHSNSTKFSLFAGGMLRVHLDIQVGEHANDYAEIAAKDKLSELQLRVRQLVEQVEQIQKEQNYQRWREERFRQTSESTNQRVLWWSILQTLILWAVW

SEQ ID NO: 903433 - protein, 249 aa, Homo sapiens; identical to SEQ ID NO: 903429

SEQ ID NO: 903434 - protein, 241 aa, Homo sapiens
RGAAGCGCAGRWSKMAVELGVLLVRPRPGTGLGRVMRTLLLVLWLATRGSALYFHIGETEKKCFIEEIPDETMVIGNYRTQLYDKQREEYQPATPGLGMFVEVKDPEDKVILARQYGSEGRFTFTSHTPGEHQICLHSNSTKFSLFAGGMLRVHLDIQVGEHANDYAEIAAKDKLSELQLRVRQLVEQVEQIQKEQNYQRWREERFRQTSESTRAPARIPLAPARIPVAPARIPVAPARIP

SEQ ID NO: 903435 - protein, 221 aa, Homo sapiens
RGAAGCGCAGRWSKMAVELGVLLVRPRPGTGLGRVMRTLLLVLWLATRGSALYFHIGETEKKCFIEEIPDETMVIGNYRTQLYDKQREEYQPATPGLGMFVEVKDPEDKVILARQYGSEGRFTFTSHTPGEHQICLHSNSTKFSLFAGGMLRVHLDIQVGEHANDYAEIAAKDKLSELQLRVRQLVEQVEQIQKEQNYQRDEQESARQTSESTTSGRVLSN

SEQ ID NO: 903436 - protein, 161 aa, Homo sapiens
SRNKVGVGEPAEGSLRWSKMAVELGVLLVRPRPGTGLGRVMRTLLLVLWLATRGSALYFHIGETEKKCFIEEIPDETMVIGNYRTQLYDKQREEYQPATPGLGMFVEVKDPEDKVILARQYGSEGRFTFTSHTPGEHQICLHSNSTKFSLFAGGMLVSGPM

SEQ ID NO: 903437 - protein, 249 aa, Homo sapiens; identical to SEQ ID NO: 903429

SEQ ID NO: 903438 - protein, 249 aa, Homo sapiens; identical to SEQ ID NO: 903429

SEQ ID NO: 903439 - protein, 249 aa, Homo sapiens; identical to SEQ ID NO: 903429

SEQ ID NO: 903440 - protein, 249 aa, Homo sapiens; identical to SEQ ID NO: 903429

SEQ ID NO: 903441 - protein, 131 aa, Homo sapiens
THHLICPPHLRHHHQICLHSNSTKFSLFAGGMLRVHLDIQVGEHANDYAEIAAKDKLSELQLRVRQLVEQVEQIQKEQNYQRWREERFRQTSESTNQRVLWWSILQTLILVAIGVWQMRHLKSFFEAKKLV

SEQ ID NO: 903442 - protein, 114 aa, Homo sapiens [sequence omitted]

SEQ ID NO: 903443 - protein, 224 aa, Homo sapiens
RGAAGCGCAGRWSKMAVELGVLLVRPRPGTGLGRVMRTLLLVLWLATRGSALYFHIGETEKKCFIEEIPDETMVIGNYRTQLYDKQREEYQPATPGLGMFVEVKDPEDKVILARQYGSEGRFTFTSHTPGEHQICLHSNSTKFSLFAGGMLRVHLDIQVGEHANDYAEIAAKDKLSELQLRVRQLVEQVEQIQKEQNYQRVSDWAGSSGLLPRSCPLAQPGISH

SEQ ID NO: 903444 - protein, 323 aa, Homo sapiens
RREAGPRQPAGCDWAASELADARGNMAAAEPAVLALPNSGAGGAGAPSGTVPVLFCFSVFARPSSVPHGAGYELLIQKFLSLYGDQIDMHRKFVVQLFAEEWGQYVDLPKGFAVSERCKVRLVPLQIQLTTLGNLTPSSTVFFCCDMQERFRPAIKYFGDIISVGQRLLQGARILGIPVIVTEQYPKGLGSTVQEIDLTGVKLVLPKTKFSMVLPEVEAALAEIPGVRSVVLFGVETHVCIQQTALELVGRGVEVHIVADATSSRSMMDRMFALERLARTGIIVTTSEAVLLQLVADKDHPKFKEIQNLIKASAPESGLLSKV

SEQ ID NO: 903445 - protein, 158 aa, Homo sapiens
MAARGTIECKARDDGYMSSFLTIEHESLCSLDHMMHRDFIDRDNKTTALWPANPEDVVGINIADWKFCSVDYWIYQLGVHSGARSIKDYAPLCLDATSSRSMMDRMFALERLARTGIIVTTSEAVLLQLVADKDHPKFKEIQNLIKASAPESGLLSKV

SEQ ID NO: 903446 - protein, 323 aa, Homo sapiens; identical to SEQ ID NO: 903444

SEQ ID NO: 903447 - protein, 302 aa, Homo sapiens
RREAGPRQPAGCDWAASELADARGNMAGTVPVLFCFSVFARPSSVPHGAGYELLIQKFLSLYGDQIDMHRKFVVQLFAEEWGQYVDLPKGFAVSERCKVRLVPLQIQLTTLGNLTPSSTVFFCCDMQERFRPAIKYFGDIISVGQRLLQGARILGIPVIVTEQYPKGLGSTVQEIDLTGVKLVLPKTKFSMVLPEVEAALAEIPGVRSVVLFGVETHVCIQQTALELVGRGVEVHIVADATSSRSMMDRMFALERLARTGIIVTTSEAVLLQLVADKDHPKFKEIQNLIKASAPESGLLSKV

SEQ ID NO: 903448 - protein, 251 aa, Homo sapiens [sequence omitted]

SEQ ID NO: 903449 - protein, 148 aa, Homo sapiens
MMRLTINRSMDPKNMFAIWRVPAPFKPITRKSVGHRMGGGKGAIDHYVTPVKAGRLVVEMGGRCEFEEVQGFLDQVAHKLPFAAKAVSRGTLEKMRKDQEERERNNQNPWTFERIATANMLGIRKVLSPYDLTHKGKYWGKFYMPKRV

SEQ ID NO: 903450 - protein, 225 aa, Homo sapiens [sequence omitted]

SEQ ID NO: 903451 - protein, 238 aa, Homo sapiens
MWRLLARASAPLLRVPLSDPGLSVLLLDVSIPEKPKLRFIERAPLVPKVRREPKNLSDIRGPSTEATEFTEGNFAILALGGGYLHWGHFEMMRLTINRSMDPKNMFAIWRVPAPFKPITRKSVGHRMGGGKGAIDHYVTPVKAGRLVVEMGGRCEFEEVQGFLDQVAHKLPFAAKAVSRGTLEKMRKDQEERERNNQNPWTFERIATANMLGIRKVLSPYDLTHKGKYWGKFYMPKRV

SEQ ID NO: 903452 - protein, 111 aa, Homo sapiens
MFTKKTSNSDVATYSVEIEHTEMGGRCEFEEVQGFLDQVAHKLPFAAKAVSRGTLEKMRKDQEERERNNQNPWTFERIATANMLGIRKVLSPYDLTHKGKYWGKFYMPKRV

SEQ ID NO: 903453 - protein, 251 aa, Homo sapiens [sequence omitted]

SEQ ID NO: 903454 - protein, 148 aa, Homo sapiens; identical to SEQ ID NO: 903449

SEQ ID NO: 903455 - protein, 233 aa, Homo sapiens
MWRLLARASAPLLRVPLSDSWALLPASAGVKTLLPVPSFEDVSIPEKPKLRFIERAPLVPKVRREPKNLSDIRGPSTEATEFTEGNFAILALGGGYLHWGHFEMMRLTINRSMDPKNMFAIWRVPAPFKPITRKTVKAGRLVVEMGGRCEFEEVQGFLDQVAHKLPFAAKAVSRGTLEKMRKDQEERERNNQNPWTFERIATANMLGIRKVLSPYDLTHKGKYWGKFYMPKRV

SEQ ID NO: 903456 - protein, 111 aa, Homo sapiens
MMRLTINRSMDPKNMFAIWRVPAPFKPITRKSVGHRMGGGKGAIDHYVTPVKAGRLVVEMGGRCEFEEVQGFLDQVAHKLPFAAKAVSRGTLEKMRKDQEERERNNQNPWT

SEQ ID NO: 903457 - protein, 610 aa, Homo sapiens
GDFPFPATGPQAEREAGPGSRAAASAASAAAATAAGAVMAELVQGQSAPVGMKAEGFVDALHRVRQIAAKIDSIPHLNNSTPLVDPSVYGYGVQKRPLDDGVGNQLGALVHQRTVITEEFKVPDKMVGFIIGRGGEQISRIQAESGCKIQIASESSGIPERPCVLTGTPESIEQAKRLLGQIVDRCRNGPGFHNDIDSNSTIQEILIPASKVGLVIGRGGETIKQLQERTGVKMVMIQDGPLPTGADKPLRITGDAFKVQQAREMVLEIIREKDQADFRGVRGDFNSRMGGGSIEVSVPRFAVGIVIGRNGEMIKKIQNDAGVRIQFKPDDGISPERAAQVMGPPDRCQHAAHIISELILTAQERDGFGGLAAARGRGRGRGDWSVGAPGGVQEITYTVPADKCGLVIGKGGENIKSINQQSGAHVELQRNPPPNSDPNLRRFTIRGVPQQIEVARQLIDEKVGGTNLGAPGAFGQSPFSQPPAPPHQNTFPPRSSGCFPNMAAKVNGNPHSTPVSGPPAFLTQGWGSTYQAWQQPTQQVPSQQSQPQSSQPNYSKAWEDYYKKQSHAASAAPQASSPPDYTMAWAEYYRQQVAFYGQTLGQAQAHSQEQ

SEQ ID NO: 903458 - protein, 71 aa, Homo sapiens
VSCYRTLHTGPTAVRNGSMCSPPYAYSDVVAVLSYLTVNIWICIHISGDMHGPCTHLRQKTMLGWVTNLVN

SEQ ID NO: 903459 - protein, 485 aa, Homo sapiens
MVGFIIGRGGEQISRIQAESGCKIQIASESSGIPERPCVLTGTPESIEQAKRLLGQIVDRCRNGPGFHNDIDSNSTIQEILIPASKVGLVIGRGGETIKQLQERTGVKMVMIQDGPLPTGADKPLRITGDAFKVQQAREMVLEIIREKDQADFRGVRGDFNSRMGGGSIEVSVPRFAVGIVIGRNGEMIKKIQNDAGVRIQFKPDDGISPERAAQVMGPPDRCQHAAHIISELILTAQERDGFGGLAAARGRGRGRGDWSVGAPGGVQEITYTVPADKCGLVIGKGGENIKSINQQSGAHVELQRNPPPNSDPNLRRFTIRGVPQQIEVARQLIDEKVGGTNLGAPGAFGQSPFSQPPAPPHQNTFPPRSSGCFPNMAAKVNGNPHSTPVSGPPAFLTQGWGSTYQAWQQPTQQVPSQQSQPQSSQPNYSKAWEDYYKKQSHAASAAPQASSPPDYTMAWAEYYRQQVAFYGQTLGQAQAHSQEQ

SEQ ID NO: 903460 - protein, 635 aa, Homo sapiens
GDFPFPATGPQAEREAGPGSRAAASAASAAAATAAGAVMAELVQGQSAPVGMKAEGFVDALHRVRQIAAKIDSIPHLNNSTPLVDPSVYGYGVQKRPLDDGVGNQLGALVHQRTVITEEFKVPDKMVGFIMAGEREHDFTAFKHDILRFLAPNNKTFSKRKLLGAFFPNEKNGKGFPWGEFHRKKALCTYRKPPESIEQAKRLLGQIVDRCRNGPGFHNDIDSNSTIQEILIPASKVGLVIGRGGETIKQLQERTGVKMVMIQDGPLPTGADKPLRITGDAFKVQQAREMVLEIIREKDQADFRGVRGDFNSRMGGGSIEVSVPRFAVGIVIGRNGEMIKKIQNDAGVRIQFKPDDGISPERAAQVMGPPDRCQHAAHIISELILTAQERDGFGGLAAARGRGRGRGDWSVGAPGGVQEITYTVPADKCGLVIGKGGENIKSINQQSGAHVELQRNPPPNSDPNLRRFTIRGVPQQIEVARQLIDEKVGGTNLGAPGAFGQSPFSQPPAPPHQNTFPPRSSGCFPNMAAKVNGNPHSTPVSGPPAFLTQGWGSTYQAWQQPTQQVPSQQSQPQSSQPNYSKAWEDYYKKQSHAASAAPQASSPPDYTMAWAEYYRQQVAFYGQTLGQAQAHSQEQ

SEQ ID NO: 903461 - protein, 610 aa, Homo sapiens; identical to SEQ ID NO: 903457

SEQ ID NO: 903462 - protein, 566 aa, Homo sapiens
GDFPFPATGPQAEREAGPGSRAAASAASAAAATAAGAVMAELVQGQSAPVGMKAEGFVDALHRVRQIAAKIDSIPHLNNSTPLVDPSVYGYGVQKRPLDDGVGNQLGALVHQRTVITEEFKVPDKMVGFIIGRGGEQISRIQAESGCKIQIASESSGIPERPCVLTGTPESIEQAKRLLGQIVDRCRNGPGFHNDIDSNSTIQEILIPASKVGLVIGRGGETIKQLQERTGVKMVMIQDGPLPTGADKPLRITGDAFKVQQAREMVLEIIREKDQADFRGVRGDFNSRMGGGSIEVSVPRFAVGIVIGRNGEMIKKIQNDAGVRIQFKPDDGISPERAAQVMGPPDRCQHAAHIISELILTAQERDGFGGLAAARGRGRGRGDWSLRTESIQPATCPTSSKYLSSKELRVLPKHGCQGEWEPPQHPCEWSSGLSDPGLGQHLPGVAAAHTAGPKPAEPAAEQPAQLQQGLGRLLQKTESRRQRCSSGQLPTGLHNGLGRILQTAGRFLRTDVRAGAGPQPGAVGQRPRGQLSPQNHCQRKPICNRGFYICKPFDEELLFCSVKHYI

SEQ ID NO: 903463 - protein, 610 aa, Homo sapiens; identical to SEQ ID NO: 903457

SEQ ID NO: 903464 - protein, 84 aa, Homo sapiens
CEEPVRPDCFCVLRTGQQSQPQSSQPNYSKAWEDYYKKQSHAASAAPQASSPPDYTMAWAEYYRQQVAFYGQTLGQAQAHSQEQ

SEQ ID NO: 903465 - protein, 305 aa, Homo sapiens
GDFPFPATGPQAEREAGPGSRAAASAASAAAATAAGAVMAELVQGQSAPVGMKAEGFVDALHRVRQIAAKIDSIPHLNNSTPLVDPSVYGYGVQKRPLDDGVGNQLGALVHQRTVITEEFKVPDKMVGFIIGRGGEQISRIQAESGCKIQIASESSGIPERPCVLTGTPESIEQAKRLLGQIVDRCRNGPGFHNDIDSNSTIQEILIPASKVGLVIGRGGETIKQLQERTGVKMVMIQDGPLPTGADKPLRITGDAFKVQQAREMVLEIIREKDQADFRGVRGDFNSRMGGGSIEVCLNYRLVGK

SEQ ID NO: 903466 - protein, 304 aa, Homo sapiens
MPPIGNQLGALVHQRTVITEEFKVPDKMVGFIIGRGGEQISRIQAESGCKIQIASESSGIPERPCVLTGTPESIEQAKRLLGQIVDRCRNGPGFHNDIDSNSTIQEILIPASKVGLVIGRGGETIKQLQERTGVKMVMIQDGPLPTGADKPLRITGDAFKVQQAREMVLEIIREKDQADFRGVRGDFNSRMGGGSIEVSVPRFAVGIVIGRNGEMIKKIQNDAGVRIQFKPDNGLGRILQTAGRFLRTDVRAGAGPQPGAVGQRPRGQLSPQNHCQRKPICNRGFYICKPFDEELLFCSVKHYI

SEQ ID NO: 903467 - protein, 512 aa, Homo sapiens [sequence omitted]

SEQ ID NO: 903468 - protein, 610 aa, Homo sapiens; identical to SEQ ID NO: 903457

SEQ ID NO: 903469 - protein, 610 aa, Homo sapiens; identical to SEQ ID NO: 903457

SEQ ID NO: 903470 - protein, 284 aa, Homo sapiens
SEFCNQILLESVKLLTSPADNKSNHFVRHFEFFRYYRPLMYQGPYLVTYSIIQGRFCTPYPYTEEVQEITYTVPADKCGLVIGKGGENIKSINQQSGAHVELQRNPPPNSDPNLRRFTIRGVPQQIEVARQLIDEKVGGTNLGAPGAFGQSPFSQPPAPPHQNTFPPRSSGCFPNMAAKVNGNPHSTPVSGPPAFLTQGWGSTYQAWQQPTQQVPSQQSQPQSSQPNYSKAWEDYYKKQSHAASAAPQASSPPDYTMAWAEYYRQQVAFYGQTLGQAQAHSQEQ

SEQ ID NO: 903471 - protein, 92 aa, Homo sapiens
HQPHLTASQTSLPSSRPEGEQMPRAFGKGPAQCTSAPDNLCFLLCQPGHAASAAPQASSPPDYTMAWAEYYRQQVAFYGQTLGQAQAHSQEQ

SEQ ID NO: 903472 - protein, 82 aa, Homo sapiens
GDFPFPATGPQAEREAGPGSRAAASAASAAAATAAGAVMAELVQGQSAPVGMKAEGFVDALHRVRQKATGVIVLEEGLHSGA

SEQ ID NO: 903473 - protein, 69 aa, Homo sapiens
GNNVTNSIRINVYYDAEINKLVKLLCCLNPQVTNLQSCRLPLEGIGVDLLNYHMREEAQKLAHYSQAGP

SEQ ID NO: 903474 - protein, 69 aa, Homo sapiens; identical to SEQ ID NO: 903473

SEQ ID NO: 903475 - protein, 69 aa, Homo sapiens; identical to SEQ ID NO: 903473

SEQ ID NO: 903476 - protein, 946 aa, Homo sapiens
MEEQGHSEMEIIPSESHPHIQLLKSNRELLVTHIRNTQCLVDNLLKNDYFSAEDAEIVCACPTQPDKVRKILDLVQSKGEEVSEFFLYLLQQLADAYVDLRPWLLEIGFSPSLLTQSKVVVNTDPVSRYTQQLRHHLGRDSKFVLCYAQKEELLLEEIYMDTIMELVGFSNESLGSLNSLACLLDHTTGILNEQGETIFILGDAGVGKSMLLQRLQSLWATGRLDAGVKFFFHFRCRMFSCFKESDRLCLQDLLFKHYCYPERDPEEVFAFLLRFPHVALFTFDGLDELHSDLDLSRVPDSSCPWEPAHPLVLLANLLSGKLLKGASKLLTARTGIEVPRQFLRKKVLLRGFSPSHLRAYARRMFPERALQDRLLSQLEANPNLCSLCSVPLFCWIIFRCFQHFRAAFEGSPQLPDCTMTLTDVFLLVTEVHLNRMQPSSLVQRNTRSPVETLHAGRDTLCSLGQVAHRGMEKSLFVFTQEEVQASGLQERDMQLGFLRALPELGPGGDQQSYEFFHLTLQAFFTAFFLVLDDRVGTQELLRFFQEWMPPAGAATTSCYPPFLPFQCLQGSGPAREDLFKNKDHFQFTNLFLCGLLSKAKQKLLRHLVPAAALRRKRKALWAHLFSSLRGYLKSLPRVQVESFNQVQAMPTFIWMLRCIYETQSQKVGQLAARGICANYLKLTYCNACSADCSALSFVLHHFPKRLALDLDNNNLNDYGVRELQPCFSRLTVLRLSVNQITDGGVKVLSEELTKYKIVTYLGLWKSVDTICFKKQEAIKMTSGARKSHGCAFSGSLYNNQITDVGARLGKNKITSEGGKYLALAVKNSKSISEVGMWGNQVGDEGAKAFAEALRNHPSLTTLSLASNGISTEGGKSLARALQQNTSLEILWLTQNELNDEVAESLAEMLKVNQTLKHLWLIQNQITAKGTAQLADALQSNTGITEI

SEQ ID NO: 903477 - protein, 953 aa, Homo sapiens
MEEQGHSEMEIIPSESHPHIQLLKSNRELLVTHIRNTQCLVDNLLKNDYFSAEDAEIVCACPTQPDKVRKILDLVQSKGEEVSEFFLYLLQQLADAYVDLRPWLLEIGFSPSLLTQSKVVVNTDPVSRYTQQLRHHLGRDSKFVLCYAQKEELLLEEIYMDTIMELVGFSNESLGSLNSLACLLDHTTGILNEQGETIFILGDAGVGKSMLLQRLQSLWATGRLDAGVKFFFHFRCRMFSCFKESDRLCLQDLLFKHYCYPERDPEEVFAFLLRFPHVALFTFDGLDELHSDLDLSRVPDSSCPWEPAHPLVLLANLLSGKLLKGASKLLTARTGIEVPRQFLRKKVLLRGFSPSHLRAYARRMFPERALQDRLLSQLEANPNLCSLCSVPLFCWIIFRCFQHFRAAFEGSPQLPDCTMTLTDVFLLVTEVHLNRMQPSSLVQRNTRSPVETLHAGRDTLCSLGQVAHRGMEKSLFVFTQEEVQASGLQERDMQLGFLRALPELGPGGDQQSYEFFHLTLQAFFTAFFLVLDDRVGTQELLRFFQEWMPPAGAATTSCYPPFLPFQCLQGSGPAREDLFKNKDHFQFTNLFLCGLLSKAKQKLLRHLVPAAALRRKRKALWAHLFSSLRGYLKSLPRVQVESFNQVQAMPTFIWMLRCIYETQSQKVGQLAARGICANYLKLTYCNACSADCSALSFVLHHFPKRLALDLDNNNLNDYGVRELQPCFSRLTVLRLSVNQITDGGVKVLSEELTKYKIVTYLGLYNNQITDVGARYVTKILDECKGLTHLKLGKNKITSEGGKYLALAVKNSKSISEVGMWGNQVGDEGAKAFAEALRNHPSLTTLSLASNGISTEGGKSLARALQQNTSLEILWLTQNELNDEVAESLAEMLKVNQTLKHLWLIQNQITAKGTAQLADALQSNTGITEICLNGNLIKPEEAKVYEDEKRIICF

SEQ ID NO: 903478 - protein, 953 aa, Homo sapiens; identical to SEQ ID NO: 903477

SEQ ID NO: 903479 - protein, 269 aa, Homo sapiens
MRRLKQGCSALSFVLHHFPKRLALDLDNNNLNDYGVRELQPCFSRLTVLRLSVNQITDGGVKVLSEELTKYKIVTYLGLYNNQITDVGARYVTKILDECKGLTHLKLGKNKITSEGGKYLALAVKNSKSISEVGMWGNQVGDEGAKAFAEALRNHPSLTTLSLASNGISTEGGKSLARALQQNTSLEILWLTQNELNDEVAESLAEMLKVNQTLKHLWLIQNQITAKGTAQLADALQSNTGITEICLNGNLIKPEEAKVYEDEKRIICF

SEQ ID NO: 903480 - protein, 930 aa, Homo sapiens
MEEQGHSEMEIIPSESHPHIQLLKSNRELLVTHIRNTQCLVDNLLKNDYFSAEDAEIVCACPTQPDKVRKILDLVQSKGEEVSEFFLYLLQQLADAYVDLRPWLLEIGFSPSLLTQSKVVVNTDPVSRYTQQLRHHLGRDSKFVLCYAQKEELLLEEIYMDTIMELVGFSNESLGSLNSLACLLDHTTGILNEQGETIFILGDAGVGKSMLLQRLQSLWATGRLDAGVKFFFHFRCRMFSCFKESDRLCLQDLLFKHYCYPERDPEEVFAFLLRFPHVALFTFDGLDELHSDLDLSRVPDSSCPWEPAHPLVLLANLLSGKLLKGASKLLTARTGIEVPRQFLRKKVLLRGFSPSHLRAYARRMFPERALQDRLLSQLEANPNLCSLCSVPLFCWIIFRCFQHFRAAFEGSPQLPDCTMTLTDVFLLVTEVHLNRMQPSSLVQRNTRSPVETLHAGRDTLCSLGQVAHRGMEKSLFVFTQEEVQASGLQERDMQLGFLRALPELGPGGDQQSYEFFHLTLQAFFTAFFLVLDDRVGTQELLRFFQEWMPPAGAATTSCYPPFLPFQCLQGSGPAREDLFKNKDHFQFTNLFLCGLLSKAKQKLLRHLVPAAALRRKRKALWAHLFSSLRGYLKSLPRVQVESFNQVQAMPTFIWMLRCIYETQSQKVGQLAARGICANYLKLTYCNACSADCSALSFVLHHFPKRLALDLDNNNLNDYGVRELQPCFSRLTVLRLSVNQITDGGVKVLSEELTKYKIVTYLGLYNNQITDVGARYVTKILDECKGLTHLKLGKNKITSEGGKYLALAVKNSKSISEVGMWGNQVGDEGAKAFAEALRNHPSLTTLSLASNGISTEGGKSLARALQQNTSLEILWLTQNELNDEVAESLAEMLKVNQTLKHLWLIQNQITAKGTAQLADALQSNTGITEIW

SEQ ID NO: 903481 - protein, 953 aa, Homo sapiens; identical to SEQ ID NO: 903477

SEQ ID NO: 903482 - protein, 925 aa, Homo sapiens
MEEQGHSEMEIIPSESHPHIQLLKSNRELLVTHIRNTQCLVDNLLKNDYFSAEDAEIVCACPTQPDKVRKILDLVQSKGEEVSEFFLYLLQQLADAYVDLRPWLLEIGFSPSLLTQSKVVVNTDPVSRYTQQLRHHLGRDSKFVLCYAQKEELLLEEIYMDTIMELVGFSNESLGSLNSLACLLDHTTGILNEQGETIFILGDAGVGKSMLLQRLQSLWATGRLDAGVKFFFHFRCRMFSCFKESDRLCLQDLLFKHYCYPERDPEEVFAFLLRFPHVALFTFDGLDELHSDLDLSRVPDSSCPWEPAHPLVLLANLLSGKLLKGASKLLTARTGIEVPRQFLRKKVLLRGFSPSHLRAYARRMFPERALQDRLLSQLEANPNLCSLCSVPLFCWIIFRCFQHFRAAFEGSPQLPDCTMTLTDVFLLVTEVHLNRMQPSSLVQRNTRSPVETLHAGRDTLCSLGQVAHRGMEKSLFVFTQEEVQASGLQERDMQLGFLRALPELGPGGDQQSYEFFHLTLQAFFTAFFLVLDDRVGTQELLRFFQEWMPPAGAATTSCYPPFLPFQCLQGSGPAREDLFKNKDHFQFTNLFLCGLLSKAKQKLLRHLVPAAALRRKRKALWAHLFSSLRGYLKSLPRVQVESFNQVQAMPTFIWMLRCIYETQSQKVGQLAARGICANYLKLTYCNACSADCSALSFVLHHFPKRLALDLDNNNLNDYGVRELQPCFSRLTVLRLSVNQITDGGVKVLSEELTKYKIVTYLGLYNNQITDVGARYVTKILDECKGLTHLKLGKNKITSEGGKYLALAVKNSKSISEVGMWGNQVGDEGAKAFAEALRNHPSLTTLSLASNGISTEGGKSLARALQQNTSLEILWLTQNELNDEVAESLAEMLKVNQTLKHLCLNGNLIKPEEAKVYEDEKRIICF

SEQ ID NO: 903483 - protein, 135 aa, Homo sapiens [sequence omitted]

SEQ ID NO: 903484 - protein, 101 aa, Homo sapiens
MEEQGHSEMEIIPSESHPHIQLLKSNRELLVTHIRNTQCLVDNLLKNDYFSAEDAEIVCACPTQPDKVPRGQGRAWALCGPRELEEASPADLSEERGSLVQ

SEQ ID NO: 903485 - protein, 207 aa, Homo sapiens
MLALRCGSRWLGLLSVPRSVPLRLPAARACSKGSGDPSSSSSSGNPLVYLDVDANGKPLGRVVLELKADVVPKTAENFRALCTGEKGFGYKGSTFHRVIPSFMCQAGDFTNHNGTGGKSIYGSRFPDENFTLKHVGPGVLSMANAGPNTNGSQFFICTIKTDWLDGKHVVFGHVKEGMDVVKKIESFGSKSGRTSKKIVITDCGQLS

SEQ ID NO: 903486 - protein, 207 aa, Homo sapiens; identical to SEQ ID NO: 903485

SEQ ID NO: 903487 - protein, 207 aa, Homo sapiens; identical to SEQ ID NO: 903485

SEQ ID NO: 903488 - protein, 207 aa, Homo sapiens; identical to SEQ ID NO: 903485

SEQ ID NO: 903489 - protein, 207 aa, Homo sapiens; identical to SEQ ID NO: 903485

SEQ ID NO: 903490 - protein, 207 aa, Homo sapiens; identical to SEQ ID NO: 903485

SEQ ID NO: 903491 - protein, 191 aa, Homo sapiens
MLALRCGSRWLGLLSVPRSVPLRLPAARACSKGSGDPSSSSSSGNPLVYLDVDANGKPLGRVVLELKADVVPKTAENFRALCTGEKGFGYKGSTFHNGTGGKSIYGSRFPDENFTLKHVGPGVLSMANAGPNTNGSQFFICTIKTDWLDGKHVVFGHVKEGMDVVKKIESFGSKSGRTSKKIVITDCGQLS

SEQ ID NO: 903492 - protein, 207 aa, Homo sapiens; identical to SEQ ID NO: 903485

SEQ ID NO: 903493 - protein, 207 aa, Homo sapiens; identical to SEQ ID NO: 903485

SEQ ID NO: 903494 - protein, 207 aa, Homo sapiens; identical to SEQ ID NO: 903485

SEQ ID NO: 903495 - protein, 155 aa, Homo sapiens
MLALRCGSRWLGLLSVPRSVPLRLPAARACSKGSGDPSSSSSSGNPLVYLDVDANGKPLGRVVLELKADVVPKTAENFRALCTGEKGFGYKGSTFHRVIPSFMCQAGDFTNHNGTGGKSIYGSRFPDENFTLKHVGPGWMASMLCSVTSKRAWTS

SEQ ID NO: 903496 - protein, 71 aa, Homo sapiens
HFCTQAHFCTQAHFCTQAHFCTIKTDWLDGKHVVFGHVKEGMDVVKKIESFGSKSGRTSKKIVITDCGQLS

SEQ ID NO: 903497 - protein, 74 aa, Homo sapiens
GHTPHWPDTVWPSGCQQFERKALLNVDRLKKLSRPHREAVGSTTSEGRKIIESFGSKSGRTSKKIVITDCGQLS

SEQ ID NO: 903498 - protein, 107 aa, Homo sapiens [sequence omitted]

SEQ ID NO: 903499 - protein, 207 aa, Homo sapiens; identical to SEQ ID NO: 903485

SEQ ID NO: 903500 - protein, 207 aa, Homo sapiens; identical to SEQ ID NO: 903485

SEQ ID NO: 903501 - protein, 207 aa, Homo sapiens; identical to SEQ ID NO: 903485

SEQ ID NO: 903502 - protein, 151 aa, Homo sapiens
DVARAQKAELKADVVPKTAENFRALCTGEKGFGYKGSTFHRVIPSFMCQAGDFTNHNGTGGKSIYGSRFPDENFTLKHVGPGVLSMANAGPNTNGSQFFICTIKTDWLDGKHVVFGHVKEGMDVVKKIESFGSKSGRTSKKIVITDCGQLS

SEQ ID NO: 903503 - protein, 114 aa, Homo sapiens
MVATQKVLCAQQAGDFTNHNGTGGKSIYGSRFPDENFTLKHVGPGVLSMANAGPNTNGSQFFICTIKTDWLDGKHVVFGHVKEGMDVVKKIESFGSKSGRTSKKIVITDCGQLS

SEQ ID NO: 903504 - protein, 145 aa, Homo sapiens
MLALRCGSRWLGLLSVPRSVPLRLPAARACSKGSGDPSSSSSSGNPLVYLDVDANGKPLGRVVLELKADVVPKTAENFRALCTGEKGFGYKGSTFHRVIPSFMCQAGDFTNHNGTGGKSIYGSRFPDENFTLKHVGPGEWGPPLG

SEQ ID NO: 903505 - protein, 201 aa, Homo sapiens
MLALRCGSRWLGLLSVPRSVPLRLPAARACSKGSGDPSSSSSSGNPLVYLDVDANGKPLGRVVLELKADVVPKTAENFRALCTGEKGFGYKGSTFHRVIPSFMCQAGDFTNHNGTGGKSIYGSRFPDENFTLKHVGPGVLSMANAGPNTNGSQFFICTIKTDWSMALDDIALHCCSPGSPVLTGWMASMLCSVTSKRAWTS

SEQ ID NO: 903506 - protein, 105 aa, Homo sapiens
MGLPGFRLHGLRQGHNMSDRMCPGSQASSGVYLGRSTRLDRALGVDLAIPWGFFSELLFSVTNSMTRSMALDDIALHCCSPGSPVLTGWMASMLCSVTSKRAWTS

SEQ ID NO: 903507 - protein, 189 aa, Homo sapiens
MLALRCGSRWLGLLSVPRSVPLRLPAARACSKGSGDPSSSSSSGNPLVYLDVDANGKPLGRVVLELKADVVPKTAENFRALCTGEKGFGYKGSTFHRVIPSFMCQAGDFTNHNGTGGKSIYGSRFPDENFTLKHVGPGVLSMANAGPNTNGSQFFICTIKTDWLDGKHVVFGHVKEGMDVVKKDCGQLS

SEQ ID NO: 903508 - protein, 207 aa, Homo sapiens; identical to SEQ ID NO: 903485

SEQ ID NO: 903509 - protein, 454 aa, Homo sapiens
GAIVTGKGLDRETAGWHNITVLAMEADNHAQLSRASLRIRILDVNDNPPELATPYEAAVCEDAKPGQLIQTISVVDRDEPQGGHRFYFRLVPEAPSNPHFSLLDIQDNTAAVHTQHVGFNRQEQDVFFLPILVVDSGPPTLSSTGTLTIRICGCDSSGTIQSCNTTAFVMAASLSPGALIALLVCVLILVVLVLLILTLRRHHKSHLSSDEDEDMRDNVIKYNDEGGGEQDTEAYDMSALRSLYDFGELKGGDGGGSAGGGAGGGSGGGAGSPPQAHLPSERHSLPQGPPSPEPDFSVFRDFISRKVALADGDLSVPPYDAFQTYAFEGADSPAASLSSLHSGSSGSEQDFAYLSSWGPRFRPLAALYAGHRGDDEAQASSPSPCRRGAAAHPPSTRRGPRTTRFPRGPPFLPSPNPPLAAGRRGDLLGADSSIPPPLGVQLWSPEVRDSDQRH

SEQ ID NO: 903510 - protein, 174 aa, Homo sapiens
MGLLRDEALAEVKDMEQLLALGKEARACPYYRSRLAIPAAQLVVLPYQMLLHAATRQAAGIRLQDQVVIIDEAHNLIDTITGMHSVEVSGSQLCQAHSQLLQYMERYGKRLKAKNLMYLKQILYLLEKFVAVLGGNIKAKSHTQSLSQTGRDETSNDFSFQSRSNITVQGPELG

SEQ ID NO: 903511 - protein, 729 aa, Homo sapiens
VCLLKVEQARRKQREERLQQLQHRVQLKYAAKRLRQEEEETENLLRLSREMLETGPEAERLEQLESGEEELVLAEYESDEEKKVASGVDEDEDDLEEEHITKIYYCSRTHSQLAQFVHEVKKSPFGKDVRLVSLGSQQNLCVNEDVRSLGSVQLINDRCVDMQRSRHEKKKGAEEEKPKRRRQEKQAACPFYNHEQMGLLRDEALAEVKDMEQLLALGKEARACPYYRSRLAIPAAQLVVLPYQMLLHAATRQAAGIRLQDQVVIIDEAHNLIDTITGMHSVEVSGSQLCQAHSQLLQYMERYGKRLKAKNLMYLKQILYLLEKFVAVLGGNIKQNPNTQSLSQTGTELKTINDFLFQSQIDNINLFKVQRYCEKSMISRKLFGFTERYGAVFSSREQPKLAGFQQFLQSLQPRTTEALAAPADESQASVPQPASPLMHIEGFLAALTTANQDGRVILSRQGSLSESTLKFLLLNPAVHFAQVVKECRAVVIAGGTMQPVSDFRQQLLACAGVEAERVVEFSCGHVIPPDNICPYVICSGISNQPLEFTFQKRDLPQMMDEVGRILCNLCGVVSGGVVCFFPSYEYLRQVHAHWEKGGLLGRLAARKKIFQEPKSAHQVEQVLLAYSRCIQACGQERGQVTEALLLSVVGGKMSEGINFSDNLGRCVVMVGMPFPNIRSAELQEKMAYLDQTLPRAPGQAPPGKALVENLCMKAVKPAGPSGTRRILPA

SEQ ID NO: 903512 - protein, 509 aa, Homo sapiens
MLLHAATRQAAGIRLQDQVVIIDEAHNLIDTITGMHSVEVSGSQLCQAHSQLLQYMERYGKRLKAKNLMYLKQILYLLEKFVAVLGGNIKQNPNTQSLSQTGTELKTINDFLFQSQIDNINLFKVQRYCEKSMISRKLFGFTERYGAVFSSREQPKLAGFQQFLQSLQPRTTEALAAPADESQASVPQPASPLMHIEGFLAALTTANQDGRVILSRQGSLSESTLKFLLLNPAVHFAQVVKECRAVVIAGGTMQPANFSLPFCWASEGSWGHDAVALVYRCLTSGSSCWPVLGWKLSRGGVFLWSRDPSRQHLPLVICSGISNQPLEFTFQKRDLPQMMDEVGRILCNLCGVVSGGVVCFFPSYEYLRQVHAHWEKGGLLGRLAARKKIFQEPKSAHQVEQVLLAYSRCIQACGQERGQVTEALLLSVVGGKMSEGINFSDNLGRCVVMVGMPFPNIRSAELQEKMAYLDQTLPRAPGQAPPGKALVENLCMKAVKPAGPSGTRRILPA

SEQ ID NO: 903513 - protein, 557 aa, Homo sapiens
MGLLRDEALAEVKDMEQLLALGKEARACPYYRSRLAIPAAQLVVLPYQMLLHAATRQAAGIRLQDQVVIIDEAHNLIDTITGMHSVEVSGSQLCQAHSQLLQYMERYGKRLKAKNLMYLKQILYLLEKFVAVLGGNIKQNPNTQSLSQTGTELKTINDFLFQSQIDNINLFKVQRYCEKSMISRKLFGFTERYGAVFSSREQPKLAGFQQFLQSLQPRTTEALAAPADESQASVPQPASPLMHIEGFLAALTTANQDGRVILSRQGSLSESTLKFLLLNPAVHFAQVVKECRAVVIAGGTMQPANFSLPFCWASEGSWGHDAVALVYRCLTSGSSCWPVLGWKLSRGGVFLWSRDPSRQHLPLVICSGISNQPLEFTFQKRDLPQMMDEVGRILCNLCGVVSGGVVCFFPSYEYLRQVHAHWEKGGLLGRLAARKKIFQEPKSAHQVEQVLLAYSRCIQACGQERGQVTEALLLSVVGGKMSEGINFSDNLGRCVVMVGMPFPNIRSAELQEKMAYLDQTLPRAPGQAPPGKALVENLCMKAVKPAGPSGTRRILPA

SEQ ID NO: 903514 - protein, 607 aa, Homo sapiens
MLLHAATRQAAGIRLQDQVVIIDEAHNLIDTITGMHSVEVSGSQLCQAHSQLLQYMERYGKRLKAKNLMYLKQILYLLEKFVAVLGGNIKQNPNTQSLSQTGTELKTINDFLFQSQIDNINLFKVQRYCEKSMISRKLFGFTERYGAVFSSREQPKLAGFQQFLQSLQPRTTEALAAPADESQASVPQPASPLMHIEGFLAALTTANQDGRVILSRQGSLSESTLKFLLLNPAVHFAQVVKECRAVVIAGGTMQPVSDFRQQLLACAGVEAERVVEFSCGHVIPPDNICPYVICSGISNQPLEFTFQKRDLPQMMDEVGRILCNLCGVVSGGVVCFFPSYEYLRQVHAHWEKGGLLGRLAARKKIFQEPKSAHQVEQVLLAYSRCIQVRASCCAWACGQERGQVTEALLLSVVGGKMSEGINFSDNLGRCVVMVGMPFPNIRSAELQEKMAYLDQTLPRAPGQAPPGKALVENLCMKAVNQQGHQAPEGFCQHSAPGPAIRPAPCPGQAAGLDPSPRGGQSYLWPRHCCCAEVSPGEVGLFLMGNHTTARRRALPLSCPLETVFVVGVVCRDPVTKVKPRRRVWSPERCQDPGTGVSSRRRKCGNPE

SEQ ID NO: 903515 - protein, 595 aa, Homo sapiens
MLLHAATRQAAGIRLQDQVVIIDEAHNLIDTITGMHSVEVSGSQLCQAHSQLLQYMERYGKRLKAKNLMYLKQILYLLEKFVAVLGGNIKQNPNTQSLSQTGTELKTINDFLFQSQIDNINLFKVQRYCEKSMISRKLFGFTERYGAVFSSREQPKLAGFQQFLQSLQPRTTEALAAPADESQASVPQPASPLMHIEGFLAALTTANQDGRVILSRQGSLSESTLKFLLLNPAVHFAQVVKECRAVVIAGGTMQPANFSLPFCWASEGSWGHDAVALVYRCLTSGSSCWPVLGWKLSRGGVFLWSRDPSRQHLPLVICSGISNQPLEFTFQKRDLPQMMDEVGRILCNLCGVVSGGVVCFFPSYEYLRQVHAHWEKGGLLGRLAARKKIFQEPKSAHQVEQVLLAYSRCIQACGQERGQVTEALLLSVVGGKMSEGINFSDNLGRCVVMVGMPFPNIRSAELQEKMAYLDQTLPRAPGQAPPGKALVENLCMKAVKPVHEVSLAASSWVDRWGLEKGRTGKRGCLPCFLYKSEEGRAIRHQKDFASIVLLDQRYARPPVLAKLPAWIRARVEVKATFGPAIAAVQKFHREKSASS

SEQ ID NO: 903516 - protein, 486 aa, Homo sapiens
AVLAGIFGITGMHSVDVSGSQLCQAHSQLLQYMERYGKRLKAKNLMYLKQILYLLEKFVAVLGGNIKQNPNTQSLSQTGTELKTINDFLFQSQIDNINLFKVQRYCEKSMISRKLFGFTERYGAVFSSREQPKLAGFQQFLQSLQPRTTEALAAPADESQASVPQPASPLMHIEGFLAALTTANQDGRVILSRQGSLSESTLKFLLLNPAVHFAQVVKECRAVVIAGGTMQPANFSLPFCWASEGSWGHDAVALVYRCLTSGSSCWPVLGWKLSRGGVFLWSRDPSRQHLPLVICSGISNQPLEFTFQKRDLPQMMDEVGRILCNLCGVVSGGVVCFFPSYEYLRQVHAHWEKGGLLGRLAARKKIFQEPKSAHQVEQVLLAYSRCIQACGQERGQVTEALLLSVVGGKMSEGINFSDNLGRCVVMVGMPFPNIRSAELQEKMAYLDQTLPRAPGQAPPGKALVENLCMKAVKPAGPSGTRRILPA

SEQ ID NO: 903517 - protein, 463 aa, Homo sapiens
MLLHAATRQAAGIRLQDQVVIIDEAHNLIDTITGMHSVEVSGSQLCQAHSQLLQYMERYGKRLKAKNLMYLKQILYLLEKFVAVLGGNIKQNPNTQSLSQTGTELKTINDFLFQSQIDNINLFKVQRYCEKSMISRKLFGFTERYGAVFSSREQPKLAGFQQFLQSLQPRTTEALAAPADESQASVPQPASPLMHIEGFLAALTTANQDGRVILSRQGSLSESTLKFLLLNPAVHFAQVVKECRAVVIAGGTMQPANFSLPFCWASEGSWGHDAVALVYRCLTSGSSCWPVLGWKLSRGGVFLWSRDPSRQHLPLVICSGISNQPLEFTFQKRDLPQMMDEVGRILCNLCGVVSGGVVCFFPSYEYLRQVHAHWEKGGLLGRLAARKKIFQEPKSAHQVEQVLLAYSRCIQACGQERGQVTEALLLSVVGGKMSEGINFSDNLGRPEPPARHPQGRLWWRTCA

SEQ ID NO: 903518 - protein, 107 aa, Homo sapiens
RHCCCAEGQSYLFLSESLPTPRSHFSLPSVCPVSPGEVGLFLMGNHTTARRRALPLSCPLETVFVVGVVCRDPVTKVKPRRRVWSPERCQDPGTGVSSRRRKCGNPE

SEQ ID NO: 903519 - protein, 79 aa, Homo sapiens
GGTYHPVVPTQGSQVLFMTIETPYHHGDLCSCGKITLPPATAAPADCACLLPLTPEKGAVVSWDLLPPSGTNRGQEESH

SEQ ID NO: 903520 - protein, 729 aa, Homo sapiens; identical to SEQ ID NO: 903511

SEQ ID NO: 903521 - protein, 472 aa, Homo sapiens
MLLHAATRQAAGIRLQDQVVIIDEAHNLIDTITGMHSVEVSGSQLCQAHSQLLQYMERYGKRLKAKNLMYLKQILYLLEKFVAVLGGNIKQNPNTQSLSQTGTELKTINDFLFQSQIDNINLFKVQRYCEKSMISRKLFGFTERYGAVFSSREQPKLAGFQQFLQSLQPRTTEALAAPADESQASVPQPASPLMHIEGFLAALTTANQDGRVILSRQGSLSESTLKFLLLNPAVHFAQVVKECRAVVIAGGTMQPANFSLPFCWASEGSWGHDAVALVYRCLTSGSSCWPVLGWKLSRGGVFLWSRDPSRQHLPLVICSGISNQPLEFTFQKRDLPQMMDEVGRILCNLCGVVSGGVVCFFPSYEYLRQVHAHWEKGGLLGRLAARKKIFQEPKSAHQVEQVLLAYSRCIQACGQERGQVTEALLLSVVGGKMSEGINFSDNLGRSAELQEKMAYLDQTLAGPSGTRRILPA

SEQ ID NO: 903522 - protein, 545 aa, Homo sapiens
MGLLRDEALAEVKDMEQLLALGKEARACPYYRSRLAIPAAQLVVLPYQMLLHAATRQAAGIRLQDQVVIIDEAHNLIDTITGMHSVEVSGSQLCQAHSQLLQYMERYGKRLKAKNLMYLKQILYLLEKFVAVLGGNIKQNPNTQSLSQTEPDRQHQPVQGAAILEKSMISRKLFGFTERYGAVFSSREQPKLAGFQQFLQSLQPRTTEALAAPADESQASVPQPASPLMHIEGFLAALTTANQDGRVILSRQGSLSESTLKFLLLNPAVHFAQVVKECRAVVIAGGTMQPANFSLPFCWASEGSWGHDAVALVYQVSDFRQQLLACAGVEAERVVEFSCGHVIPPDNILPLVICSGISNQPLEFTFQKRDLPQMMDEVGRILCNLCGVVSGGVVCFFPSYEYLRQVHAHWEKGGLLGRLAARKKIFQEPKSAHQVEQVLLAYSRCIQACGQERGQVTEALLLSVVGGKMSEGINFSDNLGRCVVMVGMPFPNIRSAELQEKMAYLDQTLPRAPGQAPPGKALVENLCMKAVKPAGPSGTRRILPA

SEQ ID NO: 903523 - protein, 729 aa, Homo sapiens; identical to SEQ ID NO: 903511

SEQ ID NO: 903524 - protein, 70 aa, Homo sapiens
VGRILCNLCGVVSGGVVCFFPSYEYLRQVHAHWEKGGLLGRLAARKKVSGLSAALPLVRTVPLSPPGSSC

SEQ ID NO: 903525 - protein, 474 aa, Homo sapiens
YRSVKQAGCSAAPGAVPPPEADSTSAGMSRRPCSCALRPPRCSCSASPSAVTAAGRPRPSDSCKEESSTLSVKMKCDFNCNHVHSGLKLVKPDDIGRLVSYTPAYLEGSCKDCIKDYERLSCIGSPIVSPRIVELETESKRLHNKENQHVQQTLNSTNEIEALETSRLYEDSGYSSFSLQSGLSEHEEGSLLEENFGDSLQSCLLQIQSPDQYPNKNLLPVLHFEKVVCSTLKKNAKRNPKVDREMLKEIIARGNFRLQNIIGRKMGLECVDILSELFRRGLRHVLATILAQLSDMDLINVSKVSTTWKKILEDDKGAFQLYSKAIQRVTENNNKFSPHASTREYVMFRTPLASVQKSAAQTSLKKDAQTKLSNQGDQKGSTYSRHNEFSEVAKTLKKNESLKACIRCNSPAKYDCYLQRATCKREGCGFDYCTKCLCNYHTTKDCSDGKLLKASCKIGPLPGTKKSKKNLRRL

SEQ ID NO: 903526 - protein, 401 aa, Homo sapiens [sequence omitted]

SEQ ID NO: 903527 - protein, 383 aa, Homo sapiens
MKCDFNCNHVHSGLKLVKPDDIGRLVSYTPAYLEGSCKDCIKDYERLSCIGSPIVSPRIVELETESKRLHNKETSRLYEDSGYSSFSLQSGLSEHEEGSLLEENFGDSLQSCLLQIQSPDQYPNKNLLPVLHFEKVVCSTLKKNAKRNPKVDREMLKEIIARGNFRLQNIIGRKMGLECVDILSELFRRGLRHVLATILAQLSDMDLINVSKVSTTWKKILEDDKGAFQLYSKAIQRVTENNNKFSPHASTREYVMFRTPLASVQKSAAQTSLKKDAQTKLSNQGDQKGSTYSRHNEFSEVAKTLKKNESLKACIRCNSPAKYDCYLQRATCKREGCGFDYCTKCLCNYHTTKDCSDGKLLKASCKIGPLPGTKKSKKNLRRL

SEQ ID NO: 903528 - protein, 401 aa, Homo sapiens [sequence omitted]

SEQ ID NO: 903529 - protein, 119 aa, Homo sapiens
MDGQKKNWKDKVVDLLYWRDIKKTGVVFGASLFLLLSLTVFSIVSVTAYIALALLSVTISFRIYKGVIQAIQKSDEGHPFRAYLESEVAISEELVQKYSNSALWSCELHDKGTQAPLLS

SEQ ID NO: 903530 - protein, 128 aa, Homo sapiens
EGEGGGNVRGYIFSRAEYNFIVDLLYWRDIKKTGVVFGASLFLLLSLTVFSIVSVTAYIALALLSVTISFRIYKGVIQAIQKSDEGHPFRAYLESEVAISEELVQKYSNSALWSCELHDKGTQAPLLS

SEQ ID NO: 903531 - protein, 881 aa, Homo sapiens
MEDLDQSPLVSSSDSPPRPQPAFKYQFVREPEDEEEEEEEEEEDEDEDLEELEVLERKPEFSELEYSEMGSSFSVSPKAESAVIVANPREEIIVKNKDEEEKLVSNNILHNQQELPTALTKLVKEDEVVSSEKAKDSFNEKRVAVEAPMREEYADFKPFERVWEVKDSKEDSDMLAAGGKIESNLESKVDKKCFADSLEQTNHEKDSESSNDDTSFPSTPEGIKDRSGAYITCAPFNPAATESIATNIFPLLGDPTSENKTDEKKIEEKKAQIVTEKNTSTKTSNPFLVAAQDSETDYVTTDNLTKVTEEVVANMPEGLTPDLVQEACESELNEVTGTKIAYETKMDLVQTSEVMQESLYPAAQLCPSFEESEATPSPVLPDIVMEAPLNSAVPSAGASVIQPSSSPLEASSVNYESIKHEPENPPPYEEAMSVSLKKVSGIKEEIKEPENINAALQETEAPYISIACDLIKETKLSAEPAPDFSDYSEMAKVEQPVPDHSELVEDSSPDSEPVDLFSDDSIPDVPQKQDETVMLVKESLTETSFESMIEYENKEKLSALPPEGGKPYLESFKLSLDNTKDTLLPDEVSTLSKKEKIPLQMEELSTAVYSNDDLFISKEAQIRETETFSDSSPIEIIDEFPTLISSKTDSFSKLAREYTDLEVSHKSEIANAPDGAGSLPCTELPHDLSLKNIQPKVEEKISFSDDFSKNGSATSKVLLLPPDVSALATQAEIESIVKPKVLVKEAEKKLPSDTEKEDRSPSAIFSAELSKTSVVDLLYWRDIKKTGVVFGASLFLLLSLTVFSIVSVTAYIALALLSVTISFRIYKGVIQAIQKSDEGHPFRAYLESEVAISEELVQKYSNSALWSCELHDKGTQAPLLS

SEQ ID NO: 903532 - protein, 1041 aa, Homo sapiens
MEDLDQSPLVSSSDSPPRPQPAFKYQFVREPEDEEEEEEEEEEDEDEDLEELEVLERKPAAGLSAAPVPTAPAAGAPLMDFGNDFVPPAPRGPLPAAPPVAPERQPSWDPSPVSSTVPAPSPLSAAAVSPSKLPEDDEPPARPPPPPPASVSPQAEPVWTPPAPAPAAPPSTPAAPKRRGSSGSVDETLFALPAASEPVIRSSAENMDLKEQPGNTISAGQEDFPSVLLETAASLPSLSPLSAASFKEHEYLGNLSTVLPTEGTLQENVSEASKEVSEKAKTLLIDRDLTEFSELEYSEMGSSFSVSPKAESAVIVANPREEIIVKNKDEEEKLVSNNILHNQQELPTALTKLVKEDEVVSSEKAKDSFNEKRVAVEAPMREEYADFKPFERVWEVKDSKEDSDMLAAGGKIESNLESKVDKKCFADSLEQTNHEKDSESSNDDTSFPSTPEGIKDRSGAYITCAPFNPAATESIATNIFPLLGDPTSENKTDEKKIEEKKAQIVTEKNTSTKTSNPFLVAAQDSETDYVTTDNLTKVTEEVVANMPEGLTPDLVQEACESELNEVTGTKIAYETKMDLVQTSEVMQESLYPAAQLCPSFEESEATPSPVLPDIVMEAPLNSAVPSAGASVIQPSSSPLEASSVNYESIKHEPENPPPYEEAMSVSLKKVSGIKEEIKEPENINAALQETEAPYISIACDLIKETKLSAEPAPDFSDYSEMAKVEQPVPDHSELVEDSSPDSEPVDLFSDDSIPDVPQKQDETVMLVKESLTETSFESMIEYENKEKLSALPPEGGKPYLESFKLSLDNTKDTLLPDEVSTLSKKEKIPLQMEELSTAVYSNDDLFISKEAQIRETETFSDSSPIEIIDEFPTLISSKTDSFSKLAREYTDLEVSHKSEIANAPDGAGSLPCTELPHDLSLKNIQPKVEEKISFSDDFSKNGSATSKVLLLPPDVSALATQAEIESIVKPKVLVKEAEKKLPSDTEKEDRSPSAIFSAELSKTSGSGVWCQPIPAAFIDSIQHCERNSLHCLGPALCDHQL

SEQ ID NO: 903533 - protein, 1112 aa, Homo sapiens
MEDLDQSPLVSSSDSPPRPQPAFKYQFVREPEDEEEEEEEEEEDEDEDLEELEVLERKPAAGLSAAPVPTAPAAGAPLMDFGNDFVPPAPRGPLPAAPPVAPERQPSWDPSPVSSTVPAPSPLSAAAVSPSKLPEDDEPPARPPPPPPASVSPQAEPVWTPPAPAPAAPPSTPAAPKRRGSSGSVDETLFALPAASEPVIRSSAENMDLKEQPGNTISAGQEDFPSVLLETAASLPSLSPLSAASFKEHEYLGNLSTVLPTEGTLQENVSEASKEVSEKAKTLLIDRDLTEFSELEYSEMGSSFSVSPKAESAVIVANPREEIIVKNKDEEEKLVSNNILHNQQELPTALTKLVKEDEVVSSEKAKDSFNEKRVAVEAPMREEYADFKPFERVWEVKDSKEDSDMLAAGGKIESNLESKVDKKCFADSLEQTNHEKDSESSNDDTSFPSTPEGIKDRSGAYITCAPFNPAATESIATNIFPLLGDPTSENKTDEKKIEEKKAQIVTEKNTSTKTSNPFLVAAQDSETDYVTTDNLTKVTEEVVANMPEGLTPDLVQEACESELNEVTGTKIAYETKMDLVQTSEVMQESLYPAAQLCPSFEESEATPSPVLPDIVMEAPLNSAVPSAGASVIQPSSSPLEASSVNYESIKHEPENPPPYEEAMSVSLKKVSGIKEEIKEPENINAALQETEAPYISIACDLIKETKLSAEPAPDFSDYSEMAKVEQPVPDHSELVEDSSPDSEPVDLFSDDSIPDVPQKQDETVMLVKESLTETSFESMIEYENKEKLSALPPEGGKPYLESFKLSLDNTKDTLLPDEVSTLSKKEKIPLQMEELSTAVYSNDDLFISKEAQIRETETFSDSSPIEIIDEFPTLISSKTDSFSKLAREYTDLEVSHKSEIANAPDGAGSLPCTELPHDLSLKNIQPKVEEKISFSDDFSKNGSATSKVLLLPPDVSALATQAEIESIVKPKVLVKEAEKKLPSDTEKEDRSPSAIFSAELSKTSVVDLLYWRDIKKTGVVFGASLFLLLSLTVFSIVSVTAYIALALLSVTISFRIYKGVIQAIQKSDEGHPFRAYLESEVAISEELVQKYSNSALWSCELHDKGTQAPLLS

SEQ ID NO: 903534 - protein, 1112 aa, Homo sapiens; identical to SEQ ID NO: 903533

SEQ ID NO: 903535 - protein, 1112 aa, Homo sapiens; identical to SEQ ID NO: 903533

SEQ ID NO: 903536 - protein, 1112 aa, Homo sapiens; identical to SEQ ID NO: 903533

SEQ ID NO: 903537 - protein, 1112 aa, Homo sapiens; identical to SEQ ID NO: 903533

SEQ ID NO: 903538 - protein, 1112 aa, Homo sapiens; identical to SEQ ID NO: 903533

SEQ ID NO: 903539 - protein, 1112 aa, Homo sapiens; identical to SEQ ID NO: 903533

SEQ ID NO: 903540 - protein, 1112 aa, Homo sapiens; identical to SEQ ID NO: 903533

SEQ ID NO: 903541 - protein, 1112 aa, Homo sapiens; identical to SEQ ID NO: 903533

SEQ ID NO: 903542 - protein, 1112 aa, Homo sapiens; identical to SEQ ID NO: 903533

SEQ ID NO: 903543 - protein, 1112 aa, Homo sapiens; identical to SEQ ID NO: 903533

SEQ ID NO: 903544 - protein, 1112 aa, Homo sapiens; identical to SEQ ID NO: 903533

SEQ ID NO: 903545 - protein, 1112 aa, Homo sapiens; identical to SEQ ID NO: 903533

SEQ ID NO: 903546 - protein, 1112 aa, Homo sapiens; identical to SEQ ID NO: 903533

SEQ ID NO: 903547 - protein, 1112 aa, Homo sapiens; identical to SEQ ID NO: 903533

SEQ ID NO: 903548 - protein, 1112 aa, Homo sapiens; identical to SEQ ID NO: 903533

SEQ ID NO: 903549 - protein, 197 aa, Homo sapiens
MEDLDQSPLVSSSDSPPRPQPAFKYQFVREPEDEEEEEEEEEEDEDEDLEELEVLERKPAAGLSAAPVPTAPAAGAPLMDFGNDFVPPAPRGPLPAAPPVAPERQPSWDPSPVSSTVPAPSPLSAAAVSPSKLPEDDEPPARPPPPPPASVSPQAEPVWTPPAPAPAAPPSTPAAPKRRGSSGSVVNLLNWTDFATD

SEQ ID NO: 903550 - protein, 119 aa, Homo sapiens; identical to SEQ ID NO: 903529

SEQ ID NO: 903551 - protein, 1112 aa, Homo sapiens; identical to SEQ ID NO: 903533

SEQ ID NO: 903552 - protein, 293 aa, Homo sapiens
MEDLDQSPLVSSSDSPPRPQPAFKYQFVREPEDEEEEEEEEEEDEDEDLEELEVLERKPAAGLSAAPVPTAPAAGAPLMDFGNDFVPPAPRGPLPAAPPVAPERQPSWDPSPVSSTVPAPSPLSAAAVSPSKLPEDDEPPARPPPPPPASVSPQAEPVWTPPAPAPAAPPSTPAAPKRRGSSGSVVVDLLYWRDIKKTGVVFGASLFLLLSLTVFSIVSVTAYIALALLSVTISFRIYKGVIQAIQKSDEGHPFRAYLESEVAISEELVQKYSNSALWSCELHDKGTQAPLLS

SEQ ID NO: 903553 - protein, 360 aa, Homo sapiens
MEDLDQSPLVSSSDSPPRPQPAFKYQFVREPEDEEEEEEEEEEDEDEDLEELEVLERKPAAGLSAAPVPTAPAAGAPLMDFGNDFVPPAPRGPLPAAPPVAPERQPSWDPSPVSSTVPAPSPLSAAAVSPSKLPEDDEPPARPPPPPPASVSPQAEPVWTPPAPAPAAPPSTPAAPKRRGSSGSVDETLFALPAASEPVIRSSAENMDLKEQPGNTISAGQEDFPSVLLETAASLPSLSPLSAASFKEHEYLVVDLLYWRDIKKTGVVFGASLFLLLSLTVFSIVSVTAYIALALLSVTISFRIYKGVIQAIQKSDEGHPFRAYLESEVAISEELVQKYSNSALWSCELHDKGTQAPLLS

SEQ ID NO: 903554 - protein, 1112 aa, Homo sapiens; identical to SEQ ID NO: 903533

SEQ ID NO: 903555 - protein, 1112 aa, Homo sapiens; identical to SEQ ID NO: 903533

SEQ ID NO: 903556 - protein, 1112 aa, Homo sapiens; identical to SEQ ID NO: 903533

SEQ ID NO: 903557 - protein, 293 aa, Homo sapiens; identical to SEQ ID NO: 903552

SEQ ID NO: 903558 - protein, 1112 aa, Homo sapiens; identical to SEQ ID NO: 903533

SEQ ID NO: 903559 - protein, 1112 aa, Homo sapiens; identical to SEQ ID NO: 903533

SEQ ID NO: 903560 - protein, 1112 aa, Homo sapiens; identical to SEQ ID NO: 903533

SEQ ID NO: 903561 - protein, 1112 aa, Homo sapiens; identical to SEQ ID NO: 903533

SEQ ID NO: 903562 - protein, 1112 aa, Homo sapiens; identical to SEQ ID NO: 903533

SEQ ID NO: 903563 - protein, 1112 aa, Homo sapiens; identical to SEQ ID NO: 903533

SEQ ID NO: 903564 - protein, 1112 aa, Homo sapiens; identical to SEQ ID NO: 903533

SEQ ID NO: 903565 - protein, 685 aa, Homo sapiens
MEDLDQSPLVSSSDSPPRPQPAFKYQFVREPEDEEEEEEEEEEDEDEDLEELEVLERKPAAGLSAAPVPTAPAAGAPLMDFGNDFVPPAPRGPLPAAPPVAPERQPSWDPSPVSSTVPAPSPLSAAAVSPSKLPEDDEPPARPPPPPPASVSPQAEPVWTPPAPAPAAPPSTPAAPKRRGSSGSVDETLFALPAASEPVIRSSAENMDLKEQPGNTISAGQEDFPSVLLETAASLPSLSPLSAASFKEHEYLGNLSTVLPTEGTLQENVSEASKEVSEKAKTLLIDRDLTEFSELEYSEMGSSFSVSPKAESAVIVANPREEIIVKNKDEEEKLVSNNILHNQQELPTALTKLVKEDEVVSSEKAKDSFNEKRVAVEAPMREEYADFKPFERVWEVKDSKEDSDMLAAGGKIESNLESKVDKKCFADSLEQTNHEKDSESSNDDTSFPSTPEGIKDRSGAYITCAPFNPAATESIATNIFPLLGDPTSENKTDEKKIEEKKAQIVTEKNTSTKTSNPFLVAAQDSETDYVTTDNLTKVTEEVVANMPEGLTPDLVQEACESELNEVTGTKIAYETKMDLVQTSEVMQESLYPAAQLCPSFEESEATPSPVLPDIVMEAPLNSAVPSAGASVIQPSSSPLEASSLILSQNLWTESNASKNVVCLQISNIVMQEIINYKMKIYTIVV

SEQ ID NO: 903566 - protein, 511 aa, Homo sapiens
MALRAMRGIVNGAAPELPVPTGGPAVGAREQALAVSRNYLSQPRLTYKTVSGVNGPLVILDHVKFPRYAEIVHLTLPDGTKRSGQVLEVSGSKAVVQVFEGTSGIDAKKTSCEFTGDILRTPVSEDMLGRVFNGSGKPIDRGPVVLAEDFLDIMGQPINPQCRIYPEEMIQTGISAIDGMNSIARGQKIPIFSAAGLPHNEIAAQICRQAGLVKKSKDVVDYSEENFAIVFAAMGVNMETARFFKSDFEENGSMDNVCLFLNLANDPTIERIITPRLALTTAEFLAYQCEKHVLVILTDMSSYAEALREVSAAREEVPGRRGFPGYMYTDLATIYERAGRVEGRNGSITQIPILTMPNDDITHPIPDLTGYITEGQIYVDRQLHNRQIYPPINVLPSLSRLMKSAIGEGMTRKDHADVSNQLYACYAIGKDVQAMKAVVGEEALTSDDLLYLEFLQKFERNFIAQGPYENRTVFETLDIGWQLLRIFPKEMLKRIPQSTLSEFYPRDSAKH

SEQ ID NO: 903567 - protein, 525 aa, Homo sapiens
ARRRCWASRDRGDKMALRAMRGIVNGAAPELPVPTGGPAVGAREQALAVSRNYLSQPRLTYKTVSGVNGPLVILDHVKFPRYAEIVHLTLPDGTKRSGQVLEVSGSKAVVQVFEGTSGIDAKKTSCEFTGDILRTPVSEDMLGRVFNGSGKPIDRGPVVLAEDFLDIMGQPINPQCRIYPEEMIQTGISAIDGMNSIARGQKIPIFSAAGLPHNEIAAQICRQAGLVKKSKDVVDYSEENFAIVFAAMGVNMETARFFKSDFEENGSMDNVCLFLNLANDPTIERIITPRLALTTAEFLAYQCEKHVLVILTDMSSYAEALREVSAAREEVPGRRGFPGYMYTDLATIYERAGRVEGRNGSITQIPILTMPNDDITHPIPDLTGYITEGQIYVDRQLHNRQIYPPINVLPSLSRLMKSAIGEGMTRKDHADVSNQLYACYAIGKDVQAMKAVVGEEALTSDDLLYLEFLQKFERNFIAQGPYENRTVFETLDIGWQLLRIFPKEMLKRIPQSTLSEFYPRDSAKH

SEQ ID NO: 903568 - protein, 525 aa, Homo sapiens; identical to SEQ ID NO: 903567

SEQ ID NO: 903569 - protein, 525 aa, Homo sapiens; identical to SEQ ID NO: 903567

SEQ ID NO: 903570 - protein, 223 aa, Homo sapiens
ARRRCWASRDRGDKMALRAMRGIVNGAAPELPVPTGGPAVGAREQALAVSRNYLSQPRLTYKTVSGVNGPLVILDHVKFPRYAEIVHLTLPDGTKRSGQVLEVSGSKAVVQVFEGTSGIDAKKTSCEFTGDILRTPVSEDMLGRVFNGSGKPIDRGPVVLAEDFLDIMGQPINPQCRIYPEEMIQTGISAIDGMNSIARGQKIPIFSAAGLPHNEVRTGIGLL

SEQ ID NO: 903571 - protein, 525 aa, Homo sapiens; identical to SEQ ID NO: 903567

SEQ ID NO: 903572 - protein, 525 aa, Homo sapiens; identical to SEQ ID NO: 903567

SEQ ID NO: 903573 - protein, 385 aa, Homo sapiens
MLGRVFNGSGKPIDRGPVVLAEDFLDIMGQPINPQCRIYPEEMIQTGISAIDGMNSIARGQKIPIFSAAGLPHNEIAAQICRQAGLVKKSKDVVDYSEENFAIVFAAMGVNMETARFFKSDFEENGSMDNVCLFLNLANDPTIERIITPRLALTTAEFLAYQCEKHVLVILTDMSSYAEALREVSAAREEVPGRRGFPGYMYTDLATIYERAGRVEGRNGSITQIPILTMPNDDITHPIPDLTGYITEGQIYVDRQLHNRQIYPPINVLPSLSRLMKSAIGEGMTRKDHADVSNQLYACYAIGKDVQAMKAVVGEEALTSDDLLYLEFLQKFERNFIAQGPYENRTVFETLDIGWQLLRIFPKEMLKRIPQSTLSEFYPRDSAKH

SEQ ID NO: 903574 - protein, 494 aa, Homo sapiens
ARRRCWASRDRGDKMALRAMRGIVNGAAPELPVPTGGPAVGAREQALAVSRNYLSQPRLTYKTVSGVNGPLVILDHVKFPRYAEIVHLTLPDGTKRSGQVLEVSGSKAVVQVFEGTSGIDAKKTSCEFTGDILRTPVSEDMLGRVFNGSGKPIDRGPVVLAEDFLDIMGQPINPQCRIYPEEMIQTGISAIDGMNSIARGQKIPIFSAAGLPHNEIAAQICRQAGLVKKSKDVVDYSEENFAIVFAAMGVNMETARFFKSDFEENGSMDNVCLFLNLANDPTIERIITPRLALTTAEFLAYQCEKHVLVILTDMSSYAEALREVSAAREEVPGRRGFPGYMYTDLATIYERAGRVEGRNGSITQIPILTMPNDDITHPIPDLTGYITEGQIYVDRQLHNRQIYPPINVLPSLSRLMKSAIGEGMTRKDHADVSNQLYACYAIGKDVQAMKAVVGEEALTSDDLLYLEFLQKFERNFIAQGVSLCRPGWSTVVRS

SEQ ID NO: 903575 - protein, 605 aa, Homo sapiens
FERKEEVKQIHGDTVQNQLVVQGVELPSYLPLYPPAMDWIFQCISYHAPEALLTEMMERCKKLGNNALLLNSVMSAFRAEFIATRSMDFIGMIKECDESGFPKHLLFRSLGLNLALADPPESDRLQILNEAWKVITKLKNPQDYINCAEVWVEYTCKHFTKREVNTVLADVIKHMTPDRAFEDSYPQLQLIIKKVIAHFHDFSVLFSVEKFLPFLDMFQKESVRVEVCKCIMDAFIKHQQEPTKDPVILNALLHVCKTMHDSVNALTLEDEKRMLSYLINGFIKMVSFGRDFEQQLSFYVESRSMFCNLEPVLVQLIHSVNRLAMETRKVMKGNHSRKTAAFVRACVAYCFITIPSLAGIFTRLNLYLHSGQVALANQCLSQADAFFKAAISLVPEVPKMINIDGKMRPSESFLLEFLCNFFSTLLIVPDHPEHGVLFLVRELLNVIQDYTWEDNSDEKIRIYTCVLHLLSAMSQETYLYHIDKVDSNDSLYGGDSKFLAENNKLCETVMAQILEHLKTLAKDEALKRQSSLGLSFFNSILAHGDLRNNKLNQLSVNLWHLAQRHGCADTRTMVKTLEYIKKQSKQPDMTHLTELALRLPLQTRT

SEQ ID NO: 903576 - protein, 155 aa, Homo sapiens
MELIPRFYVEASILKCNKFLSKTGISECLPRLTCMIRGIGDPLVSVYARAYLCRALLTEMMERCKKLGNNALLLNSVMSAFRAEFIATRSMDFIGMIKECDESGFPKHLLFRSLGLNLALPYAIAYGKAKNRFLLYLLFRCQGITHCLNLCQMIL

SEQ ID NO: 903577 - protein, 976 aa, Homo sapiens
GRCGAASCPSQTWRPRGAGSGGVRMGSRADGPRTSGHVTGKMAVFPWHSRNRNYKAEFASCRLEAVPLEFGDYHPLKPITVTESKTKKVNRKGSTSSTSSSSSSSVVDPLSSVLDGTDPLSMFAATADPAALAAAMDSSRRKRDRDDNSVVGSDFEPWTNKRGEILARYTTTEKLSINLFMGSEKGKAGTATLAMSEKVRTRLEELDDFEEGSQKELLNLTQQDYVNRIEELNQSLKDAWASDQKVKALKIVIQESSCTSASFPCVWMSRSVLPDHFSPENANDTAKETCLNWFFKIASIRELIPRFYVEASILKCNKFLSKTGISECLPRLTCMIRGIGDPLVSVYARAYLCRVGMEVAPHLKETLNKNFFDFLLTFKQIHGDTVQNQLVVQGVELPSYLPLYPPAMDWIFQCISYHAPEALLTEMMERCKKLGNNALLLNSVMSAFRAEFIATRSMDFIGMIKECDESGFPKHLLFRSLGLNLALADPPESDRLQILNEAWKVITKLKNPQDYINCAEVWVEYTCKHFTKREVNTVLADVIKHMTPDRAFEDSYPQLQLIIKKVIAHFHDFSVLFSVEKFLPFLDMFQKESVRVEVCKCIMDAFIKHQQEPTKDPVILNALLHVCKTMHDSVNALTLEDEKRMLSYLINGFIKMVSFGRDFEQQLSFYVESRSMFCNLEPVLVQLIHSVNRLAMETRKVMKGNHSRKTAAFVRACVAYCFITIPSLAGIFTRLNLYLHSGQVALANQCLSQADAFFKAAISLVPEVPKMINIDGKMRPSESFLLEFLCNFFSTLLIVPDHPEHGVLFLVRELLNVIQDYTWEDNSDEKIRIYTCVLHLLSAMSQETYLYHIDKVDSNDSLYGGDSKFLAENNKLCETVMAQILEHLKTLAKDEALKRQSSLGLSFFNSILAHGDLRNNKLNQLSVNLWHLAQRHGCADTRTMVKTLEYIKKQSKQPDMTHLTELALRLPLQTRT

SEQ ID NO: 903578 - protein, 703 aa, Homo sapiens
IYESSAYLSYGKAKETCLNWFFKIASIRELIPRFYVEASILKCNKFLSKTGISECLPRLTCMIRGIGDPLVSVYARAYLCRVGMEVAPHLKETLNKNFFDFLLTFKQIHGDTVQNQLVVQGVELPSYLPLYPPAMDWIFQCISYHAPEALLTEMMERCKKLGNNALLLNSVMSAFRAEFIATRSMDFIGMIKECDESGFPKHLLFRSLGLNLALADPPESDRLQILNEAWKVITKLKNPQDYINCAEVWVEYTCKHFTKREVNTVLADVIKHMTPDRAFEDSYPQLQLIIKKVIAHFHDFSVLFSVEKFLPFLDMFQKESVRVEVCKCIMDAFIKHQQEPTKDPVILNALLHVCKTMHDSVNALTLEDEKRMLSYLINGFIKMVSFGRDFEQQLSFYVESRSMFCNLEPVLVQLIHSVNRLAMETRKVMKGNHSRKTAAFVRACVAYCFITIPSLAGIFTRLNLYLHSGQVALANQCLSQADAFFKAAISLVPEVPKMINIDGKMRPSESFLLEFLCNFFSTLLIVPDHPEHGVLFLVRELLNVIQDYTWEDNSDEKIRIYTCVLHLLSAMSQETYLYHIDKVDSNDSLYGGDSKFLAENNKLCETVMAQILEHLKTLAKDEALKRQSSLGLSFFNSILAHGDLRNNKLNQLSVNLWHLAQRHGCADTRTMVKTLEYIKKQSKQPDMTHLTELALRLPLQTRT

SEQ ID NO: 903579 - protein, 1011 aa, Homo sapiens
GRCGAASCPSQTWRPRGAGSGGVRMGSRADGPRTSGHVTGKMAVFPWHSRNRNYKAEFASCRLEAVPLEFGDYHPLKPITVTESKTKKVNRKGSTSSTSSSSSSSVVDPLSSVLDGTDPLSMFAATADPAALAAAMDSSRRKRDRDDNSVVGSDFEPWTNKRGEILARYTTTEKLSINLFMGSEKGKAGTATLAMSEKVRTRLEELDDFEEGSQKELLNLTQQDYVNRIEELNQSLKDAWASDQKVKALKIVIQCSKLLSDTSVIQFYPSKFVLITDILDTFGKLVYERIFSMCVDSRSVLPDHFSPENANDTAKETCLNWFFKIASIRELIPRFYVEASILKCNKFLSKTGISECLPRLTCMIRGIGDPLVSVYARAYLCRVGMEVAPHLKETLNKNFFDFLLTFKQIHGDTVQNQLVVQGVELPSYLPLYPPAMDWIFQCISYHAPEALLTEMMERCKKLGNNALLLNSVMSAFRAEFIATRSMDFIGMIKECDESGFPKHLLFRSLGLNLALADPPESDRLQILNEAWKVITKLKNPQDYINCAEVWVEYTCKHFTKREVNTVLADVIKHMTPDRAFEDSYPQLQLIIKKVIAHFHDFSVLFSVEKFLPFLDMFQKESVRVEVCKCIMDAFIKHQQEPTKDPVILNALLHVCKTMHDSVNALTLEDEKRMLSYLINGFIKMVSFGRDFEQQLSFYVESRSMFCNLEPVLVQLIHSVNRLAMETRKVMKGNHSRKTAAFVRACVAYCFITIPSLAGIFTRLNLYLHSGQVALANQCLSQADAFFKAAISLVPEVPKMINIDGKMRPSESFLLEFLCNFFSTLLIVPDHPEHGVLFLVRELLNVIQDYTWEDNSDEKIRIYTCVLHLLSAMSQETYLYHIDKVDSNDSLYGGDSKFLAENNKLCETVMAQILEHLKTLAKDEALKRQSSLGLSFFNSILAHGDLRNNKLNQLSVNLWHLAQRHGCADTRTMVKTLEYIKKQSKQPDMTHLTAEKRLPHPNPERSALLPLT

SEQ ID NO: 903580 - protein, 1028 aa, Homo sapiens
GRCGAASCPSQTWRPRGAGSGGVRMGSRADGPRTSGHVTGKMAVFPWHSRNRNYKAEFASCRLEAVPLEFGDYHPLKPITVTESKTKKVNRKGSTSSTSSSSSSSVVDPLSSVLDGTDPLSMFAATADPAALAAAMDSSRRKRDRDDNSVVGSDFEPWTNKRGEILARYTTTEKLSINLFMGSEKGKAGTATLAMSEKVRTRLEELDDFEEGSQKELLNLTQQDYVNRIEELNQSLKDAWASDQKVKALKIVIQCSKLLSDTSVIQFYPSKFVLITDILDTFGKLVYERIFSMCVDSRSVLPDHFSPENANDTAKETCLNWFFKIASIRELIPRFYVEASILKCNKFLSKTGISECLPRLTCMIRGIGDPLVSVYARAYLCRVGMEVAPHLKETLNKNFFDFLLTFKQIHGDTVQNQLVVQGVELPSYLPLYPPAMDWIFQCISYHAPEALLTEMMERCKKLGNNALLLNSVMSAFRAEFIATRSMDFIGMIKECDESGFPKHLLFRSLGLNLALADPPESDRLQILNEAWKVITKLKNPQDYINCAEVWVEYTCKHFTKREVNTVLADVIKHMTPDRAFEDSYPQLQLIIKKVIAHFHDFSVLFSVEKFLPFLDMFQKESVRVEVCKCIMDAFIKHQQEPTKDPVILNALLHVCKTMHDSVNALTLEDEKRMLSYLINGFIKMVSFGRDFEQQLSFYVESRSMFCNLEPVLVQLIHSVNRLAMETRKVMKGNHSRKTAAFVRACVAYCFITIPSLAGIFTRLNLYLHSGQVALANQCLSQADAFFKAAISLVPEVPKMINIDGKMRPSESFLLEFLCNFFSTLLIVPDHPEHGVLFLVRELLNVIQDYTWEDNSDEKIRIYTCVLHLLSAMSQETYLYHIDKVDSNDSLYGGDSKFLAENNKLCETVMAQILEHLKTLAKDEALKRQSSLGLSFFNSILAHGDLRNNKLNQLSVNLWHLAQRHGCADTRTMSWPSDSLCKQGPDPRAHPQAQGLWCQIQKDLLCCPELLRQFRFLIFLFFLHMYKLF

SEQ ID NO: 903581 - protein, 662 aa, Homo sapiens
MKEKAFRLRASSSLFAAEAKVCMHRPLLETWGGFSIQRYQVGMEVAPHLKETLNKNFFDFLLTFKQIHGDTVQNQLVVQGVELPSYLPLYPPAMDWIFQCISYHAPEALLTEMMERCKKLGNNALLLNSVMSAFRAEFIATRSMDFIGMIKECDESGFPKHLLFRSLGLNLALADPPESDRLQILNEAWKVITKLKNPQDYINCAEVWVEYTCKHFTKREVNTVLADVIKHMTPDRAFEDSYPQLQLIIKKVIAHFHDFSVLFSVEKFLPFLDMFQKESVRVEVCKCIMDAFIKHQQEPTKDPVILNALLHVCKTMHDSVNALTLEDEKRMLSYLINGFIKMVSFGRDFEQQLSFYVESRSMFCNLEPVLVQLIHSVNRLAMETRKVMKGNHSRKTAAFVRACVAYCFITIPSLAGIFTRLNLYLHSGQVALANQCLSQADAFFKAAISLVPEVPKMINIDGKMRPSESFLLEFLCNFFSTLLIVPDHPEHGVLFLVRELLNVIQDYTWEDNSDEKIRIYTCVLHLLSAMSQETYLYHIDKVDSNDSLYGGDSKFLAENNKLCETVMAQILEHLKTLAKDEALKRQSSLGLSFFNSILAHGDLRNNKLNQLSVNLWHLAQRHGCADTRTMVKTLEYIKKQSKQPDMTHLTELALRLPLQTRT

SEQ ID NO: 903582 - protein, 667 aa, Homo sapiens
MHDQRDRRPTSVGVCPCLPVPAEAKVCMHRPLLETWGGFSIQRYQVGMEVAPHLKETLNKNFFDFLLTFKQIHGDTVQNQLVVQGVELPSYLPLYPPAMDWIFQCISYHAPEALLTEMMERCKKLGNNALLLNSVMSAFRAEFIATRSMDFIGMIKECDESGFPKHLLFRSLGLNLALADPPESDRLQILNEAWKVITKLKNPQDYINCAEVWVEYTCKHFTKREVNTVLADVIKHMTPDRAFEDSYPQLQLIIKKVIAHFHDFSVLFSVEKFLPFLDMFQKESVRVEVCKCIMDAFIKHQQEPTKDPVILNALLHVCKTMHDSVNALTLEDEKRMLSYLINGFIKMVSFGRDFEQQLSFYVESRSMFCNLEPVLVQLIHSVNRLAMETRKVMKGNHSRKTAAFVRACVAYCFITIPSLAGIFTRLNLYLHSGQVALANQCLSQADAFFKAAISLVPEVPKMINIDGKMRPSESFLLEFLCNFFSTLLIVPDHPEHGVLFLVRELLNVIQDYTWEDNSDEKIRIYTCVLHLLSAMSQETYLYHIDKVDSNDSLYGGDSKFLAENNKLCETVMAQILEHLKTLAKDEALKRQSSLGLSFFNSILAHGDLRNNKLNQLSVNLWHLAQRHGCADTRTMVKTLEYIKKQSKQPDMTHLTELALRLPLQTRT

SEQ ID NO: 903583 - protein, 452 aa, Homo sapiens
WFLFPAQKREVNTVLADVIKHMTPDRAFEDSYPQLQLIIKKVIAHFHDFSVLFSVEKFLPFLDMFQKESVRVEVCKCIMDAFIKHQQEPTKDPVILNALLHVCKTMHDSVNALTLEDEKRMLSYLINGFIKMVSFGRDFEQQLSFYVESRSMFCNLEPVLVQLIHSVNRLAMETRKVMKGNHSRKTAAFVRACVAYCFITIPSLAGIFTRLNLYLHSGQVALANQCLSQADAFFKAAISLVPEVPKMINIDGKMRPSESFLLEFLCNFFSTLLIVPDHPEHGVLFLVRELLNVIQDYTWEDNSDEKIRIYTCVLHLLSAMSQETYLYHIDKVDSNDSLYGGDSKFLAENNKLCETVMAQILEHLKTLAKDEALKRQSSLGLSFFNSILAHGDLRNNKLNQLSVNLWHLAQRHGCADTRTMVKTLEYIKKQSKQPDMTHLTELALRLPLQTRT

SEQ ID NO: 903584 - protein, 304 aa, Homo sapiens
SHYLSPHAYTTHTKKLYSVNRLAMETRKVMKGNHSRKTAAFVRACVAYCFITIPSLAGIFTRLNLYLHSGQVALANQCLSQADAFFKAAISLVPEVPKMINIDGKMRPSESFLLEFLCNFFSTLLIVPDHPEHGVLFLVRELLNVIQDYTWEDNSDEKIRIYTCVLHLLSAMSQETYLYHIDKVDSNDSLYGGDSKFLAENNKLCETVMAQILEHLKTLAKDEALKRQSSLGLSFFNSILAHGDLRNNKLNQLSVNLWHLAQRHGCADTRTMVKTLEYIKKQSKQPDMTHLTELALRLPLQTRT

SEQ ID NO: 903585 - protein, 518 aa, Homo sapiens
GRCGAASCPSQTWRPRGAGSGGVRMGSRADGPRTSGHVTGKMAVFPWHSRNRNYKAEFASCRLEAVPLEFGDYHPLKPITVTESKTKKVNRKGSTSSTSSSSSSSVVDPLSSVLDGTDPLSMFAATADPAALAAAMDSSRRKRDRDDNSVVGSDFEPWTNKRGEILARYTTTEKLSINLFMGSEKGKAGTATLAMSEKVRTRLEELDDFEEGSQKELLNLTQQDYVNRIEELNQSLKDAWASDQKVKALKIVIQCSKLLSDTSVIQFYPSKFVLITDILDTFGKLVYERIFSMCVDSRSVLPDHFSPENANDTAKETCLNWFFKIASIRELIPRFYVEASILKCNKFLSKTGISECLPRLTCMIRGIGDPLVSVYARAYLCRVGMEVAPHLKETLNKNFFDFLLTFKQIHGDTVQNQLVVQGVELPSYLPLYPPAMDWIFQCISYHAPEALLTEMMERCKKLGNNALLLNSVMSAFRAEFIATRSMDFIGMIKECDESGFPKHLLVRALELKEGLSDI

SEQ ID NO: 903586 - protein, 512 aa, Homo sapiens
GRCGAASCPSQTWRPRGAGSGGVRMGSRADGPRTSGHVTGKMAVFPWHSRNRNYKAEFASCRLEAVPLEFGDYHPLKPITVTESKTKKVNRKGSTSSTSSSSSSSVVDPLSSVLDGTDPLSMFAATADPAALAAAMDSSRRKRDRDDNSVVGSDFEPWTNKRGEILARYTTTEKLSINLFMGSEKGKAGTATLAMSEKVRTRLEELDDFEEGSQKELLNLTQQDYVNRIEELNQSLKDAWASDQKVKALKIVIQCSKLLSDTSVIQFYPSKFVLITDILDTFGKLVYERIFSMCVDSRSVLPDHFSPENANDTAKETCLNWFFKIASIRELIPRFYVEASILKCNKFLSKTGISECLPRLTCMIRGIGDPLVSVYARAYLCRALLTEMMERCKKLGNNALLLNSVMSAFRAEFIATRSMDFIGMIKECDESGFPKHLLFRSLGLNLALADPPESDRLQILNEAWKVITKLKNPQDYIHWCPKCGWEFTLEHFTNEKGIRWGMVQPDPNPVGN

SEQ ID NO: 903587 - protein, 417 aa, Homo sapiens
GRCGAASCPSQTWRPRGAGSGGVRMGSRADGPRTSGHVTGKMAVFPWHSRNRNYKAEFASCRLEAVPLEFGDYHPLKPITVTESKTKKVNRKGSTSSTSSSSSSSVVDPLSSVLDGTDPLSMFAATADPAALAAAMDSSRRKRDRDDNSVVGSDFEPWTNKRGEILARYTTTEKLSINLFMGSEKGKAGTATLAMSEKVRTRLEELDDFEEGSQKELLNLTQQDYVNRIEELNQSLKDAWASDQKVKALKIVIQCSKLLSDTSVIQFYPSKFVLITDILDTFGKLVYERIFSMCVDSRSVLPDHFSPENANDTAKETCLNWFFKIASIRELIPRFYVEASILKCNKFLSKTGISECLPRLTCMIRGIGDPLVSVFMGIRSRTSWWSKEWSSHLTSPCTRLPWTGSSSASPTMPPRLC

SEQ ID NO: 903588 - protein, 362 aa, Homo sapiens
GRCGAASCPSQTWRPRGAGSGGVRMGSRADGPRTSGHVTGKMAVFPWHSRNRNYKAEFASCRLEAVPLEFGDYHPLKPITVTESKTKKVNRKGSTSSTSSSSSSSVVDPLSSVLDGTDPLSMFAATADPAALAAAMDSSRRKRDRDDNSVVGSDFEPWTNKRGEILARYTTTEKLSINLFMGSEKGKAGTATLAMSEKVRTRLEELDDFEEGSQKELLNLTQQDYVNRIEELNQSLKDAWASDQKVKALKIVIQCSKLLSDTSVIQFYPSKFVLITDILDTFGKLVYERIFSMCVDSRSVLPGNVAAVPGVSFCPGVRTRRLLLSQDSLKLDKGFNFGCVKVKETPLKISDHLSLLKTLEGF

SEQ ID NO: 903589 - protein, 1004 aa, Homo sapiens
GRCGAASCPSQTWRPRGAGSGGVRMGSRADGPRTSGHVTGKMAVFPWHSRNRNYKAEFASCRLEAVPLEFGDYHPLKPITVTESKTKKVNRKGSTSSTSSSSSSSVVDPLSSVLDGTDPLSMFAATADPAALAAAMDSSRRKRDRDDNSVVGSDFEPWTNKRGEILARYTTTEKLSINLFMGSEKGKAGTATLAMSEKVRTRLEELDDFEEGSQKELLNLTQQDYVNRIEELNQSLKDAWASDQKVKALKIVIQCSKLLSDTSVIQFYPSKFVLITDILDTFGKLVYERIFSMCVDSRSVLPDHFSPENANDTAKETCLNWFFKIASIRELIPRFYVEASILKCNKFLSKTGISECLPRLTCMIRGIGDPLVSVYARAYLCRVGMEVAPHLKETLNKNFFDFLLTFKQIHGDTVQNQLVVQGVELPSYLPLYPPAMDWIFQCISYHAPEALLTEMMERCKKLGNNALLLNSVMSAFRAEFIATRSMDFIGMIKECDESGFPKHLLFRSLGLNLALADPPESDRLQILNEAWKVITKLKNPQDYINCAEVWVEYTCKHFTKREVNTVLADVIKHMTPDRAFEDSYPQLQLIIKKVIAHFHDFSVLFSVEKFLPFLDMFQKESVRVEVCKCIMDAFIKHQQEPTKDPVILNALLHVCKTMHDSVNALTLEDEKRMLSYLINGFIKMVSFGRDFEQQLSFYVESRSMFCNLEPVLVQLIHSVNRLAMETRKVMKGNHSRKTAAFVRACVAYCFITIPSLAGIFTRLNLYLHSGQVALANQCLSQADAFFKAAISLVPEVPKMINIDGKMRPSESFLLEFLCNFFSTLLIVPDHPEHGVLFLVRELLNVIQDYTWEDNSDEKIRIYTCVLHLLSAMSQETYLYHIDKVDSNDSLYGGDSKFLAENNKLCETVMAQILEHLKTLAKDEALKRQSSLGLSFFNSILAHGDLRNNKLNQLSVNLWHLAQRHGCADTRTMVKTLEYIKKQSKQPDMTHLTELALRLPLQTRT

SEQ ID NO: 903590 - protein, 1004 aa, Homo sapiens; identical to SEQ ID NO: 903589

SEQ ID NO: 903591 - protein, 1004 aa, Homo sapiens; identical to SEQ ID NO: 903589

SEQ ID NO: 903592 - protein, 937 aa, Homo sapiens
GRCGAASCPSQTWRPRGAGSGGVRMGSRADGPRTSGHVTGKMAVFPWHSRNRNYKAEFASCRLEAVPLEFGDYHPLKPITVTESKTKKVNRKGSTSSTSSSSSSSVVDPLSSVLDGTDPLSMFAATADPAALAAAMDSSRRKRDRDDNSVVGSDFEPWTNKRGEILARYTTTEKLSINLFMGSEKGKAGTATLAMSEKVRTRLEELDDFEEGSQKELLNLTQQDYVNRIEELNQSLKDAWASDQKVKALKIVIQCSKLLSDTSVIQFYPSKFVLITDILDTFGKLVYERIFSMCVDSRSVLPDHFSPENANDTAKETCLNWFFKIASIRELIPRFYVEASILKCNKFLSKTGISECLPRLTCMIRGIGDPLVSVYARAYLCRALLTEMMERCKKLGNNALLLNSVMSAFRAEFIATRSMDFIGMIKECDESGFPKHLLFRSLGLNLALADPPESDRLQILNEAWKVITKLKNPQDYINCAEVWVEYTCKHFTKREVNTVLADVIKHMTPDRAFEDSYPQLQLIIKKVIAHFHDFSVLFSVEKFLPFLDMFQKESVRVEVCKCIMDAFIKHQQEPTKDPVILNALLHVCKTMHDSVNALTLEDEKRMLSYLINGFIKMVSFGRDFEQQLSFYVESRSMFCNLEPVLVQLIHSVNRLAMETRKVMKGNHSRKTAAFVRACVAYCFITIPSLAGIFTRLNLYLHSGQVALANQCLSQADAFFKAAISLVPEVPKMINIDGKMRPSESFLLEFLCNFFSTLLIVPDHPEHGVLFLVRELLNVIQDYTWEDNSDEKIRIYTCVLHLLSAMSQETYLYHIDKVDSNDSLYGGDSKFLAENNKLCETVMAQILEHLKTLAKDEALKRQSSLGLSFFNSILAHGDLRNNKLNQLSVNLWHLAQRHGCADTRTMVKTLEYIKKQSKQPDMTHLTELALRLPLQTRT

SEQ ID NO: 903593 - protein, 958 aa, Homo sapiens
GRCGAASCPSQTWRPRGAGSGGVRMGSRADGPRTSGHVTGKMAVFPWHSRNRNYKAEFASCRLEAVPLEFGDYHPLKPITVTESKTKKVNRKGSTSSTSSSSSSSVVDPLSSVLDGTDPLSMFAATADPAALAAAMDSSRRKRDRDDNSVVGSDFEPWTNKRGEILARYTTTEKLSINLFMGSEKGKAGTATLAMSEKVRTRLEELDDFEEGSQKELLNLTQQDYVNRIEELNQSLKDAWASDQKVKALKIVIQCSKLLSDTSVIQFYPSKFVLITDILDTFGKLVYERIFSMCVDSRSVLPDHFSPENANDTAKETCLNWFFKIASIRELIPRFYVEASILKCNKFLSKTGISECLPRLTCMIRGIGDPLVSVYARAYLCRVGMEVAPHLKETLNKNFFDFLLTFKQIHGDTVQNQLVVQGVELPSYLPLYPPAMDWIFQCISYHAPEALLTEMMERCKKLGNNALLLNSVMSAFRAEFIATRSMDFIGMIKECDESGFPKHLLFRSLGLNLALADPPESDRLQILNEAWKVITKLKNPQDYINCAEVWVEYTCKHFTKREVNTVLADVIKHMTPDRAFEDSYPQLQLIIKKVIAHFHDFSVLFSVEKFLPFLDMFQKESVRVEVCKCIMDAFIKHQQEPTKDPVILNALLHVCKTMHDSVNALTLEDEKRMLSYLINGFIKMVSFGRDFEQQLSFYVESRSMFCNLEPVLVQLIHSVNRLAMETRKVMKGNHSRKTAAFVRACVAYCFITIPSLAGIFTRLNLYLHSGQVALANQCLSQADAFFKAAISLVPEVPKMINIDGKMRPSESFLLEFLCNFFSTLLIVPDHPEHGVLFLVRELLNVIQDYTWEDNSDEKIRIYTCVLHLLSAMSQETYLYHIDKVDSNDSLYGGDSKFLAENNKLCETVMAQILEHLKTLAKDEVGALCCPPPAPCSESTSFQGGSTLVHSRKETMSCE

SEQ ID NO: 903594 - protein, 756 aa, Homo sapiens
MLEAVAKNVGRRARVPGLNSNSYICLLCALDHFSPENANDTAKETCLNWFFKIASIRELIPRFYVEASILKCNKFLSKTGISECLPRLTCMIRGIGDPLVSVYARAYLCRQRPKCVCIAHCLKPGEGFSIQRYQVGMEVAPHLKETLNKNFFDFLLTFKQIHGDTVQNQLVVQGVELPSYLPLYPPAMDWIFQCISYHAPEALLTEMMERCKKLGNNALLLNSVMSAFRAEFIATRSMDFIGMIKECDESGFPKHLLFRSLGLNLALADPPESDRLQILNEAWKVITKLKNPQDYINCAEVWVEYTCKHFTKREVNTVLADVIKHMTPDRAFEDSYPQLQLIIKKVIAHFHDFSVLFSVEKFLPFLDMFQKESVRVEVCKCIMDAFIKHQQEPTKDPVILNALLHVCKTMHDSVNALTLEDEKRMLSYLINGFIKMVSFGRDFEQQLSFYVESRSMFCNLEPVLVQLIHSVNRLAMETRKVMKGNHSRKTAAFVRACVAYCFITIPSLAGIFTRLNLYLHSGQVALANQCLSQADAFFKAAISLVPEVPKMINIDGKMRPSESFLLEFLCNFFSTLLIVPDHPEHGVLFLVRELLNVIQDYTWEDNSDEKIRIYTCVLHLLSAMSQETYLYHIDKVDSNDSLYGGDSKFLAENNKLCETVMAQILEHLKTLAKDEALKRQSSLGLSFFNSILAHGDLRNNKLNQLSVNLWHLAQRHGCADTRTMVKTLEYIKKQSKQPDMTHLTELALRLPLQTRT

SEQ ID NO: 903595 - protein, 492 aa, Homo sapiens
GRCGAASCPSQTWRPRGAGSGGVRMGSRADGPRTSGHVTGKMAVFPWHSRNRNYKAEFASCRLEAVPLEFGDYHPLKPITVTESKTKKVNRKGSTSSTSSSSSSSVVDPLSSVLDGTDPLSMFAATADPAALAAAMDSSRRKRDRDDNSVVGSDFEPWTNKRGEILARYTTTEKLSINLFMGSEKGKAGTATLAMSEKVRTRLEELDDFEEGSQKELLNLTQQDYVNRIEELNQSLKDAWASDQKVKALKIVIQCSKLLSDTSVIQFYPSKFVLITDILDTFGKLVYERIFSMCVDSRSVLPDHFSPENANDTAKETCLNWFFKIASIRELIPRFYVEASILKCNKFLSKTGISECLPRLTCMIRGIGDPLVSVYARAYLCRVGMEVAPHLKETLNKNFFDFLLTFKQIHGDTVQNQLVVQGVELPSYLPLYPPAMDWIFQCISYHAPEALLTEMMERYEPGDVPLPHRQSGLQRQPLRGRLQVPGRKQQAV

SEQ ID NO: 903596 - protein, 548 aa, Homo sapiens
GRCGAASCPSQTWRPRGAGSGGVRMGSRADGPRTSGHVTGKMAVFPWHSRNRNYKAEFASCRLEAVPLEFGDYHPLKPITVTESKTKKVNRKGSTSSTSSSSSSSVVDPLSSVLDGTDPLSMFAATADPAALAAAMDSSRRKRDRDDNSVVGSDFEPWTNKRGEILARYTTTEKLSINLFMGSEKGKAGTATLAMSEKVRTRLEELDDFEEGSQKELLNLTQQDYVNRIEELNQSLKDAWASDQKVKALKIVIQCSKLLSDTSVIQFYPSKFVLITDILDTFGKLVYERIFSMCVDSRSVLPDHFSPENANDTAKETCLNWFFKIASIRELIPRFYVEASILKCNKFLSKTGISECLPRLTCMIRGIGDPLVSVYARAYLCRVGMEVAPHLKETLNKNFFDFLLTFKQIHGDTVQNQLVVQGVELPSYLPLYPPAMDWIFQCISYHAPEALLTEMMERCKKLGNNALLLNSVMSAFRAEFIATRSMDFIGMIKECDESGFPKHLLFRSLGLNLALPYAIAYGKAIGQKMNHVRNRKSYLWIVARDPLE

SEQ ID NO: 903597 - protein, 473 aa, Homo sapiens
GRCGAASCPSQTWRPRGAGSGGVRMGSRADGPRTSGHVTGKMAVFPWHSRNRNYKAEFASCRLEAVPLEFGDYHPLKPITVTESKTKKVNRKGSTSSTSSSSSSSVVDPLSSVLDGTDPLSMFAATADPAALAAAMDSSRRKRDRDDNSVVGSDFEPWTNKRGEILARYTTTEKLSINLFMGSEKGKAGTATLAMSEKVRTRLEELDDFEEGSQKELLNLTQQDYVNRIEELNQSLKDAWASDQKVKALKIVIQCSKLLSDTSVIQFYPSKFVLITDILDTFGKLVYERIFSMCVDSRSVLPDHFSPENANDTAKETCLNWFFKIASIRELIPRFYVEASILKCNKFLSKTGISECLPRLTCMIRGIGDPLVSVYARAYLCRVGMEVAPHLKETLNKNFFDFLLTFKQIHGDTVQNQLVVQGVELPSYLPLYPPAMDWIFQCISYHAPEALLTEMMERCKKLGNNALLLNSTM

SEQ ID NO: 903598 - protein, 122 aa, Homo sapiens
MAELALELRHDLPQSQHCPQHLCGARPEPQCKAVNLPFLFQALKRQSSLGLSFFNSILAHGDLRNNKLNQLSVNLWHLAQRHGCADTRTMVKTLEYIKKQSKQPDMTHLTELALRLPLQTRT

SEQ ID NO: 903599 - protein, 111 aa, Homo sapiens
MADSLEPWAPRIMNQKGDGSFFFLIGENARIHQEAKQTTRHDSSDGAGPQTPSANKDLTPGPIPRLRDSGAKSRKICSAALNSYGNLGFSFFFSFYICTNCFKLWPLSRLF

SEQ ID NO: 903600 - protein, 196 aa, Homo sapiens
GRCGAASCPSQTWRPRGAGSGGVRMGSRADGPRTSGHVTGKMAVFPWHSRNRNYKAEFASCRLEAVPLEFGDYHPLKPITVTESKTKKVNRKGSTSSTSSSSSSSVVDPLSSVLDGTDPLSMFAATADPAALAAAMDSSRRKRDRDDNSVVGSDFEPWTNKRGEILARYTTTEKLSICWDYRCEPLQPSLRSCFCG

SEQ ID NO: 903601 - protein, 77 aa, Homo sapiens
AAAYYYYYCSNSSFKRCTGHENTLILSWRFCICFSSFTPIFLPTAANDNVSVQVCPPAHPRMPLTFFSSCYLDHAVQ

SEQ ID NO: 903602 - protein, 532 aa, Homo sapiens
MWFLQMAQLSTTISQAQRATAFHFFTSKRFLPAPLLVPLGVIHIHRCGLTKRPDARRRRVAGAQGREPAISLPGDRAAGARATRTRGPGPAPKMPAIAVLAAAAAAWCFLQVESRHLDALAGGAGPNHGNFLDNDQWLSTVSQYDRDKYWNRFRDDDYFRNWNPNKPFDQALDPSKDPCLKVKCSPHKVCVTQDYQTALCVSRKHLLPRQKKGNVAQKHWVGPSNLVKCKPCPVAQSAMVCGSDGHSYTSKCKLEFHACSTGKSLATLCDGPCPCLPEPEPPKHKAERSACTDKELRNLASRLKDWFGALHEDANRVIKPTSSNTAQGRFDTSILPICKDSLGWMFNKLDMNYDLLLDPSEINAIYLDKYEPCIKPLFNSCDSFKDGKLSNNEWCYCFQKPGGLPCQNEMNRIQKLSKGKSLLGAFIPRCNEEGYYKATQCHGSTGQCWCVDKYGNELAGSRKQGAVSCEEEQETSGDFGSGGSVVLLDDLEYERELGPKDKEGKLRVHTRAVTEDDEDEDDDKEDEVGYIW

SEQ ID NO: 903603 - protein, 405 aa, Homo sapiens
SGLVRHHQSQSALAAHRCHQNLLSLHHQDDYFRNWNPNKPFDQALDPSKDPCLKVKCSPHKVCVTQDYQTALCVSRKHLLPRQKKGNVAQKHWVGPSNLVKCKPCPVAQSAMVCGSDGHSYTSKCKLEFHACSTGKSLATLCDGPCPCLPEPEPPKHKAERSACTDKELRNLASRLKDWFGALHEDANRVIKPTSSNTAQGRFDTSILPICKDSLGWMFNKLDMNYDLLLDPSEINAIYLDKYEPCIKPLFNSCDSFKDGKLSNNEWCYCFQKPGGLPCQNEMNRIQKLSKGKSLLGAFIPRCNEEGYYKATQCHGSTGQCWCVDKYGNELAGSRKQGAVSCEEEQETSGDFGSGGSVVLLDDLEYERELGPKDKEGKLRVHTRAVTEDDEDEDDDKEDEVGYIW

SEQ ID NO: 903604 - protein, 532 aa, Homo sapiens; identical to SEQ ID NO: 903602

SEQ ID NO: 903605 - protein, 303 aa, Homo sapiens
FLLLPLTKTLHQQKGHDFLKAQCKLEFHACSTGKSLATLCDGPCPCLPEPEPPKHKAERSACTDKELRNLASRLKDWFGALHEDANRVIKPTSSNTAQGRFDTSILPICKDSLGWMFNKLDMNYDLLLDPSEINAIYLDKYEPCIKPLFNSCDSFKDGKLSNNEWCYCFQKPGGLPCQNEMNRIQKLSKGKSLLGAFIPRCNEEGYYKATQCHGSTGQCWCVDKYGNELAGSRKQGAVSCEEEQETSGDFGSGGSVVLLDDLEYERELGPKDKEGKLRVHTRAVTEDDEDEDDDKEDEVGYIW

SEQ ID NO: 903606 - protein, 464 aa, Homo sapiens
METEQPEETFPNTETNGEFGKRPAEDMEEEQAFKRSRNTDEMVELRILLQSKNAGAVIGKGGKNIKALRTDYNASVSVPDSSGPERILSISADIETIGEILKKIIPTLEEGLQLPSPTATSQLPLESDAVECLNYQHYKGSDFDCELRLLIHQSLAGGIIGVKGAKIKELRENTQTTIKLFQECCPHSTDRVVLIGGKPDRVVECIKIILDLISESPIKGRAQPYDPNFYDETYDYGGFTMMFDDRRGRPVGFPMRGRGGFDRMPPGRGGRPMPPSRRDYDDMSPRRGPPPPPPGRGGRGGSRARNLPLPPPPPPRGGDLMAYDRRGRPGDRYDGMVGFSADETWDSAIDTWSPSEWQMAYEPQGGSGYDYSYAGGRGSYGDLGGPIITTQVTIPKDLAGSIIGKGGQRIKQIRHESGASIKIDEPLEGSEDRIITITGTQDQIQNAQYLLQNSVKQYADVEGF

SEQ ID NO: 903607 - protein, 464 aa, Homo sapiens; identical to SEQ ID NO: 903606

SEQ ID NO: 903608 - protein, 464 aa, Homo sapiens; identical to SEQ ID NO: 903606

SEQ ID NO: 903609 - protein, 464 aa, Homo sapiens; identical to SEQ ID NO: 903606

SEQ ID NO: 903610 - protein, 464 aa, Homo sapiens; identical to SEQ ID NO: 903606

SEQ ID NO: 903611 - protein, 401 aa, Homo sapiens
METEQPEETFPNTETNGEFGKRPAEDMEEEQAFKRSRNTDEMVELRILLQSKNAGAVIGKGGKNIKALRTDYNASVSVPDSSGPERILSISADIETIGEILKKIIPTLEEGLQLPSPTATSQLPLESDAVECLNYQHYKGSDFDCELRLLIHQSLAGGIIGVKGAKIKELRENTQTTIKLFQECCPHSTDRVVLIGGKPDRVVECIKIILDLISESPIKGRAQPYDPNFYDETYDYGGFTMMFDDRRGRPVGFPMRGRGGFDRMPPGRGGRPMPPSRRDYDDMSPRRGPPPPPPGRGGRGGSRARNLPLPPPPPPRGGDLMAYDRRGRPGDRYDGMVGFSADETWDSAIDTWSPSEWQMAYEPQGGSGYDYSYAGGRGSYGDLGGPIITTQVTIPKDCKYL

SEQ ID NO: 903612 - protein, 463 aa, Homo sapiens
METEQPEETFPNTETNGEFGKRPAEDMEEEQAFKRSRNTDEMVELRILLQSKNAGAVIGKGGKNIKALRTDYNASVSVPDSSGPERILSISADIETIGEILKKIIPTLEEGLQLPSPTATSQLPLESDAVECLNYQHYKGSDFDCELRLLIHQSLAGGIIGVKGAKIKELRENTQTTIKLFQECCPHSTDRVVLIGGKPDRVVECIKIILDLISESPIKGRAQPYDPNFYDETYDYGGFTMMFDDRRGRPVGFPMRGRGGFDRMPPGRGGRPMPPSRRDYDDMSPRRGPPPPPPGRGGRGGSRARNLPLPPPPPPRGGDLMAYDRRGRPGDRYDGMVGFSADETWDSAIDTWSPSEWQMAYEPQGGSGYDYSYAGGRGSYGDLGGPIITTQVTIPKDLAGSIIGKGGQRIKQIRHESGASIKIDEPLEGSEDRIITITGTQDQIQNAQYLLQNSVKQYSGKFF

SEQ ID NO: 903613 - protein, 456 aa, Homo sapiens
METEQPEETFPNTETNGEFGKRPAEDMEEEQAFKRSRNTDEMVELRILLQSKNAGAVIGKGGKNIKALRTDYNASVSVPDSSGPERILSISADIETIGEILKKIIPTLEEGLQLPSPTATSQLPLESDAVECLNYQHYKGSDFDCELRLLIHQSLAGGIIGVKGAKIKELRENTQTTIKLFQECCPHSTDRVVLIGGKPDRVVECIKIILDLISESPIKGRAQPYDPNFYDETYDYGGFTMMFDDRRGRPVGFPMRGRGGFDRMPPGRGGRPMPPSRRDYDDMSPRRGPPPPPPGRGGRGGSRARNLPLPPPPPPRGGDLMAYDRRGRPGDRYDGMVGFSADETWDSAIDTWSPSEWQMAYEPQGGSGYDYSYAGGRGSYGDLGGPIITTQVTIPKDLAGSIIGKGGHESGASIKIDEPLEGSEDRIITITGTQDQIQNAQYLLQNSVKQYSGKFF

SEQ ID NO: 903614 - protein, 410 aa, Homo sapiens
METEQPEETFPNTETNGEFGKRPAEDMEEEQAFKRSRNTDEMVELRILLQSKNAGAVIGKGGKNIKALRTDYNASVSVPDSSGPERILSISADIETIGEILKKIIPTLEEGLQLPSPTATSQLPLESDAVECLNYQHYKGSDFDCELRLLIHQSLAGGIIGVKGAKIKELRENTQTTIKLFQECCPHSTDRVVLIGGKPDRVVECIKIILDLISESPIKGRAQPYDPNFYDETYDYGGFTMMFDDRRGRPVGFPLPPPPPPRGGDLMAYDRRGRPGDRYDGMVGFSADETWDSAIDTWSPSEWQMAYEPQGGSGYDYSYAGGRGSYGDLGGPIITTQVTIPKDLAGSIIGKGGQRIKQIRHESGASIKIDEPLEGSEDRIITITGTQDQIQNAQYLLQNSVKQYADVEGF

SEQ ID NO: 903615 - protein, 409 aa, Homo sapiens
METEQPEETFPNTETNGEFGKRPAEDMEEEQAFKRSRNTDEMVELRILLQSKNAGAVIGKGGKNIKALRTDYNASVSVPDSSGPERILSISADIETIGEILKKIIPTLEEGLQLPSPTATSQLPLESDAVECLNYQHYKGSDFDCELRLLIHQSLAGGIIGVKGAKIKELRENTQTTIKLFQECCPHSTDRVVLIGGKPDRVVECIKIILDLISESPIKGRAQPYDPNFYDETYDYGGFTMMFDDRRGRPVGFPLPPPPPPRGGDLMAYDRRGRPGDRYDGMVGFSADETWDSAIDTWSPSEWQMAYEPQGGSGYDYSYAGGRGSYGDLGGPIITTQVTIPKDLAGSIIGKGGQRIKQIRHESGASIKIDEPLEGSEDRIITITGTQDQIQNAQYLLQNSVKQYSGKFF

SEQ ID NO: 903616 - protein, 464 aa, Homo sapiens; identical to SEQ ID NO: 903606

SEQ ID NO: 903617 - protein, 464 aa, Homo sapiens; identical to SEQ ID NO: 903606

SEQ ID NO: 903618 - protein, 464 aa, Homo sapiens; identical to SEQ ID NO: 903606

SEQ ID NO: 903619 - protein, 464 aa, Homo sapiens; identical to SEQ ID NO: 903606

SEQ ID NO: 903620 - protein, 463 aa, Homo sapiens; identical to SEQ ID NO: 903612

SEQ ID NO: 903621 - protein, 401 aa, Homo sapiens; identical to SEQ ID NO: 903611

SEQ ID NO: 903622 - protein, 401 aa, Homo sapiens
METEQPEETFPNTETNGEFGKRPAEDMEEEQAFKRSRNTDEMVELRILLQSKNAGAVIGKGGKNIKALRTDYNASVSVPDSSGPERILSISADIETIGEILKKIIPTLEEGLQLPSPTATSQLPLESDAVECLNYQHYKGSDFDCELRLLIHQSLAGGIIGVKGAKIKELRENTQTTIKLFQECCPHSTDRVVLIGGKPDRVVECIKIILDLISESPIKGRAQPYDPNFYDETYDYGGFTMMFDDRRGRPVGFPMRGRGGFDRMPPGRGGRPMPPSRRDYDDMSPRRGPPPPPPGRGGRGGSRARNLPLPPPPPPRGGDLMAYDRRGRPGDRYDGMVGFSADETWDSAIDTWSPSEWQMAYEPQGGSGYDYSYAGGRGSYGDLGGPIITTQVTIPKDIWLI

SEQ ID NO: 903623 - protein, 341 aa, Homo sapiens
METEQPEETFPNTETNGEFGKRPAEDMEEEQAFKRSRNTDEMVELRILLQSKNAGAVIGKGGKNIKALRTDYNASVSVPDSSGPERILSISADIETIGEILKKIIPTLEEGLQLPSPTATSQLPLESDAVECLNYQHYKGSDFDCELRLLIHQSLAGGIIGVKGAKIKELRENTQTTIKLFQECCPHSTDRVVLIGGKPDRVVECIKIILDLISESPSKGSCNDYDPINDESYAYAWLHTDCLRTVREPEGITTGEKTEIRDEETEQESQAKTQSDAQTNAHERTPPTQTKTGEHNEDQANDKRTPAPTQTNKKKRQPNDQHREQRTQTYNEKRQKTREEN

SEQ ID NO: 903624 - protein, 178 aa, Homo sapiens
METEQPEETFPNTETNGEFGKRPAEDMEEEQAFKRSRNTDEMVELRILLQSKNAGAVIGKGGKNIKALRTDYNASVSVPDSSGPERILSISADIETIGEILKKIIPTLEEGLQLPSPTATSQLPLESDAVECLNYQHYKGSDFDCELRLLIHQSLAGGIIGVKGHFLYSVGNLTIPRP

SEQ ID NO: 903625 - protein, 78 aa, Homo sapiens
RGRGACARFLSSSDRLRRRGSGGTAVSRGEEPGWGSGSWRLLQHWGVSCWSDPERFSSALQGYIITDWCARLIKEYGN

SEQ ID NO: 903626 - protein, 78 aa, Homo sapiens; identical to SEQ ID NO: 903625

SEQ ID NO: 903627 - protein, 463 aa, Homo sapiens; identical to SEQ ID NO: 903612

SEQ ID NO: 903628 - protein, 464 aa, Homo sapiens; identical to SEQ ID NO: 903606

SEQ ID NO: 903629 - protein, 464 aa, Homo sapiens; identical to SEQ ID NO: 903606

SEQ ID NO: 903630 - protein, 143 aa, Homo sapiens
METEQPEETFPNTETNGEFGKRPAEDMEEEQAFKRSRNTDEMVELRILLQSKNAGAVIGKGGKNIKALRTDYNASVSVPDSSGPERILSISADIETIGEILKKIIPTLEEGLQLPSPTATSQLPLESDAVECLNVCHSAIEPH

SEQ ID NO: 903631 - protein, 446 aa, Homo sapiens
METEQPEETFPNTETNGEFGKRPAEDMEEEQAFKRSRNTDEMVELRILLQSKNAGAVIGKGGKNIKALRTDYNASVSVPDSSGPERILSISADIETIGEILKKIIPTLEEGLQLPSPTATSQLPLESDAVECLNYQHYKGSDFDCELRLLIHQSLAGGIIGVKGAKIKELRENTQTTIKLFQECCPHSTDRVVLIGGKPDRVVECIKIILDLISESPIKGRAQPYDPNFYDETYDYGGFTMMFDDRRGRPVGFPMRGRGGFDRMPPGRGGRPMPPSRRDYDDMSPRRGPPPPPPGRGGRGGSRARNLPLPPPPPPRGGDLMAYDRRGRPGDRYDGMVGFSADETWDSAIDTWSPSEWQMAYEPQGGSGYDYSYAGGRGSYGDLGGPIITTQVTIPKDLAGSIIGKGGQRIKQIRHESGASIKQDQIQNAQYLLQNSVKQYADVEGF

SEQ ID NO: 903632 - protein, 464 aa, Homo sapiens; identical to SEQ ID NO: 903606

SEQ ID NO: 903633 - protein, 464 aa, Homo sapiens; identical to SEQ ID NO: 903606

SEQ ID NO: 903634 - protein, 464 aa, Homo sapiens; identical to SEQ ID NO: 903606

SEQ ID NO: 903635 - protein, 463 aa, Homo sapiens; identical to SEQ ID NO: 903612

SEQ ID NO: 903636 - protein, 463 aa, Homo sapiens; identical to SEQ ID NO: 903612

SEQ ID NO: 903637 - protein, 462 aa, Homo sapiens
METEQPEETFPNTETNGEFGKRPAEDMEEEQAFKRSRNTDEMVELRILLQSKNAGAVIGKGGKNIKALRTDYNASVSVPDSSGPERILSISADIETIGEILKKIIPTLEEGLQLPSPTATSQLPLESDAVECLNYQHYKGSDFDCELRLLIHQSLAGGIIGVKGAKIKELRENTQTTIKLFQECCPHSTDRVVLIGGKPDRVVECIKIILDLISESPIKGRAQPYDPNFYDETYDYGGFTMMFDDRRGRPVGFPMRGRGGFDRMPPGRGGRPMPPSRRDYDDMSPRRGPPPPPPGRGGRGGSRARNLPLPPPPPPRGGDLMAYDRRGRPGDRYDGMVGFSADETWDSAIDTWSPSEWQMAYEPQGGSGYDYSYAGGRGSYGDLGGPIITTQVTIPKDLAGSIIGKGGQRIKQIRHESGASIKIDEPLEGSEDRIITITGTQDQIQNAQYLLQNRVSLSLALC

SEQ ID NO: 903638 - protein, 290 aa, Homo sapiens
METEQPEETFPNTETNGEFGKRPAEDMEEEQAFKRSRNTDEMVELRILLQSKNAGAVIGKGGKNIKALRTDYNASVSVPDSSGPERILSISADIETIGEILKKIIPTLEEGLQLPSPTATSQLPLESDAVECLNYQHYKGSDFDCELRLLIHQSLAGGIIGVKGAKIKELRENTQTTIKLFQECCPHSTDRVVLIGGKPDRVVECIKIILDLISESPIKGRAQPYDPNFYDETYDYGGFTMMFDDRRGRPVGFPMRGRGGFDRMPPGRGGRPMPPSRRDYDDMILGGQCW

SEQ ID NO: 903639 - protein, 226 aa, Homo sapiens
METEQPEETFPNTETNGEFGKRPAEDMEEEQAFKRSRNTDEMVELRILLQSKNAGAVIGKGGKNIKALRTDYNASVSVPDSSGPERILSISADIETIGEILKKIIPTLEEGLQLPSPTATSQLPLESDAVECLNYQHYKGSDFDCELRLLIHQSLAGGIIGVKGAKIKELRENTQTTIKLFQECCPHSTDRVVLIGGKPDRVVECIKIILDLISESPIKGRAGRGH

SEQ ID NO: 903640 - protein, 185 aa, Homo sapiens
METEQPEETFPNTETNGEFGKRPAEDMEEEQAFKRSRNTDEMVELRILLQSKNAGAVIGKGGKNIKALRTDYNASVSVPDSSGPERILSISADIETIGEILKKIIPTLEEGLQLPSPTATSQLPLESDAVECLNYQHYKGSDFDCELRLLIHQSLAGGIIGVKGKATASSSSTLLETVLVMKGLG

SEQ ID NO: 903641 - protein, 113 aa, Homo sapiens
MTERRVPFSLLRGPSWDPFRDWYPHSRLFDQAFGLPRLPEEWSQWLGGKQLGQATCAPCPPPPSRAPQWPAPAYSRALSRQLSKRGLGDPGHTCPGPLGACPWMSTTFAPGRS

SEQ ID NO: 903642 - protein, 145 aa, Homo sapiens
GRVGRPTRPHKSAAEPSAPHFSEQTSRAESASMTERRVPFSLLRGPSWDPFRDWYPHSRLFDQAFGLPRLPEEWSQWLGGKQLGQATCAPCPPPPSRAPQWPAPAYSRALSRQLSKRGLGDPGHTCPGPLGACPWMSTTFAPGRS

SEQ ID NO: 903643 - protein, 259 aa, Homo sapiens
MVLLIYKARTFCQFFLSNDTKKYDSQVNVIHKLIVCHLHVTNSYSQTNTFFIWNLIVDFTSSTLATMFSLCVSREGNFPALFKPGPRIRGICLIRDSEAKTASYFLASFLTSFLFLLSFFSASMSMWGISTALASSRPTPRAESASMTERRVPFSLLRGPSWDPFRDWYPHSRLFDQAFGLPRLPEEWSQWLGGKQLGQATCAPCPPPPSRAPQWPAPAYSRALSRQLSKRGLGDPGHTCPGPLGACPWMSTTFAPGRS

SEQ ID NO: 903644 - protein, 113 aa, Homo sapiens; identical to SEQ ID NO: 903641

SEQ ID NO: 903645 - protein, 105 aa, Homo sapiens
MANIFPGCFNAENTPAPRCGLAIRNVSHRFTLSSMRWSSIVTDGWPRTMPQKLEHTPSPIRDPLILQGLAYRSSAGHRRLGGRRKAWQIHPEVRTCAARDGKDAL

SEQ ID NO: 903646 - protein, 113 aa, Homo sapiens; identical to SEQ ID NO: 903641

SEQ ID NO: 903647 - protein, 122 aa, Homo sapiens
GRVGRPTRPHKSAAEPSAPHFSEQTSRAESASMTERRVRPLPPAAIESPAVACARLQPRAQPATQQAGSRRSGPHLAGTAGRVSLDVNHFRPRTKLTVKTKGLAWWRSPRAKHEERQGQKHG

SEQ ID NO: 903648 - protein, 113 aa, Homo sapiens; identical to SEQ ID NO: 903641

SEQ ID NO: 903649 - protein, 113 aa, Homo sapiens; identical to SEQ ID NO: 903641

SEQ ID NO: 903650 - protein, 113 aa, Homo sapiens; identical to SEQ ID NO: 903641

SEQ ID NO: 903651 - protein, 113 aa, Homo sapiens; identical to SEQ ID NO: 903641

SEQ ID NO: 903652 - protein, 113 aa, Homo sapiens; identical to SEQ ID NO: 903641

SEQ ID NO: 903653 - protein, 145 aa, Homo sapiens; identical to SEQ ID NO: 903642

SEQ ID NO: 903654 - protein, 145 aa, Homo sapiens; identical to SEQ ID NO: 903642

SEQ ID NO: 903655 - protein, 113 aa, Homo sapiens; identical to SEQ ID NO: 903641

SEQ ID NO: 903656 - protein, 145 aa, Homo sapiens; identical to SEQ ID NO: 903642

SEQ ID NO: 903657 - protein, 145 aa, Homo sapiens; identical to SEQ ID NO: 903642

SEQ ID NO: 903658 - protein, 105 aa, Homo sapiens; identical to SEQ ID NO: 903645

SEQ ID NO: 903659 - protein, 113 aa, Homo sapiens; identical to SEQ ID NO: 903641

SEQ ID NO: 903660 - protein, 145 aa, Homo sapiens; identical to SEQ ID NO: 903642

SEQ ID NO: 903661 - protein, 98 aa, Homo sapiens
GRVGRPTRPHKSAAEPSAPHFSEQTSRAESASMTERRVPFSLLRGPSWDPFRDWYPHSRLFDQAFGLPRLPEEWSQWLGGKQLGQATKLQNSDETAAK

SEQ ID NO: 903662 - protein, 149 aa, Homo sapiens
GGGFELYLRKTEDEMYQKNTQVAGEAQPVAAAGGGIRAEGFTWRQSHRILQPSWDPFRDWYPHSRLFDQAFGLPRLPEEWSQWLGGKQLGQATCAPCPPPPSRAPQWPAPAYSRALSRQLSKRGLGDPGHTCPGPLGACPWMCSPEGHT

SEQ ID NO: 903663 - protein, 113 aa, Homo sapiens; identical to SEQ ID NO: 903641

SEQ ID NO: 903664 - protein, 113 aa, Homo sapiens; identical to SEQ ID NO: 903641

SEQ ID NO: 903665 - protein, 113 aa, Homo sapiens; identical to SEQ ID NO: 903641

SEQ ID NO: 903666 - protein, 161 aa, Homo sapiens
GRVGRPTRPHKSAAEPSAPHFSEQTSRAESASMTERRVPFSLLRGPSWDPFRDWYPHSRLRPPTAARSAGNSASGVSEIRATLARDRWARVPGCQPLSPPDEADGQDPRIGVVEITPGKARGAARTEAWLTSSRGASTREIHACPPCCGPPPKVSFLPLFP

SEQ ID NO: 903667 - protein, 113 aa, Homo sapiens; identical to SEQ ID NO: 903641

SEQ ID NO: 903668 - protein, 113 aa, Homo sapiens; identical to SEQ ID NO: 903641

SEQ ID NO: 903669 - protein, 113 aa, Homo sapiens; identical to SEQ ID NO: 903641

SEQ ID NO: 903670 - protein, 113 aa, Homo sapiens; identical to SEQ ID NO: 903641

SEQ ID NO: 903671 - protein, 145 aa, Homo sapiens; identical to SEQ ID NO: 903642

SEQ ID NO: 903672 - protein, 145 aa, Homo sapiens; identical to SEQ ID NO: 903642

SEQ ID NO: 903673 - protein, 145 aa, Homo sapiens; identical to SEQ ID NO: 903642

SEQ ID NO: 903674 - protein, 143 aa, Homo sapiens
GRVGRPTRPHKSAAEPSAPHFSEQTSRAESASMTERRVPFSLLRGPSWDPFRDWYPHSRLFDQAFGLPRLPEEWSQWLGGKQLGQATCAPCPPPPSRAPQWPAPAYSRALSRQLSKRGLGDPGHTCPGPLGACPWMCSPEGHT

SEQ ID NO: 903675 - protein, 145 aa, Homo sapiens; identical to SEQ ID NO: 903642

SEQ ID NO: 903676 - protein, 302 aa, Homo sapiens
GRVGRPTRPHKSAAEPSAPHFSEQTSRAESASMTERRVPFSLLRGPSWDPFRDWYPHSRLFDQAFGLPRLPEEWSQWLGGKQLGQATCAPCPPPPSRAPQWLAALADRAIKQAKLKKVAGLSEMNRGQHYDGPAIGQSSVTRCEYVQTQVIAPGKRRLEPHASILRVRSEVWTNAPWHRADDVRPARTVAIGVRIIARMTVTTGKISDWLRARDDGAPSQWGPPSRYNFGGGNNWTVRGRHHDSKTSYRSAGPRLNACTDQPLEVMGQRWGAPESMQNREEPARQDKDLRPVMRNTSAMTKG

SEQ ID NO: 903677 - protein, 141 aa, Homo sapiens [sequence omitted]

SEQ ID NO: 903678 - protein, 100 aa, Homo sapiens
SSTSTSRPVPTAQLSPTEISAVRQLIAGYRESAAFLLRSADELENLILQQKLTPPAPGAHCPREGGCPSLDLASCLTSWYILFLKEVGSKRAVSSHTPST

SEQ ID NO: 903679 - protein, 100 aa, Homo sapiens; identical to SEQ ID NO: 903678

SEQ ID NO: 903680 - protein, 100 aa, Homo sapiens; identical to SEQ ID NO: 903678

SEQ ID NO: 903681 - protein, 100 aa, Homo sapiens; identical to SEQ ID NO: 903678

SEQ ID NO: 903682 - protein, 1141 aa, Homo sapiens
MSLRCLHILLAWILFSQSSNLFHKPQHCQISPRPLQIIHQPQFSPFISLSFSIFFFAFISFYFHILFFSLYTVFFLLIYSFLFFDFLFYFSILTSFIYPSFFLSFAFIFLSRFASNYLAFPSPVSPVSSSFMISSSFPPILHSPSVSTSPSPFIPIHPFNPPHWGKKVEKRREESGVEKKGIEKKVETRQLKRAIDSALPSALSKNDHKHQKQLLSKINCEKEMNENMRATLATSKNVFQLKLEETQKLLEDQHLSNLQKFCDEVNQITNSETLSSIDSLEATEHEEIYLTLNKEHSTSIQRNTISLKPANMQSTNLSCFDEDKLAFSKTQHINNWLTNLDASNTQNVTAFSDILSKSNVLPSWEYFNSKEQNPSPLNGTVERATNTANNSVPFVSSPPMFVLDKKCEKTSETSTMRTTDSTSGAFKRERPLVTESPTFKFSKSQSTSDSLTQEVATFPDQEKYSELNQENGTTSIPTSCVPVATPLVLPSNIQSARPSAKNSIHIKEIDAVQCSDKLDELKDGKEEEIKYFNCNKEELPLFSDSFQDAYIPHNPDSKDEKQKLAETSSLSNVTSNYDFVGQHKKMKYNIHERNGVRFLKSILKKESKYEHGYLKALIINQSFKFGNQKAAAIRDSIELTKEKGAEIPKTIKKLRWFDETSNIENNAENSHSLKNKTGTTQQHSQQFHIQSGAGSNIISVSTCAVNSADTKKSREDSISENVTTLGGSGADHMPLNCFIPSGYNFAKHAWPASKKEESKIPVHDDSKTKQGKPQRGRAKIIRKPGSAKVQSGFICTNRKGAVIQPQSASKVNIFTQAQGKLIIPCPPPQSTSNIRSGKNIQVSQCQPVTPENPQNIITHNSFNSKHVLPTEHSLNQWNQESSSPLSNACSDLVTVIPSLPSYCSSECQTFAKINHSNGTQAVARQDATLYCTQRSPVCEESYPSVTLRTAEEESVPLWKRGPNVLHQNKRATGSTVMRRKRIAETKRRNILEQKRQNPGSVGQKYSEQINNFGQSVLLSSSEPKQTTRGTSYIEEVSDSTSEFLMAENLVKASVPEDEILTVLNSKQIQKSNLPLNKTQQFNICTLSAEEQKILESLNDLNERLHYIQESICKNPSIKNTLQIIPLLEKREDRTSSCRDKR

SEQ ID NO: 903683 - protein, 1055 aa, Homo sapiens
HALYFSQLLTYFLLFFRIKFLKKNVYIQVFLFVFLTLVFSIECNLAGRCFTPLEQGLLIPKGLLASKTTEVLLSLSYLSSWQHKCWFSSYLFGLSSSVFIMYFVPQTAIDSALPSALSKNDHKHQKQLLSKINCEKEMNENMRATLATSKNVFQLKLEETQKLLEDQHLSNLQKFCDEVNQITNSETLSSIDSLEATEHEEIYLTLNKEHSTSIQRNTISLKPANMQSTNLSCFDEDKLAFSKTQHINNWLTNLDASNTQNVTAFSDILSKSNVLPSWEYFNSKEQNPSPLNGTVERATNTANNSVPFVSSPPMFVLDKKCEKTSETSTMRTTDSTSGAFKRERPLVTESPTFKFSKSQSTSDSLTQEVATFPDQEKYSELNQENGTTSIPTSCVPVATPLVLPSNIQSARPSAKNSIHIKEIDAVQCSDKLDELKDGKEEEIKYFNCNKEELPLFSDSFQDAYIPHNPDSKDEKQKLAETSSLSNVTSNYDFVGQHKKMKYNIHERNGVRFLKSILKKESKYEHGYLKALIINQSFKFGNQKAAAIRDSIELTKEKGAEIPKTIKKLRWFDETSNIENNAENSHSLKNKTGTTQQHSQQFHIQSGAGSNIISVSTCAVNSADTKKSREDSISENVTTLGGSGADHMPLNCFIPSGYNFAKHAWPASKKEESKIPVHDDSKTKQGKPQRGRAKIIRKPGSAKVQSGFICTNRKGAVIQPQSASKVNIFTQAQGKLIIPCPPPQSTSNIRSGKNIQVSQCQPVTPENPQNIITHNSFNSKHVLPTEHSLNQWNQESSSPLSNACSDLVTVIPSLPSYCSSECQTFAKINHSNGTQAVARQDATLYCTQRSPVCEESYPSVTLRTAEEESVPLWKRGPNVLHQNKRATGSTVMRRKRIAETKRRNILEQKRQNPGSVGQKYSEQINNFGQSVLLSSSEPKQTTRGTSYIEEVSDSTSEFLMAENLVKASVPEDEILTVLNSKQIQKSNLPLNKTQQFNICTLSAEEQKILESLNDLNERLHYIQESICKNPSIKNTLQIIPLLEKREDRTSSCRDKR

SEQ ID NO: 903684 - protein, 266 aa, Homo sapiens
MLAGRPGTRSAVGELGTESSDNLDRAPLGPRESGGHHRPGSYLDMKIHLEKNLEEERQILLQQQKICRNRARKYFVESNRRKKAFEEKRKEQEEKEHQIREQILQQRKQKFEEVTEKFQRAHVPLSQRRKAVSRKPVPPLEEALKQIQESNLKSEVNLPFSRRPTINWRAIDSALPSALSKNDHKHQKQLLSKINCEKEMNENMRATLATSKNVFQLKLEETQKLLEDQHLSNLQNFVMKLSDNPSWTLLRYTGLRLEHEKYFYTL

SEQ ID NO: 903685 - protein, 1117 aa, Homo sapiens
MLAGRPGTRSAVGELGTESSDNLDRAPLGPRESGGHHRPGSYLDMKIHLEKNLEEERQILLQQQKICRNRARKYFVESNRRKKAFEEKRKEQEEKEHQIREQILQQRKQKFEEVTEKFQRAHVPLSQRRKAVSRKPVPPLEEALKQIQESNLKSEVNLPFSRRPTINWRAIDSALPSALSKNDHKHQKQLLSKINCEKEMNENMRATLATSKNVFQLKLEETQKLLEDQHLSNLQKFCDEVNQITNSETLSSIDSLEATEHEEIYLTLNKEHSTSIQRNTISLKPANMQSTNLSCFDEDKLAFSKTQHINNWLTNLDASNTQNVTAFSDILSKSNVLPSWEYFNSKEQNPSPLNGTVERATNTANNSVPFVSSPPMFVLDKKCEKTSETSTMRTTDSTSGAFKRERPLVTESPTFKFSKSQSTSDSLTQEVATFPDQEKYSELNQENGTTSIPTSCVPVATPLVLPSNIQSARPSAKNSIHIKEIDAVQCSDKLDELKDGKEEEIKYFNCNKEELPLFSDSFQDAYIPHNPDSKDEKQKLAETSSLSNVTSNYDFVGQHKKMKYNIHERNGVRFLKSILKKESKYEHGYLKALIINQSFKFGNQKAAAIRDSIELTKEKGAEIPKTIKKLRWFDETSNIENNAENSHSLKNKTGTTQQHSQQFHIQSGAGSNIISVSTCAVNSADTKKSREDSISENVTTLGGSGADHMPLNCFIPSGYNFAKHAWPASKKEESKIPVHDDSKTKQGKPQRGRAKIIRKPGSAKVQSGFICTNRKGAVIQPQSASKVNIFTQAQGKLIIPCPPPQSTSNIRSGKNIQVSQCQPVTPENPQNIITHNSFNSKHVLPTEHSLNQWNQESSSPLSNACSDLVTVIPSLPSYCSSECQTFAKINHSNGTQAVARQDATLYCTQRSPVCEESYPSVTLRTAEEESVPLWKRGPNVLHQNKRATGSTVMRRKRIAETKRRNILEQKRQNPGSVGQKYSEQINNFGQSVLLSSSEPKQTTRGTSYIEEVSDSTSEFLMAENLVKASVPEDEILTVLNSKQIQKSNLPLNKTQQFNICTLSAEEQKILESLNDLNERLHYIQESICKNPSIKNTLQIIPLLEKREDRTSSCRDKR

SEQ ID NO: 903686 - protein, 1106 aa, Homo sapiens [sequence omitted]

SEQ ID NO: 903687 - protein, 166 aa, Homo sapiens
MQWAVGRRWAWAALLLAVAAVLTQVVWLWLGTQSFVFQREEIAQLARQYAGLDHELAFSRLIVELRRLHPGHVLPDEELQWVFVNAGGWMGAMCLLHASLSEYVLLFGTALGSRGHSGRYWAEISDTIISGTFHQWREGTTKSEVFYPEGETVVKRALVAKKLLEG

SEQ ID NO: 903688 - protein, 223 aa, Homo sapiens
MQWAVGRRWAWAALLLAVAAVLTQVVWLWLGTQSFVFQREEIAQLARQYAGLDHELAFSRLIVELRRLHPGHVLPDEELQWVFVNAGGWMGAMCLLHASLSEYVLLFGTALGSRGHSGRYWAEISDTIISGTFHQWREGTTKSEVFYPGETVVHGPGEATAVEWGPNTWMVEYGRGVIPSTLAFALADTVFSTQDFLTLFYTLRSYARGLRLELTTYLFGQDP

SEQ ID NO: 903689 - protein, 223 aa, Homo sapiens; identical to SEQ ID NO: 903688

SEQ ID NO: 903690 - protein, 223 aa, Homo sapiens; identical to SEQ ID NO: 903688

SEQ ID NO: 903691 - protein, 223 aa, Homo sapiens; identical to SEQ ID NO: 903688

SEQ ID NO: 903692 - protein, 223 aa, Homo sapiens; identical to SEQ ID NO: 903688

SEQ ID NO: 903693 - protein, 106 aa, Homo sapiens
MQWAVGRRWAWAALLLAVAAVLTQVVWLWLGTQSFVFQREEIAQLARQYAGLDHELAFSRLIVELRRLHPGHVLPDEELQWVFVNAGGWMGAMCLLHASLSEALLG

SEQ ID NO: 903694 - protein, 223 aa, Homo sapiens; identical to SEQ ID NO: 903688

SEQ ID NO: 903695 - protein, 159 aa, Homo sapiens
MQWAVGRRWAWAALLLAVAAVLTQVVWLWLGTQSFVFQREEIAQLARQYAGLDHELAFSRLIVELRRLHPGHVLPDEELQWVFVNAGGWMGAMCLLHASLSEYVLLFGTALGSRGHSVSCAIVTQGATGLRSRIPSSLAPSTSGERAPPKVRSSTQGRR

SEQ ID NO: 903696 - protein, 182 aa, Homo sapiens
MRVAGWAPCAFCTPRCPSMCCSSAPPWAPAATRVSASGGPDWEAGVVKGPMPSFLMFGWAMQWREYPDSVMCDCHSGRYWAEISDTIISGTFHQWREGTTKSEVFYPGETVVHGPGEATAVEWGPNTWMVEYGRGVIPSTLAFALADTVFSTQDFLTLFYTLRSYARGLRLELTTYLFGQDP

SEQ ID NO: 903697 - protein, 223 aa, Homo sapiens; identical to SEQ ID NO: 903688

SEQ ID NO: 903698 - protein, 103 aa, Homo sapiens
MGAMCLLHASLSEYVLLFGTALGSRGHSGETVVHGPGEATAVEWGPNTWMVEYGRGVIPSTLAFALADTVFSTQDFLTLFYTLRSYARGLRLELTTYLFGQDP

SEQ ID NO: 903699 - protein, 155 aa, Homo sapiens
MQWAVGRRWAWAALLLAVAAVLTQVVWLWLGTQSFVFQREEIAQLARQYAGLDHELAFSRLIVELRRLHPGHVLPDEELQWVFVNAGGWMGAMCLLHASLSEYVLLFGTALGSRGHSGRYWAEISDTIISGTFHQWREGTTKSEVFYPGPLTSQA

SEQ ID NO: 903700 - protein, 211 aa, Homo sapiens
MQWAVGRRWAWAALLLAVAAVLTQVVWLWLGTQSFVFQREEIAQLARQYAGLDHELAFSRLIVELRRLHPGHVLPDEELQWVFVNAGGWMGAMCLLHASLSEYVLLFGTALGSRGHSGRYWAEISDTIISGTFHQWREGTTKSEVFYPGETVVHGPGEATAVEWGPNTWMVEYGRGVIPSTLAFALADTVFSTQDFLTLFYTLRKKKGGRM

SEQ ID NO: 903701 - protein, 106 aa, Homo sapiens; identical to SEQ ID NO: 903693

SEQ ID NO: 903702 - protein, 223 aa, Homo sapiens; identical to SEQ ID NO: 903688

SEQ ID NO: 903703 - protein, 223 aa, Homo sapiens; identical to SEQ ID NO: 903688

SEQ ID NO: 903704 - protein, 223 aa, Homo sapiens; identical to SEQ ID NO: 903688

SEQ ID NO: 903705 - protein, 131 aa, Homo sapiens
MCLLHASLSEYVLLFGTALGSRGHSGRYWAEISDTIISGTFHQWREGTTKSEVFYPGETVVHGPGEATAVEWGPNTWMVEYGRGVIPSTLAFALADTVFSTQDFLTLFYTLRSYARGLRLELTTYLFGQDP

SEQ ID NO: 903706 - protein, 223 aa, Homo sapiens; identical to SEQ ID NO: 903688

SEQ ID NO: 903707 - protein, 266 aa, Homo sapiens
MQWAVGRRWAWAALLLAVAAVLTQVVWLWLGTQSFVFQREEIAQLARQYAGLDHELAFSRLIVELRRLHPGHVLPDEELQWVFVNAGGWMGAMCLLHASLSEYVLLFGTALGSRGHSGQCCGGPDWEAGVVKGPMPSFLMFGWAMQWREYPDSVMCDCHSGRYWAEISDTIISGTFHQWREGTTKSEVFYPGETVVHGPGEATAVEWGPNTWMVEYGRGVIPSTLAFALADTVFSTQDFLTLFYTLRSYARGLRLELTTYLFGQDP

SEQ ID NO: 903708 - protein, 215 aa, Homo sapiens
MQWAVGRRWAWAALLLAVAAVLTQVVWLWLGTQSFVFQREEIAQLARQYAGLDHELAFSRLIVELRRLHPGHVLPDEELQWVFVNAGGWMGAMCLLHASLSDVMCDCHSGRYWAEISDTIISGTFHQWREGTTKSEVFYPGETVVHGPGEATAVEWGPNTWMVEYGRGVIPSTLAFALADTVFSTQDFLTLFYTLRSYARGLRLELTTYLFGQDP

SEQ ID NO: 903709 - protein, 192 aa, Homo sapiens
MQWAVGRRWAWAALLLAVAAVLTQVVWLWLGTQSFVFQREEIAQLARQYAGLDHELAFSRLIVELRRLHPGHVLPDEELQWVFVNAGGWMGAMCLLHASLSEYVLLFGTALGSRGHSGETVVHGPGEATAVEWGPNTWMVEYGRGVIPSTLAFALADTVFSTQDFLTLFYTLRSYARGLRLELTTYLFGQDP

SEQ ID NO: 903710 - protein, 74 aa, Homo sapiens
AKYEAGGESAEASSILFAPMLGASGLSSPPTSLARTLDQPGLKEDLRMDRSGQARTYPLAGAHVYRQGHTPCRS

SEQ ID NO: 903711 - protein, 155 aa, Homo sapiens
MRVAGWAPCAFCTPRCPSMCCSSAPPWAPAATRVSASGGPDWEAGVVKGPMPSFLMFGWAMQWREYPDSVMCDCHSGRYWAEISDTIISGTFHQWREGTTKSEVFYPGWVRRLCQRSGSLHAGGAHNCGEHGMEKECVGGALLMVPFLHPPISHR

SEQ ID NO: 903712 - protein, 57 aa, Homo sapiens
MKFFVFALVLALMISMISADSHEKRHHGYRRKFHEKHHSHREFPFYGDYGSNYLYDN

SEQ ID NO: 903713 - protein, 1500 aa, Homo sapiens
MAKNKEPRPPSYTISIVGLSGTEKDKGNCGVGKSCLCNRFVRSKADEYYPEHTSVLSTIDFGGRVVNNDHFLYWGDIIQNSEDGVECKIHVIEQTEFIDDQTFLPHRSTNLQPYIKRAAASKLQSAEKLMYICTDQLGLEQDFEQKQMPEGKLNVDGFLLCIDVSQGCNRKFDDQLKFVNNLFVQLSKSKKPVIIAATKCDECVGHYLREVQAFASNKKNLLVVETLSAIKVNIETCFTALVQMLDKTRSKPKIIPYLDAYKTQRQLVVTATDKFEKLVQTVRDYHATWKTVSNKLKNHPDYEEYINLEGTRKARNTFSKHIEQLKQEHIRKRREEYINTLPRAFNTLLPNLEEIEHLNWSEALKLMEKRADFQLCFVVLEKTPWDETDHIDKINDRRIPFDLLSTLEAEKVYQNHVQHLISEKRRVEMKEKFKKTLEKIQFISPGQPWEEVMCFVMEDEAYKYITEADSKEVYGRHQREIVEKAKEEFQEMLFEHSELFYDLDLNATPSSDKMSEIHTVLSEEPRYKALQKLAPDRESLLLKHIGFVYHPTKETCLSGQNCTDIKVEQLLASSLLQLDHGRLRLYHDSTNIDKVNLFILGKDGLAQELANEIRTQSTDDEYALDGKIYELDLRPVDAKSPYFLSQLWTAAFKPHGCFCVFNSIESLSFIGEFIGKIRTEASQIRKDKYMANLPFTLILANQRDSISKNLPILRHQGQQLANKLQCPFVDVPAGTYPRKFNETQIKQALRGVLESVKHNLDVVSPIPANKDLSEADLRIVMCAMCGDPFSVDLILSPFLDSHSCSAAQAGQNNSLMLDKIIGEKRRRIQITILSYHSSIGVRKDELVHGYILVYSAKRKASMGMLRAFLSEVQDTIPVQLVAVTDSQADFFENEAIKELMTEGEHIATEITAKFTALYSLSQYHRQTEVFTLFFSDVLEKKNMIENSYLSDNTRESTHQSEDVFLPSPRDCFPYNNYPDSDDDTEAPPPYSPIGDDVQLLPTPSDRSRYRLDLEGNEYPIHSTPNCHDHERNHKVPPPIKPKPVVPKTNVKKLDPNLLKTIEAGIGKNPRKQTSRVPLAHPEDMDPSDNYAEPIDTIFKQKGYSDEIYVVPDDSQNRIKIRNSFVNNTQGDEENGFSDRTSKSHGERRPSKYKYKSKTLFSKAKSYYRRTHSDASDDEAFTTSKTKRKGRHRGSEEDPLLSPVETWKGGIDNPAITSDQELDDKKMKKKTHKVKEDKKKKKTKNFNPPTRRNWESNYFGMPLQDLVTAEKPIPLFVEKCVEFIEDTGLCTEGLYRVSGNKTDQDNIQKQFDQDHNINLVSMEVTVNAVAGALKAFFADLPDPLIPYSLHPELLEAAKIPDKTERLHALKEIVKKFHPVNYDVFRYVITHLNRVSQQHKINLMTADNLSICFWPTLMRPDFENREFLSTTKIHQSVVETFIQQCQFFFYNGEIVETTNIVAPPPPSNPGQLVEPMVPLQLPPPLQPQLIQPQLQTDPLGII

SEQ ID NO: 903714 - protein, 1500 aa, Homo sapiens; identical to SEQ ID NO: 903713

SEQ ID NO: 903715 - protein, 1500 aa, Homo sapiens; identical to SEQ ID NO: 903713

SEQ ID NO: 903716 - protein, 284 aa, Homo sapiens
SVIRNARELEARGVAEVERCTEKKKTKNFNPPTRRNWESNYFGMPLQDLVTAEKPIPLFVEKCVEFIEDTGLCTEGLYRVSGNKTDQDNIQKQFDQDHNINLVSMEVTVNAVAGALKAFFADLPDPLIPYSLHPELLEAAKIPDKTERLHALKEIVKKFHPVNYDVFRYVITHLNRVSQQHKINLMTADNLSICFWPTLMRPDFENREFLSTTKIHQSVVETFIQQCQFFFYNGEIVETTNIVAPPPPSNPGQLVEPMVPLQLPPPLQPQLIQPQLQTDPLGII

SEQ ID NO: 903717 - protein, 1296 aa, Homo sapiens
MAKNKEPRPPSYTISIVGLSGTEKDKGNCGVGKSCLCNRFVRSKADEYYPEHTSVLSTIDFGGRVVNNDHFLYWGDIIQNSEDGVECKIHVIEQTEFIDDQTFLPHRSTNLQPYIKRAAASKLQSAEKLMYICTDQLGLEQDFEQKQMPEGKLNVDGFLLCIDVSQGCNRKFDDQLKFVNNLFVQLSKSKKPVIIAATKCDECVGHYLREVQAFASNKKNLLVVETLSAIKVNIETCFTALVQMLDKTRSKPKIIPYLDAYKTQRQLVVTATDKFEKLVQTVRDYHATWKTVSNKLKNHPDYEEYINLEGTRKARNTFSKHIEQLKQEHIRKRREEYINTLPRAFNTLLPNLEEIEHLNWSEALKLMEKRADFQLCFVVLEKTPWDETDHIDKINDRRIPFDLLSTLEAEKVYQNHVQHLISEKRRVEMKEKFKKTLEKIQFISPGQPWEEVMCFVMEDEAYKYITEADSKEVYGRHQREIVEKAKEEFQEMLFEHSELFYDLDLNATPSSDKMSEIHTVLSEEPRYKALQKLAPDRESLLLKHIGFVYHPTKETCLSGQNCTDIKVEQLLASSLLQLDHGRLRLYHDSTNIDKVNLFILGKDGLAQELANEIRTQSTDDEYALDGKIYELDLRPVDAKSPYFLSQLWTAAFKPHGCFCVFNSIESLSFIGEFIGKIRTEASQIRKDKYMANLPFTLILANQRDSISKNLPILRHQGQQLANKLQCPFVDVPAGTYPRKFNETQIKQALRGVLESVKHNLDVVSPIPANKDLSEADLRIVMCAMCGDPFSVDLILSPFLDSHSCSAAQAGQNNSLMLDKIIGEKRRRIQITILSYHSSIGVRKDELVHGYILVYSAKRKASMGMLRAFLSEVQDTIPVQLVAVTDSQADFFENEAIKELMTEGEHIATEITAKFTALYSLSQYHRQTEVFTLFFSDVLEKKNMIENSYLSDNTRESTHQSEDVFLPSPRDCFPYNNYPDSDDDTEAPPPYSPIGDDVQLLPTPSDRSRYRLDLEGNEYPIHSTPNCHDHERNHKVPPPIKPKPVVPKTNVKKLDPNLLKTIEAGIGKNPRKQTSRVPLAHPEDMDPSDNYAEPIDTIFKQKGYSDEIYVVPDDSQNRIKIRNSFVNNTQGDEENGFSDRTSKSHGERRPSKYKYKSKTLFSKAKSYYRRTHSDASDDEAFTTSKTKRKGRHRGSEEDPLLSPVETWKGGIDNPAITSDQELDDKKMKKKTHKVKEDKKKKKTKNFNPPTRRNWESNYFGMPLQDLVTAEKPIPLFVEKCVEFIEDTGRIEESLQEI

SEQ ID NO: 903718 - protein, 158 aa, Homo sapiens
MSLPPPPPGPLPLRRRRRRPTLLGLCTEGLYRVSGNKTDQDNIQKQFDQDHNINLVSMEVTVNAVAGALKAFFADLPDPLIPYSLHPELLEAAKIPDKTERLHALKEIVKKFHPVNYDVFRYVITHLNRYFYFFRVFWQIKCTTHFKHVNFINWIIIR

SEQ ID NO: 903719 - protein, 1500 aa, Homo sapiens; identical to SEQ ID NO: 903713

SEQ ID NO: 903720 - protein, 1500 aa, Homo sapiens; identical to SEQ ID NO: 903713

SEQ ID NO: 903721 - protein, 1269 aa, Homo sapiens
MAKNKEPRPPSYTISIVGLSGTEKDKGNCGVGKSCLCNRFVRSKADEYYPEHTSVLSTIDFGGRVVNNDHFLYWGDIIQNSEDGVECKIHVIEQTEFIDDQTFLPHRSTNLQPYIKRAAASKLQSAEKLMYICTDQLGLEQDFEQKQMPEGKLNVDGFLLCIDVSQGCNRKFDDQLKFVNNLFVQLSKSKKPVIIAATKCDECVGHYLREVQAFASNKKNLLVVETLSAIKVNIETCFTALVQMLDKTRSKPKIIPYLDAYKTQRQLVVTATDKFEKLVQTVRDYHATWKTVSNKLKNHPDYEEYINLEGTRKARNTFSKHIEQLKQEHIRKRREEYINTLPRAFNTLLPNLEEIEHLNWSEALKLMEKRADFQLCFVVLEKTPWDETDHIDKINDRRIPFDLLSTLEAEKVYQNHVQHLISEKRRVEMKEKFKKTLEKIQFISPGQPWEEVMCFVMEDEAYKYITEADSKEVYGRHQREIVEKAKEEFQEMLFEHSELFYDLDLNATPSSDKMSEIHTVLSEEPRYKALQKLAPDRESLLLKHIGFVYHPTKETCLSGQNCTDIKVEQLLASSLLQLDHGRLRLYHDSTNIDKVNLFILGKDGLAQELANEIRTQSTDDEYALDGKIYELDLRPVDAKSPYFLSQLWTAAFKPHGCFCVFNSIESLSFIGEFIGKIRTEASQIRKDKYMANLPFTLILANQRDSISKNLPILRHQGQQLANKLQCPFVDVPAGTYPRKFNETQIKQALRGVLESVKHNLDVVSPIPANKDLSEADLRIVMCAMCGDPFSVDLILSPFLDSHSCSAAQAGQNNSLMLDKIIGEKRRRIQITILSYHSSIGVRKDELVHGYILVYSAKRKASMGMLRAFLSEVQDTIPVQLVAVTDSQADFFENEAIKELMTEGEHIATEITAKFTALYSLSQYHRQTEVFTLFFSDVLEKKNMIENSYLSDNTRESTHQSEDVFLPSPRDCFPYNNYPDSDDDTEAPPPYSPIGDDVQLLPTPSDRSRYRLDLEGNEYPIHSTPNCHDHERNHKVPPPIKPKPVVPKTNVKKLDPNLLKTIEAGIGKNPRKQTSRVPLAHPEDMDPSDNYAEPIDTIFKQKGYSDEIYVVPDDSQNRIKIRNSFVNNTQGDEENGFSDRTSKSHGERRPSKYKYKSKTLFSKAKSYYRRTHSDASDDEAFTTSKTKRKGRHRGSEEDPLLSPVETWKGGIDNPAITSDQELDDKKMKKKTHKVKEDKKGYVPKDSTVSAGIKLTKTIFKSSLIKIIISI

SEQ ID NO: 903722 - protein, 1421 aa, Homo sapiens
MAKNKEPRPPSYTISIVGLSGTEKDKGNCGVGKSCLCNRFVRSKADEYYPEHTSVLSTIDFGGRVVNNDHFLYWGDIIQNSEDGVECKIHVIEQTEFIDDQTFLPHRSTNLQPYIKRAAASKLQSAEKLMYICTDQLGLEQDFEQKQMPEGKLNVDGFLLCIDVSQGCNRKFDDQLKFVNNLFVQLSKSKKPVIIAATKCDECVGHYLREVQAFASNKKNLLVVETLSAIKVNIETCFTALVQMLDKTRSKPKIIPYLDAYKTQRQLVVTATDKFEKLVQTVRDYHATWKTVSNKLKNHPDYEEYINLEGTRKARNTFSKHIEQLKQEHIRKRREEYINTLPRAFNTLLPNLEEIEHLNWSEALKLMEKRADFQLCFVVLEKTPWDETDHIDKINDRRIPFDLLSTLEAEKVYQNHVQHLISEKRRVEMKEKFKKTLEKIQFISPGQPWEEVMCFVMEDEAYKYITEADSKEVYGRHQREIVEKAKEEFQEMLFEHSELFYDLDLNATPSSDKMSEIHTVLSEEPRYKALQKLAPDRESLLLKHIGFVYHPTKETCLSGQNCTDIKVEQLLASSLLQLDHGRLRLYHDSTNIDKVNLFILGKDGLAQELANEIRTQSTDDEYALDGKIYELDLRPVDAKSPYFLSQLWTAAFKPHGCFCVFNSIESLSFIGEFIGKIRTEASQIRKDKYMANLPFTLILANQRDSISKNLPILRHQGQQLANKLQCPFVDVPAGTYPRKFNETQIKQALRGVLESVKHNLDVVSPIPANKDLSEADLRIVMCAMCGDPFSVDLILSPFLDSHSCSAAQAGQNNSLMLDKIIGEKRRRIQITILSYHSSIGVRKDELVHGYILVYSAKRKASMGMLRAFLSEVQDTIPVQLVAVTDSQADFFENEAIKELMTEGEHIATEITAKFTALYSLSQYHRQTEVFTLFFSDVLEKKNMIENSYLSDNTRESTHQSEDVFLPSPRDCFPYNNYPDSDDDTEAPPPYSPIGDDVQLLPTPSDRSRYRLDLEGNEYPIHSTPNCHDHERNHKVPPPIKPKPVVPKTNVKKLDPNLLKTIEAGIGKNPRKQTSRVPLAHPEDMDPSDNYAEPIDTIFKQKGYSDEIYVVPDDSQNRIKIRNSFVNNTQGDEENGFSDRTSKSHGERRPSKYKYKSKTLFSKAKSYYRRTHSDASDDEAFTTSKTKRKGRHRGSEEDPLLSPVETWKGGIDNPAITSDQELDDKKMKKKTHKVKEDKKKKKTKNFNPPTRRNWESNYFGMPLQDLVTAEKPIPLFVEKCVEFIEDTGLCTEGLYRVSGNKTDQDNIQKQFDQDHNINLVSMEVTVNAVAGALKAFFADLPDPLIPYSLHPELLEAAKIPDKTERLHALKEIVKKFHPVNYDVFRYVITHLNRYFYFFRVFWQIKCTTHFKHVNFINWIIIR

SEQ ID NO: 903723 - protein, 1242 aa, Homo sapiens
MAKNKEPRPPSYTISIVGLSGTEKDKGNCGVGKSCLCNRFVRSKADEYYPEHTSVLSTIDFGGRVVNNDHFLYWGDIIQNSEDGVECKIHVIEQTEFIDDQTFLPHRSTNLQPYIKRAAASKLQSAEKLMYICTDQLGLEQDFEQKQMPEGKLNVDGFLLCIDVSQGCNRKFDDQLKFVNNLFVQLSKSKKPVIIAATKCDECVGHYLREVQAFASNKKNLLVVETLSAIKVNIETCFTALVQMLDKTRSKPKIIPYLDAYKTQRQLVVTATDKFEKLVQTVRDYHATWKTVSNKLKNHPDYEEYINLEGTRKARNTFSKHIEQLKQEHIRKRREEYINTLPRAFNTLLPNLEEIEHLNWSEALKLMEKRADFQLCFVVLEKTPWDETDHIDKINDRRIPFDLLSTLEAEKVYQNHVQHLISEKRRVEMKEKFKKTLEKIQFISPGQPWEEVMCFVMEDEAYKYITEADSKEVYGRHQREIVEKAKEEFQEMLFEHSELFYDLDLNATPSSDKMSEIHTVLSEEPRYKALQKLAPDRESLLLKHIGFVYHPTKETCLSGQNCTDIKVEQLLASSLLQLDHGRLRLYHDSTNIDKVNLFILGKDGLAQELANEIRTQSTDDEYALDGKIYELDLRPVDAKSPYFLSQLWTAAFKPHGCFCVFNSIESLSFIGEFIGKIRTEASQIRKDKYMANLPFTLILANQRDSISKNLPILRHQGQQLANKLQCPFVDVPAGTYPRKFNETQIKQALRGVLESVKHNLDVVSPIPANKDLSEADLRIVMCAMCGDPFSVDLILSPFLDSHSCSAAQAGQNNSLMLDKIIGEKRRRIQITILSYHSSIGVRKDELVHGYILVYSAKRKASMGMLRAFLSEVQDTIPVQLVAVTDSQADFFENEAIKELMTEGEHIATEITAKFTALYSLSQYHRQTEVFTLFFSDVLEKKNMIENSYLSDNTRESTHQSEDVFLPSPRDCFPYNNYPDSDDDTEAPPPYSPIGDDVQLLPTPSDRSRYRLDLEGNEYPIHSTPNCHDHERNHKVPPPIKPKPVVPKTNVKKLDPNLLKTIEAGIGKNPRKQTSRVPLAHPEDMDPSDNYAEPIDTIFKQKGYSDEIYVVPDDSQNRIKIRNSFVNNTQGDEENGFSDRTSKSHGERRPSKYKYKSKTLFSKAKSYYRRTHSDASDDEAFTTSKTKRKGRHRGSEEDPLLSPVETWKGGIDNPAITSDQELDDKKMKKKTHKVKEDKKVRLT

SEQ ID NO: 903724 - protein, 191 aa, Homo sapiens
MSDTSESGAGLTRFQAEASEKDSSSMMQTLLTVTQNVEVPETPKASKALEVSEDVKVSKASGVSKATEVSKTPEAREAPATQASSTTQLTDTQVLAAENKSLAADTKKQNADPQAVTMPATETKKVSHVADTKVNTKAQETEAAPSQAPADEPEPESAAAQSQENQDTRPKVKAKKARKVKHLDGGRGWQQ

SEQ ID NO: 903725 - protein, 305 aa, Homo sapiens
MLKDIIKEYTDVYPEIIERAGYSLEKVFGIQLKEIDKNDHLYILLSTLEPTDAGILGTTKDSPKLGLLMVLLSIIFMNGNRSSEAVIWEVLRKLGLRPGIHHSLFGDVKKLITDEFVKQKYLDYARVPNSNPPEYEFFWGLRSYYETSKMKVLKFACKVQKKDPKEWAAQYREAMEADLKAAAEAAAEAKARAEIRARMGIGLGSENAAGPCNWDEADIGPWAKARIQAGAEAKAKAQESGSASTGASTSTNNSASASASTSGGFSAGASLTATLTFGLFAGLGGSWCQHQWQLWCLWFLLQVRF

SEQ ID NO: 903726 - protein, 305 aa, Homo sapiens; identical to SEQ ID NO: 903725

SEQ ID NO: 903727 - protein, 305 aa, Homo sapiens; identical to SEQ ID NO: 903725

SEQ ID NO: 903728 - protein, 362 aa, Homo sapiens
MSLSSQSSDLAVLASLLISTEPGYATLGVVGKESIAWASGPPGISSVRCSQHSPLADMLKDIIKEYTDVYPEIIERAGYSLEKVFGIQLKEIDKNDHLYILLSTLEPTDAGILGTTKDSPKLGLLMVLLSIIFMNGNRSSEAVIWEVLRKLGLRPGIHHSLFGDVKKLITDEFVKQKYLDYARVPNSNPPEYEFFWGLRSYYETSKMKVLKFACKVQKKDPKEWAAQYREAMEADLKAAAEAAAEAKARAEIRARMGIGLGSENAAGPCNWDEADIGPWAKARIQAGAEAKAKAQESGSASTGASTSTNNSASASASTSGGFSAGASLTATLTFGLFAGLGGSWCQHQWQLWCLWFLLQVRF

SEQ ID NO: 903729 - protein, 156 aa, Homo sapiens
MKVLKFACKVQKKDPKEWAAQYREAMEADLKAAAEAAAEAKARAEIRARMGIGLGSENAAGPCNWDEADIGPWAKARIQAGAEAKAKAQESGSASTGASTSTNNSASASASTSGGFSAGASLTATLTFGLFAGLGGSWCQHQWQLWCLWFLLQVRF

SEQ ID NO: 903730 - protein, 305 aa, Homo sapiens; identical to SEQ ID NO: 903725

SEQ ID NO: 903731 - protein, 305 aa, Homo sapiens; identical to SEQ ID NO: 903725

SEQ ID NO: 903732 - protein, 305 aa, Homo sapiens; identical to SEQ ID NO: 903725

SEQ ID NO: 903733 - protein, 305 aa, Homo sapiens; identical to SEQ ID NO: 903725

SEQ ID NO: 903734 - protein, 305 aa, Homo sapiens; identical to SEQ ID NO: 903725

SEQ ID NO: 903735 - protein, 191 aa, Homo sapiens; identical to SEQ ID NO: 903724

SEQ ID NO: 903736 - protein, 271 aa, Homo sapiens
MLKDIIKEYTDVYPEIIERAGYSLEKVFGIQLKEIDKNDHLYILLSTLEPTDAGILGTTKDSPKLGLLMVLLSIIFMNGNRSSEAVIWEVLRKLGLRPGIHHSLFGDVKKLITDEFVKQKYLDYARVPNSNPPEYEFFWGLRSYYETSKMKVLKFACKVQKKDPKEWAAQYREAMEADLKAAAEAAAEAKARAEIRARMGIGLGSENAAGPCNWDEADIGPWAKARIQAGAEAKAKAQESGSASTGASTSTNNSANQWQLWCLWFLLQVRF

SEQ ID NO: 903737 - protein, 366 aa, Homo sapiens
FYLKPLIYEVEDLPCVSSYEPSQEPEAPPPRDVALLQGRANDLVKYLLAKDQTKIPIKRSDMLKDIIKEYTDVYPEIIERAGYSLEKVFGIQLKEIDKNDHLYILLSTLEPTDAGILGTTKDSPKLGLLMVLLSIIFMNGNRSSEAVIWEVLRKLGLRPGIHHSLFGDVKKLITDEFVKQKYLDYARVPNSNPPEYEFFWGLRSYYETSKMKVLKFACKVQKKDPKEWAAQYREAMEADLKAAAEAAAEAKARAEIRARMGIGLGSENAAGPCNWDEADIGPWAKARIQAGAEAKAKAQESGSASTGASTSTNNSASASASTSGGFSAGASLTATLTFGLFAGLGGSWCQHQWQLWCLWFLLQVRF

SEQ ID NO: 903738 - protein, 179 aa, Homo sapiens
MLKDIIKEYTDVYPEIIERAGYSLEKVFGIQLKEIDKNDHLYILLSTLEPTDAGILGTTKDSPKLGLLMVLLSIIFMNGNRSSEAVIWEVLRKLGLRPGIHHSLFGDVKKLITDEFVKQKYLDYARVPNSNPPEYEFFWGLRSYYETSKMKVLKFACKVQKKDPKEGADQSQSARGSSG

SEQ ID NO: 903739 - protein, 231 aa, Homo sapiens
MLKDIIKEYTDVYPEIIERAGYSLEKVFGIQLKEIDKNDHLYILLSTLEPTDAGILGTTKDSPKLGLLMVLLSIIFMNGNRSSEAVIWEVLRKLGLRPGYIIHSLGDSDRKLITDELAESPKVPCTTPRSTQQQTPRQTQNTGGQAPNHGHRQKYTPQDARNAPPRPPGRAPTPKRRTAHTEHTKTPPPQPQASPPTHATSHPPPTPPNPTHPPPPPNPPHHPPTPPPPHT

SEQ ID NO: 903740 - protein, 191 aa, Homo sapiens; identical to SEQ ID NO: 903724

SEQ ID NO: 903741 - protein, 191 aa, Homo sapiens; identical to SEQ ID NO: 903724

SEQ ID NO: 903742 - protein, 149 aa, Homo sapiens
NIGQVRGLGVEDVKVSKASGVSKATEVSKTPEAREAPATQASSTTQLTDTQVLAAENKSLAADTKKQNADPQAVTMPATETKKVSHVADTKVNTKAQETEAAPSQAPADEPEPESAAAQSQENQDTRPKVKAKKARKVKHLDGGRGWQQ

SEQ ID NO: 903743 - protein, 76 aa, Homo sapiens
RKFPPRGINPVQNPEPPDRREGRRIPNSLEDKVRGVDIGVLWRSDSGSRPLEPIARQMSNSYCTTAAEAEVTWSGV

SEQ ID NO: 903744 - protein, 305 aa, Homo sapiens; identical to SEQ ID NO: 903725

SEQ ID NO: 903745 - protein, 98 aa, Homo sapiens
MLKDIIKEYTDVYPEIIERAGYSLEKVFGIQLKEIDKNDHLYILLSTLEPTDAGILGTTKDSPKLGLLMVLLSIIFMNGNRSSEAVIWEVGGEEGYRA

SEQ ID NO: 903746 - protein, 305 aa, Homo sapiens; identical to SEQ ID NO: 903725

SEQ ID NO: 903747 - protein, 305 aa, Homo sapiens; identical to SEQ ID NO: 903725

SEQ ID NO: 903748 - protein, 320 aa, Homo sapiens
MLKDIIKEYTDVYPEIIERAGYSLEKVFGIQLKEIDKNDHLYILLSTLEPTDAGILGTTKDSPKLGLLMVLLSIIFMNGNRSSEAVIWEVLRKLGLRPGYDWALSALAVRVVLWIHHSLFGDVKKLITDEFVKQKYLDYARVPNSNPPEYEFFWGLRSYYETSKMKVLKFACKVQKKDPKEWAAQYREAMEADLKAAAEAAAEAKARAEIRARMGIGLGSENAAGPCNWDEADIGPWAKARIQAGAEAKAKAQESGSASTGASTSTNNSASASASTSGGFSAGASLTATLTFGLFAGLGGSWCQHQWQLWCLWFLLQVRF

SEQ ID NO: 903749 - protein, 305 aa, Homo sapiens; identical to SEQ ID NO: 903725

SEQ ID NO: 903750 - protein, 305 aa, Homo sapiens; identical to SEQ ID NO: 903725

SEQ ID NO: 903751 - protein, 194 aa, Homo sapiens
MSLSSQSSDLAVLASLLISTEPGYATLGVVGKESIAWASGPPGISSVRCSQHSPLADMLKDIIKEYTDVYPEIIERAGYSLEKVFGIQLKEIDKNDHLYILLSTLEPTDAGILGTTKDSPKLGLLMVLLSIIFMNGNRSSEAVIWEVLRKLGLRPGYDWALSALAVRVVLWQERTVLGLHQSGGLVERVGCWTG

SEQ ID NO: 903752 - protein, 305 aa, Homo sapiens; identical to SEQ ID NO: 903725

SEQ ID NO: 903753 - protein, 191 aa, Homo sapiens; identical to SEQ ID NO: 903724

SEQ ID NO: 903754 - protein, 424 aa, Homo sapiens
VAYTTLSKDSSIRDGKTIGEDKDPYGNYYLSGPRGQNGYNLNPVKFSLNCFLAALFMEIPGPVYVCAFGYYSFGMPKRRSQEPEAPPPRDVALLQGRANDLVKYLLAKDQTKIPIKRSDMLKDIIKEYTDVYPEIIERAGYSLEKVFGIQLKEIDKNDHLYILLSTLEPTDAGILGTTKDSPKLGLLMVLLSIIFMNGNRSSEAVIWEVLRKLGLRPGIHHSLFGDVKKLITDEFVKQKYLDYARVPNSNPPEYEFFWGLRSYYETSKMKVLKFACKVQKKDPKEWAAQYREAMEADLKAAAEAAAEAKARAEIRARMGIGLGSENAAGPCNWDEADIGPWAKARIQAGAEAKAKAQESGSASTGASTSTNNSASASASTSGGFSAGASLTATLTFGLFAGLGGSWCQHQWQLWCLWFLLQVRF

SEQ ID NO: 903755 - protein, 272 aa, Homo sapiens
MLKDIIKEYTDVYPEIIERAGYSLEKVFGIQLKEIDKNDHLYILLSTLEPTDAGILGTTKDSPKLGLLMVLLSIIFMNGNRSSEAVIWEVLRKLGLRPGIHHSLFGDVKKLITDEFVKQKYLDYARVPNSNPPEYEFFWGLRSYYETSKMKYLLAKDQTKIPIKRSDMLKDIIKEYTDVYPEIIERAGYSLEKVFGIQLKEIDKNDHLYILLSTLEPTDAGILGTTKDSPKLGLLMVLLSIIFMNGNRSSEAVIWDSETYSTQHSRQPLSIN

SEQ ID NO: 903756 - protein, 191 aa, Homo sapiens; identical to SEQ ID NO: 903724

SEQ ID NO: 903757 - protein, 191 aa, Homo sapiens; identical to SEQ ID NO: 903724

SEQ ID NO: 903758 - protein, 218 aa, Homo sapiens
MSDTSESGAGLTRFQAEASEKDSSSMMQTLLTVTQNVEVPETPKASKALEVSEDVKVSKASGVSKATEVSKTPEAREAPATQASSTTQLTDTQVLAAENKSLAADTKKQNADPQAVTMPATETKKVSHVADTKVNTKAQETEAAPSQAPADEPEPESAAAQSQENQDTRPKVKAKKARKGEALDGERMERDQSKLWNTGATVPRRRARRREGRHLPAS

SEQ ID NO: 903759 - protein, 208 aa, Homo sapiens [sequence omitted]

SEQ ID NO: 903760 - protein, 208 aa, Homo sapiens [sequence omitted]

SEQ ID NO: 903761 - protein, 208 aa, Homo sapiens [sequence omitted]

SEQ ID NO: 903762 - protein, 214 aa, Homo sapiens
MRGALGARGARWRRGRFKEAPGRGRTGVAGWRGAVSPAAAGPGGRDAASSPAQARRGRPECRSRAGAGARVLDTAGQEEFSAMREQYMRTGDGFLIVYSVTDKASFEHVDRFHQLILRVKDRESFPMILVANKVDLMHLRKITREQGKEMATKHNIPYIETSAKDPPLNVDKAFHDLVRVIRQQIPEKSQKKKKKTKWRGDRATGTHKLQCVIL

SEQ ID NO: 903763 - protein, 208 aa, Homo sapiens [sequence omitted]

SEQ ID NO: 903764 - protein, 208 aa, Homo sapiens [sequence omitted]

SEQ ID NO: 903765 - protein, 208 aa, Homo sapiens [sequence omitted]

SEQ ID NO: 903766 - protein, 208 aa, Homo sapiens [sequence omitted]

SEQ ID NO: 903767 - protein, 208 aa, Homo sapiens [sequence omitted]

SEQ ID NO: 903768 - protein, 208 aa, Homo sapiens [sequence omitted]

SEQ ID NO: 903769 - protein, 592 aa, Homo sapiens
MHTRYSVSSPDSSVSPHPRAWSCRGSYRRSRPPTSASCRPTWRASSGRPSLCAAAAGKYKKRYSELEQQLLERSGELEQQRLRDTEHSQDLQSALIRLEEEPQRSASLAQVKAMLREHLDQAGSANQALSEDIQKVTNDWTRSRKELEQREAAWRREEESFNAYFSKKHNHLLLLWRQVVGFRRLVSEVKMFTERVTELGLAVKRLQKQNPEKDQVNTDLTEKLEALSVLSDTERRPAERLQRTADDSFGSLRGLSAQQTPSPPRRSSPGRGRSPRRGPSPACSDSSTLALIHSTLHKHELQVQDMRGRYEASQDLLGTLRKQLSDSESERRALEEQLQRLRDKTDSTMQAHEDAQREVQRLRSAKELLRREKSNLAHSLQVAQQQAKELRQERKKLQAAQEELRRQRYWLGEEQEDAVQDGVRVRRELERSHRQLEQLEGKRSVLAKELVEVREALSRATLQRDMLQAEKAEVAEALTKAEGRGGLPAGLPVQAERPQREPCSGQVGSEPPCHPGHSWRKKSAPCRAGSGRRSRRPQWHGKSRSGWRRCGWNRRWRGRAWRAPYERRSRPRRQWSSSSPRCIMSAAGCRSS

SEQ ID NO: 903770 - protein, 663 aa, Homo sapiens
MHTRYSVSSPDSSVSPHPRAWSCRGSYRRSRPPTSASCRPTWRASSGRPSLCAAAAGKYKKRYSELEQQLLERSGELEQQRLRDTEHSQDLQSALIRLEEEPQRSASLAQVKAMLREHLDQAGSANQALSEDIQKVTNDWTRSRKELEQREAAWRREEEDLLQLGGELARTSRAVQEAGLGLSTGLWLAESRAKAALEKQALLQAQLEEQLRDKVLHQKDLAQQQMQSDLDKADLSARVTELGLAVKRLQKQNPEKDQVNTDLTEKLEALESLRLQEQVALETEDGEGLQQSLRDLAQSVLSDTERRPAERLQRTADDSFGSLRGLSAQQTPSPPRRSSPGRGRSPRRGPSPACSDSSTLALIHSTLHKHELQVQDMRGRYEASQDLLGTLRKQLSDSESERRALEEQLQRLRDKTDSTMQAHEDAQREVQRLRSAKELLRREKSNLAHSLQVAQQQAKELRQERKKLQAAQEELRRQRYWLGEEQEDAVQDGVRVRRELERSHRQLEQLEGKRSVLAKELVEVREALSRATLQRDMLQAEKAEVAEALTKAEGRGGLPAGLPVQAERPQREPCSGQVGSEPPCHPGHSWRKKSAPCRAGSGRRSRRPQWHGKSRSGWRRCGWNRRWRGRAWRAPYERRSRPRRQWSSSSPRCIMSAAGCRSS

SEQ ID NO: 903771 - protein, 799 aa, Homo sapiens
MELNFYKIPDNLPFSTKNLDLSFNPLRHLGSYSFFSFPELQVLDLSRCEIQTIEDGAYQSLSHLSTLILTGNPIQSLALGAFSGLSSLQKLVAVETNLASLENFPIGHLKTLKELNVAHNLIQSFKLPEYFSNLTNLEHLDLSSNKIQSIYCTDLRVLHQMPLLNLSLDLSLNPMNFIQPGAFKEIRLHKLTLRNNFDSLNVMKTCIQGLAGLEVHRLVLGEFRNEGNLEKFDKSALEGLCNLTIEEFRLAYLDYYLDDIIDLFNCLTNVSSFSLVSVTIERVKDFSYNFGWQHLELVNCKFGQFPTLKLKSLKRLTFTSNKGGNAFSEVDLPSLEFLDLSRNGLSFKGCCSQSDFGTTSLKYLDLSFNGVITMSSNFLGLEQLEHLDFQHSNLKQMSEFSVFLSLRNLIYLDISHTHTRVAFNGIFNGLSSLEVLKMAGNSFQENFLPDIFTELRNLTFLDLSQCQLEQLSPTAFNSLSSLQVLNMSHNNFFSLDTFPYKCLNSLQVLDYSLNHIMTSKKQELQHFPSSLAFLNLTQNDFACTCEHQSFLQWIKDQRQLLVEVERMECATPSDKQGMPVLSLNITCQMNKTIIGVSVLSVLVVSVVAVLVYKFYFHLMLLAGCIKYGRGENIYDAFVIYSSQDEDWVRNELVKNLEEGVPPFQLCLHYRDFIPGVAIAANIIHEGFHKSRKVIVVVSQHFIQSRWCIFEYEIAQTWQFLSSRAGIIFIVLQKVEKTLLRQQVELYRLLSRNTYLEWEDSVLGRHIFWRRLRKALLDGKSWNPEGTVGTGCNWQEATSI

SEQ ID NO: 903772 - protein, 799 aa, Homo sapiens; identical to SEQ ID NO: 903771

SEQ ID NO: 903773 - protein, 639 aa, Homo sapiens
MPLLNLSLDLSLNPMNFIQPGAFKEIRLHKLTLRNNFDSLNVMKTCIQGLAGLEVHRLVLGEFRNEGNLEKFDKSALEGLCNLTIEEFRLAYLDYYLDDIIDLFNCLTNVSSFSLVSVTIERVKDFSYNFGWQHLELVNCKFGQFPTLKLKSLKRLTFTSNKGGNAFSEVDLPSLEFLDLSRNGLSFKGCCSQSDFGTTSLKYLDLSFNGVITMSSNFLGLEQLEHLDFQHSNLKQMSEFSVFLSLRNLIYLDISHTHTRVAFNGIFNGLSSLEVLKMAGNSFQENFLPDIFTELRNLTFLDLSQCQLEQLSPTAFNSLSSLQVLNMSHNNFFSLDTFPYKCLNSLQVLDYSLNHIMTSKKQELQHFPSSLAFLNLTQNDFACTCEHQSFLQWIKDQRQLLVEVERMECATPSDKQGMPVLSLNITCQMNKTIIGVSVLSVLVVSVVAVLVYKFYFHLMLLAGCIKYGRGENIYDAFVIYSSQDEDWVRNELVKNLEEGVPPFQLCLHYRDFIPGVAIAANIIHEGFHKSRKVIVVVSQHFIQSRWCIFEYEIAQTWQFLSSRAGIIFIVLQKVEKTLLRQQVELYRLLSRNTYLEWEDSVLGRHIFWRRLRKALLDGKSWNPEGTVGTGCNWQEATSI

SEQ ID NO: 903774 - protein, 873 aa, Homo sapiens
EDTSASETARSDGDSEPRIHRATAAHRSSEDDARMMSASRLAGTLIPAMAFLSCVRPESWEPCVEVVPNITYQCMELNFYKIPDNLPFSTKNLDLSFNPLRHLGSYSFFSFPELQVLDLSRCEIQTIEDGAYQSLSHLSTLILTGNPIQSLALGAFSGLSSLQKLVAVETNLASLENFPIGHLKTLKELNVAHNLIQSFKLPEYFSNLTNLEHLDLSSNKIQSIYCTDLRVLHQMPLLNLSLDLSLNPMNFIQPGAFKEIRLHKLTLRNNFDSLNVMKTCIQGLAGLEVHRLVLGEFRNEGNLEKFDKSALEGLCNLTIEEFRLAYLDYYLDDIIDLFNCLTNVSSFSLVSVTIERVKDFSYNFGWQHLELVNCKFGQFPTLKLKSLKRLTFTSNKGGNAFSEVDLPSLEFLDLSRNGLSFKGCCSQSDFGTTSLKYLDLSFNGVITMSSNFLGLEQLEHLDFQHSNLKQMSEFSVFLSLRNLIYLDISHTHTRVAFNGIFNGLSSLEVLKMAGNSFQENFLPDIFTELRNLTFLDLSQCQLEQLSPTAFNSLSSLQVLNMSHNNFFSLDTFPYKCLNSLQVLDYSLNHIMTSKKQELQHFPSSLAFLNLTQNDFACTCEHQSFLQWIKDQRQLLVEVERMECATPSDKQGMPVLSLNITCQMNKTIIGVSVLSVLVVSVVAVLVYKFYFHLMLLAGCIKYGRGENIYDAFVIYSSQDEDWVRNELVKNLEEGVPPFQLCLHYRDFIPGVAIAANIIHEGFHKSRKVIVVVSQHFIQSRWCIFEYEIAQTWQFLSSRAGIIFIVLQKVEKTLLRQQVELYRLLSRNTYLEWEDSVLGRHIFWRRLRKALLDGKSWNPEGTVGTGCNWQEATSI

SEQ ID NO: 903775 - protein, 799 aa, Homo sapiens; identical to SEQ ID NO: 903771

SEQ ID NO: 903776 - protein, 104 aa, Homo sapiens
QNAKVAAFTSSHPLAQNCFEYTNCCGAARGREDTSASETARSDGDSEPRIHRATAAHRSSEDDARMMSASRLAGTLIPAMAFLSCVRPESWEPCVEVCGWSQLL

SEQ ID NO: 903777 - protein, 672 aa, Homo sapiens
PNGVALLHLPGAAVIPNTNYMFQDALGGRSRGSREESPAPSRAPASASLWRRLVVVEAKMAAQAAAAAQAAAAQAAQAEAADSWYLALLGFAEHFRTSSPPKIRLCVHCLQAVFPFKPPQRIEARTHLQLGSVLYHHTKNSEQARSHLEKAWLISQQIPQFEDVKFEAASLLSELYCQENSVDAAKPLLRKAIQISQQTPYWHCRLLFQLAQLHTLEKDLVSACDLLGVGAEYARVVGSEYTRALFLLSKGMLLLMERKLQEVHPLLTLCGQIVENWQGNPIQKESLRVFFLVLQVTHYLDAGQVKSVKPCLKQLQQCIQTISTLHDDEILPSNPADLFHWLPKEHMCVLVYLVTVMHSMQAGYLEKAQKYTDKALMQLEKLKMLDCSPILSSFQVILLEHIIMCRLVTGHKATALQEISQVCQLCQQSPRLFSNHAAQLHTLLGLYCVSVNCMDNAEAQFTTALRLTNHQELWAFIVTNLASVYIREGNRHQEVLYSLLERINPDHSFPVSSHCLRAAAFYVRGLFSFFQGRYNEAKRFLRETLKMSNAEDLNRLTACSLVLLGHIFYVLGNHRESNNMVVPAMQLASKIPDMSVQLWSSALLRDLNKACGNAMDAHEAAQMHQNFSQQLLQDHIEACSLPEHNLITWTDGPPPVQFQAQNGPNTSLASLL

SEQ ID NO: 903778 - protein, 974 aa, Homo sapiens
PNGVALLHLPGAAVIPNTNYMFQDALGGRSRGSREESPAPSRAPASASLWRRLVVVEAKMAAQAAAAAQAAAAQAAQAEAADSWYLALLGFAEHFRTSSPPKIRLCVHCLQAVFPFKPPQRIEARTHLQLGSVLYHHTKNSEQARSHLEKAWLISQQIPQFEDVKFEAASLLSELYCQENSVDAAKPLLRKAIQISQQTPYWHCRLLFQLAQLHTLEKDLVSACDLLGVGAEYARVVGSEYTRALFLLSKGMLLLMERKLQEVHPLLTLCGQIVENWQGNPIQKESLRVFFLVLQVTHYLDAGQVKSVKPCLKQLQQCIQTISTLHDDEILPSNPADLFHWLPKEHMCVLVYLVTVMHSMQAGYLEKAQKYTDKALMQLEKLKMLDCSPILSSFQVILLEHIIMCRLVTGHKATALQEVRLEAGGAGRPRSLLGLSSVRQETEFTKCILAGQPILLSRCRPAFYSPAWAPLIRESHTKTSGGRAQWLTPVIPAVWEAEAGGSLEARSLRPAWPTWRNPASTKNIKISQVWWQTPVIPVLERLRQENSLNPGGRGCSEPRSHYCTPTWATEGDSISKKKTQKTNGPWPKSLHTKGIAHMVSGDLGGPLTVIVIPHPAIRNTLPPVPTLLRGHGGPQQAGGPLQPRHLLDRVEETSNRQGSLSTMGSGLPFALMVDVSAGALYPSLVRQDMGSPTSYGVSPLLLRRQVPGCSPVMAVHSLPADLPGLPAVPAVPPALLQPCSTAAHIAGPVCVSVNCMDNAEAQFTTALRLTNHQELWAFIVTNLASVYIREGNRHQEVLYSLLERINPDHSFPVSSHCLRAAAFYVRGLFSFFQGRYNEAKRFLRETLKMSNAEDLNRLTACSLVLLGHIFYVLGNHRESNNMVVPAMQLASKIPDMSVQLWSSALLRDLNKACGNAMDAHEAAQMHQNFSQQLLQDHIEACSLPEHNLITWTDGPPPVQFQAQNGPNTSLASLL

SEQ ID NO: 903779 - protein, 984 aa, Homo sapiens
PNGVALLHLPGAAVIPNTNYMFQDALGGRSRGSREESPAPSRAPASASLWRRLVVVEAKMAAQAAAAAQAAAAQAAQAEAADSWYLALLGFAEHFRTSSPPKIRLCVHCLQAVFPFKPPQRIEARTHLQLGSVLYHHTKNSEQARSHLEKAWLISQQIPQFEDVKFEAASLLSELYCQENSVDAAKPLLRKAIQISQQTPYWHCRLLFQLAQLHTLEKDLVSACDLLGVGAEYARVVGSEYTRALFLLSKGMLLLMERKLQEVHPLLTLCGQIVENWQGNPIQKESLRVFFLVLQVTHYLDAGQVKSVKPCLKQLQQCIQTISTLHDDEILPSNPADLFHWLPKEHMCVLVYLVTVMHSMQAGYLEKAQKYTDKALMQLEKLKMLDCSPILSSFQVILLEHIIMCRLVTGHKATALQEVRLEAGGAGRPRSLLGLSSVRQETEFTKCILAGQPILLSRCRPAFYSPAWAPLIRESHTKTSGGRAQWLTPVIPAVWEAEAGGSLEARSLRPAWPTWRNPASTKNIKISQVWWQTPVIPVLERLRQENSLNPGGRGCSEPRSHYCTPTWATEGDSISKKKTQKTNGPWPKSLHTKGIAHMVSGDLGGPLTVIVIPHPAIRNTLPPVPTLLRGHGGPQQAGGPLQPRHLLDRVEETSNRQGSLSTMGSGLPFALMVDVSAGALYPSLVRQDMGSPTSYGVSPLLLRRQVPGCSPVMAVHSLPADLPGLPAVPAVPPALLQPCSTAAHIAGPVCVSVNCMDNAEAQFTTALRLTNHQELWAFIVTNLASVYIREGNRHQEVLYSLLERINPDHSFPVSSHCLRAAAFYVRGLFSFFQGRYNEAKRFLRETLKMSNAEDLNRLTACSLVLLGHIFYVLGNHRESNNMVVPAMQLASKIPDMSVQLWSSALLRDLNKACGNAMDAHEAAQMHQNFSQQLLQDHIEACSLPEHNLITVRVWVLGDGIRTSGLPTCKRKGHLGCISLLSNKP

SEQ ID NO: 903780 - protein, 984 aa, Homo sapiens; identical to SEQ ID NO: 903779

SEQ ID NO: 903781 - protein, 974 aa, Homo sapiens; identical to SEQ ID NO: 903778

SEQ ID NO: 903782 - protein, 974 aa, Homo sapiens; identical to SEQ ID NO: 903778

SEQ ID NO: 903783 - protein, 672 aa, Homo sapiens; identical to SEQ ID NO: 903777

SEQ ID NO: 903784 - protein, 312 aa, Homo sapiens
MGSGLPFALMVDVSAGALYPSLVRQDMGSPTSYGVSPLLLRRQVPGCSPVMQYTLSRQISQVCQLCQQSPRLFSNHAAQLHTLLGLYCVSVNCMDNAEAQFTTALRLTNHQELWAFIVTNLASVYIREGNRHQEVLYSLLERINPDHSFPVSSHCLRAAAFYVRGLFSFFQGRYNEAKRFLRETLKMSNAEDLNRLTACSLVLLGHIFYVLGNHRESNNMVVPAMQLASKIPDMSVQLWSSALLRDLNKACGNAMDAHEAAQMHQNFSQQLLQDHIEACSLPEHNLITWTDGPPPVQFQAQNGPNTSLASLL

SEQ ID NO: 903785 - protein, 974 aa, Homo sapiens; identical to SEQ ID NO: 903778

SEQ ID NO: 903786 - protein, 974 aa, Homo sapiens; identical to SEQ ID NO: 903778

SEQ ID NO: 903787 - protein, 102 aa, Homo sapiens
LDRVEETSNRQGSLSTMGSGLPFALMVDVSAGALYPSLVRQDMGSPTSYGVSPLLLRRQVPGCSPVMAVHSLPADLPGLPAVPAVPPALLQPCSTAAHIAGE

SEQ ID NO: 903788 - protein, 744 aa, Homo sapiens
GGGRYGADKMAAGGAVAAAPECRLLPYALHKWSSFSSTYLPENILVDKPNDQSSRWSSESNYPPQYLILKLERPAIVQNITFGKYEKTHVCNLKKFKVFGGMNEENMTELLSSGLKNDYNKETFTLKHKIDEQMFPCRFIKIVPLLSWGPSFNFSIWYVELSGIDDPDIVQPCLNWYSKYREQEAIRLCLKHFRQHNYTEAFESLQKKTKIALEHPMLTDIHDKLVLKGDFDACEELIEKAVNDGLFNQYISQQEYKPRWSQIIPKSTKGDGEDNRPGMRGGHQMVIDVQTETVYLFGGWDGTQDLADFWAYSVKENQWTCISRDTEKENGPSARSCHKMCIDIQRRQIYTLGRYLDSSVRNSKSLKSDFYRYDIDTNTWMLLSEDTAADGGPKLVFDHQMCMDSEKHMIYTFGGRILTCNGSVDDSRASEPQFSGLFAFNCQCQTWKLLREDSCNAGPEDIQSRIGHCMLFHSKNRCLYVFGGQRSKTYLNDFFSYDVDSDHVDIISDGTKKDSGMVPMTGFTQRATIDPELNEIHVLSGLSKDKEKREENVRNSFWIYDIVRNSWSCVYKNDQAAKDNPTKSLQEEEPCPRFAHQLVYDELHKVHYLFGGNPGKSCSPKMRLDDFWSLKLCRPSKDYLLRHCKYLIRKHRFEEKAQVDPLSALKYLQNDLYITVDHSDPEETKEFQLLASALFKSGSDFTALGFSDVDHTYAQRTQLFDTLVNFFPDSMTPPKGNLVDLITL

SEQ ID NO: 903789 - protein, 744 aa, Homo sapiens; identical to SEQ ID NO: 903788

SEQ ID NO: 903790 - protein, 705 aa, Homo sapiens
GGGRYGADKMAAGGAVAAAPECRLLPYALHKWSSFSSTYLPENILVDKPNDQSSRWSSESNYPPQYLILKLERPAIVQNITFGKYEKTHVCNLKKFKVFGGMNEENMTELLSSGLKNDYNKETFTLKHKIDEQMFPCRFIKIVPLLSWGPSFNFSIWYVELSGIDDPDIVQPCLNWYSKYREQEAIRLCLKHFRQHNYTEAFESLQKKTKIALEHPMLTDIHDKLVLKGDFDACEELIEKAVNDGLFNQYISQQEYKPRWSQIIPKSTKGDGEDNRPGMRGGHQMVIDVQTETVYLFGGWDGTQDLADFWAYSVKENQWTCISRDTEKENGPSARSCHKMCIDIQRRQIYTLGRYLDSSVRNSKSLKSDFYRYDIDTNTWMLLSEDTAADGGPKLVFDHQMCMDSEKHMIYTFGGRILTCNGSVDDSRASEPQFSGLFAFNCQCQTWKLLREDSCNAGPEDIQSRIGHCMLFHSKNRCLYVFGGQRSKTYLNDFFSYDVDSDHVDIISDGTKKDSGMVPMTGFTQRATIDPELNEIHVLSGLSKDKEKREENVRNSFWIYDIVRNSWSCVYKNDQAAKDNPTKSLQEEEPCPRFAHQLVYDELHKVHYLFGGNPGKSCSPKMRLDDFWSLKLCRPSKDYLLRHCKYLIRKHRFEEKAQVDPLSALKYLQNDLYITVDHSDPEETKEFQLLASALFKSGSDFTALA

SEQ ID NO: 903791 - protein, 691 aa, Homo sapiens
GGGRYGADKMAAGGAVAAAPECRLLPYALHKWSSFSSTYLPENILVDKPNDQSSRWSSESNYPPQYLILKLERPAIVQNITFGKYEKTHVCNLKKFKVFGGMNEENMTELLSSGLKNDYNKETFTLKHKIDEQMFPCRFIKIVPLLSWGPSFNFSIWYVELSGIDDPDIVQPCLNWYSKYREQEAIRLCLKHFRQHNYTEAFESLQKKTKIALEHPMLTDIHDKLVLKGDFDACEELIEKAVNDGLFNQYISQQEYKPRWSQIIPKSTKGDGEDNRPGMRGGHQMVIDVQTETVYLFGGWDGTQDLADFWAYSVKENQWTCISRDTEKENGPSARSCHKMCIDIQRRQIYTLGRYLDSSVRNSKSLKSDFYRYDIDTNTWMLLSEDTAADGGPKLVFDHQMCMDSEKHMIYTFGGRILTCNGSVDDSRASEPQFSGLFAFNCQCQTWKLLREDSCNAGPEDIQSRIGHCMLFHSKNRCLYVFGGQRSKTYLNDFFSYDVDSDHVDIISDGTKKDSGMVPMTGFTQRATIDPELNEIHVLSGLSKDKEKREENVRNSFWIYDIVRNSWSCVYKNDQAAKDNPTKSLQEEEPCPRFAHQLVYDELHKVHYLFGGNPGKSCSPKMRLDDFWSLKLCRPSKDYLLRHCKYLIRKHRFEEKAQVDPLSALKYLQNDLYITVDHSDPEETKEASLFI

SEQ ID NO: 903792 - protein, 280 aa, Homo sapiens
GGGRYGADKMAAGGAVAAAPECRLLPYALHKWSSFSSTYLPENILVDKPNDQSSRWSSESNYPPQYLILKLERPAIVQNITFGKYEKTHVCNLKKFKVFGGMNEENMTELLSSGLKNDYNKETFTLKHKIDEQMFPCRFIKIVPLLSWGPSFNFSIWYVELSGIDDPDIVQPCLNWYSKYREQEAIRLCLKHFRQHNYTEAFESLQKKTKIALEHPMLTDIHDKLVLKGDFDACEELIEKAVNDGLFNQYISQQEYKPRWSQIIPLMISGLSFIQSVWTF

SEQ ID NO: 903793 - protein, 695 aa, Homo sapiens
GGGRYGADKMAAGGAVAAAPECRLLPYALHKWSSFSSTYLPENILVDKPNDQSSRWSSESNYPPQYLILKLERPAIVQNITFGKYEKTHVCNLKKFKVFGGMNEENMTELLSSGLKNDYNKETFTLKHKIDEQMFPCRFIKIVPLLSWGPSFNFSIWYVELSGIDDPDIVQPCLNWYSKYREQEAIRLCLKHFRQHNYTEAFESLQKKTKIALEHPMLTDIHDKLVLKGDFDACEELIEKAVNDGLFNQYISQQEYKPRWSQIIPKSTKGDGEDNRPGMRGGHQMVIDVQTETVYLFGGWDGTQDLADFWAYSVKENQWTCISRDTEKENGPSARSCHKMCIDIQRRQIYTLGRYLDSSVRNSKSLKSDFYRYDIDTNTWMLLSEDTAADGGPKLVFDHQMCMDSEKHMIYTFGGRILTCNGSVDDSRASEPQFSGLFAFNCQCQTWKLLREDSCNAGPEDIQSRIGHCMLFHSKNRCLYVFGGQRSKTYLNDFFSYDVDSDHVDIISDGTKKDSGMVPMTGFTQRATIDPELNEIHVLSGLSKDKEKREENVRNSFWIYDIVRNSWSCVYKNDQAAKDNPTKSLQEEEPCPRFAHQLVYDELHKVHYLFGGNPGKSCSPKMRLDDFWSLKLCRPSKDYLLRHCKYLIRKHRFEEKAQVDPLSALKYLQNDLYIISAPGISSIQIWFRFYSSGLF

SEQ ID NO: 903794 - protein, 744 aa, Homo sapiens; identical to SEQ ID NO: 903788

SEQ ID NO: 903795 - protein, 715 aa, Homo sapiens
GGGRYGADKMAAGGAVAAAPECRLLPYALHKWSSFSSTYLPENILVDKPNDQSSRWSSESNYPPQYLILKLERPAIVQNITFGKYEKTHVCNLKKFKVFGGMNEENMTELLSSGLKNDYNKETFTLKHKIDEQMFPCRFIKIVPLLSWGPSFNFSIWYVELSGIDDPDIVQPCLNWYSKYREQEAIRLCLKHFRQHNYTEAFESLQKKTKIALEHPMLTDIHDKLVLKGDFDACEELIEKAVNDGLFNQYISQQEYKPRWSQIIPKSTKGDGEDNRPGMRGGHQMVIDVQTETVYLFGGWDGTQDLADFWAYSVKENQWTCISRDTEKENGPSARSCHKMCIDIQRRQIYTLGRYLDSSVRNSKSLKSDFYRYDIDTNTWMLLSEDTAADGGPKLVFDHQMCMDSEKHMIYTFGGRILTCNGSVDDSRASEPQFSGLFAFNCQCQTWKLLREDSCNAGPEDIQSRIGHCMLFHSKNRCLYVFGGQRSKTYLNDFFSYDVDSDHVDIISDGTKKDSGMVPMTGFTQRATIDPELNEIHVLSGLSKDKEKREENVRNSFWIYDIVRNSWSCVYKNDQAAKDNPTKSLQEEEPCPRFAHQLVYDELHKVHYLFGGNPGKSCSPKMRLDDFWSLKLCRPSKDYLLRHCKYLIRKHRFEEKAQVDPLSALKYLQNDLYITVDHSDPEETKEVKKGGNKFQKLSIFKCLPNLYLMILLLSV

SEQ ID NO: 903796 - protein, 307 aa, Homo sapiens
MGTVLSLSPSYRKATLFEDGAATVGHYTAVQNSKNAKDKNLKRHSIISVLPWKRIVAVSAKKKNSKKVQPNSSYQNNITHLNNENLKKSLSCANLSTFAQPPPAQPPAPPASQLSGSQTGGSSSVKKAPHPAVTSAGTPKRVIVQASTSELLRCLGEFLCRRCYRLKHLSPTDPVLWLRSVDRSLLLQGWQDQGFITPANVVFLYMLCRDVISSEVGSDHELQAVLLTCLYLSYSYMGNEISYPLKPFLVESCKEAFWDRCLSVINLMSSKMLQINADPHYFTQVFSDLKNESGQEDKKRLLLGLDR

SEQ ID NO: 903797 - protein, 173 aa, Homo sapiens [sequence omitted]

SEQ ID NO: 903798 - protein, 307 aa, Homo sapiens; identical to SEQ ID NO: 903796

SEQ ID NO: 903799 - protein, 307 aa, Homo sapiens; identical to SEQ ID NO: 903796

SEQ ID NO: 903800 - protein, 351 aa, Homo sapiens [sequence omitted]

SEQ ID NO: 903801 - protein, 351 aa, Homo sapiens [sequence omitted]

SEQ ID NO: 903802 - protein, 351 aa, Homo sapiens [sequence omitted]

SEQ ID NO: 903803 - protein, 351 aa, Homo sapiens [sequence omitted]

SEQ ID NO: 903804 - protein, 316 aa, Homo sapiens
MADQDPAGISPLQQMVASGTGAVVTSLFRKCLLYCNGVLEPLYLCPNGARCATWFQDPTRFTGTMDAFVKIVRHEGTRTLWSGLPATLVMTVPATAIYFTAYDQLKAFLCGRALTSDLYAPMVAGALARLGTVTVISPLELMRTKLQAQHVSYRELGACVRTAVAQGGWRSLWLGWGPTALRDVPFSALYWFNYELVKSWLNGLRPKDQTSVGMSFVAGGISGTVAAVLTLPFDVVKTQRQVALGAMEAVRVNPLHVDSTWLLLRRIRAESGTKGLFAGFLPRIIKAAPSCAIMISTYEFGKSFFQRLNQDRLLGG

SEQ ID NO: 903805 - protein, 351 aa, Homo sapiens [sequence omitted]

SEQ ID NO: 903806 - protein, 357 aa, Homo sapiens
MADQDPAGISPLQQMVASGTGAVVTSLFMTPLDVVKVRLQSQRPSMASELMPSSRLWSLSYTKWKCLLYCNGVLEPLYLCPNGARCATWFQDPTRFTGTMDAFVKIVRHEGTRTLWSGLPATLVMTVPATAIYFTAYDQLKAFLCGRALTSDLYAPMVAGALARLGTVTVISPLELMRTKLQAQHVSYRELGACVRTAVAQGGWRSLWLGWGPTALRDVPFSVHPPPQALYWFNYELVKSWLNGLRPKDQTSVGMSFVAGGISGTVAAVLTLPFDVVKTQRQVALGAMEAVRVNPLHVDSTWLLLRRIRAESGTKGLFAGFLPRIIKAAPSCAIMISTYEFGKSFFQRLNQDRLLGG

SEQ ID NO: 903807 - protein, 258 aa, Homo sapiens
MVSWSLCTCAQMVPAVPPGFKTLPASLAPWVMTVPATAIYFTAYDQLKAFLCGRALTSDLYAPMVAGALARLGTVTVISPLELMRTKLQAQHVSYRELGACVRTAVAQGGWRSLWLGWGPTALRDVPFSALYWFNYELVKSWLNGLRPKDQTSVGMSFVAGGISGTVAAVLTLPFDVVKTQRQVALGAMEAVRVNPLHVDSTWLLLRRIRAESGTKGLFAGFLPRIIKAAPSCAIMISTYEFGKSFFQRLNQDRLLGG

SEQ ID NO: 903808 - protein, 419 aa, Homo sapiens
MADQDPAGISPLQQMVASGTGAVVTSLFMTPLDVVKVRLQSQRPSMASELMPSSRLWSLSYTKWKCLLYCNGVLEPLYLCPNGARCATWFQDPTRFTGTMDAFVKIVRHEGTRTLWSGLPATLVMTVPATAIYFTAYDQLKAFLCGRALTSDLYAPMVAGALARREHSLVAFDLPLSPPRPKPSQSQLPAPTSASLGIGGCSRSPDLGQQVGDAMLRPVISLLPIVTPNPHTVGTVTVISPLELMRTKLQAQHVSYRELGACVRTAVAQGGWRSLWLGWGPTALRDVPFSALYWFNYELVKSWLNGLRPKDQTSVGMSFVAGGISGTVAAVLTLPFDVVKTQRQVALGAMEAVRVNPLHVDSTWLLLRRIRAESGTKGLFAGFLPRIIKAAPSCAIMISTYEFGKSFFQRLNQDRLLGG

SEQ ID NO: 903809 - protein, 195 aa, Homo sapiens
MADQDPAGISPLQQMVASGTGAVVTSLFMTPLDVVKVRLQSQRPSMASELMPSSRLWSLSYTKWKCLLYCNGVLEPLYLCPNGARCATWFQDPTRFTGTMDAFVKIVRHEGTRTLWSGLPATLVMTVPATAIYFTAYDQLKAFLCGRALTSDLYAPMVAGALARREHSLGPLTSLCPHLGPNPVSPSSQPQPLPA

SEQ ID NO: 903810 - protein, 195 aa, Homo sapiens; identical to SEQ ID NO: 903809

SEQ ID NO: 903811 - protein, 271 aa, Homo sapiens
MADQDPAGISPLQQMVASGTGAVVTSLFMTPLDVVKVRLQSQRPSMASELMPSSRLWSLSYTKWKCLLYCNGVLEPLYLCPNGARCATWFQDPTRFTGTMDAFVKIVRHEGTRTLWSGLPATLVMTVPATAIYFTAYDQLKAFLCGRALTSDLYAPMVAGALARLGTVTVISPLELMRTVAAVLTLPFDVVKTQRQVALGAMEAVRVNPLHVDSTWLLLRRIRAESGTKGLFAGFLPRIIKAAPSCAIMISTYEFGKSFFQRLNQDRLLGG

SEQ ID NO: 903812 - protein, 279 aa, Homo sapiens
MADQDPAGISPLQQMVASGTGAVVTSLFMTPLDVVKVRLQSQRPSMASELMPSSRLWSLSYTKLPSSLQSTGKCLLYCNGVLEPLYLCPNGARCATWFQDPTRFTGTMDAFVKIVRHEGTRTLWSGLPATLVMTVPATAIYFTAYDQLKAFLCGRALTSDLYAPMVAGALARLGTVTVISPLELMRTVAAVLTLPFDVVKTQRQVALGAMEAVRVNPLHVDSTWLLLRRIRAESGTKGLFAGFLPRIIKAAPSCAIMISTYEFGKSFFQRLNQDRLLGG

SEQ ID NO: 903813 - protein, 351 aa, Homo sapiens [sequence omitted]

SEQ ID NO: 903814 - protein, 359 aa, Homo sapiens [sequence omitted]

SEQ ID NO: 903815 - protein, 351 aa, Homo sapiens [sequence omitted]

SEQ ID NO: 903816 - protein, 351 aa, Homo sapiens [sequence omitted]

SEQ ID NO: 903817 - protein, 424 aa, Homo sapiens
MADQDPAGISPLQQMVASGTGAVVTSLFMTPLDVVKVRLQSQRPSMASELMPSSRLWSLSYTKWKCLLYCNGVLEPLYLCPNGARCATWFQDPTRFTGTMDAFVKIVRHEGTRTLWSGLPATLVMTVPATAIYFTAYDQLKAFLCGRALTSDLYAPMVAGALARLGTVTVISPLELMRTKLQAQHVSYRELGACVRTAVAQGGWRSLWLGWGPTALRDVPFSALYWFNYELVKSWLNGLRPKDQTSVGMSFVAGGISGTVAAVLTLPFDVVKTQRQVALGAMEAVRVNPLHVDSTWLLLRRIRAESGTKGLFAGFLPRIIKAAPSCAIMISTYEFGKSPVSPTDGERAGGDPAKCLFLSTEGGGLFPFPPGDKLQGRAVPLGGPALPQTQLLPAAPVVGIITYPPPKFKTKSSSCPLRVSLCLL

SEQ ID NO: 903818 - protein, 460 aa, Homo sapiens
MADQDPAGISPLQQMVASGTGAVVTSLFMTPLDVVKVRLQSQRPSMASELMPSSRLWSLSYTKWKCLLYCNGVLEPLYLCPNGARCATWFQDPTRFTGTMDAFVKIVRHEGTRTLWSGLPATLVMTVPATAIYFTAYDQLKAFLCGRALTSDLYAPMVAGALARLGTVTVISPLELMRTKLQAQHVSYRELGACVRTAVAQGGWRSLWLGWGPTALRDVPFSGRHPSCRGWVREPWGDCTKGLQPSPSFVTSDHEVTSAFLSHGFLICEVGLAGRVFAQAVRRLIPTECLLLSLHVADKTHSWEGVVAVKGGRSGATSLPFPSLTVHPPPQALYWFNYELVKSWLNGLRPKDQTSVGMSFVAGGISGTVAAVLTLPFDVVKTQRQVALGAMEAVRVNPLHVDSTWLLLRRIRAESGTKGLFAGFLPRIIKAAPSCAIMISTYEFGKSFFQRLNQDRLLGG

SEQ ID NO: 903819 - protein, 341 aa, Homo sapiens
MADQDPAGISPLQQMVASGTGAVVTSLFMTPLDVVKVRLQSQRPSMASELMPSSRLWSLSYTKWKCLLYCNGVLEPLYLCPNGARCATWFQDPTRFTGTMDAFVKIVRHEGTRTLWSGLPATLVMTVPATAIYFTAYDQLKAFLCGRALTSDLYVGTVTVISPLELMRTKLQAQHVSYRELGACVRTAVAQGGWRSLWLGWGPTALRDVPFSALYWFNYELVKSWLNGLRPKDQTSVGMSFVAGGISGTVAAVLTLPFDVVKTQRQVALGAMEAVRVNPLHVDSTWLLLRRIRAESGTKGLFAGFLPRIIKAAPSCAIMISTYEFGKSFFQRLNQDRLLGG

SEQ ID NO: 903820 - protein, 279 aa, Homo sapiens
MADQDPAGISPLQQMVASGTGAVVTSLFMTPLDVVKVRLQSQRPSMASELMPSSRLWSLSYTKWKCLLYCNGVLEPLYLCPNGARCATWFQDPTRFTGTMDAFVKIVRHEGTRTLWSGLPATLVMTVPATAIYFMWLGWGPTALRDVPFSALYWFNYELVKSWLNGLRPKDQTSVGMSFVAGGISGTVAAVLTLPFDVVKTQRQVALGAMEAVRVNPLHVDSTWLLLRRIRAESGTKGLFAGFLPRIIKAAPSCAIMISTYEFGKSFFQRLNQDRLLGG

SEQ ID NO: 903821 - protein, 264 aa, Homo sapiens
MVSWSLCTCAQMVPAVPPGFKTLPASLAPWVMTVPATAIYFTAYDQLKAFLCGRALTSDLYAPMVAGALARLGTVTVISPLELMRTKLQAQHVSYRELGACVRTAVAQGGWRSLWLGWGPTALRDVPFSVHPPPQALYWFNYELVKSWLNGLRPKDQTSVGMSFVAGGISGTVAAVLTLPFDVVKTQRQVALGAMEAVRVNPLHVDSTWLLLRRIRAESGTKGLFAGFLPRIIKAAPSCAIMISTYEFGKSFFQRLNQDRLLGG

SEQ ID NO: 903822 - protein, 253 aa, Homo sapiens
MADQDPAGISPLQQMVASGTGAVVTSLFMTPLDVVKVRLQSQRPSMASGKCLLYCNGVLEPLYLCPNGARCATWFQDPTRFTGTMDAFVKIVRHEGTRTLWSGLPATLVMTVPATAIYFTAYDQLKAFLCGRALTSDLYAPMVAGALARLGTVTVISPLELMRTKLQAQHVSYRELGACVRTAVAQGGWRSLWLGWGPTALRDVPFSACLCSTMSCCRPWLKGLRPMSRLLVGQLTLEARWGHSGTTACEGCT

SEQ ID NO: 903823 - protein, 229 aa, Homo sapiens
MTTAARPTFEPARGGRGKGEGDLSQLSKQYSSRDLPSHTKIKYRQTTQDAPEEVRNRDFRRELEERERAAAREKNRDRPTREHTTSSSVSKKPRLDQIPAANLDADDPLTDEEDEDFEEESDDDDTAALLAELEKIKKERAEEQARKEQEQKAEEERIRMENILSGNPLLNLTGPSQPQANFKVKRRWDDDVVFKNCAKGVDDQKKDKRFVNDTLRSEFHKKFMEKYIK

SEQ ID NO: 903824 - protein, 229 aa, Homo sapiens; identical to SEQ ID NO: 903823

SEQ ID NO: 903825 - protein, 229 aa, Homo sapiens; identical to SEQ ID NO: 903823

SEQ ID NO: 903826 - protein, 144 aa, Homo sapiens
MTTAARPTFEPARGGRGKGEGDLSQLSKQYSSRDLPSHTKIKYRQTTQDAPEEVRNRDFRRELEERERAAAREKNRDRPTREHTTSSSVSKKRKMKILKKKVMMMILQLFLQNWKKLKKKELKSRPGRNKNKKLKKRGFVWKTF

SEQ ID NO: 903827 - protein, 120 aa, Homo sapiens
MTTAARPTFEPARGGRGKGEGDLSQLSKQYSSRDLPSHTKIKYRQTTQDAPEEVRNRDFRRELEERERAAAREKNRDRPTREHTTSSSVSKKPRLDQIPAANLDADDPLTDVCFVSSFHL

SEQ ID NO: 903828 - protein, 229 aa, Homo sapiens; identical to SEQ ID NO: 903823

SEQ ID NO: 903829 - protein, 120 aa, Homo sapiens; identical to SEQ ID NO: 903827

SEQ ID NO: 903830 - protein, 191 aa, Homo sapiens
MTTAARPTFEPARGGRGKGEGDLSQLSKQYSSRDLPSHTKIKYRQTTQDAPEEVRNRDFRRELEERERAAAREKNRDRPTREHTTSSSVSKKPRLDQIPAANLDADDPLTDEEDEDFEEESDDDDTAALPLLNLTGPSQPQANFKVKRRWDDDVVFKNCAKGVDDQKKDKRFVNDTLRSEFHKKFMEKYIK

SEQ ID NO: 903831 - protein, 120 aa, Homo sapiens
MPLKRFVTVTSGESWKKERELAELEKIKKERAEEQARKEQEQKAEEERIRMENILSGNPLLNLTGPSQPQANFKVKRRWDDDVVFKNCAKGVDDQKKDKRFVNDTLRSEFHKKFMEKYIK

SEQ ID NO: 903832 - protein, 257 aa, Homo sapiens
ILFSSFYLSAKKARSKLSCLFVPSYMSPPLPTGMEFEGAIIALFHLLATRTDKVRALREAFYRQNLPNLMNLIATIFVFAVVIYFQVCPDPTPGSFHGLDLSFRMPCVQSPTLWGALSSYCVETMRWYLKAAGFQMSWTSMFIESWDLFHFLWSIQHGPDYHHSVQKVKRDAVRGCDVLSASDDTVASVGCKDDDGSDRRLQGAVQVGEALNVQHVDLINKQHTRDQLSNALVDVLVHHLINLPSKFVCDFCLLWLH

SEQ ID NO: 903833 - protein, 476 aa, Homo sapiens
MAIKFLEVIKPFCVILPEIQKPERKIQFKEKVLWTAITLFIFLVCCQIPLFGIMSSDSADPFYWMRVILASNRGTLMELGISPIVTSGLIMQLLAGAKIIEVGDTPKDRALFNGAQKLFGMIITIGQSIVYVMTGMYGDPSEMGAGICLLITIQLFVAGLIVLLLDELLQKGYGLGSGISLFIATNICETIVWKAFSPTTVNTGRGMEFEGAIIALFHLLATRTDKVRALREAFYRQNLPNLMNLIATIFVFAVVIYFQGFRVDLPIKSARYRGQYNTYPIKLFYTSNIPIILQSALVSNLYVISQMLSARFSGNLLVSLLGTWSDTSSGGPARAYPVGGLCYYLSPPESFGSVLEDPVHAVVYIVFMLGSCAFFSKTWIEVSGSSAKDVAKQLKEQQMVMRGHRETSMVHELNRYIPTAAAFGGLCIGALSVLADFLGAIGSGTGILLAVTIIYQYFEIFVKEQSEVGSMGALLF

SEQ ID NO: 903834 - protein, 135 aa, Homo sapiens
SRGAFEALGPKVSGEPVGRLAHGELCGCPGADCVPSPRYIPTAAAFGGLCIGALSVLADFLGAIGSGTGILLAVTIIYQYFEIFVKEQLGKEGQSPGDLRCCHSTLQSAQSSVQLLISSIATALQPGQQTKIRLK

SEQ ID NO: 903835 - protein, 476 aa, Homo sapiens
MGIKFLEVIKPFCVILPEIQKPERKIQFKEKVLWTAITLFIFLVCCQIPLFGIMSSDSADPFYWMRVILASNRGTLMELGISPIVTSGLIMQLLAGAKIIEVGDTPKDRALFNGAQKLFGMIITIGQSIVYVMTGMYGDPSEMGAGICLLITIQLFVAGLIVLLLDELLQKGYGLGSGISLFIATNICETIVWKAFSPTTVNTGRGMEFEGAIIALFHLLATRTDKVRALREAFYRQNLPNLMNLIATIFVFAVVIYFQGFRVDLPIKSARYRGQYNTYPIKLFYTSNIPIILQSALVSNLYVISQMLSARFSGNLLVSLLGTWSDTSSGGPARAYPVGGLCYYLSPPESFGSVLEDPVHAVVYIVFMLGSCAFFSKTWIEVSGSSAKDVAKQLKEQQMVMRGHRETSMVHELNRYIPTAAAFGGLCIGALSVLADFLGAIGSGTGILLAVTIIYQYFEIFVKEQSEVGSMGALLF

SEQ ID NO: 903836 - protein, 239 aa, Homo sapiens
CVSVQQAEDEAVKGIWFCLASQGFRVDLPIKSARYRGQYNTYPIKLFYTSNIPIILQSALVSNLYVISQMLSARFSGNLLVSLLGTWSDTSSGGPARAYPVGGLCYYLSPPESFGSVLEDPVHAVVYIVFMLGSCAFFSKTWIEVSGSSAKDVAKQLKEQQMVMRGHRETSMVHELNRYIPTAAAFGGLCIGALSVLADFLGAIGSGTGILLAVTIIYQYFEIFVKEQSEVGSMGALLF

SEQ ID NO: 903837 - protein, 476 aa, Homo sapiens; identical to SEQ ID NO: 903833

SEQ ID NO: 903838 - protein, 135 aa, Homo sapiens
AKMIIVGAGCDSVLEDPVHAVVYIVFMLGSCAFFSKTWIEVSGSSAKDVAKQLKEQQMVMRGHRETSMVHELNRYIPTAAAFGGLCIGALSVLADFLGAIGSGTGILLAVTIIYQYFEIFVKEQSEVGSMGALLF

SEQ ID NO: 903839 - protein, 99 aa, Homo sapiens
SRGAFEALGPKVSGEPVGRLAHGELCGCPGADCVPSPRYIPTAAAFGGLCIGALSVLADFLGAIGSGTGILLAVTIIYQYFEIFVKEQSEVGSMGALLF

SEQ ID NO: 903840 - protein, 476 aa, Homo sapiens; identical to SEQ ID NO: 903833

SEQ ID NO: 903841 - protein, 476 aa, Homo sapiens; identical to SEQ ID NO: 903833

SEQ ID NO: 903842 - protein, 476 aa, Homo sapiens; identical to SEQ ID NO: 903833

SEQ ID NO: 903843 - protein, 433 aa, Homo sapiens
MAIKFLEVIKPFCVILPEIQKPERKIQFKEKVLWTAITLFIFLVCCQIPLFGIMSSDSADPFYWMRVILASNRGTLMELGISPIVTSGLIMQLLAGAKIIEVGDTPKDRALFNGAQKLFGMIITIGQSIVYVMTGMYGDPSEMGAGICLLITIQLFVAGLIVLLLDELLQKGYGLGSGISLFIATNICETIVWKAFSPTTVNTGRGMEFEGAIIALFHLLATRTDKVRALREAFYRQNLPNLMNLIATIFVFAVVIYFQVCPDPTPGSFHGLDLSFRMPCVQSPTLWGALSSYCVETMRWYLKAAGFQMSWTSMFIESWDLPGCGEEFGPEVMVPDTAVPLEMEQLGKEGQSPGDLRCCHSTLQSAQSSVQLLISSIVTQKQPQTDNRQMSMAVFLQSWLQSQLQTRLSYGPYLKEATTGKARIANFRSFSNP

SEQ ID NO: 903844 - protein, 327 aa, Homo sapiens
MAIKFLEVIKPFCVILPEIQKPERKIQFKEKVLWTAITLFIFLVCCQIPLFGIMSSDSADPFYWMRVILASNRGTLMELGISPIVTSGLIMQLLAGAKIIEVGDTPKDRALFNGAQKLFGMIITIGQSIVYVMTGMYGDPSEMGAGICLLITIQLFVAGLIVLLLDELLQKGYGLGSGISLFIATNICETIVWKAFSPTTVNTGRGMEFEGAIIALFHLLATRTDKVRALREAFYRQNLPNLMNLIATIFVFAVVIYFQVCPDPTPGSFHGLDLSFRMPCVQSPTLWGALSSYCVETMRWYLKAAGFQMSWTSMFIESWDLPLTKQN

SEQ ID NO: 903845 - protein, 430 aa, Homo sapiens
MAIKFLEVIKPFCVILPEIQKPERKIQFKEKVLWTAITLFIFLVCCQIPLFGIMSSDSADPFYWMRVILASNRGTLMELGISPIVTSGLIMQLLAGAKIIEVGDTPKDRALFNGAQKLFGMIITIGQSIVYVMTGMYGDPSEMGAGICLLITIQLFVAGLIVLLLDELLQKGYGLGSGISLFIATNICETIVWKAFSPTTVNTGRGMEFEGAIIALFHLLATRTDKVRALREAFYRQNLPNLMNLIATIFVFAVVIYFQVCPDPTPGSFHGLDLSFRMPCVQSPTLWGALSSYCVETMRWYLKAAGFQMSWTSMFIESWDLFHFLWSIQHGPDYHHSVQKVKRDAVRGCDVLSASDDTVASVGCKDDDGSDRRLQGAVQVGEALNVQHVDLINKQHTRDQLSNALVDVLVHHLINLPSKFVCDFCLLWLH

SEQ ID NO: 903846 - protein, 110 aa, Homo sapiens
QDALILRRGPGGACSLSGRPHSDSGHTAACKAQGHRHSPAEGHTLETLLAVLARKQSDQGTRRDLPKATQQLSSRTKMGPRLLHMAQGLPPYHTWPCLDPVLSRGEALET

SEQ ID NO: 903847 - protein, 172 aa, Homo sapiens
ILFSSFYLSAKKARSKLSCLFVPSYMSPPLPTGMEFEGAIIALFHLLATRTDKVRALREAFYRQNLPNLMNLIATIFVFAVVIYFQVCPDPTPGSFHGLDLSFRMPCVQSPTLWGALSSYCVETMRWYLKAAGFQMSWTSMFIESWDLMTQLPRLDAKMTMGAIEDSRARCR

SEQ ID NO: 903848 - protein, 476 aa, Homo sapiens; identical to SEQ ID NO: 903833

SEQ ID NO: 903849 - protein, 337 aa, Homo sapiens
DRTSGVLEFAANHHQLFVAGLIVLLLDELLQKGYGLGSGISLFIATNICETIVWKAFSPTTVNTGRGMEFEGAIIALFHLLATRTDKVRALREAFYRQNLPNLMNLIATIFVFAVVIYFQGFRVDLPIKSARYRGQYNTYPIKLFYTSNIPIILQSALVSNLYVISQMLSARFSGNLLVSLLGTWSDTSSGGPARAYPVGGLCYYLSPPESFGSVLEDPVHAVVYIVFMLGSCAFFSKTWIEVSGSSAKDVAKQLKEQQMVMRGHRETSMVHELNRYIPTAAAFGGLCIGALSVLADFLGAIGSGTGILLAVTIIYQYFEIFVKEQSEVGSMGALLF

SEQ ID NO: 903850 - protein, 109 aa, Homo sapiens
MLGSCAFFSKTWIEVSGSSAKDVAKQLKEQQMVMRGHRETSMVHELNRYIPTAAAFGGLCIGALSVLADFLGAIGSGTGILLAVTIIYQYFEIFVKEQSEVGSMGALLF

SEQ ID NO: 903851 - protein, 476 aa, Homo sapiens; identical to SEQ ID NO: 903833

SEQ ID NO: 903852 - protein, 102 aa, Homo sapiens
QGVGTLRSTGSPAPRRAACRRASTDVSLGGAAVQWNALGRGQRRLTRSRAELKRDPEPEQPPPWQAIGSGTGILLAVTIIYQYFEIFVKEQSEVGSMGALLF

SEQ ID NO: 903853 - protein, 79 aa, Homo sapiens
RCSPTVSTTELIPDINMSLLISNTGATDQHHHSPCTPNLTSLPTLSLCCPLSADDTGDAERKSVVSAHLRAVLSTVRKF

SEQ ID NO: 903854 - protein, 476 aa, Homo sapiens; identical to SEQ ID NO: 903833

SEQ ID NO: 903855 - protein, 554 aa, Homo sapiens
MAIKFLEVIKPFCVILPEIQKPERKIQFKEKVLWTAITLFIFLVCCQIPLFGIMSSDSADPFYWMRVILASNRGTLMELGISPIVTSGLIMQLLAGAKIIEVGDTPKDRALFNGAQKLFGMIITIGQSIVYVMTGMYGDPSEMGAGICLLITIQLFVAGLIVLLLDELLQKGYGLGSGISLFIATNICETIVWKAFSPTTVNTGRGMEFEGAIIALFHLLATRTDKVRALREAFYRQNLPNLMNLIATIFVFAVVIYFQVCPDPTPGSFHGLDLSFRMPCVQSPTLWGALSSYCVETMRWYLKAAGFQMSWTSMFIESWDLPGCGEEFGPEVMVPDTAVPLEMEQLGKEGQSPGDLRCCHSTLQSAQSSVQLLISSIVTQKQPQTDNRQMSMAVFLQSWLQSQLQTRLSYGPYLSVVIGANLPQVVQCLLTDVDSFRLGTDFNDLFHFLWSIQHGPDYHHSVQKVKRDAVRGCDVLSASDDTVASVGCKDDDGSDRRLQGAVQVGEALNVQHVDLINKQHTRDQLSNALVDVLVHHLINLPSKFVCDFCLLWLH

SEQ ID NO: 903856 - protein, 422 aa, Homo sapiens
MAIKFLEVIKPFCVILPEIQKPERKIQFKEKVLWTAITLFIFLVCCQIPLFGIMSSDSADPFYWMRVILASNRGTLMELGISPIVTSGLIMQLLAGAKIIEVGDTPKDRALFNGAQKLFGMIITIGQSIVYVMTGMYGDPSEMGAGICLLITIQLFVAGLIVLLLDELLQKGYGLGSGISLFIATNICETIVWKAFSPTTVNTGRGMEFEGAIIALFHLLATRTDKVRALREAFYRQNLPNLMNLIATIFVFAVVIYFQVCPDPTPGSFHGLDLSFRMPCVQSPTLWGALSSYCVETMRWYLKAAGFQMSWTSMFIESWDLPGCGEEFGPEVMVPDTAVPLEMEQLGKEGQSPGDLRCCHSTLQSAQSSVQLLISSIVTQKQPQTDNRQMSMAVFLQSWLQSQLQTRLSYGPYLKEATTGAI

SEQ ID NO: 903857 - protein, 842 aa, Homo sapiens
MDFQERDPPFLPESAQSSKPSSAQQASELWEVVEEPRVRLGTEGVMPERQEGHLLKKRKWPLKGWHKRYFVLEDGILHYATTRQDITKGKLHGSIDVRLSVMSINKKAQRIDLDTEDNIYHLKIKSQDLFQSWVAQLRAHRLAHRLDMPRGSLPSTAHRKVPGAQLPTAATASALPGLGPREKVSSWLRDSDGLDRCSHELSECQGKLQELHRLLQSLESLHRIPSAPVIPTHQASVTTERPKKGKRTSRMWCTQSFAKDDTIGRVGRLHGSVPNLSRYLESRDSSGTRGLPPTDYAHLQRSFWALAQKVHSSLSSVLAALTMERDQLRDMHQGSELSRMGVSEASTGQRRLHSLSTSSDTTADSFSSLNPEEQEALYMKGRELTPQLSQTSILSLADSHTEFFDACEVLLSASSSENEGSEEEESCTSEITTSLSEEMLDLRGAERCQKGGCVPGRPMGPPRRRCLPAASGPGADVSLWNILRNNIGKDLSKVSMPVQLNEPLNTLQRLCEELEYSSLLDQASRIADPCERMVYIAAFAVSAYSSTYHRAGCKPFNPVLGETYECERPDRGFRFISEQVSHHPPISACHAESENFAFWQDMKWKNKFWGKSLEIVPVGTVNVSLPRFGDHFEWNKVTSCIHNVLSGQRWIEHYGEVLIRNTQDSSCHCKITFCKAKYWSSNVHEVQGAVLSRSGRVLHRLFGKWHEGLYRGPTPGGQCIWKPNSMPPDHERNFGFTQFALELNELTAELKRSLPSTDTRLRPDQRYLEEGNIQAAEAQKRRIEQLQRDRRKVMEENNIVHQARFFRRQTDSSGKEWWVTNNTYWRLRAEPGYGNMDGAVLW

SEQ ID NO: 903858 - protein, 687 aa, Homo sapiens
APFPHPVSKIAPTLTCQASVTTERPKKGKRTSRMWCTQSFAKDDTIGRVGRLHGSVPNLSRYLESRDSSGTRGLPPTDYAHLQRSFWALAQKVHSSLSSVLAALTMERDQLRDMHQGSELSRMGVRPGGQGDWCGEEGFKLRTASLGSDSRSGSGWGVGRGSLCRDAARWGGPHPPGTVSLTLSLQVSEASTGQRRLHSLSTSSDTTADSFSSLNPEEQEALYMKGRELTPQLSQTSILSLADSHTEFFDACEVLLSASSSENEGSEEEESCTSEITTSLSEEMLDLRGAERCQKGGCVPGRPMGPPRRRCLPAASGPGADVSLWNILRNNIGKDLSKVSMPVQLNEPLNTLQRLCEELEYSSLLDQASRIADPCERMVYIAAFAVSAYSSTYHRAGCKPFNPVLGETYECERPDRGFRFISEQVSHHPPISACHAESENFAFWQDMKWKNKFWGKSLEIVPVGTVNVSLPRFGDHFEWNKVTSCIHNVLSGQRWIEHYGEVLIRNTQDSSCHCKITFCKAKYWSSNVHEVQGAVLSRSGRVLHRLFGKWHEGLYRGPTPGGQCIWKPNSMPPDHERNFGFTQFALELNELTAELKRSLPSTDTRLRPDQRYLEEGNIQAAEAQKRRIEQLQRDRRKVMEENNIVHQARFFRRQTDSSGKEWWVTNNTYWRLRAEPGYGNMDGAVLW

SEQ ID NO: 903859 - protein, 846 aa, Homo sapiens
MASGRWWLYGSESLKQVPSPSTNLHPQITKGKLHGSIDVRLSVMSINKKAQRIDLDTEDNIYHLKIKSQDLFQSWVAQLRAHRLAHRLDMPRGSLPSTAHRKVPGAQLPTAATASALPGLGPREKVSSWLRDSDGLDRCSHELSECQGKLQELHRLLQSLESLHRIPSAPVIPTHQASVTTERPKKGKRTSRMWCTQSFAKDDTIGRVGRLHGSVPNLSRYLESRDSSGTRGLPPTDYAHLQRSFWALAQKVHSSLSSVLAALTMERDQLRDMHQGSELSRMGVRPGGQGDWCGEEGFKLRTASLGSDSRSGSGWGVGRGSLCRDAARWGGPHPPGTVSLTLSLQVSEASTGQRRLHSLSTSSDTTADSFSSLNPEEQEALYMKGRELTPQLSQTSILSLADSHTEFFDACEVLLSASSSENEGSEEEESCTSEITTSLSEEMLDLRGAERCQKGGCVPGRPMGPPRRRCLPAASGPGADVSLWNILRNNIGKDLSKVSMPVQLNEPLNTLQRLCEELEYSSLLDQASRIADPCERMVYIAAFAVSAYSSTYHRAGCKPFNPVLGETYECERPDRGFRFISEQVSHHPPISACHAESENFAFWQDMKWKNKFWGKSLEIVPVGTVNVSLPRFGDHFEWNKVTSCIHNVLSGQRWIEHYGEVLIRNTQDSSCHCKITFCKAKYWSSNVHEVQGAVLSRSGRVLHRLFGKWHEGLYRGPTPGGQCIWKPNSMPPDHERNFGFTQFALELNELTAELKRSLPSTDTRLRPDQRYLEEGNIQAAEAQKRRIEQLQRDRRKVMEENNIVHQARFFRRQTDSSGKEWWVTNNTYWRLRAEPGYGNMDGAVLW

SEQ ID NO: 903860 - protein, 70 aa, Homo sapiens
VGRLHGSVPNLSRYLESRDSSGTRGLPPTDYAHLQRSFWALAQKGKCLLGGAGGERTGASEDSDGLPHSL

SEQ ID NO: 903861 - protein, 846 aa, Homo sapiens; identical to SEQ ID NO: 903859

SEQ ID NO: 903862 - protein, 731 aa, Homo sapiens
MASGRWWLYGSESLKQVPSPSTNLHPQITKGKLHGSIDVRLSVMSINKKAQRIDLDTEDNIYHLKIKSQDLFQSWVAQLRAHRLAHRLDMPRGSLPSTAHRKVPGAQLPTAATASALPGLGPREKVSSWLRDSDGLDRCSHELSECQGKLQELHRLLQSLESLHRIPSAPVIPTHQASVTTERPKKGKRTSRMWCTQSFAKDDTIGRVGRLHGSVPNLSRYLESRDSSGTRGLPPTDYAHLQRSFWALAQKVHSSLSSVLAALTMERDQLRDMHQGSELSRMGVRPGGQGDWCGEEGFKLRTASLGSDSRSGSGWGVGRGSLCRDAARWGGPHPPGTVSLTLSLQVSEASTGQRRLHSLSTSSDTTADSFSSLNPEEQEALYMKGRELTPQLSQTSILSLADSHTEFFDACEVLLSASSSENEGSEEEESCTSEITTSLSEEMLDLRGAERCQKGGCVPGRPMGPPRRRCLPAASGPGADVSLWNILRNNIGKDLSKVSMPVQLNEPLNTLQRLCEELEYSSLLDQASRIADPCERMVYIAAFAVSAYSSTYHRAGCKPFNPVLGETYECERPDRGFRFISEQVSHHPPISACHAESENFAFWQDMKWKNKFWGKSLEIVPVGTVNVSLPRFGDHFEWNKVTSCIHNVLSGQRWIEHYGEVLIRNTQDSSCHCKITFCKAKYWSSNVHEVQGAVLSRSGRVLHRLFGKWHEGLYRGPTPGGQCIWKPIGAE

SEQ ID NO: 903863 - protein, 121 aa, Homo sapiens
EIYALGSENTPGNLFSIRELELNELTAELKRSLPSTDTRLRPDQRYLEEGNIQAAEAQKRRIEQLQRDRRKVMEENNIVHQARFFRRQTDSSGKEWWVTNNTYWRLRAEPGYGNMDGAVLW

SEQ ID NO: 903864 - protein, 95 aa, Homo sapiens
AESLPATAAGARPGAVVRICAGSGCWLLGSAASLPNELHQVGSLQLCALGTQGNAQLWGSWGAFQFYHLWKWTPQGEDKWTDCVVESGNREALEV

SEQ ID NO: 903865 - protein, 312 aa, Homo sapiens
MIQVLDPRPLTSSVMPVDVAMRLCLAHSPPVKSFLGPYDEFQRRHFVNKLKPLKSCLNIKHKAKSQNDWKCSHNQAKKRVVFADSKGLSLTAIHVFSDLPEEPAWDLQFDLLDLNDISSALKHHEEKNLILDFPQPSTDYLSFRSHFQKNFVCLENCSLQERTVTGTVKVKNVSFEKKVQIRITFDSWKNYTDVDCVYMKNVYGGTDSDTFSFAIDLPPVIPTEQKIEFCISYHANGQVFWDNNDGQNYRIVHVQWKPDGVQTQMAPQDCAFHQTSPKTELESTIFGSPRLASGLFPEWQSWGRMENLASYR

SEQ ID NO: 903866 - protein, 180 aa, Homo sapiens
MIQVLDPRPLTSSVMPVDVAMRLCLAHSPPVKSFLGPYDEFQRRHFVNKLKPLKSCLNIKHKAKSQNDWKCSHNQAKKRVVFADSKGLSLTAIHVFSDLPEEPAWDLQFDLLDLNDISSALKHHEEKNLILDFPQPSTDYLSFRSHFQKNFVCLENCSLQERTVTGTVKPFCSDVIYKKS

SEQ ID NO: 903867 - protein, 312 aa, Homo sapiens; identical to SEQ ID NO: 903865

SEQ ID NO: 903868 - protein, 312 aa, Homo sapiens; identical to SEQ ID NO: 903865

SEQ ID NO: 903869 - protein, 479 aa, Homo sapiens
MVGRSRRRGAAKWAAVRAKAGPTLTDENGDDLGLPPSPGDTSYYQDQVDDFHEARSRAALAKGWNEVQSGDEEDGEEEEEEVLALDMDDEDDEDGGNAGEEEEEENADDDGGSSVQSEAEASVDPSLSWGQRKKLYYDTDYGSKSRGRQSQQEAEEEEREEEEEAQIIQRRLAQALQEDDFGVAWVEAFAKPVPQVDEAETRVVKDLAKVSVKEKLKMLRKESPELLELIEDLKVKLTEVKDELEPLLELVEQGIIPPGKGSQYLRTKYNLYLNYCSNISFYLILKARRVPAHGHPVIERLVTYRNLINKLSVVDQKLSSEIRHLLTLKDDAVKKELIPKAKSTKPKPKSVSKTSAAACAVTDLSDDSDFDEKAKLKYYKEIEDRQKLKRKKEENSTEEQALEDQNAKRAITYQIAKNRGLTPRRKKIDRNPRVKHREKFRRAKIRRRGQVREVRKEEQRYSGELSGIRAGVKKSIKLK

SEQ ID NO: 903870 - protein, 479 aa, Homo sapiens; identical to SEQ ID NO: 903869

SEQ ID NO: 903871 - protein, 259 aa, Homo sapiens
CLLLTLPASGSCLMKVIYLILVELEPLLELVEQGIIPPGKGSQYLRTKYNLYLNYCSNISFYLILKARRVPAHGHPVIERLVTYRNLINKLSVVDQKLSSEIRHLLTLKDDAVKKELIPKAKSTKPKPKSVSKTSAAACAVTDLSDDSDFDEKAKLKYYKEIEDRQKLKRKKEENSTEEQALEDQNAKRAITYQIAKNRGLTPRRKKIDRNPRVKHREKFRRAKIRRRGQVREVRKEEQRYSGELSGIRAGVKKSIKLK

SEQ ID NO: 903872 - protein, 479 aa, Homo sapiens; identical to SEQ ID NO: 903869

SEQ ID NO: 903873 - protein, 311 aa, Homo sapiens
MVGRSRRRGAAKWAAVRAKAGPTLTDENGDDLGLPPSPGDTSYYQDQVDDFHEARSRAALAKGWNEVQSGDEEDGEEEEEEVLALDMDDEDDEDGGNAGEEEEEENADDDGGSSVQSEAEASVDPSLSWGQRKKLYYDTDYGSKSRGRQSQQEAEEEEREEEEEAQIIQRRLAQALQEDDFGVAWVEAFAKPVPQVDEAETRVVKDLAKVSVKEKLKMLRKESPELLELIEDLKVKLTEVKDELEPLLELVEQGIIPPGKGSQYLRTKYSAATTLSRITHCRPLLVDRARYQLGVIMAELFLCEIGIRSQF

SEQ ID NO: 903874 - protein, 461 aa, Homo sapiens
MVGRSRRRGAAKWAAVRAKAGPTLTDENGDDLGLPPSPGDTSYYQDQVDDFHEARSRAALAKGWNEVQSGDEEDGEEEEEEVLALDMDDEDDEDGGNAGEEEEEENADDDGGSSVQSEAEASVDPSLSWGQRKKLYYDTDYGSKSRGRQSQQEAEEEEREEEEEAQIIQRRLAQALQEDDFGVAWVEAFAKPVPQVDEAETRVVKDLAKVSVKEKLIKLTEVKDELEPLLELVEQGIIPPGKGSQYLRTKYNLYLNYCSNISFYLILKARRVPAHGHPVIERLVTYRNLINKLSVVDQKLSSEIRHLLTLKDDAVKKELIPKAKSTKPKPKSVSKTSAAACAVTDLSDDSDFDEKAKLKYYKEIEDRQKLKRKKEENSTEEQALEDQNAKRAITYQIAKNRGLTPRRKKIDRNPRVKHREKFRRAKIRRRGQVREVRKEEQRYSGELSGIRAGVKKSIKLK

SEQ ID NO: 903875 - protein, 297 aa, Homo sapiens
MAAAAVVEFQRAQSLLSTDREASIDILHSIVKRDIQENDEEAVQVKEQSILELGSLLAKTGQAAELGGLLKYVRPFLNSISKAKAARLVRSLLDLFLDMEAATGQEVELCLECIEWAKSEKRTFLRQALEARLVSLYFDTKRYQEALHLGSQLLRELKKMDDKALLVEVQLLESKTYHALSNLPKARAALTSARTTANAIYCPPKLQATLDMQSGIIHAAEEKDWKTAYSYFYEAFEGYDSIDSPKAITSLKYMLLCKIMLNTPENVSLGNGNLPSVAGGERALRGGRHSVRRFGGC

SEQ ID NO: 903876 - protein, 128 aa, Homo sapiens
MAAAAVVEFQRAQSLLSTDREASIDILHSIVKRDIQENDEEAVQVKEQSILELGSLLAKTGQAAELGGLLKYVRPFLNSISKAKAARLVRSLLDLFLDMEAATGQEVELCLECIKLGQENVREKNLFL

SEQ ID NO: 903877 - protein, 179 aa, Homo sapiens
ILVFFPLPYGLSALPSPHWLQQSSRRSCRRRHHHHHCSPKAITSLKYMLLCKIMLNTPEDVQALVSGKLALRYAGRQTEALKCVAQASKNRSLADFEKALTDYRAELRDDPIISTHLAKLYDNLLEQNLIRVIEPFSRVQIEHISSLIKLSKADVGKELSQMILTEFMGLDQGGCLIIR

SEQ ID NO: 903878 - protein, 422 aa, Homo sapiens
MAAAAVVEFQRAQSLLSTDREASIDILHSIVKRDIQENDEEAVQVKEQSILELGSLLAKTGQAAELGGLLKYVRPFLNSISKAKAARLVRSLLDLFLDMEAATGQEVELCLECIEWAKSEKRTFLRQALEARLVSLYFDTKRYQEALHLGSQLLRELKKMDDKALLVEVQLLESKTYHALSNLPKARAALTSARTTANAIYCPPKLQATLDMQSGIIHAAEEKDWKTAYSYFYEAFEGYDSIDSPKAITSLKYMLLCKIMLNTPEDVQALVSGKLALRYAGRQTEALKCVAQASKNRSLADFEKALTDYRAELRDDPIISTHLAKLYDNLLEQNLIRVIEPFSRVQIEHISSLIKLSKADVERKLSQMILDKKFHGILDQGEGVLIIFDEPPVDKTYEAALETIQNMSKVVDSLYNKAKKLT

SEQ ID NO: 903879 - protein, 422 aa, Homo sapiens; identical to SEQ ID NO: 903878

SEQ ID NO: 903880 - protein, 422 aa, Homo sapiens; identical to SEQ ID NO: 903878

SEQ ID NO: 903881 - protein, 337 aa, Homo sapiens
SEDPFGSIEVCFLYWKRSGQEVELCLECIEWAKSEKRTFLRQALEARLVSLYFDTKRYQEALHLGSQLLRELKKMDDKALLVEVQLLESKTYHALSNLPKARAALTSARTTANAIYCPPKLQATLDMQSGIIHAAEEKDWKTAYSYFYEAFEGYDSIDSPKAITSLKYMLLCKIMLNTPEDVQALVSGKLALRYAGRQTEALKCVAQASKNRSLADFEKALTDYRAELRDDPIISTHLAKLYDNLLEQNLIRVIEPFSRVQIEHISSLIKLSKADVERKLSQMILDKKFHGILDQGEGVLIIFDEPPVDKTYEAALETIQNMSKVVDSLYNKAKKLT

SEQ ID NO: 903882 - protein, 267 aa, Homo sapiens
EVMDIVDPALRVEVQLLESKTYHALSNLPKARAALTSARTTANAIYCPPKLQATLDMQSGIIHAAEEKDWKTAYSYFYEAFEGYDSIDSPKAITSLKYMLLCKIMLNTPEDVQALVSGKLALRYAGRQTEALKCVAQASKNRSLADFEKALTDYRAELRDDPIISTHLAKLYDNLLEQNLIRVIEPFSRVQIEHISSLIKLSKADVERKLSQMILDKKFHGILDQGEGVLIIFDEPPVDKTYEAALETIQNMSKVVDSLYNKAKKLT

SEQ ID NO: 903883 - protein, 261 aa, Homo sapiens
SSKLSYNLAKCVLMIGHALSNLPKARAALTSARTTANAIYCPPKLQATLDMQSGIIHAAEEKDWKTAYSYFYEAFEGYDSIDSPKAITSLKYMLLCKIMLNTPEDVQALVSGKLALRYAGRQTEALKCVAQASKNRSLADFEKALTDYRAELRDDPIISTHLAKLYDNLLEQNLIRVIEPFSRVQIEHISSLIKLSKADVERKLSQMILDKKFHGILDQGEGVLIIFDEPPVDKTYEAALETIQNMSKVVDSLYNKAKKLT

SEQ ID NO: 903884 - protein, 385 aa, Homo sapiens
MAAAAVVEFQRAQSLLSTDREASIDILHSIVKRDIQENDEEAVQVKEQSILELGSLLAKTGQAAELGGLLKYVRPFLNSISKAKAARLVRSLLDLFLDMEAATGQEVELCLECIEWAKSEKRTFLRQALEARLVSLYFDTKRYQEALHLGSQLLRELKKMDDKALLVEVQLLESKTYHALSNLPKARAALTSARTTANAIYCPPKLQATLDMQSGIIHAAEEKDWKTAYSYFYEAFEGYDSIDSPKAITSLKYMLLCKIMLNTPEDVQALVSGKLALRYAGRQTEALKCVAQASKNRSLADFEKALTDYRAELRDDPIISTHLAKLYDNLLEQNLIRVIEPFSRVQIEHISSLIKLSKADVGKELSQMILTEFMGLDQGGCLIIR

SEQ ID NO: 903885 - protein, 374 aa, Homo sapiens
MAAAAVVEFQRAQSLLSTDREASIDILHSIVKRDIQENDEEAVQVKEQSILELGSLLAKTGQAAELGGLLKYVRPFLNSISKAKAARLVRSLLDLFLDMEAATGQEVELCLECIEWAKSEKRTFLRQALEARLVSLYFDTKRYQEALHLGSQLLRELKKMDDKALLVEVQLLESKTYHALSNLPKARAALTSARTTANAIYCPPKLQATLDMQSGIIHAAEEKDWKTAYSYFYEAFEGYDSIDSPKAITSLKYMLLCKIMLNTPEDVQALVSGKLALRYAGRQTEALKCVAQASKNRSLADFEKLDRYGRAPDDHHQPPWQCCTTTIVGLAFSRGLFLHSSPGISFQMGCGGGLPQWSTGPKFGGGSFPSLHSI

SEQ ID NO: 903886 - protein, 99 aa, Homo sapiens
LQDIGPRAKLGLPFISTHWSKVQIEHISSLIKLSKADVERKLSQMILDKKFHGILDQGEGVLIIFDEPPVDKTYEAALETIQNMSKVVDSLYNKAKKLT

SEQ ID NO: 903887 - protein, 99 aa, Homo sapiens; identical to SEQ ID NO: 903886

SEQ ID NO: 903888 - protein, 151 aa, Homo sapiens
MAAAAVVEFQRAQSLLSTDREASIDILHSIVKRDIQENDEEAVQVKEQSILELGSLLAKTGQAAELGGLLKYVRPFLNSISKAKAARLVRSLLDLFLDMEAATGQEVELCLECIEWAKSEKRTFLRQALEARLVSLYFDTKRYQEALHLGS

SEQ ID NO: 903889 - protein, 237 aa, Homo sapiens [sequence omitted]

SEQ ID NO: 903890 - protein, 422 aa, Homo sapiens; identical to SEQ ID NO: 903878

SEQ ID NO: 903891 - protein, 422 aa, Homo sapiens; identical to SEQ ID NO: 903878

SEQ ID NO: 903892 - protein, 422 aa, Homo sapiens; identical to SEQ ID NO: 903878

SEQ ID NO: 903893 - protein, 372 aa, Homo sapiens
MYLRKFGHQEVVYSTSCRIVRPYLESHYVKDIHYRGGRSLLDLVARYWTPVYESYYTTTGVSCIEWAKSEKRTFLRQALEARLVSLYFDTKRYQEALHLGSQLLRELKKMDDKALLVEVQLLESKTYHALSNLPKARAALTSARTTANAIYCPPKLQATLDMQSGIIHAAEEKDWKTAYSYFYEAFEGYDSIDSPKAITSLKYMLLCKIMLNTPEDVQALVSGKLALRYAGRQTEALKCVAQASKNRSLADFEKALTDYRAELRDDPIISTHLAKLYDNLLEQNLIRVIEPFSRVQIEHISSLIKLSKADVERKLSQMILDKKFHGILDQGEGVLIIFDEPPVDKTYEAALETIQNMSKVVDSLYNKAKKLT

SEQ ID NO: 903894 - protein, 394 aa, Homo sapiens
MAAAAVVEFQRAQSLLSTDREASIDILHSIVKRDIQENDEEAVQVKEQSILELGSLLAKTGQAAELGGLLKYVRPFLNSISKAKAARLVRSLLDLFLDMEAATGQEVELCLECIEWAKSEKRTFLRQALEARLVSLYFDTKRYQEALHLGSQLLRELKKMDDKALLVEVQLLESKTYHALSNLPKARAALTSARTTANAIYCPPKLQATLDMQSGIIHAAEEKDWKTAYSYFYEAFEGYDSIDSPKAITSLKYMLLCKIMLNTPEDVQALVSGKLALRYAGRQTEALKCVAQASKNRSLADFEKALTDYRAELRDDPIISTHLAKLYDNLLEQNLIRVIEPFSRVQIEHISSLIKLSKADVERKLSQMILDKKFHGILDQWEGVPVILDEPLVH

SEQ ID NO: 903895 - protein, 376 aa, Homo sapiens
MAAAAVVEFQRAQSLLSTDREASIDILHSIVKRDIQENDEEAVQVKEQSILELGSLLAKTGQAAELGGLLKYVRPFLNSISKAKAARLVRSLLDLFLDMEAATGQEVELCLECIEWAKSEKRTFLRQALEARLVSLYFDTKRYQEALHLGSQLLRELKKMDDKALLVEVQLLESKTYHALSNLPKARAALTSARTTANAIYCPPKLQATLDMQSGIIHAAEEKDWKTAYSYFYEAFEGYDSIDSPKAITSLKYMLLCKIMLNTPEDVQALVSGKLALRYAGRQTEALKCVAQASKNRSLADFEKALTDYRAELRDDPIISTHLAKLYDNLLEQNLIRVIEPFSRVQVRTLWGLHFWPGILTVATSLPHLSRMGTHF

SEQ ID NO: 903896 - protein, 390 aa, Homo sapiens
MAAAAVVEFQRAQSLLSTDREASIDILHSIVKRDIQENDEEAVQVKEQSILELGSLLAKTGQAAELGGLLKYVRPFLNSISKAKAARLVRSLLDLFLDMEAATGQEVELCLECIEWAKSEKRTFLRQALEARLVSLYFDTKRYQEALHLGSQLLRELKKMDDKALLVEVQLLESKTYHALSNLPKARAALTSARTTANAIYCPPKLQATLDMQSGIIHAAEEKDWKTAYSYFYEAFEGYDSIDSPKAITSLKYMLLCKIMLNTPEDVQALVSGKLALRYAGRQTEALKCVAQASKNRSLADFEKSGKLKVPEWVDTVKLAKHKELAPYDENWFYTRAASTARHLYLRGGAGVGSMTKIYGGRQRNGVMPSHFSRGSKSVAAGSSKPGGAE

SEQ ID NO: 903897 - protein, 111 aa, Homo sapiens
MTYTLRTYEGSQGTFQKWAAVVVPSGEEQRYTCHVQHEGLPEPVTLRWKPASQPTIPIVGIIAGLVLLGSVVSGAVVAAVIWRKKSSGGKGGSYSKAEWSDSAQGSESHSL

SEQ ID NO: 903898 - protein, 164 aa, Homo sapiens
KQSTSVSTMTPFLTLTCVPSLFSFLLKIRTWALGFYPAEITLTWQQDGEGHTQDTELVETRPAGDGTFQKWAAVVVPSGEEQRYTCHVQHEGLPEPVTLRWKPASQPTIPIVGIIAGLVLLGSVVSGAVVAAVIWRKKSSGGKGGSYSKAEWSDSAQGSESHSL

SEQ ID NO: 903899 - protein, 111 aa, Homo sapiens; identical to SEQ ID NO: 903897

SEQ ID NO: 903900 - protein, 164 aa, Homo sapiens; identical to SEQ ID NO: 903898

SEQ ID NO: 903901 - protein, 167 aa, Homo sapiens
KQSTSVSTMTPFLTLTCVPSLFSFLLKIRTWALGFYPAEITLTWQQDGEGHTQDTELVETRPAGDGTFQKWAAVVVPSGEEQRYTCHVQHEGLPEPVTLRWKPASQPTIPIVGIIAGLVLLGSVVSGAVVAAVIWRKKSSEKEGATLTAEWRRQLPQGSELSQLVKP

SEQ ID NO: 903902 - protein, 147 aa, Homo sapiens
KQSTSVSTMTPFLTLTCVPSLFSFLLKIRTWALGFYPAEITLTWQQDGEGHTQDTELVETRPAGDGTFQKWAAVVVPSGEEQRYTCHVQHEGLPEPVTLRWKPASQPTIPIVGIIAGLVLLGSVVSGAVVAAVIWRKKSSVSQLVKP

SEQ ID NO: 903903 - protein, 164 aa, Homo sapiens; identical to SEQ ID NO: 903898

SEQ ID NO: 903904 - protein, 164 aa, Homo sapiens; identical to SEQ ID NO: 903898

SEQ ID NO: 903905 - protein, 164 aa, Homo sapiens; identical to SEQ ID NO: 903898

SEQ ID NO: 903906 - protein, 164 aa, Homo sapiens; identical to SEQ ID NO: 903898

SEQ ID NO: 903907 - protein, 164 aa, Homo sapiens; identical to SEQ ID NO: 903898

SEQ ID NO: 903908 - protein, 164 aa, Homo sapiens; identical to SEQ ID NO: 903898

SEQ ID NO: 903909 - protein, 164 aa, Homo sapiens; identical to SEQ ID NO: 903898

SEQ ID NO: 903910 - protein, 164 aa, Homo sapiens; identical to SEQ ID NO: 903898

SEQ ID NO: 903911 - protein, 164 aa, Homo sapiens; identical to SEQ ID NO: 903898

SEQ ID NO: 903912 - protein, 199 aa, Homo sapiens
MSTSVSTMTPFLTLTCVPSLFSFLLKIRTWALGFYPAEITLTWQQDGEGHTQDTELVETRPAGDGTFQKWAAVVVPSGEEQRYTCHVQHEGLPEPVTLRWSKEGDGRSCLFSGKAGALLEPFRRVRAEAWGSGPLTFPSPEPASQPTIPIVGIIAGLVLLGSVVSGAVVAAVIWRKKSSGGEGRRVGSEFSCPTGCFKP

SEQ ID NO: 903913 - protein, 170 aa, Homo sapiens
DTIENVKAKIQDKEGIPPDQQGLIFAGIQLEDGRTLSDYYIQKCAWVRTQAHFWKFHTQDTELVETRPAGDGTFQKWAAVVVPSGEEQRYTCHVQHEGLPEPVTLRWKPASQPTIPIVGIIAGLVLLGSVVSGAVVAAVIWRKKSSGGKGGSYSKAEWSDSAQGSESHSL

SEQ ID NO: 903914 - protein, 214 aa, Homo sapiens
GDSEDPKLLEKGKETLLHLEPPKTHVTHHPISDHEATLRCWALGFYPAEITLTWQQDGEGHTQDTELVETRPAGDGTFQKWAAVVVPSGEEQRYTCHVQHEGLPEPVTLRWSKEGDGRSCLFSGKAGALLEPFRRVRAEAWGSGPLTFPSPEPASQPTIPIVGIIAGLVLLGSVVSGAVVAAVIWRKKSSGGKGGSYSKAEWSDSAQGSESHSL

SEQ ID NO: 903915 - protein, 199 aa, Homo sapiens
KQSTSVSTMTPFLTLTCVPSLFSFLLKIRTWALGFYPAEITLTWQQDGEGHTQDTELVETRPAGDGTFQKWAAVVVPSGEEQRYTCHVQHEGLPEPVTLRWKPASQPTIPIVGIIAGLVLLGSVVSGAVVAAVIWRKKSSGGKGGSYSKAECKCGAGSVEELAHPIIPPAPHLLWALTRSCFCSTPGSDSAQGSESHSL

SEQ ID NO: 903916 - protein, 164 aa, Homo sapiens; identical to SEQ ID NO: 903898

SEQ ID NO: 903917 - protein, 164 aa, Homo sapiens; identical to SEQ ID NO: 903898

SEQ ID NO: 903918 - protein, 199 aa, Homo sapiens; identical to SEQ ID NO: 903912

SEQ ID NO: 903919 - protein, 164 aa, Homo sapiens; identical to SEQ ID NO: 903898

SEQ ID NO: 903920 - protein, 164 aa, Homo sapiens; identical to SEQ ID NO: 903898

SEQ ID NO: 903921 - protein, 164 aa, Homo sapiens; identical to SEQ ID NO: 903898

SEQ ID NO: 903922 - protein, 164 aa, Homo sapiens; identical to SEQ ID NO: 903898

SEQ ID NO: 903923 - protein, 164 aa, Homo sapiens; identical to SEQ ID NO: 903898

SEQ ID NO: 903924 - protein, 160 aa, Homo sapiens
KQSTSVSTMTPFLTLTCVPSLFSFLLKIRTWALGFYPAEITLTWQQDGEGHTQDTELVETRPAGDGTFQKWAAVVVPSGEEQRYTCHVQHEGLPEPVTLRWKPASQPTIPIVGIIAGLVLLGSVVSGAVVAAVIWRKKSSGGEGRRVGSEFSCPTGCFKP

SEQ ID NO: 903925 - protein, 209 aa, Homo sapiens
MRAAAISTPKLDKMPGMFFSANPKELKGTTHSLLDDKMQKRRPKTFGMDMKAYLRSMIPHLESGMKSSKSKDVLSAAEVMQWSQSLEKLLANQTGQNVFGSFLKSEFSEENIEFWLACEDYKKTESDLLPCKAEEIYKAFVHSDAAKQINIDFRTRESTAKKIKAPTPTCFDEAQKVIYTLMEKDSYPRFLKSDIYLNLLNDLQANSLK

SEQ ID NO: 903926 - protein, 152 aa, Homo sapiens
MPGMFFSANPKELKGTTHSLLDDKMQKRRPKTFGMDMKAYLRSMIPHSEFSEENIEFWLACEDYKKTESDLLPCKAEEIYKAFVHSDAAKQINIDFRTRESTAKKIKAPTPTCFDEAQKVIYTLMEKDSYPRFLKSDIYLNLLNDLQANSLK

SEQ ID NO: 903927 - protein, 178 aa, Homo sapiens
MPGMFFSANPKELKGTTHSLLDDKMQKRRPKTFGMDMKAYLRSMIPHLESGMKSSKSKDVLSAAEVMQWSQSLEKLLANQTGQNVFGSFLKSEFSEENIEFWLACEDYKVHSDAAKQINIDFRTRESTAKKIKAPTPTCFDEAQKVIYTLMEKDSYPRFLKSDIYLNLLNDLQANSLK

SEQ ID NO: 903928 - protein, 191 aa, Homo sapiens
MRAAAISTPKLDKMPGMFFSANPKELKGTTHSLLDDKMQKRRPKTFGMDMKAYLRSMIPHLESGMKSSKSKDVLSAAEVMQWSQSLEKLLANQTGQNVFGSFLKSEFSEENIEFWLACEDYKVHSDAAKQINIDFRTRESTAKKIKAPTPTCFDEAQKVIYTLMEKDSYPRFLKSDIYLNLLNDLQANSLK

SEQ ID NO: 903929 - protein, 209 aa, Homo sapiens; identical to SEQ ID NO: 903925

SEQ ID NO: 903930 - protein, 196 aa, Homo sapiens
MPGMFFSANPKELKGTTHSLLDDKMQKRRPKTFGMDMKAYLRSMIPHLESGMKSSKSKDVLSAAEVMQWSQSLEKLLANQTGQNVFGSFLKSEFSEENIEFWLACEDYKKTESDLLPCKAEEIYKAFVHSDAAKQINIDFRTRESTAKKIKAPTPTCFDEAQKVIYTLMEKDSYPRFLKSDIYLNLLNDLQANSLK

SEQ ID NO: 903931 - protein, 224 aa, Homo sapiens
GKKRRGGRALFRPTRPGAAAISTPKLDKMPGMFFSANPKELKGTTHSLLDDKMQKRRPKTFGMDMKAYLRSMIPHLESGMKSSKSKDVLSAAEVMQWSQSLEKLLANQTGQNVFGSFLKSEFSEENIEFWLACEDYKKTESDLLPCKAEEIYKAFVHSDAAKQINIDFRTRESTAKKIKAPTPTCFDEAQKVIYTLMEKDSYPRFLKSDIYLNLLNDLQANSLK

SEQ ID NO: 903932 - protein, 191 aa, Homo sapiens
MRAAAISTPKLDKMPGMFFSANPKELKGTTHSLLDDKMQKRRPKTFGMDMKAYLRSMIPHLESGMKSSKSKDVLSAAEVMQWSQSLEKLLANQTGQNVFGSFLKSEFSEENIEFWLACEDYKKTESDLLPCKAEEIYKAFVHSDAAKQINIDFRTRESTAKKIKAPTPTCFDEAQKVIYTLMDDLQANSLK

SEQ ID NO: 903933 - protein, 182 aa, Homo sapiens
MRAAAISTPKLDKMPGMFFSANPKELKGTTHSLLDDKMQKRRPKTLLSAAEVMQWSQSLEKLLANQTGQNVFGSFLKSEFSEENIEFWLACEDYKKTESDLLPCKAEEIYKAFVHSDAAKQINIDFRTRESTAKKIKAPTPTCFDEAQKVIYTLMEKDSYPRFLKSDIYLNLLNDLQANSLK

SEQ ID NO: 903934 - protein, 209 aa, Homo sapiens; identical to SEQ ID NO: 903925

SEQ ID NO: 903935 - protein, 142 aa, Homo sapiens
PGDGGGGGRSSKGFMRPVPVRGVHSLHPRPFGGPVSLPWLRTGRCRWGLGLYRQPSLLPEEICGVFFRRHYPLTTLRFCGMDPEQRKWQKYCKPSWIFGFVAKSQTEPQENVCHLFAEYDMVQPASQVIGLVTALLQDAERM

SEQ ID NO: 903936 - protein, 145 aa, Homo sapiens
LASNCDHPHTHFLLGGGSKRSSTGFLNRRLTPSPGPGQRENLGPGSVAPAQCLPPTGCHTLYLSSVSVETLTGALAVQKAISTTFERDILPTPTVVHFKVTEQGITLTDVQRKVFFRRHYPLTTLRFCGMDPEQRKWQKYCKPSW

SEQ ID NO: 903937 - protein, 120 aa, Homo sapiens
MSQVMSSPLLAGGHAVSLAPCDEPRRTLHPAPSPSLPPQCSYYTTEGWGAQALMAPVPCMGPPGRLQQAPQVEAKATCFLPSPGEKALGTPEDLDSYIDFSLEEPGGWQRPPYTLLQLLS

SEQ ID NO: 903938 - protein, 374 aa, Homo sapiens
MGQPRTPHSPPLAKEHASSCPPSITNSMVDIPIVLINGCPEPGSSPPQRTPGHQNSVQPGAASPSNPCPATRSNSQTLSDAPFTTCPEGPARDMQPTMKFVMDTSKYWFKPNITREQAIELLRKEEPGAFVIRDSSSYRGSFGLALKVQEVPASAQSRPGEDSNDLIRHFLIESSAKGVHLKGADEEPYFGSLSAFVCQHSIMALALPCKLTIPQRELGGADGASDSTDSPASCQKKSAGCHTLYLSSVSVETLTGALAVQKAISTTFERDILPTPTVVHFKVTEQGITLTDVQRKVFFRRHYPLTTLRFCGMDPEQRKWQKYCKPSWIFGFVAKSQTEPQENVCHLFAEYDMVQPASQVIGLVTALLQDAERM

SEQ ID NO: 903939 - protein, 277 aa, Homo sapiens
MKFVMDTSKYWFKPNITREQAIELLRKEEPGAFVIRDSSSYRGSFGLALKVQEVPASAQSRPGEDSNDLIRHFLIESSAKGVHLKGADEEPYFGSLSAFVCQHSIMALALPCKLTIPQRELGGADGASDSTDSPASCQKKSAGCHTLYLSSVSVETLTGALAVQKAISTTFERDILPTPTVVHFKVTEQGITLTDVQRKVFFRRHYPLTTLRFCGMDPEQRKWQKYCKPSWIFGFVAKSQTEPQENVCHLFAEYDMVQPASQVIGLVTALLQDAERM

SEQ ID NO: 903940 - protein, 537 aa, Homo sapiens
MSQVMSSPLLAGGHAVSLAPCDEPRRTLHPAPSPSLPPQCSYYTTEGWGAQALMAPVPCMGPPGRLQQAPQVEAKATCFLPSPGEKALGTPEDLDSYIDFSLESLNQMILELDPTFQLLPPGTGGSQAELAQSTMSMRKKEESEALDIKYIEVTSARSRCHDGPQHCSSPSVTPPFGSLRSGGLLLSRDVPRETRSSSESLIFSGNQGRGHQRPLPPSEGLSPRPPNSPSISIPCMGSKASSPHGLGSPLVASPRLEKRLGGLAPQRGSRISVLSASPVSDVSYMFGSSQSLLHSSNSSHQSSSRSLESPANSSSSLHSLGSVSLCTRPSDFQAPRNPTLTMGQPRTPHSPPLAKEHASSCPPSITNSMVDIPIVLINGCPEPGSSPPQRTPGHQNSVQPGAASPSNPCPATRSNSQTLSDAPFTTCPEGPARDMQPTMKFVMDTSKYWFKPNITREQAIELLRKEEPGAFVIRDSSSYRGSFGLALKVQEVPASAQSRPGMRLSLCSLKASLRQRGVVGSSPGSGTSFQGDMAPVL

SEQ ID NO: 903941 - protein, 312 aa, Homo sapiens
MSQVMSSPLLAGGHAVSLAPCDEPRRTLHPAPSPSLPPQCSYYTTEGWGAQALMAPVPCMGPPGRLQQAPQVEAKATCFLPSPGEKALGTPEDLDSYIDFSLESLNQMILELDPTFQLLPPGTGGSQAELAQSTMSMRKKEESEALDIKYIEVTSARSRCHDGPQHCSSPSVTPPFGSLRSGGLLLSRDVPRETRSSSESLIFSGNQGRGHQRPLPPSEGLSPRPPNSPSISIPCMGSKASSPHGLGSPLVASPRLEKRLGGLAPQRGSRISVLSASPVSDVSYMFGSSQSLLHSSNSSHQSSSRSLEICRM

SEQ ID NO: 903942 - protein, 169 aa, Homo sapiens
MSQVMSSPLLAGGHAVSLAPCDEPRRTLHPAPSPSLPPQCSYYTTEGWGAQALMAPVPCMGPPGRLQQAPQVEAKATCFLPSPGEKALGTPEDLDSYIDFSLESLNQMILELDPTFQLLPPGTGGSQAELAQSTMSMRKKEESEALDIAPIFRKLFPLLAPSCIHQSLR

SEQ ID NO: 903943 - protein, 715 aa, Homo sapiens
MSQVMSSPLLAGGHAVSLAPCDEPRRTLHPAPSPSLPPQCSYYTTEGWGAQALMAPVPCMGPPGRLQQAPQVEAKATCFLPSPGEKALGTPEDLDSYIDFSLESLNQMILELDPTFQLLPPGTGGSQAELAQSTMSMRKKEESEALDIKYIEVTSARSRCHDGPQHCSSPSVTPPFGSLRSGGLLLSRDVPRETRSSSESLIFSGNQGRGHQRPLPPSEGLSPRPPNSPSISIPCMGSKASSPHGLGSPLVASPRLEKRLGGLAPQRGSRISVLSASPVSDVSYMFGSSQSLLHSSNSSHQSSSRSLESPANSSSSLHSLGSVSLCTRPSDFQAPRNPTLTMGQPRTPHSPPLAKEHASSCPPSITNSMVDIPIVLINGCPEPGSSPPQRTPGHQNSVQPGAASPSNPCPATRSNSQTLSDAPFTTCPEGPARDMQPTMKFVMDTSKYWFKPNITREQAIELLRKEEPGAFVIRDSSSYRGSFGLALKVQEVPASAQSRPGEDSNDLIRHFLIESSAKGVHLKGADEEPYFGSLSAFVCQHSIMALALPCKLTIPQRELGGADGASDSTDSPASCQKKSAGCHTLYLSSVSVETLTGALAVQKAISTTFERDILPTPTVVHFKVTEQGITLTDVQRKVFFRRHYPLTTLRFCGMDPEQRKWQKYCKPSWIFGFVAKSQTEPQENVCHLFAEYDMVQPASQVIGLVTALLQDAERM

SEQ ID NO: 903944 - protein, 477 aa, Homo sapiens
MKNKLRQVLEKYEDRKIYAKNWINSTEKMRKLLVTNLFEKPINLISGGAEVEKVKEMSSSPLPSSSRSLESPANSSSSLHSLGSVSLCTRPSDFQAPRNPTLTMGQPRTPHSPPLAKEHASSCPPSITNSMVDIPIVLINGCPEPGSSPPQRTPGHQNSVQPGAASPSNPCPATRSNSQTLSDAPFTTCPEGPARDMQPTMKFVMDTSKYWFKPNITREQAIELLRKEEPGAFVIRDSSSYRGSFGLALKVQEVPASAQSRPGEDSNDLIRHFLIESSAKGVHLKGADEEPYFGSLSAFVCQHSIMALALPCKLTIPQRELGGADGASDSTDSPASCQKKSAGCHTLYLSSVSVETLTGALAVQKAISTTFERDILPTPTVVHFKVTEQGITLTDVQRKVFFRRHYPLTTLRFCGMDPEQRKWQKYCKPSWIFGFVAKSQTEPQENVCHLFAEYDMVQPASQVIGLVTALLQDAERM

SEQ ID NO: 903945 - protein, 306 aa, Homo sapiens
SSVPDALSVGDFLGTKGDSVNICSVKTLRGWGQGVHGGAVSISDSRIVPAIELLRKEEPGAFVIRDSSSYRGSFGLALKVQEVPASAQSRPGEDSNDLIRHFLIESSAKGVHLKGADEEPYFGSLSAFVCQHSIMALALPCKLTIPQRELGGADGASDSTDSPASCQKKSAGCHTLYLSSVSVETLTGALAVQKAISTTFERDILPTPTVVHFKVTEQGITLTDVQRKVFFRRHYPLTTLRFCGMDPEQRKWQKYCKPSWIFGFVAKSQTEPQENVCHLFAEYDMVQPASQVIGLVTALLQDAERM

SEQ ID NO: 903946 - protein, 288 aa, Homo sapiens
MSQVMSSPLLAGGHAVSLAPCDEPRRTLHPAPSPSLPPQCSYYTTEGWGAQALMAPVPCMGPPGRLQQAPQVEAKATCFLPSPGEKALGTPEDLDSYIDFSLESLNQMILELDPTFQLLPPGTGGSQAELAQSTMSMRKKEESEALDIKYIEVTSARSRCHDGPQHCSSPSVTPPFGSLRSGGLLLSRDVPRETRSSSESLIFSGNQGRGHQRPLPPSEGLSPRPPNSPSISIPCMGSKASSPHGLGSPLVASPRLEKRLGGLAPQRGSRISVLSASPVSDVSYMFGR

SEQ ID NO: 903947 - protein, 110 aa, Homo sapiens
HSPASSAACRTMAQGQRKFQAHKPAKSKTAAAASEKNRGPRKGGRVIAPKKARVVQQQKLKKNLEVGIRKKIEHDVVMKASSSLPKKLALLKAPAKKKGAAAATSSKTPS

SEQ ID NO: 903948 - protein, 72 aa, Homo sapiens
RARSEGIEPGAALGAKDGARGQRGNLEVGIRKKIEHDVVMKASSSLPKKLALLKAPAKKKGAAAATSSKTPS

SEQ ID NO: 903949 - protein, 110 aa, Homo sapiens; identical to SEQ ID NO: 903947

SEQ ID NO: 903950 - protein, 79 aa, Homo sapiens
PEDYEALGPRKGGRVIAPKKARVVQQQKLKKNLEVGIRKKIEHDVVMKASSSLPKKLALLKAPAKKKGAAAATSSKTPS

SEQ ID NO: 903951 - protein, 110 aa, Homo sapiens; identical to SEQ ID NO: 903947

SEQ ID NO: 903952 - protein, 73 aa, Homo sapiens
QEEGDWSGPLSAPGHNADCPVLLPQNLEVGIRKKIEHDVVMKASSSLPKKLALLKAPAKKKGAAAATSSKTPS

SEQ ID NO: 903953 - protein, 70 aa, Homo sapiens
CRPTVHVQKLSQECLKRLAIKKNLEVGIRKKIEHDVVMKASSSLPKKLALLKAPAKKKGAAAATSSKTPS

SEQ ID NO: 903954 - protein, 110 aa, Homo sapiens; identical to SEQ ID NO: 903947

SEQ ID NO: 903955 - protein, 110 aa, Homo sapiens; identical to SEQ ID NO: 903947

SEQ ID NO: 903956 - protein, 110 aa, Homo sapiens; identical to SEQ ID NO: 903947

SEQ ID NO: 903957 - protein, 136 aa, Homo sapiens
HSPASSAACRTMAQGQRKFQAHKPAKSKTAAAASEKNRGPRKGGKERPGDLGARWTPGFPASREQHLSPGRVIAPKKARVVQQQKLKKNLEVGIRKKIEHDVVMKASSSLPKKLALLKAPAKKKGAAAATSSKTPS

SEQ ID NO: 903958 - protein, 110 aa, Homo sapiens; identical to SEQ ID NO: 903947

SEQ ID NO: 903959 - protein, 73 aa, Homo sapiens
HSPASSAACRTMAQGQRKFQAHKPAKSKTAAAASEKNRGPRKGGRVIAPKKARVVQQQKLKKRQVSLCCSGWS

SEQ ID NO: 903960 - protein, 97 aa, Homo sapiens
HSPASSAACRTMAQGQRKFQAHKPAKSKTAAAASEKNRGPRKGGRVIAPKKARVVQQQKLKKVVMKASSSLPKKLALLKAPAKKKGAAAATSSKTPS

SEQ ID NO: 903961 - protein, 584 aa, Homo sapiens
SKSHCADDQRAPRIPPPGWPRLLPPRGKARTGQCAGGWVLAARPDGTKAAGVCGRSLGCGPGGTHAVQGNMADAEVIILPKKHKKKKERKSLPEEDVAEIQHAEEFLIKPESKVAKLDTSQWPLLLKNFDKLNVRTTHYTPLACGSNPLKREIGDYIRTGFINLDKPSNPSSHEVVAWIRRILRVEKTGHSGTLDPKVTGCLIVCIERATRLVKSQQSAGKEYVGIVRLHNAIEGGTQLSRALETLTGALFQRPPLIAAVKRQLRVRTIYESKMIEYDPERRLGIFWVSCEAGTYIRTLCVHLGLLLGVGGQMQELRRVRSGVMSEKDHMVTMHDVLDAQWLYDNHKDESYLRRVVYPLEKLLTSHKRLVMKDSAVNAICYGAKIMLPGVLRYEDGIEVNQEIVVITTKGEAICMAIALMTTAVISTCDHGIVAKIKRVIMERDTYPRKWGLGPKASQKKLMIKQGLLDKHGKPTDSTPATWKQEYVDYSESAKKEVVAEVVKAPQVVAEAAKTAKRKRESESESDETPPAAPQLIKKEKKKSKKDKKAKAGLESGAEPGDGDSDTTKKKKKKKKAKEVELVSE

SEQ ID NO: 903962 - protein, 74 aa, Homo sapiens
LLLNSRPRRLCVHLGLLLGVGGQMQELRRVRSGVMSEKDHMVTMHDVLDAQWLYDNNSPQVTLILVVISRRARE

SEQ ID NO: 903963 - protein, 584 aa, Homo sapiens; identical to SEQ ID NO: 903961

SEQ ID NO: 903964 - protein, 584 aa, Homo sapiens; identical to SEQ ID NO: 903961

SEQ ID NO: 903965 - protein, 584 aa, Homo sapiens; identical to SEQ ID NO: 903961

SEQ ID NO: 903966 - protein, 402 aa, Homo sapiens
SKRRPGCNRQSLDPKVTGCLIVCIERATRLVKSQQSAGKEYVGIVRLHNAIEGGTQLSRALETLTGALFQRPPLIAAVKRQLRVRTIYESKMIEYDPERRLGIFWVSCEAGTYIRTLCVHLGLLLGVGGQMQELRRVRSGVMSEKDHMVTMHDVLDAQWLYDNHKDESYLRRVVYPLEKLLTSHKRLVMKDSAVNAICYGAKIMLPGVLRYEDGIEVNQEIVVITTKGEAICMAIALMTTAVISTCDHGIVAKIKRVIMERDTYPRKWGLGPKASQKKLMIKQGLLDKHGKPTDSTPATWKQEYVDYSESAKKEVVAEVVKAPQVVAEAAKTAKRKRESESESDETPPAAPQLIKKEKKKSKKDKKAKAGLESGAEPGDGDSDTTKKKKKKKKAKEVELVSE

SEQ ID NO: 903967 - protein, 252 aa, Homo sapiens
MHDVLDAQWLYDNHKDESYLRRVVYPLEKLLTSHKRLVMKDSAVNAICYGAKIMLPGVLRYEDGIEVNQEIVVITTKGEAICMAIALMTTAVISTCDHGIVAKIKRVIMERDTYPRKWGLGPKASQKKLMIKQGLLDKHGKPTDSTPATWKQEYVDYSESAKKEVVAEVVKAPQVVAEAAKTAKRKRESESESDETPPAAPQLIKKEKKKSKKDKKAKAGLESGAEPGDGDSDTTKKKKKKKKAKEVELVSE

SEQ ID NO: 903968 - protein, 269 aa, Homo sapiens
GEAPLGRLMYKRDHMVTMHDVLDAQWLYDNHKDESYLRRVVYPLEKLLTSHKRLVMKDSAVNAICYGAKIMLPGVLRYEDGIEVNQEIVVITTKGEAICMAIALMTTAVISTCDHGIVAKIKRVIMERDTYPRKWGLGPKASQKKLMIKQGLLDKHGKPTDSTPATWKQEYVDYSESAKKEVVAEVVKAPQVVAEAAKTAKRKRESESESDETPPAAPQLIKKEKKKSKKDKKAKAGLESGAEPGDGDSDTTKKKKKKKKAKEVELVSE

SEQ ID NO: 903969 - protein, 442 aa, Homo sapiens
SKSHCADDQRAPRIPPPGWPRLLPPRGKARTGQCAGGWVLAARPDGTKAAGVCGRSLGCGPGGTHAVQGNMADAEVIILPKKHKKKKERKSLPEEDVAEIQHAEEFLIKPESKVAKLDTSQWPLLLKNFDKLNVRTTHYTPLACGSNPLKREIGDYIRTGFINLDKPSNPSSHEVVAWIRRILRVEKTGHSGTLDPKVTGCLIVCIERATRLVKSQQSAGKEYVGIVRLHNAIEGGTQLSRALETLTGALFQRPPLIAAVKRQLRVRTIYESKMIEYDPERRLGIFWVSCEAGTYIRTLCVHLGLLLGVGGQMQELRRVRSGVMSEKDHMVTMHDVLDAQWLYDNHKDESYLRRVVYPLEKLLTSHKRLVMKDSAVNWHLLWGRYAPGVSNGRLRPPGWGLPPGTSGWVCYATGLPGRFPIPGPGTPRGSAQSWLRAPRCFS

SEQ ID NO: 903970 - protein, 119 aa, Homo sapiens
ITLHNISTALESHSVNLTYCYLFFSESAKKEVVAEVVKAPQVVAEAAKTAKRKRESESESDETPPAAPQLIKKEKKKSKKDKKAKAGLESGAEPGDGDSDTTKKKKKKKKAKEVELVSE

SEQ ID NO: 903971 - protein, 295 aa, Homo sapiens
DAWVDPRVAHATGFINLDKPSNPSSHEVVAWIRRILRVEKTGHSGTLDPKVTGCLIVCIERATRLVKSQQSAGKEYVGIVRLHNAIEGGTQLSRALETLTGALFQRPPLIAAVKRQLRVRTIYESKMIEYDPERRLGIFWVSCEAGTYIRTLCVHLGLLLGVGGQMQELRRVRSGVMSEKDHMVTMHDVLDAQWLYDNHKDESYLRRVVYPLEKLLTSHKRLVMKDSAVNWHLLWGRYAPGVSNGRLRPPGWGLPPGTSGWVCYATGLPGRFPIPGPGTPRGSAQSWLRAPRCFS

SEQ ID NO: 903972 - protein, 555 aa, Homo sapiens
RLVRGGVNRRLAARPDGTKAAGVCGRSLGCGPGGTHAVQGNMADAEVIILPKKHKKKKERKSLPEEDVAEIQHAEEFLIKPESKVAKLDTSQWPLLLKNFDKLNVRTTHYTPLACGSNPLKREIGDYIRTGFINLDKPSNPSSHEVVAWIRRILRVEKTGHSGTLDPKVTGCLIVCIERATRLVKSQQSAGKEYVGIVRLHNAIEGGTQLSRALETLTGALFQRPPLIAAVKRQLRVRTIYESKMIEYDPERRLGIFWVSCEAGTYIRTLCVHLGLLLGVGGQMQELRRVRSGVMSEKDHMVTMHDVLDAQWLYDNHKDESYLRRVVYPLEKLLTSHKRLVMKDSAVNAICYGAKIMLPGVLRYEDGIEVNQEIVVITTKGEAICMAIALMTTAVISTCDHGIVAKIKRVIMERDTYPRKWGLGPKASQKKLMIKQGLLDKHGKPTDSTPATWKQEYVDYSESAKKEVVAEVVKAPQVVAEAAKTAKRKRESESESDETPPAAPQLIKKEKKKSKKDKKAKAGLESGAEPGDGDSDTTKKKKKKKKAKEVELVSE

SEQ ID NO: 903973 - protein, 584 aa, Homo sapiens; identical to SEQ ID NO: 903961

SEQ ID NO: 903974 - protein, 548 aa, Homo sapiens
MADAEVIYARRNHTGMKQWMPEGSLRAETKTVGATLSIVCNDKFAYQNLRVQRLTRIGARLSGALVAKRKFVTKPELLMRQSTRDTSFVGQWWCPIVHFWTWSRTIGRARDYVEVNDGLLHVNSLVQKALCLTPSSHEVVAWIRRILRVEKTGHSGTLDPKVTGCLIVCIERATRLVKSQQSAGKEYVGIVRLHNAIEGGTQLSRALETLTGALFQRPPLIAAVKRQLRVRTIYESKMIEYDPERRLGIFWVSCEAGTYIRTLCVHLGLLLGVGGQMQELRRVRSGVMSEKDHMVTMHDVLDAQWLYDNHKDESYLRRVVYPLEKLLTSHKRLVMKDSAVNAICYGAKIMLPGVLRYEDGIEVNQEIVVITTKGEAICMAIALMTTAVISTCDHGIVAKIKRVIMERDTYPRKWGLGPKASQKKLMIKQGLLDKHGKPTDSTPATWKQEYVDYSESAKKEVVAEVVKAPQVVAEAAKTAKRKRESESESDETPPAAPQLIKKEKKKSKKDKKAKAGLESGAEPGDGDSDTTKKKKKKKKAKEVELVSE

SEQ ID NO: 903975 - protein, 272 aa, Homo sapiens [sequence omitted]

SEQ ID NO: 903976 - protein, 262 aa, Homo sapiens [sequence omitted]

SEQ ID NO: 903977 - protein, 332 aa, Homo sapiens
SKSHCADDQRAPRIPPPGWPRLLPPRGKARTGQCAGGWVLAARPDGTKAAGVCGRSLGCGPGGTHAVQGNMADAEVIILPKKHKKKKERKSLPEEDVAEIQHAEEFLIKPESKVAKLDTSQWPLLLKNFDKLNVRTTHYTPLACGSNPLKREIGDYIRTGFINLDKPSNPSSHEVVAWIRRILRVEKTGHSGTLDPKVTGCLIVCIERATRLVKSQQSAGKEYVGIVRLHNAIEGGTQLSRALETLTGALFQRPPLIAAVKRQLRVRTIYESKMIEYDPERRLGIFWVSCEAGTYIRTLCVHLGCIGVGANADLGARLGWGRPWGACVSQGV

SEQ ID NO: 903978 - protein, 739 aa, Homo sapiens
TCPPEFLHQQHGRRLRGEPGRRRLCSPRVTGPLPPSALGPRGEIDVYLAKSLAEKLYLFQYPVRPASMTYDDIPHLSAKIKPKQQKVELEMAIDTLNPNYCRSKGEQIALNVDGACADETSTYSSKLMDKQTFCSSQTTSNTSRYAAALYRQGELHLTPLHGILQLRPSFSYLDKADAKHREREAANEAGDSSQDEAEDDVKQITVRFSRPESEQARQRRVQSYEFLQKKHAEEPWVHLHYYGLRDSRSEHERQYLLCPGSSGVENTELVKSPSEYLMMLMPPSQEEEKDKPVAPSNVLSMAQLRTLPLADQIKILMKNVKVMPFANLMSLLGPSIDSVAVLRGIQKVAMLVQGNWVVKSDILYPKDSSSPHSGVPAEVLCRGRDFVMWKFTQSRWVVRKEVATVTKLCAEDVKDFLEHMAVVRINKGWEFILPYDGEFIKKHPDVVQRQHMLWTGIQAKLEKVYNLVKETMPKKPDAQSGPAGLVCGDQRIQVAKTKAQQNHALLERELQRRKEQLRVPAVPPGVRIKEEPVSEEGEEDEEQEAEEEPMDTSPSGLHSKLANGLPLGRAAGTDSFNGHPPQGCASTPVARELKAFVEATFQRQFVLTLSELKRLFNLHLASLPPGHTLFSGISDRMLQDTVLAAGCKQILVPFPPQTAASPDEQKVFALWESGDMSDQHRQVLLEIFSKNYRVRRNMIQSRLTQECGEDLSKQEVDKVLKDCCVSYGGMWYLKGTVQS

SEQ ID NO: 903979 - protein, 763 aa, Homo sapiens
VSAGVSPPATWPPPERRAGPPPSLQPAGNWAVAAVRARPPRRDRAEGLRGWLSSSMANEEDDPVVQEIDVYLAKSLAEKLYLFQYPVRPASMTYDDIPHLSAKIKPKQQKVELEMAIDTLNPNYCRSKGEQIALNVDGACADETSTYSSKLMDKQTFCSSQTTSNTSRYAAALYRQGELHLTPLHGILQLRPSFSYLDKADAKHREREAANEAGDSSQDEAEDDVKQITVRFSRPESEQARQRRVQSYEFLQKKHAEEPWVHLHYYGLRDSRSEHERQYLLCPGSSGVENTELVKSPSEYLMMLMPPSQEEEKDKPVAPSNVLSMAQLRTLPLADQIKILMKNVKVMPFANLMSLLGPSIDSVAVLRGIQKVAMLVQGNWVVKSDILYPKDSSSPHSGVPAEVLCRGRDFVMWKFTQSRWVVRKEVATVTKLCAEDVKDFLEHMAVVRINKGWEFILPYDGEFIKKHPDVVQRQHMLWTGIQAKLEKVYNLVKETMPKKPDAQSGPAGLVCGDQRIQVAKTKAQQNHALLERELQRRKEQLRVPAVPPGVRIKEEPVSEEGEEDEEQEAEEEPMDTSPSGLHSKLANGLPLGRAAGTDSFNGHPPQGCASTPVARELKAFVEATFQRQFVLTLSELKRLFNLHLASLPPGHTLFSGISDRMLQDTVLAAGCKQILVPFPPQTAASPDEQKVFALWESGDMSDQHRQVLLEIFSKNYRVRRNMIQSRLTQECGEDLSKQEVDKVLKDCCVSYGGMWYLKGTVQS

SEQ ID NO: 903980 - protein, 721 aa, Homo sapiens
VSAGVSPPATWPPPERRAGPPPSLQPAGNWAVAAVRARPPRRDRAEGLRGWLSSSMANEEDDPVVQEIDVYLAKSLAEKLYLFQYPVRPASMTYDDIPHLSAKIKPKQQKVELEMAIDTLNPNYCRSKGEQIALNVDGACADETSTYSSKLMDKQTFCSSQTTSNTSRYAAALYRQGELHLTPLHGILQLRPSFSYLDKADAKHREREAANEAGDSSQDEAEDDVKQITVRFSRPESEQARQRRVQSYEFLQKKHAEEPWVHLHYYGLRDSRSEHERQYLLCPGSSGVENTELVKSPSEYLMMLMPPSQEEEKDKPVAPSNVLSMAQLRTLPLADQIKILMKNVKVMPFANLMSLLGPSIDSVAVLRGIQKVAMLVQGNWVVKSDILYPKDSSSPHSGVPAEVLCRGRDFVMWKFTQSRWVVRKEVATVTKLCAEDVKDFLEHMAVVRINKGWEFILPYDGEFIKKHPDVVQRQHMLWTGIQAKLEKVYNLVKETMPKKPDAQSGPAGLVCGDQRIQVAKTKAQQNHALLERELQRRKEQLRVPAVPPGVRIKEEPVSEEGEEDEEQEAEEEPMDTSPSGLHSKLANGLPLGRAAGTDSFNGHPPQGCASTPVARELKAFVEATFQRQFVLTLSELKRLFNLHLASLPPGHTLFSGISDRMLQDTVLAAGCKQILVPFPPQTAASPDEQKVFALWESGDMSDQDCCVSYGGMWYLKGTVQS

SEQ ID NO: 903981 - protein, 534 aa, Homo sapiens
VSAGVSPPATWPPPERRAGPPPSLQPAGNWAVAAVRARPPRRDRAEGLRGWLSSSMANEEDDPVVQEIDVYLAKSLAEKLYLFQYPVRPASMTYDDIPHLSAKIKPKQQKVELEMAIDTLNPNYCRSKGEQIALNVDGACADETSTYSSKLMDKQTFCSSQTTSNTSRYAAALYRQGELHLTPLHGILQLRPSFSYLDKADAKHREREAANEAGDSSQDEAEDDVKQITVRFSRPESEQARQRRVQSYEFLQKKHAEEPWVHLHYYGLRDSRSEHERQYLLCPGSSGVENTELVKSPSEYLMMLMPPSQEEEKDKPVAPSNVLSMAQLRTLPLADQIKILMKNVKVMPFANLMSLLGPSIDSVAVLRGIQKVAMLVQGNWVVKSDILYPKDSSSPHSGVPAEVLCRGRDFVMWKFTQSRWVVRKEVATVTKLCAEDVKDFLEHMAVVRINKGWEFILPYDGEFIKKHPDVVQRQHMLWTGIQAKLEKVYNLVKETMPKKPDAQSGPAGLVCGDQRIQVAKTKAQAAPAPLWLGN

SEQ ID NO: 903982 - protein, 739 aa, Homo sapiens; identical to SEQ ID NO: 903978

SEQ ID NO: 903983 - protein, 745 aa, Homo sapiens
VSAGVSPPATWPPPERRAGPPPSLQPAGNWAVAAVRARPPRRDRAEGLRGWLSSSMANEEDDPVVQEIDVYLAKSLAEKLYLFQYPVRPASMTYDDIPHLSAKIKPKQQKVELEMAIDTLNPNYCRSKGEQIALNVDGACADETSTYSSKLMDKQTFCSSQTTSNTSRYAAALYRQGELHLTPLHGILQLRPSFSYLDKADAKHREREAANEAGDSSQDEAEDDVKQITVRFSRPESEQARQRRVQSYEFLQKKHAEEPWVHLHYYGLRDSRSEHERQYLLCPGSSGVENTELVKSPSEYLMMLMPPSQEEEKDKPVAPSNVLSMAQLRTLPLADQIKILMKNVKVMPFANLMSLLGPSIDSVAVLRGIQKVAMLVQGNWVVKSDILYPKDSSSPHSGVPAEVLCRGRDFVMWKFTQSRWVVRKEVATVTKLCAEDVKDFLEHMAVVRINKGWEFILPYDGEFIKKHPDVVQRQHMLWTGIQAKLEKVYNLVKETMPKKPDAQSGPAGLVCGDQRIQVAKTKAQQNHALLERELQRRKEQLRVPAVPPGVRIKEEPVSEEGEEDEEQEAEEEPMDTSPSGLHSKLANGLPLGRAAGTDSFNGHPPQGCASTPVARELKAFVEATFQRQFVLTLSELKRLFNLHLASLPPGHTLFSGISDRMLQDTVLAAGCKQILVPFPPQTAASPDEQKVFALWESGDMSDQHRQVLLEIFSREDLSKQEVDKVLKDCCVSYGGMWYLKGTVQS

SEQ ID NO: 903984 - protein, 462 aa, Homo sapiens
MMLMPPSQEEEKDKPVAPSNVLSMAQLRTLPLADQIKILMKNVKVMPFANLMSLLGPSIDSVAVLRGIQKVAMLVQGNWVVKSDILYPKDSSSPHSGVPAEVLCRGRDFVMWKFTQSRWVVRKEVATVTKLCAEDVKDFLEHMAVVRINKGWEFILPYDGEFIKKHPDVVQRQHMLWTGIQAKLEKVYNLVKETMPKKPDAQSGPAGLVCGDQRIQVAKTKAQQNHALLERELQRRKEQLRVPAVPPGVRIKEEPVSEEGEEDEEQEAEEEPMDTSPSGLHSKLANGLPLGRAAGTDSFNGHPPQGCASTPVARELKAFVEATFQRQFVLTLSELKRLFNLHLASLPPGHTLFSGISDRMLQDTVLAAGCKQILVPFPPQTAASPDEQKVFALWESGDMSDQHRQVLLEIFSKNYRVRRNMIQSRLTQECGEDLSKQEVDKVLKDCCVSYGGMWYLKGTVQS

SEQ ID NO: 903985 - protein, 709 aa, Homo sapiens
VSAGVSPPATWPPPERRAGPPPSLQPAGNWAVAAVRARPPRRDRAEGLRGWLSSSMANEEDDPVVQEIDVYLAKSLAEKLYLFQYPVRPASMTYDDIPHLSAKIKPKQQKVELEMAIDTLNPNYCRSKGEQIALNVDGACADETSTYSSKLMDKQTFCSSQTTSNTSRYAAALYRQGELHLTPLHGILQLRPSFSYLDKADAKHREREAANEAGDSSQDEAEDDVKQITVRFSRPESEQARQRRVQSYEFLQKKHAEEPWVHLHYYGLRDSRSEHERQYLLCPGSSGVENTELVKSPSEYLMMLMPPSQEEEKDKPVAPSNVLSMAQLRTLPLADQIKILMKNVKVMPFANLMSLLGPSIDSVAVLRGIQKVAMLVQGNWVVKSDILYPKDSSSPHSGVPAEVLCRGRDFVMWKFTQSRWVVRKEVATVTKLCAEDVKDFLEHMAVVRINKGWEFILPYDGEFIKKHPDVVQRQHMLWTGIQAKLEKVYNLVKETMPKKPDAQSGPAGLVCGDQRIQVAKTKAQQNHALLERELQRRKEQLRVPAVPPGVRIKEEPVSEEGEEDEEQEAEEEPMDTSPSGLHSKLANGLPLGRAAGTDSFNGHPPQGCASTPVARELKAFVEATFQRQFVLTLSELKRLFNLHLASLPPGHTLFSGISDRMLQDTVLAAGCKQILVPVSRALPARGMGGGGWGEPAVGRPRGDTGGHAW

SEQ ID NO: 903986 - protein, 763 aa, Homo sapiens; identical to SEQ ID NO: 903979

SEQ ID NO: 903987 - protein, 187 aa, Homo sapiens
GLQELARELANGLPLGRAAGTDSFNGHPPQGCASTPVARELKAFVEATFQRQFVLTLSELKRLFNLHLASLPPGHTLFSGISDRMLQDTVLAAGCKQILVPFPPQTAASPDEQKVFALWESGDMSDQHRQVLLEIFSKNYRVRRNMIQSRLTQECGEDLSKQEVDKVLKDCCVSYGGMWYLKGTVQS

SEQ ID NO: 903988 - protein, 769 aa, Homo sapiens
VSAGVSPPATWPPPERRAGPPPSLQPAGNWAVAAVRARPPRRDRAEGLRGWLSSSMANEEDDPVVQEIDVYLAKSLAEKLYLFQYPVRPASMTYDDIPHLSAKIKPKQQKVELEMAIDTLNPNYCRSKGEQIALNVDGACADETSTYSSKLMDKQTFCSSQTTSNTSRYAAALYRQGELHLTPLHGILQLRPSFSYLDKADAKHREREAANEAGDSSQDEAEDDVKQITVRFSRPESEQARQRRVQSYEFLQKKHAEEPWVHLHYYGLRDSRSEHERQYLLCPGSSGVENTELVKSPSEYLMMLMPPSQEEEKDKPVAPSNVLSMAQLRTLPLADQIKILMKNVKVMPFANLMSLLGPSIDSVAVLRGIQKVAMLVQGNWVVKSDILYPKDSSSPHSGVPAEVLCRGRDFVMWKFTQSRWVVRKEVATVTKLCAEDVKDFLEHMAVVRINKGWEFILPYDGEFIKKHPDVVQRQHMLWTGIQAKLEKVYNLVKETMPKKPDAQSGPAGLVCGDQRIQVAKTKAQQNHALLERELQRRKEQLRVPAVPPGVRIKEEPVSEEGEEDEEQEAEEEPMDTSPSGLHSKLANGLPLGRAAGTDSFNGHPPQGCASTPVARELKAFVEATFQRQFVLTLSELKRLFNLHLASLPPGHTLFSGISDRMLQDTVLAAGCKQILVPFPPQTAASPDEQKVFALWESGDMSDQHRQVLLEIFSKNYRVRRNMIQSRLTQECGEDLSKQEVDKVLKDCCVSYGGMWYLKGTTEQEELTIS

SEQ ID NO: 903989 - protein, 272 aa, Homo sapiens
VSAGVSPPATWPPPERRAGPPPSLQPAGNWAVAAVRARPPRRDRAEGLRGWLSSSMANEEDDPVVQEIDVYLAKSLAEKLYLFQYPVRPASMTYDDIPHLSAKIKPKQQKVELEMAIDTLNPNYCRSKGEQIALNVDGACADETSTYSSKLMDKQTFCSSQTTSNTSRYAAALYRQGELHLTPLHGILQLRPSFSYLDKADAKHREKEAAHQVMGLFKDEAQNHVKPYKVRFFRSGVIPGPAKSSSIPLNLCKTNTPKYPWDPLAYLMPDRT

SEQ ID NO: 903990 - protein, 67 aa, Homo sapiens
RDGPLFCRGSGLLGEGGGGLSAPSPQTLTWVAGEEGPAWISPEPLPLPCPCSEYLMMLMPPSQEEEK

SEQ ID NO: 903991 - protein, 709 aa, Homo sapiens; identical to SEQ ID NO: 903985

SEQ ID NO: 903992 - protein, 763 aa, Homo sapiens; identical to SEQ ID NO: 903979

SEQ ID NO: 903993 - protein, 709 aa, Homo sapiens; identical to SEQ ID NO: 903985

SEQ ID NO: 903994 - protein, 696 aa, Homo sapiens
VSAGVSPPATWPPPERRAGPPPSLQPAGNWAVAAVRARPPRRDRAEGLRGWLSSSMANEEDDPVVQEIDVYLAKSLAEKLYLFQYPVRPASMTYDDIPHLSAKIKPKQQKVELEMAIDTLNPNYCRSKGEQIALNVDGACADETSTYSSKLMDKQTFCSSQTTSNTSRYAAALYRQGELHLTPLHGILQLRPSFSYLDKADAKHREREAANEAGDSSQDEAEDDVKQITVRFSRPESEQARQRRVQSYEFLQKKHAEEPWVHLHYYGLRDSRSEHERQYLLCPGSSGVENTELVKSPSEYLMMLMPPSQEEEKDKPVAPSNVLSMAQLRTLPLADQIKILMKNVKVMPFANLMSLLGPSIDSVAVLRGIQKVAMLVQGNWVVKSDILYPKDSSSPHSGVPAEVLCRGRDFVMWKFTQSRWVVRKEVATVTKLCAEDVKDFLEHMAVVRINKGWEFILPYDGEFIKKHPDVVQRQHMLWTGIQAKLEKVYNLVKETMPKKPDAQSGPAGLVCGDQRIQLANGLPLGRAAGTDSFNGHPPQGCASTPVARELKAFVEATFQRQFVLTLSELKRLFNLHLASLPPGHTLFSGISDRMLQDTVLAAGCKQILVPFPPQTAASPDEQKVFALWESGDMSDQHRQVLLEIFSKNYRVRRNMIQSRLTQECGEDLSKQEVDKVLKDCCVSYGGMWYLKGTVQS

SEQ ID NO: 903995 - protein, 692 aa, Homo sapiens
GQDQAQAAEGHRGWEVRNVIVGHRGWTHLSAKIKPKQQKVELEMAIDTLNPNYCRSKGEQIALNVDGACADETSTYSSKLMDKQTFCSSQTTSNTSRYAAALYRQGELHLTPLHGILQLRPSFSYLDKADAKHREREAANEAGDSSQDEAEDDVKQITVRFSRPESEQARQRRVQSYEFLQKKHAEEPWVHLHYYGLRDSRSEHERQYLLCPGSSGVENTELVKSPSEYLMMLMPPSQEEEKDKPVAPSNVLSMAQLRTLPLADQIKILMKNVKVMPFANLMSLLGPSIDSVAVLRGIQKVAMLVQGNWVVKSDILYPKDSSSPHSGVPAEVLCRGRDFVMWKFTQSRWVVRKEVATVTKLCAEDVKDFLEHMAVVRINKGWEFILPYDGEFIKKHPDVVQRQHMLWTGIQAKLEKVYNLVKETMPKKPDAQSGPAGLVCGDQRIQVAKTKAQQNHALLERELQRRKEQLRVPAVPPGVRIKEEPVSEEGEEDEEQEAEEEPMDTSPSGLHSKLANGLPLGRAAGTDSFNGHPPQGCASTPVARELKAFVEATFQRQFVLTLSELKRLFNLHLASLPPGHTLFSGISDRMLQDTVLAAGCKQILVPFPPQTAASPDEQKVFALWESGDMSDQHRQVLLEIFSKNYRVRRNMIQSRLTQECGEDLSKQEVDKVLKDCCVSYGGMWYLKGTVQS

SEQ ID NO: 903996 - protein, 627 aa, Homo sapiens
EICTSTSPVLFQYAGRRALHVLHMSQLVHTSRYAAALYRQGELHLTPLHGILQLRPSFSYLDKADAKHREREAANEAGDSSQDEAEDDVKQITVRFSRPESEQARQRRVQSYEFLQKKHAEEPWVHLHYYGLRDSRSEHERQYLLCPGSSGVENTELVKSPSEYLMMLMPPSQEEEKDKPVAPSNVLSMAQLRTLPLADQIKILMKNVKVMPFANLMSLLGPSIDSVAVLRGIQKVAMLVQGNWVVKSDILYPKDSSSPHSGVPAEVLCRGRDFVMWKFTQSRWVVRKEVATVTKLCAEDVKDFLEHMAVVRINKGWEFILPYDGEFIKKHPDVVQRQHMLWTGIQAKLEKVYNLVKETMPKKPDAQSGPAGLVCGDQRIQVAKTKAQQNHALLERELQRRKEQLRVPAVPPGVRIKEEPVSEEGEEDEEQEAEEEPMDTSPSGLHSKLANGLPLGRAAGTDSFNGHPPQGCASTPVARELKAFVEATFQRQFVLTLSELKRLFNLHLASLPPGHTLFSGISDRMLQDTVLAAGCKQILVPFPPQTAASPDEQKVFALWESGDMSDQHRQVLLEIFSKNYRVRRNMIQSRLTQECGEDLSKQEVDKVLKDCCVSYGGMWYLKGTVQS

SEQ ID NO: 903997 - protein, 321 aa, Homo sapiens
HRPALPHQYGLGSEASVLGEFIKKHPDVVQRQHMLWTGIQAKLEKVYNLVKETMPKKPDAQSGPAGLVCGDQRIQVAKTKAQQNHALLERELQRRKEQLRVPAVPPGVRIKEEPVSEEGEEDEEQEAEEEPMDTSPSGLHSKLANGLPLGRAAGTDSFNGHPPQGCASTPVARELKAFVEATFQRQFVLTLSELKRLFNLHLASLPPGHTLFSGISDRMLQDTVLAAGCKQILVPFPPQTAASPDEQKVFALWESGDMSDQHRQVLLEIFSKNYRVRRNMIQSRLTQECGEDLSKQEVDKVLKDCCVSYGGMWYLKGTVQS

SEQ ID NO: 903998 - protein, 763 aa, Homo sapiens; identical to SEQ ID NO: 903979

SEQ ID NO: 903999 - protein, 520 aa, Homo sapiens
VSAGVSPPATWPPPERRAGPPPSLQPAGNWAVAAVRARPPRRDRAEGLRGWLSSSMANEEDDPVVQEIDVYLAKSLAEKLYLFQYPVRPASMTYDDIPHLSAKIKPKQQKVELEMAIDTLNPNYCRSKGEQIALNVDGACADETSTYSSKLMDKQTFCSSQTTSNTSRYAAALYRQGELHLTPLHGILQLRPSFSYLDKADAKHREREAANEAGDSSQDEAEDDVKQITVRFSRPESEQARQRRVQSYEFLQKKHAEEPWVHLHYYGLRDSRSEHERQYLLCPGSSGVENTELVKSPSEYLMMLMPPSQEEEKDKPVAPSNVLSMAQLRTLPLADQIKILMKNVKVMPFANLMSLLGPSIDSVAVLRGIQKVAMLVQGNWVVKSDILYPKDSSSPHSGVPAEVLCRGRDFVMWKFTQSRWVVRKEVATVTKLCAEDVKDFLEHMAVVRINKGWEFILPYDGEFIKKHPDVVQRQHMLWTGIQAKLEKVYNLVKETMPKKPDAQSGLPGGLWDTIHYQTRP

SEQ ID NO: 904000 - protein, 208 aa, Homo sapiens
VSAGVSPPATWPPPERRAGPPPSLQPAGNWAVAAVRARPPRRDRAEGLRGWLSSSMANEEDDPVVQEIDVYLAKSLAEKLYLFQYPVRPASMTYDDIPHLSAKIKPKQQKVELEMAIDTLNPNYCRSKGEQIALNVDGACADETSTYSSKLMDKQTFCSSQTTSNTSRYAAALYRQGSIYPKEMKTCVHTKPYTVVHSSIFMIAKKWK

SEQ ID NO: 904001 - protein, 101 aa, Homo sapiens
MGTRLLPALFLVLLVLGFEVQGTQQPQQDEMPSPTFLTQVKESLSSYWESAKTAAQNLYEKTYLPAVDEKLRDLYSKSTAAMSTYTGIFTDQVLSVLKGEE

SEQ ID NO: 904002 - protein, 104 aa, Homo sapiens
ERTRPCLGKKKRIVDHLLVFFLRGSDLTLFLPYFLISYVWMMILCPVHVLRHQKCLSHRAGLWTLWAHDSSQLCFLSSWYWDLRSRGPNSPSKMRCLARPSSPR

SEQ ID NO: 904003 - protein, 101 aa, Homo sapiens
MGTRLLPALFLVLLVLGFEVQGTQQPQQDEMPSPTLLTQVKESLSSYWESAKTAAQNLYEKTYLPAVDEKLRDLYSKSTAAMSTYTGIFTDQVLSVLKGEE

SEQ ID NO: 904004 - protein, 106 aa, Homo sapiens
GGCGCGAEVGLNHYKASLCPSGAGEDSLPESGLWTLWAHDSSQLCFLSSWYWDLVKESLSSYWESAKTAAQNLYEKTYLPAVDEKLRGGLVQQKHSSHEHLHRHFY

SEQ ID NO: 904005 - protein, 103 aa, Homo sapiens
MTPPQCSRSLDTMGTRLLPALFLVLLVLGFEVQGTQQPQQDEMPSPTFLTQVKESLSSYWESAKTAAQNLYEKTYLPAVDEKLRGGLVQQKHSSHEHLHRHFY

SEQ ID NO: 904006 - protein, 109 aa, Homo sapiens
MGTRLLPALFLVLLVLGFEVQGTQQPQQDEMPSPTFLTQVKESLSSYWESAKTAAQNLYEKTYLPAVDEKLRGEHLPLEKWGLAHTTDCIQDPEVQAPAPPPSDPGVQA

SEQ ID NO: 904007 - protein, 118 aa, Homo sapiens
RLIRLWGFGSSQDSARGQPARVWSLDTMGTRLLPALFLVLLVLGFEVQGTQQPQQDEMPSPTFLTQVKESLSSYWESAKTAAQNLYEKTYLPAVDEKLRGGLVQQKHSSHEHLHRHFY

SEQ ID NO: 904008 - protein, 118 aa, Homo sapiens; identical to SEQ ID NO: 904007

SEQ ID NO: 904009 - protein, 104 aa, Homo sapiens; identical to SEQ ID NO: 904002

SEQ ID NO: 904010 - protein, 101 aa, Homo sapiens; identical to SEQ ID NO: 904003

SEQ ID NO: 904011 - protein, 378 aa, Homo sapiens
MLYLEDYLEMIEQLPMDLRDRFTEMREMDLQVQNAMDQLEQRVSEFFMNAKKNKPEWREEQMASIKKDYYKALEDADEKVQLANQIYDLVDRHLRKLDQELAKFKMELEADNAGITEILERRSLELDTPSQPVNNHHAHSHTPVEKRKYNPTSHHTTTDHIPEKKFKSEALLSTLTSDASKENTLGCRNNNSTASSNNAYNVNSSQPLGSYNIGSLSSGTGAGAITMAAAQAVQATAQMKEGRRTSSLKASYEAFKNNDFQLGKEFSMARETVGYSSSSALMTTLTQNASSSAADSRSGRKSKNNNKSSSQQSSSSSSSSSLSSCSSSSTVVQEISQQTTVVPESDSNSQVDWTYDPNEPRYCICNQVKVCYIYKSII

SEQ ID NO: 904012 - protein, 192 aa, Homo sapiens
MAAAQAVQATAQMKEGRRTSSLKASYEAFKNNDFQLGKEFSMARETVGYSSSSALMTTLTQNASSSAADSRSGRKSKNNNKSSSQQSSSSSSSSSLSSCSSSSTVVQEISQQTTVVPESDSNSQVDWTYDPNEPRYCICNQVSYGEMVGCDNQDCPIEWFHYGCVGLTEAPKGKWYCPQCTAAMKRRGSRHK

SEQ ID NO: 904013 - protein, 197 aa, Homo sapiens
FSSSSSTLFVFFIPFSTMKEGRRTSSLKASYEAFKNNDFQLGKEFSMARETVGYSSSSALMTTLTQNASSSAADSRSGRKSKNNNKSSSQQSSSSSSSSSLSSCSSSSTVVQEISQQTTVVPESDSNSQVDWTYDPNEPRYCICNQVSYGEMVGCDNQDCPIEWFHYGCVGLTEAPKGKWYCPQCTAAMKRRGSRHK

SEQ ID NO: 904014 - protein, 426 aa, Homo sapiens
GVERVLLAMLYLEDYLEMIEQLPMDLRDRFTEMREMDLQVQNAMDQLEQRVSEFFMNAKKNKPEWREEQMASIKKDYYKALEDADEKVQLANQIYDLVDRHLRKLDQELAKFKMELEADNAGITEILERRSLELDTPSQPVNNHHAHSHTPVEKRKYNPTSHHTTTDHIPEKKFKSEALLSTLTSDASKENTLGCRNNNSTASSNNAYNVNSSQPLGSYNIGSLSSGTGAGAITMAAAQAVQATAQMKEGRRTSSLKASYEAFKNNDFQLGKEFSMARETVGYSSSSALMTTLTQNASSSAADSRSGRKSKNNNKSSSQQSSSSSSSSSLSSCSSSSTVVQEISQQTTVVPESDSNSQVDWTYDPNEPRYCICNQVSYGEMVGCDNQDCPIEWFHYGCVGLTEAPKGKWYCPQCTAAMKRRGSRHK

SEQ ID NO: 904015 - protein, 394 aa, Homo sapiens
MLYLEDYLENAMDQLEQRVSEFFMNAKKNKPEWREEQMASIKKDYYKALEDADEKVQLANQIYDLVDRHLRKLDQELAKFKMELEADNAGITEILERRSLELDTPSQPVNNHHAHSHTPVEKRKYNPTSHHTTTDHIPEKKFKSEALLSTLTSDASKENTLGCRNNNSTASSNNAYNVNSSQPLGSYNIGSLSSGTGAGAITMAAAQAVQATAQMKEGRRTSSLKASYEAFKNNDFQLGKEFSMARETVGYSSSSALMTTLTQNASSSAADSRSGRKSKNNNKSSSQQSSSSSSSSSLSSCSSSSTVVQEISQQTTVVPESDSNSQVDWTYDPNEPRYCICNQVSYGEMVGCDNQDCPIEWFHYGCVGLTEAPKGKWYCPQCTAAMKRRGSRHK

SEQ ID NO: 904016 - protein, 418 aa, Homo sapiens
MLYLEDYLEMIEQLPMDLRDRFTEMREMDLQVQNAMDQLEQRVSEFFMNAKKNKPEWREEQMASIKKDYYKALEDADEKVQLANQIYDLVDRHLRKLDQELAKFKMELEADNAGITEILERRSLELDTPSQPVNNHHAHSHTPVEKRKYNPTSHHTTTDHIPEKKFKSEALLSTLTSDASKENTLGCRNNNSTASSNNAYNVNSSQPLGSYNIGSLSSGTGAGAITMAAAQAVQATAQMKEGRRTSSLKASYEAFKNNDFQLGKEFSMARETVGYSSSSALMTTLTQNASSSAADSRSGRKSKNNNKSSSQQSSSSSSSSSLSSCSSSSTVVQEISQQTTVVPESDSNSQVDWTYDPNEPRYCICNQVSYGEMVGCDNQDCPIEWFHYGCVGLTEAPKGKWYCPQCTAAMKRRGSRHK

SEQ ID NO: 904017 - protein, 82 aa, Homo sapiens
FRLHLTDYYIDIQPTSSDNKRAEFWDVITRLPYRMVPLWLRWIDRGTKRQMVLSTVHCCNEEKRQQTQIKVVLLFDEEINFS

SEQ ID NO: 904018 - protein, 464 aa, Homo sapiens
KPLNTWKRYRLSGGPAPCAGYERRAQRVVSESGDNFVYYISKYSEDEFRNRHTRGLIEQLPMDLRDRFTEMREMDLQVQNAMDQLEQRVSEFFMNAKKNKPEWREEQMASIKKDYYKALEDADEKVQLANQIYDLVDRHLRKLDQELAKFKMELEADNAGITEILERRSLELDTPSQPVNNHHAHSHTPVEKRKYNPTSHHTTTDHIPEKKFKSEALLSTLTSDASKENTLGCRNNNSTASSNNAYNVNSSQPLGSYNIGSLSSGTGAGAITMAAAQAVQATAQMKEGRRTSSLKASYEAFKNNDFQLGKEFSMARETVGYSSSSALMTTLTQNASSSAADSRSGRKSKNNNKSSSQQSSSSSSSSSLSSCSSSSTVVQEISQQTTVVPESDSNSQVDWTYDPNEPRYCICNQVSYGEMVGCDNQDCPIEWFHYGCVGLTEAPKGKWYCPQCTAAMKRRGSRHK

SEQ ID NO: 904019 - protein, 192 aa, Homo sapiens; identical to SEQ ID NO: 904012

SEQ ID NO: 904020 - protein, 92 aa, Homo sapiens
MLYLEDYLEMIEQLPMDLRDRFTEMREMDLQVQNAMDQLEQRVSEFFMNAKKNKPEWREEQMASIKKDYYKALEDADEKVQLANQIYDLQHF

SEQ ID NO: 904021 - protein, 198 aa, Homo sapiens
MAPARLFALLLFFVGGVAESIRETEVIDPQDLLEGRYFSGALPDDEDVVGPGQESDDFELSGSGDLDDLEDSMIGPEVVHPLVPLDNHIPERAGSGSQVPTEPKKLEENEVIPKRISPVEESEDVSNKVSMSSTVQGSNIFERTEVLAALIVGGIVGILFAVFLILLLMYRMKKKDEGSYDLGKKPIYKKAPTNEFYA

SEQ ID NO: 904022 - protein, 198 aa, Homo sapiens; identical to SEQ ID NO: 904021

SEQ ID NO: 904023 - protein, 198 aa, Homo sapiens; identical to SEQ ID NO: 904021

SEQ ID NO: 904024 - protein, 198 aa, Homo sapiens; identical to SEQ ID NO: 904021

SEQ ID NO: 904025 - protein, 164 aa, Homo sapiens
MAPARLFALLLFFVGGVAESIRETEVIDPQDLLEGRYFSGALPDDEDVVGPGQESDDFELSGSGDLDDLEDSMIGPEVVHPLVPLDNHIPERAGSGSQVPTEPKKLEENEVIPKRISPVEESEDVSNKVSMSSTVQGSNIFERTEVLAGCPRTLKDYTVLMGWL

SEQ ID NO: 904026 - protein, 198 aa, Homo sapiens; identical to SEQ ID NO: 904021

SEQ ID NO: 904027 - protein, 111 aa, Homo sapiens
MAPARLFALLLFFVGGVAESIRETEVIDPQDLLEGRYFSGALPDDEDVVGPGQESDDFELSGSGDLDDLEDSMIGPEVVHPLVPLDNHIPERAGSGSQVPTEPKKLEPPAP

SEQ ID NO: 904028 - protein, 198 aa, Homo sapiens; identical to SEQ ID NO: 904021

SEQ ID NO: 904029 - protein, 198 aa, Homo sapiens; identical to SEQ ID NO: 904021

SEQ ID NO: 904030 - protein, 470 aa, Homo sapiens
MLASGLLLVALLACLTVMVLMSVWQQRKSRGKLPPGPTPLPFIGNYLQLNTEHICDSIMKVSQGVAFSNGERAKQLLRFAIATLRDFGVGKRGIEERIQEESGFLIEAIRSTHGANIDPTFFLSRTVSNVISSIVFGDRFDYEDKEFLSLLSMMLGIFQFTSTSTGQLYEMFSSVMKHLPGPQQQAFKLLQGLEDFIAKKVEHNQRTLDPNSPQDFIDSFLIRMQEEEKNPNTEFYLKNLMMSTLNLFIAGTETVSTTLRYGFLLLMKHPEVEAKVHEEIDRVIGKNRQPKFEDRTKMPYMEAVIHEIQRFGDVIPMSLARRVKKDTKFWDFFLPKGTEVFPMLGSVLRDPSFFSNPQDFNPQHFLDDKGQFKKSDAFVPFSIGKRNCFGEGLARMELFLFFTTVMQNFRLKSSQSPKDIDVSPKHVVFATIPRYTMTSCPAERGLCRCRSGGRGQGKAGSGRGSRKRRV

SEQ ID NO: 904031 - protein, 210 aa, Homo sapiens
EALVDQAEEFSGRGEQATFDWVFKGYGVVFSNGERAKQLRRFSIATLRDFGVGKRGIEERIQEEAGFLIDALRGTGGANIDPTFFLSRTVSNVISSIVFGDRFDYKDKEFLSLLRMMLGIFQFTSTSTGQLYEMFSSVMKHLPGPQQQAFQLLQGLEDFIAKKVEHNQRTLDPNSPRDFIDSFLIRMQEEEKNPNTEFYFDHPRLWLLLL

SEQ ID NO: 904032 - protein, 494 aa, Homo sapiens
MLASGMLLVALLVCLTVMVLMSVWQQRKSKGKLPPGPTPLPFIGNYLQLNTEQMYNSLMKISERYGPVFTIHLGPRRVVVLCGHDAVREALVDQAEEFSGRGEQATFDWVFKGYGVVFSNGERAKQLRRFSIATLRDFGVGKRGIEERIQEEAGFLIDALRGTGGANIDPTFFLSRTVSNVISSIVFGDRFDYKDKEFLSLLRMMLGIFQFTSTSTGQLYEMFSSVMKHLPGPQQQAFQLLQGLEDFIAKKVEHNQRTLDPNSPRDFIDSFLIRMQEEEKNPNTEFYLKNLVMTTLNLFIGGTETVSTTLRYGFLLLMKHPEVEAKVHEEIDRVIGKNRQPKFEDRAKMPYMEAVIHEIQRFGDVIPMSLARRVKKDTKFRDFFLPKGTEVFPMLGSVLRDPSFFSNPQDFNPQHFLNEKGQFKKSDAFVPFSIGKRNCFGEGLARMELFLFFTTVMQNFRLKSSQSPKDIDVSPKHVGFATIPRNYTMSFLPR

SEQ ID NO: 904033 - protein, 410 aa, Homo sapiens
MLASGMLLVALLVCLTVMVLMSVWQQRKSKGKLPPGPTPLPFIGNYLQLNTEQMYNSLMKISERYGPVFTIHLGPRRVVVLCGHDAVREALVDQAEEFSGRGEQATFDWVFKGYGVVFSNGERAKQLRRFSIATLRDFGVGKRGIEERIQEEAGFLIDALRGTGGANIDPTFFLSRTVSNVISSIVFGDRFDYKDKEFLSLLRMMLGIFQFTSTSTGQLYEMFSSVMKHLPGPQQQAFQLLQGLEDFIAKKVEHNQRTLDPNSPRDFIDSFLIRMQEEEKNPNTEFYLKNLVMTTLNLFIGGTETVSTTLRYGFLLLMKHPEVEAKVHEEIDRVIGKNRQPKFEDRAKMPYMEAVIHEIQRFGDVIPMSLARRVKKDTKFRDFFLPKIRPHPPDYGDFQPLSVSPASHPH

SEQ ID NO: 904034 - protein, 142 aa, Homo sapiens
MPATSPYLGTLVPPPAPVYFHQSPDPPHHTQLPPPGTEVFPMLGSVLRDPSFFSNPQDFNPQHFLNEKGQFKKSDAFVPFSIGKRNCFGEGLARMELFLFFTTVMQNFRLKSSQSPKDIDVSPKHVGFATIPRNYTMSFLPR

SEQ ID NO: 904035 - protein, 456 aa, Homo sapiens
MFSSVMKHLPGPQQQAFKLLQGLEDFIAKKVEHNQRTLDPNSPQDFIDSFLIRMQEEEKNPNTEFYLKNLMMSTLNLFIAGTETVSTTLRYGFLLLMKHPEVEAKVHEEIDRVIGKNRQPKFEDRTKMPYMEAVIHEIQRFGDVIPMSLARRVKKDTKFWDFFLPKVLSSPPPRLRGLPALLCVPRILPPLEAFYSLSHSLNQSKRTSPTTTSIPPFHLDTPESCISPDSLCRENQTQVPRTQISGPPNNLRSKTWTPCLPNFLFQRCEPSIPQSSSFTGPQLLHACHFPFIWGTPVPSPAPVYFHQSPDPPHHTQLPPPYQGTEVFPMLGSVLRDPSFFSNPQDFNPQHFLDDKGQFKKSDAFVPFSIGKRNCFGEGLARMELFLFFTTVMQNFRLKSSQSPKDIDVSPKHVVFATIPRYTMTSCPAERGLCRCRSGGRGQGKAGSGRGSRKRRV

SEQ ID NO: 904036 - protein, 142 aa, Homo sapiens
MPATSPYLGHTSSPSSPCVLSPIPDPPHHTQLPPPGTEVFPMLGSVLRDPSFFSNPQDFNPQHFLNEKGQFKKSDAFVPFSIGKRNCFGEGLARMELFLFFTTVMQNFRLKSSQSPKDIDVSPKHVGFATIPRNYTMSFLPR

SEQ ID NO: 904037 - protein, 126 aa, Homo sapiens
SLSLSLSLSLSLSLSLSLSGTEVFPMLGSVLRDPSFFSNPQDFNPQHFLNEKGQFKKSDAFVPFSIGKRNCFGEGLARMELFLFFTTVMQNFRLKSSQSPKDIDVSPKHVGFATIPRNYTMSFLPR

SEQ ID NO: 904038 - protein, 410 aa, Homo sapiens; identical to SEQ ID NO: 904033

SEQ ID NO: 904039 - protein, 238 aa, Homo sapiens
NSGISPVPRRLDDSFLIRMQEEEKNPNTEFYLKNLVMTTLNLFIGGTETVSTTLRYGFLLLMKHPEVEAKVHEEIDRVIGKNRQPKFEDRAKMPYMEAVIHEIQRFGDVIPMSLARRVKKDTKFRDFFLPKGTEVFPMLGSVLRDPSFFSNPQDFNPQHFLNEKGQFKKSDAFVPFSIGKRNCFGEGLARMELFLFFTTVMQNFRLKSSQSPKDIDVSPKHVGFATIPRNYTMSFLPR

SEQ ID NO: 904040 - protein, 626 aa, Homo sapiens
MLASGLLLVALLACLTVMVLMSVWQQRKSRGKLPPGPTPLPFIGNYLQLNTEHICDSIMKVSQGVAFSNGERAKQLLRFAIATLRDFGVGKRGIEERIQEESGFLIEAIRSTHGANIDPTFFLSRTVSNVISSIVFGDRFDYEDKEFLSLLSMMLGIFQFTSTSTGQLYEMFSSVMKHLPGPQQQAFKLLQGLEDFIAKKVEHNQRTLDPNSPQDFIDSFLIRMQEEEKNPNTEFYLKNLMMSTLNLFIAGTETVSTTLRYGFLLLMKHPEVEAKVHEEIDRVIGKNRQPKFEDRTKMPYMEAVIHEIQRFGDVIPMSLARRVKKDTKFWDFFLPKVLSSPPPRLRGLPALLCVPRILPPLEAFYSLSHSLNQSKRTSPTTTSIPPFHLDTPESCISPDSLCRENQTQVPRTQISGPPNNLRSKTWTPCLPNFLFQRCEPSIPQSSSFTGPQLLHACHFPFIWGTPVPSPAPVYFHQSPDPPHHTQLPPPYQGTEVFPMLGSVLRDPSFFSNPQDFNPQHFLDDKGQFKKSDAFVPFSIGKRNCFGEGLARMELFLFFTTVMQNFRLKSSQSPKDIDVSPKHVVFATIPRYTMTSCPAERGLCRCRSGGRGQGKAGSGRGSRKRRV

SEQ ID NO: 904041 - protein, 298 aa, Homo sapiens
MLASGMLLVALLVCLTVMVLMSVWQQRKSKGKLPPGPTPLPFIGNYLQLNTEQMYNSLMKISERYGPVFTIHLGPRRVVVLCGHDAVREALVDQAEEFSGRGEQATFDWVFKGYGVVFSNGERAKQLRRFSIATLRDFGVGKRGIEERIQEEAGFLIDALRGTGGANIDPTFFLSRTVSNVISSIVFGDRFDYKDKEFLSLLRMMLGIFQFTSTSTGQLYEMFSSVMKHLPGPQQQAFQLLQGLEDFIAKKVEHNQRTLDPNSPRDFIDSFLIRMQEEEKNPNTEFYFDHPRLWLLLL

SEQ ID NO: 904042 - protein, 302 aa, Homo sapiens
LSTEVGRTAELTVTAALTREFLEPKLFSTEDKQAAETMGSPSACPYRVCIPWQGLLLTASLLTFWNLPNSAQTNIDVVPFNVAEGKEVLLVVHNESQNLYGYNWYKGERVHANYRIIGYVKNISQENAPGPAHNGRETIYPNGTLLIQNVTHNDAGFYTLHVIKENLVNEEVTRQFYVFSEPPKPSITSNNFNPVENKDIVVLTCQPETQNTTYLWWVNNQSLLVSPRLLLSTDNRTLVLLSATKNDIGPYECEIQNPVGASRSDPVTLNVRYESVQASSPDLSAGTAVSIMIGVLAGMALI

SEQ ID NO: 904043 - protein, 209 aa, Homo sapiens
LSTEVGRTAELTVTAALTREFLEPKLFSTEDKQAAETMGSPSACPYRVCIPWQGLLLTASLLTFWNLPNSAQTNIDVVPFNVAEGKEVLLVVHNESQNLYGYNWYKGERVHANYRIIGYVKNISQENAPGPAHNGRETIYPNGTLLIQNVTHNDAGFYTLHVIKENLVNEEVTRQFYVFYESVQASSPDLSAGTAVSIMIGVLAGMALI

SEQ ID NO: 904044 - protein, 297 aa, Homo sapiens
SVCGARRGEEDVGRGICPGEVGSEFDFQKFLTSADPGDSQVFKVPVPTGVRAQASLLTFWNLPNSAQTNIDVVPFNVAEGKEVLLVVHNESQNLYGYNWYKGERVHANYRIIGYVKNISQENAPGPAHNGRETIYPNGTLLIQNVTHNDAGFYTLHVIKENLVNEEVTRQFYVFSEPPKPSITSNNFNPVENKDIVVLTCQPETQNTTYLWWVNNQSLLVSPRLLLSTDNRTLVLLSATKNDIGPYECEIQNPVGASRSDPVTLNVRYESVQASSPDLSAGTAVSIMIGVLAGMALI

SEQ ID NO: 904045 - protein, 302 aa, Homo sapiens; identical to SEQ ID NO: 904042

SEQ ID NO: 904046 - protein, 392 aa, Homo sapiens
GGGGGSGFGCAWRTGWERSPGREQAPPPQATMGNVLAASSPPAGPPPPPAPALVGLPPPPPSPPGFTLPPLGGSLGAGTSTSRSSERTPGAATASASGAAEDGACGCLPNPGTFEECHRKCKELFPIQMEGVKLTVNKGLSNHFQVNHTVALSTIGESNYHFGVTYVGTKQLSPTEAFPVLVGDMDNSGSLNAQVIHQLGPGLRSKMAIQTQQSKFVNWQVDGEYRGSDFTAAVTLGNPDVLVGSGILVAHYLQSITPCLALGGELVYHRRPGEEGTVMSLAGKYTLNNWLATVTLGQAGMHATYYHKASDQLQVGVEFEASTRMQDTSVSFGYQLDLPKANLLFKGSVDSNWIVGATLEKKLPPLPLTLALGAFLNHRKNKFQCGFGLTIG

SEQ ID NO: 904047 - protein, 361 aa, Homo sapiens
MGNVLAASSPPAGPPPPPAPALVGLPPPPPSPPGFTLPPLGGSLGAGTSTSRSSERTPGAATASASGAAEDGACGCLPNPGTFEECHRKCKELFPIQMEGVKLTVNKGLSNHFQVNHTVALSTIGESNYHFGVTYVGTKQLSPTEAFPVLVGDMDNSGSLNAQVIHQLGPGLRSKMAIQTQQSKFVNWQVDGEYRGSDFTAAVTLGNPDVLVGSGILVAHYLQSITPCLALGGELVYHRRPGEEGTVMSLAGKYTLNNWLATVTLGQAGMHATYYHKASDQLQVGVEFEASTRMQDTSVSFGYQLDLPKANLLFKGSVDSNWIVGATLEKKLPPLPLTLALGAFLNHRKNKFQCGFGLTIG

SEQ ID NO: 904048 - protein, 392 aa, Homo sapiens; identical to SEQ ID NO: 904046

SEQ ID NO: 904049 - protein, 361 aa, Homo sapiens; identical to SEQ ID NO: 904047

SEQ ID NO: 904050 - protein, 350 aa, Homo sapiens
GGGGGSGFGCAWRTGWERSPGREQAPPPQATMGNVLAASSPPAGPPPPPAPALVGLPPPPPSPPGFTLPPLGGSLGAGTSTSRSSERTPGAATASASGAAEDGACGCLPNPGTFEECHRKCKELFPIQMEGVKLTVNKGLSNHFQVNHTVALSTIGESNYHFGVTYVGTKQLSPTEAFPVLVGDMDNSGSLNAQVIHQLGPGLRSKMAIQTQQSKFVNWQVDGEYRGSDFTAAVTLGNPDVLVGSGILVAHYLQSITPCLALGGELVYHRRPGEEGTVMSLAGKYTLNNWLATVTLGQAGMHATYYHKASDQLQVGVEFEASTRMQDTSVSFGYQLDLPKANLLFKGSVG

SEQ ID NO: 904051 - protein, 114 aa, Homo sapiens
MSLAGKYTLNNWLATVTLGQAGMHATYYHKASDQLQVGVEFEASTRMQDTSVSFGYQLDLPKANLLFKGSVDSNWIVGATLEKKLPPLPLTLALGAFLNHRKNKFQCGFGLTIG

SEQ ID NO: 904052 - protein, 290 aa, Homo sapiens
GGGGGSGFGCAWRTGWERSPGREQAPPPQATMGNVLAASSPPAGPPPPPAPALVGLPPPPPSPPGFTLPPLGGSLGAGTSTSRSSERTPGAATASASGAAEDGACGCLPNPGTFEECHRKCKELFPIQMEGVKLTVNKGLSNHFQVNHTVALSTIGESNYHFGVTYVGTKQLSPTEAFPVLVGDMDNSGSLNAQVIHQLGPGLRSKMAIQTQQSKFVNWQVDGEYRGSDFTAASTRGRGGQTTSGRSVLASPSSKGPGPAPRGQREELPHPRSVHPAPSTFPSPRYKSCL

SEQ ID NO: 904053 - protein, 123 aa, Homo sapiens
GLVRSEMYGILVAHYLQSITPCLALGGELVYHRRPGEEGTVMSLAGKYTLNNWLATVTLGQAGMHATYYHKASDQLQVGVEFEASTRMQDTSVSFGYQLDLPKANLLFKGKGLGSPTRETGRR

SEQ ID NO: 904054 - protein, 384 aa, Homo sapiens
GLCGVDAVSPVPGEHVLPAAQATMGNVLAASSPPAGPPPPPAPALVGLPPPPPSPPGFTLPPLGGSLGAGTSTSRSSERTPGAATASASGAAEDGACGCLPNPGTFEECHRKCKELFPIQMEGVKLTVNKGLSNHFQVNHTVALSTIGESNYHFGVTYVGTKQLSPTEAFPVLVGDMDNSGSLNAQVIHQLGPGLRSKMAIQTQQSKFVNWQVDGEYRGSDFTAAVTLGNPDVLVGSGILVAHYLQSITPCLALGGELVYHRRPGEEGTVMSLAGKYTLNNWLATVTLGQAGMHATYYHKASDQLQVGVEFEASTRMQDTSVSFGYQLDLPKANLLFKGSVDSNWIVGATLEKKLPPLPLTLALGAFLNHRKNKFQCGFGLTIG

SEQ ID NO: 904055 - protein, 315 aa, Homo sapiens
APPAQCDHGGTVLAATASASGAAEDGACGCLPNPGTFEECHRKCKELFPIQMEGVKLTVNKGLSNHFQVNHTVALSTIGESNYHFGVTYVGTKQLSPTEAFPVLVGDMDNSGSLNAQVIHQLGPGLRSKMAIQTQQSKFVNWQVDGEYRGSDFTAAVTLGNPDVLVGSGILVAHYLQSITPCLALGGELVYHRRPGEEGTVMSLAGKYTLNNWLATVTLGQAGMHATYYHKASDQLQVGVEFEASTRMQDTSVSFGYQLDLPKANLLFKGSVDSNWIVGATLEKKLPPLPLTLALGAFLNHRKNKFQCGFGLTIG

SEQ ID NO: 904056 - protein, 260 aa, Homo sapiens
GGGGGSGFGCAWRTGWERSPGREQAPPPQATMGNVLAASSPPAGPPPPPAPALVGLPPPPPSPPGFTLPPLGGSLGAGTSTSRSSERTPGAATASASGAAEDGACGCLPNPGTFEECHRKCKELFPIQMEGVKLTVNKGLSNHFQVNHTVALSTIGESNYHFGVTYVGTKQLSPTEAFPVLVGDMDNSGSLNAQVIHQLGPGLRSKMAIQTQQSKFVNWQVDGEYRGSDFTAAVTLGNPDVLVGSGKRRRAWRVVTKLQF

SEQ ID NO: 904057 - protein, 171 aa, Homo sapiens
GGGGGSGFGCAWRTGWERSPGREQAPPPQATMGNVLAASSPPAGPPPPPAPALVGLPPPPPSPPGFTLPPLGGSLGAGTSTSRSSERTPGAATASASGAAEDGACGCLPNPGTFEECHRKCKELFPIQMEGVKLTVNKGLSNHFQVNHTVALSTIGESNYHFPSPRYKSCL

SEQ ID NO: 904058 - protein, 546 aa, Homo sapiens
TSRIRRLCGSSRGPWRTLTYDLCLRDTLELTGTLPAEYPLKPGEKAPKVRRRIGAAYKLDDWALHREDPLSSLERQLALQLQITEAARRLCLEENLSRQARRQRKHSMLQEEKKLQELQRCLVERRRNSEPPPAAALPLGRELSASDDSSLSDGLLLEEEESQVPKPPPESPAPPSRPLPPQTLEGLQPTGPEAGSPERAPVQNSPWKETSLDHPYEKPRKSSEPWSESSSPATTPQDGPSASSLWLLEPASYHVVPIRGVPGQWQGRTSAPATPEIQGRRGQSQSLRVDSFRAGPEGRGRSAFPRRRPTHYTVTVPDSCFPATKPPLPHAACHSCSEDSGSDVSSISHPTSPGSSSPDISFLQPLSPPKTHRHRGAWVPAGSRELVAHHPKLLLPPGYFPAGRYVVVAESPLPPGEWELCRAAPGPAYEEEGTPLRYQRLVPSRSRIVRTPSLKDSPAGRGLSKAAVSEELKWWHERARLRSTRPHSLDRQGAFRVRSLPLGREGFGRALGPRAQVPTVCVLRRSPDGAPVQVFVPEKGEIISQV

SEQ ID NO: 904059 - protein, 668 aa, Homo sapiens
MLQMPKLNEIPPGRAGRREARGEGRWPGQTGPEAARLEWRAQGQAGGARAPWDSWGSSRLPTQPGPGWSRCPPSLLCALSFQKSTMESKDEVSDTDSGIILQSGPDSPVSPMKELTHAVHKQQRALEARLEACLEELRRLCLREAELTGTLPAEYPLKPGEKAPKVRRRIGAAYKLDDWALHREDPLSSLERQLALQLQITEAARRLCLEENLSRQARRQRKHSMLQEEKKLQELQRCLVERRRNSEPPPAAALPLGRELSASDDSSLSDGLLLEEEESQVPKPPPESPAPPSRPLPPQTLEGLQPTGPEAGSPERAPVQNSPWKETSLDHPYEKPRKSSEPWSESSSPATTPQDGPSASSLWLLEPASYHVVPIRGVPGQWQGRTSAPATPEIQGRRGQSQSLRVDSFRAGPEGRGRSAFPRRRPTHYTVTVPDSCFPATKPPLPHAACHSCSEDSGSDVSSISHPTSPGSSSPDISFLQPLSPPKTHRHRGAWVPAGSRELVAHHPKLLLPPGYFPAGRYVVVAESPLPPGEWELCRAAPGPAYEEEGTPLRYQRLVPSRSRIVRTPSLKDSPAGRGLSKAAVSEELKWWHERARLRSTRPHSLDRQGAFRVRSLPLGREGFGRALGPRAQVPTVCVLRRSPDGAPVQVFVPEKGEIISQSLAYWT

SEQ ID NO: 904060 - protein, 663 aa, Homo sapiens [sequence omitted]

SEQ ID NO: 904061 - protein, 663 aa, Homo sapiens [sequence omitted]

SEQ ID NO: 904062 - protein, 663 aa, Homo sapiens [sequence omitted]

SEQ ID NO: 904063 - protein, 292 aa, Homo sapiens
IESLIPKGLSEFTKQQIRYILQMRGMSDKSLRLVLSTFSNIREELGHLQNDMTSLENDKMRLEKDLSFKDTQLKEYEELLASVRANNHQQQQGLQDSSSKCQALEENNLSLRHTLSDMEYRLKELEYCKRNLEQENQNLRMQVSETCTGPMLQAKMDEIGNHYTEMVKNLRMEKDREICRLRSQLNQYHKDVSKREGSCSDFQFKLHELTSLLEEKDSLIKRQSEELSKLRQEIYSSHNQPSTGGRTTITTKKYRTQYPILGLLYDDYEYIPPGSETQTIVIEKTEDKYTCP

SEQ ID NO: 904064 - protein, 262 aa, Homo sapiens
RLPEDPRQSSYREELGHLQNDMTSLENDKMRLEKDLSFKDTQLKEYEELLASVRANNHQQQQGLQDSSSKCQALEENNLSLRHTLSDMEYRLKELEYCKRNLEQENQNLRMQVSETCTGPMLQAKMDEIGNHYTEMVKNLRMEKDREICRLRSQLNQYHKDVSKREGSCSDFQFKLHELTSLLEEKDSLIKRQSEELSKLRQEIYSSHNQPSTGGRTTITTKKYRTQYPILGLLYDDYEYIPPGSETQTIVIEKTEDKYTCP

SEQ ID NO: 904065 - protein, 292 aa, Homo sapiens; identical to SEQ ID NO: 904063

SEQ ID NO: 904066 - protein, 470 aa, Homo sapiens
MSSSYWSETSSSSCGTQQLPEVLQCQPQHYHCYHQSSQAQQPPEKNVVYERVRTYSGPMNKVVQALDPFNSREVLSPLKTTSSYQNLVWSDHSQELHSPTLKISTCAPSTLHITQNTEQELHSPTVKLTTYPQTTIRKYVVQNPEQEPLSQFLRGSHFFPGNNVIYEKTIRKVEKLNTDQGCHPQAQCHHHIIQQPQVIHSAHWQQPDSSQQIQAITGNNPISTHIGNELCHSGSSQICEQVIIQDDGPEKLDPRYFGELLADLSRKNTDLYHCLLEHLQKLEENNLSLRHTLSDMEYRLKELEYCKRNLEQENQNLRMQVSETCTGPMLQAKMDEIGNHYTEMVKNLRMEKDREICRLRSQLNQYHKDVSKREGSCSDFQFKLHELTSLLEEKDSLIKRQSEELSKLRQEIYSSHNQPSTGGRTTITTKKYRTQYPILGLLYDDYEYIPPGSETQTIVIEKTEDKYTCP

SEQ ID NO: 904067 - protein, 1596 aa, Homo sapiens
QAALRPRPRLPAPPPPPPPPPPPPPPALAPAAGPDHPPPGARRRPRQQPGPITRRPVPAAARATGMALRGFCSADGSDPLWDWNVTWNTSNPDFTKCFQNTVLVWVPCFYLWACFPFYFLYLSRHDRGYIQMTPLNKTKTALGFLLWIVCWADLFYSFWERSRGIFLAPVFLVSPTLLGITTLLATFLIQLERRKGVQSSGIMLTFWLVALVCALAILRSKIMTALKEDAQVDLFRDITFYVYFSLLLIQLVLSCFSDRSPLFSETIHDPNPCPESSASFLSRITFWWITGLIVRGYRQPLEGSDLWSLNKEDTSEQVVPVLVKNWKKECAKTRKQPVKVVYSSKDPAQPKESSKVDANEEVEALIVKSPQKEWNPSLFKVLYKTFGPYFLMSFFFKAIHDLMMFSGPQILKLLIKFVNDTKAPDWQGYFYTVLLFVTACLQTLVLHQYFHICFVSGMRIKTAVIGAVYRKALVITNSARKSSTVGEIVNLMSVDAQRFMDLATYINMIWSAPLQVILALYLLWLNLGPSVLAGVAVMVLMVPVNAVMAMKTKTYQVAHMKSKDNRIKLMNEILNGIKVLKLYAWELAFKDKVLAIRQEELKVLKKSAYLSAVGTFTWVCTPFLVALCTFAVYVTIDENNILDAQTAFVSLALFNILRFPLNILPMVISSIVQASVSLKRLRIFLSHEELEPDSIERRPVKDGGGTNSITVRNATFTWARSDPPTLNGITFSIPEGALVAVVGQVGCGKSSLLSALLAEMDKVEGHVAIKGSVAYVPQQAWIQNDSLRENILFGCQLEEPYYRSVIQACALLPDLEILPSGDRTEIGEKGVNLSGGQKQRVSLARAVYSNADIYLFDDPLSAVDAHVGKHIFENVIGPKGMLKNKTRILVTHSMSYLPQVDVIIVMSGGKISEMGSYQELLARDGAFAEFLRTYASTEQEQDAEENGVTGVSGPGKEAKQMENGMLVTDSAGKQLQRQLSSSSSYSGDISRHHNSTAELQKAEAKKEETWKLMEADKAQTGQVKLSVYWDYMKAIGLFISFLSIFLFMCNHVSALASNYWLSLWTDDPIVNGTQEHTKVRLSVYGALGISQGIAVFGYSMAVSIGGILASRCLHVDLLHSILRSPMSFFERTPSGNLVNRFSKELDTVDSMIPEVIKMFMGSLFNVIGACIVILLATPIAAIIIPPLGLIYFFVQRFYVASSRQLKRLESVSRSPVYSHFNETLLGVSVIRAFEEQERFIHQSDLKVDENQKAYYPSIVANRWLAVRLECVGNCIVLFAALFAVISRHSLSAGLVGLSVSYSLQVTTYLNWLVRMSSEMETNIVAVERLKEYSETEKEAPWQIQETAPPSSWPQVGRVEFRNYCLRYREDLDFVLRHINVTINGGEKVGIVGRTGAGKSSLTLGLFRINESAEGEIIIDGINIAKIGLHDLRFKITIIPQDPVLFSGSLRMNLDPFSQYSDEEVWTSLELAHLKDFVSALPDKLDHECAEGGENLSVGQRQLVCLARALLRKTKILVLDEATAAVDLETDDLIQSTIRTQFEDCTVLTIAHRLNTIMDYTRVIVLDKGEIQEYGAPSDLLQQRGLFYSMAKDAGLV

SEQ ID NO: 904068 - protein, 1489 aa, Homo sapiens
MALRGFCSADGSDPLWDWNVTWNTSNPDFTKCFQNTVLVWVPCFYLWACFPFYFLYLSRHDRGYIQMTPLNKTKTALGFLLWIVCWADLFYSFWERSRGIFLAPVFLVSPTLLGITTLLATFLIQLERRKGVQSSGIMLTFWLVALVCALAILRSKIMTALKENPCPESSASFLSRITFWWITGLIVRGYRQPLEGSDLWSLNKEDTSEQVVPVLVKNWKKECAKTRKQPVKVVYSSKDPAQPKESSKVDANEEVEALIVKSPQKEWNPSLFKVLYKTFGPYFLMSFFFKAIHDLMMFSGPQILKLLIKFVNDTKAPDWQGYFYTVLLFVTACLQTLVLHQYFHICFVSGMRIKTAVIGAVYRKALVITNSARKSSTVGEIVNLMSVDAQRFMDLATYINMIWSAPLQVILALYLLWLNLGPSVLAGVAVMVLMVPVNAVMAMKTKTYQVAHMKSKDNRIKLMNEILNGIKVLKLYAWELAFKDKVLAIRQEELKVLKKSAYLSAVGTFTWVCTPFLVALCTFAVYVTIDENNILDAQTAFVSLALFNILRFPLNILPMVISSIVQASVSLKRLRIFLSHEELEPDSIERRPVKDGGGTNSITVRNATFTWARSDPPTLNGITFSIPEGALVAVVGQVGCGKSSLLSALLAEMDKVEGHVAIKGSVAYVPQQAWIQNDSLRENILFGCQLEEPYYRSVIQACALLPDLEILPSGDRTEIGEKGVNLSGGQKQRVSLARAVYSNADIYLFDDPLSAVDAHVGKHIFENVIGPKGMLKNKTRILVTHSMSYLPQVDVIIVMSGGKISEMGSYQELLARDGAFAEFLRTYASTEQEQDAEENGVTGVSGPGKEAKQMENGMLVTDSAGKQLQRQLSSSSSYSGDISRHHNSTAELQKAEAKKEETWKLMEADKAQTGQVKLSVYWDYMKAIGLFISFLSIFLFMCNHVSALASNYWLSLWTDDPIVNGTQEHTKVRLSVYGALGISQGIAVFGYSMAVSIGGILASRCLHVDLLHSILRSPMSFFERTPSGNLVNRFSKELDTVDSMIPEVIKMFMGSLFNVIGACIVILLATPIAAIIIPPLGLIYFFVQRFYVASSRQLKRLESVSRSPVYSHFNETLLGVSVIRAFEEQERFIHQSDLKVDENQKAYYPSIVANRWLAVRLECVGNCIVLFAALFAVISRHSLSAGLVGLSVSYSLQVTTYLNWLVRMSSEMETNIVAVERLKEYSETEKEAPWQIQETAPPSSWPQVGRVEFRNYCLRYREDLDFVLRHINVTINGGEKVGIVGRTGAGKSSLTLGLFRINESAEGEIIIDGINIAKIGLHDLRFKITIIPQDPVLFSGSLRMNLDPFSQYSDEEVWTSLELAHLKDFVSALPDKLDHECAEGGENLSVGQRQLVCLARALLRKTKILVLDEATAAVDLETDDLIQSTIRTQFEDCTVLTIAHRLNTIMDYTRVIVLDKGEIQEYGAPSDLLQQRGLFYSMAKDAGLV

SEQ ID NO: 904069 - protein, 1537 aa, Homo sapiens
QAALRPRPRLPAPPPPPPPPPPPPPPALAPAAGPDHPPPGARRRPRQQPGPITRRPVPAAARATGMALRGFCSADGSDPLWDWNVTWNTSNPDFTKCFQNTVLVWVPCFYLWACFPFYFLYLSRHDRGYIQMTPLNKTKTALGFLLWIVCWADLFYSFWERSRGIFLAPVFLVSPTLLGITTLLATFLIQLERRKGVQSSGIMLTFWLVALVCALAILRSKIMTALKEDAQVDLFRDITFYVYFSLLLIQLVLSCFSDRSPLFSETIHDPNPCPESSASFLSRITFWWITGLIVRGYRQPLEGSDLWSLNKEDTSEQVVPVLVKNWKKECAKTRKQPVKVVYSSKDPAQPKESSKVDANEEVEALIVKSPQKEWNPSLFKVLYKTFGPYFLMSFFFKAIHDLMMFSGPQILKLLIKFVNDTKAPDWQGYFYTVLLFVTACLQTLVLHQYFHICFVSGMRIKTAVIGAVYRKALVITNSARKSSTVGEIVNLMSVDAQRFMDLATYINMIWSAPLQVILALYLLWLNLGPSVLAGVAVMVLMVPVNAVMAMKTKTYQVAHMKSKDNRIKLMNEILNGIKVLKLYAWELAFKDKVLAIRQEELKVLKKSAYLSAVGTFTWVCTPFLVALCTFAVYVTIDENNILDAQTAFVSLALFNILRFPLNILPMVISSIVQASVSLKRLRIFLSHEELEPDSIERRPVKDGGGTNSITVRNATFTWARSDPPTLNGITFSIPEGALVAVVGQVGCGKSSLLSALLAEMDKVEGHVAIKGVNLSGGQKQRVSLARAVYSNADIYLFDDPLSAVDAHVGKHIFENVIGPKGMLKNKTRILVTHSMSYLPQVDVIIVMSGGKISEMGSYQELLARDGAFAEFLRTYASTEQEQDAEENGVTGVSGPGKEAKQMENGMLVTDSAGKQLQRQLSSSSSYSGDISRHHNSTAELQKAEAKKEETWKLMEADKAQTGQVKLSVYWDYMKAIGLFISFLSIFLFMCNHVSALASNYWLSLWTDDPIVNGTQEHTKVRLSVYGALGISQGIAVFGYSMAVSIGGILASRCLHVDLLHSILRSPMSFFERTPSGNLVNRFSKELDTVDSMIPEVIKMFMGSLFNVIGACIVILLATPIAAIIIPPLGLIYFFVQRFYVASSRQLKRLESVSRSPVYSHFNETLLGVSVIRAFEEQERFIHQSDLKVDENQKAYYPSIVANRWLAVRLECVGNCIVLFAALFAVISRHSLSAGLVGLSVSYSLQVTTYLNWLVRMSSEMETNIVAVERLKEYSETEKEAPWQIQETAPPSSWPQVGRVEFRNYCLRYREDLDFVLRHINVTINGGEKVGIVGRTGAGKSSLTLGLFRINESAEGEIIIDGINIAKIGLHDLRFKITIIPQDPVLFSGSLRMNLDPFSQYSDEEVWTSLELAHLKDFVSALPDKLDHECAEGGENLSVGQRQLVCLARALLRKTKILVLDEATAAVDLETDDLIQSTIRTQFEDCTVLTIAHRLNTIMDYTRVIVLDKGEIQEYGAPSDLLQQRGLFYSMAKDAGLV

SEQ ID NO: 904070 - protein, 1481 aa, Homo sapiens
QAALRPRPRLPAPPPPPPPPPPPPPPALAPAAGPDHPPPGARRRPRQQPGPITRRPVPAAARATGMALRGFCSADGSDPLWDWNVTWNTSNPDFTKCFQNTVLVWVPCFYLWACFPFYFLYLSRHDRGYIQMTPLNKTKTALGFLLWIVCWADLFYSFWERSRGIFLAPVFLVSPTLLGITTLLATFLIQLERRKGVQSSGIMLTFWLVALVCALAILRSKIMTALKEDAQVDLFRDITFYVYFSLLLIQLVLSCFSDRSPLFSETIHDPNPCPESSASFLSRITFWWITGLIVRGYRQPLEGSDLWSLNKEDTSEQVVPVLVKNWKKECAKTRKQPVKVVYSSKDPAQPKESSKVDANEEVEALIVKSPQKEWNPSLFKVLYKTFGPYFLMSFFFKAIHDLMMFSGPQILKLLIKFVNDTKAPDWQGYFYTVLLFVTACLQTLVLHQYFHICFVSGMRIKTAVIGAVYRKALVITNSARKSSTVGEIVNLMSVDAQRFMDLATYINMIWSAPLQVILALYLLWLNLGPSVLAGVAVMVLMVPVNAVMAMKTKTYQVAHMKSKDNRIKLMNEILNGIKVLKLYAWELAFKDKVLAIRQEELKVLKKSAYLSAVGTFTWVCTPFLVALCTFAVYVTIDENNILDAQTAFVSLALFNILRFPLNILPMVISSIVQASVSLKRLRIFLSHEELEPDSIERRPVKDGGGTNSITVRNATFTWARSDPPTLNGITFSIPEGALVAVVGQVGCGKSSLLSALLAEMDKVEGHVAIKTRILVTHSMSYLPQVDVIIVMSGGKISEMGSYQELLARDGAFAEFLRTYASTEQEQDAEENGVTGVSGPGKEAKQMENGMLVTDSAGKQLQRQLSSSSSYSGDISRHHNSTAELQKAEAKKEETWKLMEADKAQTGQVKLSVYWDYMKAIGLFISFLSIFLFMCNHVSALASNYWLSLWTDDPIVNGTQEHTKVRLSVYGALGISQGIAVFGYSMAVSIGGILASRCLHVDLLHSILRSPMSFFERTPSGNLVNRFSKELDTVDSMIPEVIKMFMGSLFNVIGACIVILLATPIAAIIIPPLGLIYFFVQRFYVASSRQLKRLESVSRSPVYSHFNETLLGVSVIRAFEEQERFIHQSDLKVDENQKAYYPSIVANRWLAVRLECVGNCIVLFAALFAVISRHSLSAGLVGLSVSYSLQVTTYLNWLVRMSSEMETNIVAVERLKEYSETEKEAPWQIQETAPPSSWPQVGRVEFRNYCLRYREDLDFVLRHINVTINGGEKVGIVGRTGAGKSSLTLGLFRINESAEGEIIIDGINIAKIGLHDLRFKITIIPQDPVLFSGSLRMNLDPFSQYSDEEVWTSLELAHLKDFVSALPDKLDHECAEGGENLSVGQRQLVCLARALLRKTKILVLDEATAAVDLETDDLIQSTIRTQFEDCTVLTIAHRLNTIMDYTRVIVLDKGEIQEYGAPSDLLQQRGLFYSMAKDAGLV

SEQ ID NO: 904071 - protein, 1596 aa, Homo sapiens; identical to SEQ ID NO: 904067

SEQ ID NO: 904072 - protein, 1251 aa, Homo sapiens
FAAAMRFVVCIGLGGLGSLARPVATLLLIGKVQGVVQGASQEGVSFMGLGMAEGAGGGADEVASYSSLLIKFVNDTKAPDWQGYFYTVLLFVTACLQTLVLHQYFHICFVSGMRIKTAVIGAVYRKALVITNSARKSSTVGEIVNLMSVDAQRFMDLATYINMIWSAPLQVILALYLLWLNLGPSVLAGVAVMVLMVPVNAVMAMKTKTYQVAHMKSKDNRIKLMNEILNGIKVLKLYAWELAFKDKVLAIRQEELKVLKKSAYLSAVGTFTWVCTPFLVALCTFAVYVTIDENNILDAQTAFVSLALFNILRFPLNILPMVISSIVQASVSLKRLRIFLSHEELEPDSIERRPVKDGGGTNSITVRNATFTWARSDPPTLNGITFSIPEGALVAVVGQVGCGKSSLLSALLAEMDKVEGHVAIKGSVAYVPQQAWIQNDSLRENILFGCQLEEPYYRSVIQACALLPDLEILPSGDRTEIGEKGVNLSGGQKQRVSLARAVYSNADIYLFDDPLSAVDAHVGKHIFENVIGPKGMLKNKTRILVTHSMSYLPQVDVIIVMSGGKISEMGSYQELLARDGAFAEFLRTYASTEQEQDAEENGVTGVSGPGKEAKQMENGMLVTDSAGKQLQRQLSSSSSYSGDISRHHNSTAELQKAEAKKEETWKLMEADKAQTGQVKLSVYWDYMKAIGLFISFLSIFLFMCNHVSALASNYWLSLWTDDPIVNGTQEHTKVRLSVYGALGISQGIAVFGYSMAVSIGGILASRCLHVDLLHSILRSPMSFFERTPSGNLVNRFSKELDTVDSMIPEVIKMFMGSLFNVIGACIVILLATPIAAIIIPPLGLIYFFVQRFYVASSRQLKRLESVSRSPVYSHFNETLLGVSVIRAFEEQERFIHQSDLKVDENQKAYYPSIVANRWLAVRLECVGNCIVLFAALFAVISRHSLSAGLVGLSVSYSLQVTTYLNWLVRMSSEMETNIVAVERLKEYSETEKEAPWQIQETAPPSSWPQVGRVEFRNYCLRYREDLDFVLRHINVTINGGEKVGIVGRTGAGKSSLTLGLFRINESAEGEIIIDGINIAKIGLHDLRFKITIIPQDPVLFSGSLRMNLDPFSQYSDEEVWTSLELAHLKDFVSALPDKLDHECAEGGENLSVGQRQLVCLARALLRKTKILVLDEATAAVDLETDDLIQSTIRTQFEDCTVLTIAHRLNTIMDYTRVIVLDKGEIQEYGAPSDLLQQRGLFYSMAKDAGLV

SEQ ID NO: 904073 - protein, 636 aa, Homo sapiens
MENGMLVTDSAGKQLQRQLSSSSSYSGDISRHHNSTAELQKAEAKKEETWKLMEADKAQTGQVKLSVYWDYMKAIGLFISFLSIFLFMCNHVSALASNYWLSLWTDDPIVNGTQEHTKVRLSVYGALGISQGIAVFGYSMAVSIGGILASRCLHVDLLHSILRSPMSFFERTPSGNLVNRFSKELDTVDSMIPEVIKMFMGSLFNVIGACIVILLATPIAAIIIPPLGLIYFFVQRFYVASSRQLKRLESVSRSPVYSHFNETLLGVSVIRAFEEQERFIHQSDLKVDENQKAYYPSIVANRWLAVRLECVGNCIVLFAALFAVISRHSLSAGLVGLSVSYSLQVTTYLNWLVRMSSEMETNIVAVERLKEYSETEKEAPWQIQETAPPSSWPQVGRVEFRNYCLRYREDLDFVLRHINVTINGGEKVGIVGRTGAGKSSLTLGLFRINESAEGEIIIDGINIAKIGLHDLRFKITIIPQDPVLFSGSLRMNLDPFSQYSDEEVWTSLELAHLKDFVSALPDKLDHECAEGGENLSVGQRQLVCLARALLRKTKILVLDEATAAVDLETDDLIQSTIRTQFEDCTVLTIAHRLNTIMDYTRVIVLDKGEIQEYGAPSDLLQQRGLFYSMAKDAGLV

SEQ ID NO: 904074 - protein, 690 aa, Homo sapiens
DTAFLWVPINLESDMVGVWCIYSYICLHVCMWKHSVSYAMVQTHNSSPSREPSDPAQGICTVDTLVLCFSRQLSSSSSYSGDISRHHNSTAELQKAEAKKEETWKLMEADKAQTGQVKLSVYWDYMKAIGLFISFLSIFLFMCNHVSALASNYWLSLWTDDPIVNGTQEHTKVRLSVYGALGISQGIAVFGYSMAVSIGGILASRCLHVDLLHSILRSPMSFFERTPSGNLVNRFSKELDTVDSMIPEVIKMFMGSLFNVIGACIVILLATPIAAIIIPPLGLIYFFVQRFYVASSRQLKRLESVSRSPVYSHFNETLLGVSVIRAFEEQERFIHQSDLKVDENQKAYYPSIVANRWLAVRLECVGNCIVLFAALFAVISRHSLSAGLVGLSVSYSLQVTTYLNWLVRMSSEMETNIVAVERLKEYSETEKEAPWQIQETAPPSSWPQVGRVEFRNYCLRYREDLDFVLRHINVTINGGEKVGIVGRTGAGKSSLTLGLFRINESAEGEIIIDGINIAKIGLHDLRFKITIIPQDPVLFSGSLRMNLDPFSQYSDEEVWTSLELAHLKDFVSALPDKLDHECAEGGENLSVGQRQLVCLARALLRKTKILVLDEATAAVDLETDDLIQSTIRTQFEDCTVLTIAHRLNTIMDYTRVIVLDKGEIQEYGAPSDLLQQRGLFYSMAKDAGLV

SEQ ID NO: 904075 - protein, 1531 aa, Homo sapiens
QAALRPRPRLPAPPPPPPPPPPPPPPALAPAAGPDHPPPGARRRPRQQPGPITRRPVPAAARATGMALRGFCSADGSDPLWDWNVTWNTSNPDFTKCFQNTVLVWVPCFYLWACFPFYFLYLSRHDRGYIQMTPLNKTKTALGFLLWIVCWADLFYSFWERSRGIFLAPVFLVSPTLLGITTLLATFLIQLERRKGVQSSGIMLTFWLVALVCALAILRSKIMTALKEDAQVDLFRDITFYVYFSLLLIQLVLSCFSDRSPLFSETIHDPNPCPESSASFLSRITFWWITGLIVRGYRQPLEGSDLWSLNKEDTSEQVVPVLVKNWKKECAKTRKQPVKVVYSSKDPAQPKESSKVDANEEVEALIVKSPQKEWNPSLFKVLYKTFGPYFLMSFFFKAIHDLMMFSGPQILKLLIKFVNDTKAPDWQGYFYTVLLFVTACLQTLVLHQYFHICFVSGMRIKTAVIGAVYRKALVITNSARKSSTVGEIVNLMSVDAQRFMDLATYINMIWSAPLQVILALYLLWLNLGPSVLAGVAVMVLMVPVNAVMAMKTKTYQVAHMKSKDNRIKLMNEILNGIKVLKLYAWELAFKDKVLAIRQEELKVLKKSAYLSAVGTFTWVCTPFLVALCTFAVYVTIDENNILDAQTAFVSLALFNILRFPLNILPMVISSIVQASVSLKRLRIFLSHEELEPDSIERRPVKDGGGTNSITVRNATFTWARSDPPTLNGITFSIPEGALVAVVGQVGCGKSSLLSALLAEMDKVEGHVAIKGSVAYVPQQAWIQNDSLRENILFGCQLEEPYYRSVIQACALLPDLEILPSGDRTEIGEKGVNLSGGQKQRVSLARAVYSNADIYLFDDPLSAVDAHVGKHIFENVIGPKGMLKNKTRILVTHSMSYLPQVDVIIVMSGGKISEMGSYQELLARDGAFAEFLRTYASTEQEQDAEENGVTGVSGPGKEAKQMENGMLVTDSAGKQLQRQLSSSSSYSGDISRHHNSTAELQKAEAKKEETWKLMEADKAQTGQVKLSVYWDYMKAIGLFISFLSIFLFMCNHVSALASNYWLSLWTDDPIVNGTQEHTKVRLSVYGALGISQGIAVFGYSMAVSIGGILASRCLHVDLLHSILRSPMSFFERTPSGNLVNRFSKELDTVDSMIPEVIKMFMGSLFNVIGACIVILLATPIAAIIIPPLGLIYFFVQRFYVASSRQLKRLESVSRSPVYSHFNETLLGVSVIRAFEEQERFIHQSDLKVDENQKAYYPSIVANRWLAVRLECVGNCIVLFAALFAVISRHSLSAGLVGLSVSYSLQVTTYLNWLVRMSSEMETNIVAVERLKEYSETEKEAPWQIQETAPPSSWPQVGRVEFRNYCLRYREDLDFVLRHINVTINGGEKVGIVGRTGAGKSSLTLGLFRINESAEGEIIIDGINIAKIGLHDLRFKITIIPQDPVLFSGSLRMNLDPFSQYSDEEVWTSLELAHLKDFVSALPDKLDHECAEGGENLRQRRCVLAEAAATRHPGGWARDGPERKHSPQRQAES

SEQ ID NO: 904076 - protein, 977 aa, Homo sapiens
QAALRPRPRLPAPPPPPPPPPPPPPPALAPAAGPDHPPPGARRRPRQQPGPITRRPVPAAARATGMALRGFCSADGSDPLWDWNVTWNTSNPDFTKCFQNTVLVWVPCFYLWACFPFYFLYLSRHDRGYIQMTPLNKTKTALGFLLWIVCWADLFYSFWERSRGIFLAPVFLVSPTLLGITTLLATFLIQLERRKGVQSSGIMLTFWLVALVCALAILRSKIMTALKEDAQVDLFRDITFYVYFSLLLIQLVLSCFSDRSPLFSETIHDPNPCPESSASFLSRITFWWITGLIVRGYRQPLEGSDLWSLNKEDTSEQVVPVLVKNWKKECAKTRKQPVKVVYSSKDPAQPKESSKVDANEEVEALIVKSPQKEWNPSLFKVLYKTFGPYFLMSFFFKAIHDLMMFSGPQILKLLIKFVNDTKAPDWQGYFYTVLLFVTACLQTLVLHQYFHICFVSGMRIKTAVIGAVYRKALVITNSARKSSTVGEIVNLMSVDAQRFMDLATYINMIWSAPLQVILALYLLWLNLGPSVLAGVAVMVLMVPVNAVMAMKTKTYQVAHMKSKDNRIKLMNEILNGIKVLKLYAWELAFKDKVLAIRQEELKVLKKSAYLSAVGTFTWVCTPFLVALCTFAVYVTIDENNILDAQTAFVSLALFNILRFPLNILPMVISSIVQASVSLKRLRIFLSHEELEPDSIERRPVKDGGGTNSITVRNATFTWARSDPPTLNGITFSIPEGALVAVVGQVGCGKSSLLSALLAEMDKVEGHVAIKGSVAYVPQQAWIQNDSLRENILFGCQLEEPYYRSVIQACALLPDLEILPSGDRTEIGEKGVNLSGGQKQRVSLARAVYSNADIYLFDDPLSAVDAHVGKHIFENVIGPKGMLKNKTRILVTHSMSYLPQVDVIIVMSGGKISEMGSYQELLARDGAFAEFLRTYASTEQEQDAEENGVTGVSGPGKEAKQMENGMLVTDSAGKQLQR

SEQ ID NO: 904077 - protein, 607 aa, Homo sapiens
QAALRPRPRLPAPPPPPPPPPPPPPPALAPAAGPDHPPPGARRRPRQQPGPITRRPVPAAARATGMALRGFCSADGSDPLWDWNVTWNTSNPDFTKCFQNTVLVWVPCFYLWACFPFYFLYLSRHDRGYIQMTPLNKTKTALGFLLWIVCWADLFYSFWERSRGIFLAPVFLVSPTLLGITTLLATFLIQLERRKGVQSSGIMLTFWLVALVCALAILRSKIMTALKEDAQVDLFRDITFYVYFSLLLIQLVLSCFSDRSPLFSETIHDPNPCPESSASFLSRITFWWITGLIVRGYRQPLEGSDLWSLNKEDTSEQVVPVLVKNWKKECAKTRKQPVKVVYSSKDPAQPKESSKVDANEEVEALIVKSPQKEWNPSLFKVLYKTFGPYFLMSFFFKAIHDLMMFSGPQILKLLIKFVNDTKAPDWQGYFYTVLLFVTACLQTLVLHQYFHICFVSGMRIKTAVIGAVYRKALVITNSARKSSTVGEIVNLMSVDAQRFMDLATYINMIWSAPLQVILALYLLWLNLGPSVLAGVAVMVLMVPVNAVMAMKTKTYQVAHMKSKDNRIKLMNEILNGIKVLKLYAWELDKRGKSYMNAEKGCRLKPGE

SEQ ID NO: 904078 - protein, 1540 aa, Homo sapiens
QAALRPRPRLPAPPPPPPPPPPPPPPALAPAAGPDHPPPGARRRPRQQPGPITRRPVPAAARATGMALRGFCSADGSDPLWDWNVTWNTSNPDFTKCFQNTVLVWVPCFYLWACFPFYFLYLSRHDRGYIQMTPLNKTKTALGFLLWIVCWADLFYSFWERSRGIFLAPVFLVSPTLLGITTLLATFLIQLERRKGVQSSGIMLTFWLVALVCALAILRSKIMTALKEDAQVDLFRDITFYVYFSLLLIQLVLSCFSDRSPLFSETIHDPNPCPESSASFLSRITFWWITGLIVRGYRQPLEGSDLWSLNKEDTSEQVVPVLVKNWKKECAKTRKQPVKVVYSSKDPAQPKESSKVDANEEVEALIVKSPQKEWNPSLFKVLYKTFGPYFLMSFFFKAIHDLMMFSGPQILKLLIKFVNDTKAPDWQGYFYTVLLFVTACLQTLVLHQYFHICFVSGMRIKTAVIGAVYRKALVITNSARKSSTVGEIVNLMSVDAQRFMDLATYINMIWSAPLQVILALYLLWLNLGPSVLAGVAVMVLMVPVNAVMAMKTKTYQVAHMKSKDNRIKLMNEILNGIKVLKLYAWELAFKDKVLAIRQEELKVLKKSAYLSAVGTFTWVCTPFLVALCTFAVYVTIDENNILDAQTAFVSLALFNILRFPLNILPMVISSIVQASVSLKRLRIFLSHEELEPDSIERRPVKDGGGTNSITVRNATFTWARSDPPTLNGITFSIPEGALVAVVGQVGCGKSSLLSALLAEMDKVEGHVAIKGSVAYVPQQAWIQNDSLRENILFGCQLEEPYYRSVIQACALLPDLEILPSGDRTEIGEKTRILVTHSMSYLPQVDVIIVMSGGKISEMGSYQELLARDGAFAEFLRTYASTEQEQDAEENGVTGVSGPGKEAKQMENGMLVTDSAGKQLQRQLSSSSSYSGDISRHHNSTAELQKAEAKKEETWKLMEADKAQTGQVKLSVYWDYMKAIGLFISFLSIFLFMCNHVSALASNYWLSLWTDDPIVNGTQEHTKVRLSVYGALGISQGIAVFGYSMAVSIGGILASRCLHVDLLHSILRSPMSFFERTPSGNLVNRFSKELDTVDSMIPEVIKMFMGSLFNVIGACIVILLATPIAAIIIPPLGLIYFFVQRFYVASSRQLKRLESVSRSPVYSHFNETLLGVSVIRAFEEQERFIHQSDLKVDENQKAYYPSIVANRWLAVRLECVGNCIVLFAALFAVISRHSLSAGLVGLSVSYSLQVTTYLNWLVRMSSEMETNIVAVERLKEYSETEKEAPWQIQETAPPSSWPQVGRVEFRNYCLRYREDLDFVLRHINVTINGGEKVGIVGRTGAGKSSLTLGLFRINESAEGEIIIDGINIAKIGLHDLRFKITIIPQDPVLFSGSLRMNLDPFSQYSDEEVWTSLELAHLKDFVSALPDKLDHECAEGGENLSVGQRQLVCLARALLRKTKILVLDEATAAVDLETDDLIQSTIRTQFEDCTVLTIAHRLNTIMDYTRVIVLDKGEIQEYGAPSDLLQQRGLFYSMAKDAGLV

SEQ ID NO: 904079 - protein, 1482 aa, Homo sapiens
MALRGFCSADGSDPLWDWNVTWNTSNPDFTKCFQNTVLVWVPCFYLWACFPFYFLYLSRHDRGYIQMTPLNKTKTALGFLLWIVCWADLFYSFWERSRGIFLAPVFLVSPTLLGITTLLATFLIQLERRKGVQSSGIMLTFWLVALVCALAILRSKIMTALKEDAQVDLFRDITFYVYFSLLLIQLVLSCFSDRSPLFSETIHDPNPCPESSASFLSRITFWWITGLIVRGYRQPLEGSDLWSLNKEDTSEQVVPVLVKNWKKECAKTRKQPVKVVYSSKDPAQPKESSKVDANEEVEALIVKSPQKEWNPSLFKVLYKTFGPYFLMSFFFKAIHDLMMFSGPQILKLLIKFVNDTKAPDWQGYFYTVLLFVTACLQTLVLHQYFHICFVSGMRIKTAVIGAVYRKALVITNSARKSSTVGEIVNLMSVDAQRFMDLATYINMIWSAPLQVILALYLLWLNLGPSVLAGVAVMVLMVPVNAVMAMKTKTYQVAHMKSKDNRIKLMNEILNGIKVLKLYAWELAFKDKVLAIRQEELKVLKKSAYLSAVGTFTWVCTPFLASVSLKRLRIFLSHEELEPDSIERRPVKDGGGTNSITVRNATFTWARSDPPTLNGITFSIPEGALVAVVGQVGCGKSSLLSALLAEMDKVEGHVAIKGSVAYVPQQAWIQNDSLRENILFGCQLEEPYYRSVIQACALLPDLEILPSGDRTEIGEKGVNLSGGQKQRVSLARAVYSNADIYLFDDPLSAVDAHVGKHIFENVIGPKGMLKNKTRILVTHSMSYLPQVDVIIVMSGGKISEMGSYQELLARDGAFAEFLRTYASTEQEQDAEENGVTGVSGPGKEAKQMENGMLVTDSAGKQLQRQLSSSSSYSGDISRHHNSTAELQKAEAKKEETWKLMEADKAQTGQVKLSVYWDYMKAIGLFISFLSIFLFMCNHVSALASNYWLSLWTDDPIVNGTQEHTKVRLSVYGALGISQGIAVFGYSMAVSIGGILASRCLHVDLLHSILRSPMSFFERTPSGNLVNRFSKELDTVDSMIPEVIKMFMGSLFNVIGACIVILLATPIAAIIIPPLGLIYFFVQRFYVASSRQLKRLESVSRSPVYSHFNETLLGVSVIRAFEEQERFIHQSDLKVDENQKAYYPSIVANRWLAVRLECVGNCIVLFAALFAVISRHSLSAGLVGLSVSYSLQVTTYLNWLVRMSSEMETNIVAVERLKEYSETEKEAPWQIQETAPPSSWPQVGRVEFRNYCLRYREDLDFVLRHINVTINGGEKVGIVGRTGAGKSSLTLGLFRINESAEGEIIIDGINIAKIGLHDLRFKITIIPQDPVLFSGSLRMNLDPFSQYSDEEVWTSLELAHLKDFVSALPDKLDHECAEGGENLSVGQRQLVCLARALLRKTKILVLDEATAAVDLETDDLIQSTIRTQFEDCTVLTIAHRLNTIMDYTRVIVLDKGEIQEYGAPSDLLQQRGLFYSMAKDAGLV

SEQ ID NO: 904080 - protein, 1531 aa, Homo sapiens
QAALRPRPRLPAPPPPPPPPPPPPPPALAPAAGPDHPPPGARRRPRQQPGPITRRPVPAAARATGMALRGFCSADGSDPLWDWNVTWNTSNPDFTKCFQNTVLVWVPCFYLWACFPFYFLYLSRHDRGYIQMTPLNKTKTALGFLLWIVCWADLFYSFWERSRGIFLAPVFLVSPTLLGITTLLATFLIQLERRKGVQSSGIMLTFWLVALVCALAILRSKIMTALKEDAQVDLFRDITFYVYFSLLLIQLVLSCFSDRSPLFSETIHDPNPCPESSASFLSRITFWWITGLIVRGYRQPLEGSDLWSLNKEDTSEQVVPVLVKNWKKECAKTRKQPVKVVYSSKDPAQPKESSKVDANEEVEALIVKSPQKEWNPSLFKVLYKTFGPYFLMSFFFKAIHDLMMFSGPQILKLLIKFVNDTKAPDWQGYFYTVLLFVTACLQTLVLHQYFHICFVSGMRIKTAVIGAVYRKALVITNSARKSSTVGEIVNLMSVDAQRFMDLATYINMIWSAPLQVILALYLLWLNLGPSVLAGVAVMVLMVPVNAVMAMKTKTYQVAHMKSKDNRIKLMNEILNGIKVLKLYAWELAFKDKVLAIRQEELKVLKKSAYLSAVGTFTWVCTPFLVALCTFAVYVTIDENNILDAQTAFVSLALFNILRFPLNILPMVISSIVQASVSLKRLRIFLSHEELEPDSIERRPVKDGGGTNSITVRNATFTWARSDPPTLNGITFSIPEGALVAVVGQVGCGKSSLLSALLAEMDKVEGHVAIKGSVAYVPQQAWIQNDSLRENILFGCQLEEPYYRSVIQACALLPDLEILPSGDRTEIGEKGVNLSGGQKQRVSLARAVYSNADIYLFDDPLSAVDAHVGKHIFENVIGPKGMLKNKTRILVTHSMSYLPQVDVIIVMSGGKISEMGSYQELLARDGAFAEFLRTYASTEQEQDAEENGVTGVSGPGKEAKQMENGMLVTDSAGKQLQRQLSSSSSYSGDISRHHNSTAELQKAEAKKEETWKLMEADKAQTGQVKLSVYWDYMKAIGLFISFLSIFLFMCNHVSALASNYWLSLWTDDPIVNGTQEHTKVRLSVYGALGISQGIAVFGYSMAVSIGGILASRCLHVDLLHSILRSPMSFFERTPSGNLVNRFSKELDTVDSMIPEVIKMFMGSLFNVIGACIVILLATPIAAIIIPPLGLIYFFVQRFYVASSRQLKRLESVSRSPVYSHFNETLLGVSVIRAFEEQERFIHQSDLKVDENQKAYYPSIVANRWLAVRLECVGNCIVLFAALFAVISRHSLSAGLVGLSVSYSLQVTTYLNWLVRMSSEMETNIVAVERLKEYSETEKEAPWQIQETAPPSSWPQVGRVEFRNYCLRYREDLDFVLRHINVTINGGEKVGIVGRTGAGKSSLTLGLFRINESAEGEIIIDGINIAKIGLHDLRFKITIIPQDPVLFSGSLRMNLDPFSQYSDEEVWTSLELAHLKDFVSALPDKLDHECAEGGENLRVIVLDKGEIQEYGAPSDLLQQRGLFYSMAKDAGLV

SEQ ID NO: 904081 - protein, 911 aa, Homo sapiens
MWSRTAQPVPDMSLCFVGGGTNSITVRNATFTWARSDPPTLNGITFSIPEGALVAVVGQVGCGKSSLLSALLAEMDKVEGHVAIKGSVAYVPQQAWIQNDSLRENILFGCQLEEPYYRSVIQACALLPDLEILPSGDRTEIGEKGVNLSGGQKQRVSLARAVYSNADIYLFDDPLSAVDAHVGKHIFENVIGPKGMLKNKTRILVTHSMSYLPQVDVIIVMSGGKISEMGSYQELLARDGAFAEFLRTYASTEQEQDAEENGVTGVSGPGKEAKQMENGMLVTDSAGKQLQRQLSSSSSYSGDISRHHNSTAELQKAEAKKEETWKLMEADKAQTGQVKLSVYWDYMKAIGLFISFLSIFLFMCNHVSALASNYWLSLWTDDPIVNGTQEHTKVRLSVYGALGISQGIAVFGYSMAVSIGGILASRCLHVDLLHSILRSPMSFFERTPSGNLVNRFSKELDTVDSMIPEVIKMFMGSLFNVIGACIVILLATPIAAIIIPPLGLIYFFVQRFYVASSRQLKRLESVSRSPVYSHFNETLLGVSVIRAFEEQERFIHQSDLKVDENQKAYYPSIVANRWLAVRLECVGNCIVLFAALFAVISRHSLSAGLVGLSVSYSLQVTTYLNWLVRMSSEMETNIVAVERLKEYSETEKEAPWQIQETAPPSSWPQVGRVEFRNYCLRYREDLDFVLRHINVTINGGEKVGIVGRTGAGKSSLTLGLFRINESAEGEIIIDGINIAKIGLHDLRFKITIIPQDPVLFSGSLRMNLDPFSQYSDEEVWTSLELAHLKDFVSALPDKLDHECAEGGENLSVGQRQLVCLARALLRKTKILVLDEATAAVDLETDDLIQSTIRTQFEDCTVLTIAHRLNTIMDYTRVIVLDKGEIQEYGAPSDLLQQRGLFYSMAKDAGLV

SEQ ID NO: 904082 - protein, 590 aa, Homo sapiens
LRPYPLARPGMRLGSLVKLSVYWDYMKAIGLFISFLSIFLFMCNHVSALASNYWLSLWTDDPIVNGTQEHTKVRLSVYGALGISQGIAVFGYSMAVSIGGILASRCLHVDLLHSILRSPMSFFERTPSGNLVNRFSKELDTVDSMIPEVIKMFMGSLFNVIGACIVILLATPIAAIIIPPLGLIYFFVQRFYVASSRQLKRLESVSRSPVYSHFNETLLGVSVIRAFEEQERFIHQSDLKVDENQKAYYPSIVANRWLAVRLECVGNCIVLFAALFAVISRHSLSAGLVGLSVSYSLQVTTYLNWLVRMSSEMETNIVAVERLKEYSETEKEAPWQIQETAPPSSWPQVGRVEFRNYCLRYREDLDFVLRHINVTINGGEKVGIVGRTGAGKSSLTLGLFRINESAEGEIIIDGINIAKIGLHDLRFKITIIPQDPVLFSGSLRMNLDPFSQYSDEEVWTSLELAHLKDFVSALPDKLDHECAEGGENLSVGQRQLVCLARALLRKTKILVLDEATAAVDLETDDLIQSTIRTQFEDCTVLTIAHRLNTIMDYTRVIVLDKGEIQEYGAPSDLLQQRGLFYSMAKDAGLV

SEQ ID NO: 904083 - protein, 428 aa, Homo sapiens
MFSSTALPWEDGRREPSSTPRVCSLPQRFYVASSRQLKRLESVSRSPVYSHFNETLLGVSVIRAFEEQERFIHQSDLKVDENQKAYYPSIVANRWLAVRLECVGNCIVLFAALFAVISRHSLSAGLVGLSVSYSLQVTTYLNWLVRMSSEMETNIVAVERLKEYSETEKEAPWQIQETAPPSSWPQVGRVEFRNYCLRYREDLDFVLRHINVTINGGEKVGIVGRTGAGKSSLTLGLFRINESAEGEIIIDGINIAKIGLHDLRFKITIIPQDPVLFSGSLRMNLDPFSQYSDEEVWTSLELAHLKDFVSALPDKLDHECAEGGENLSVGQRQLVCLARALLRKTKILVLDEATAAVDLETDDLIQSTIRTQFEDCTVLTIAHRLNTIMDYTRVIVLDKGEIQEYGAPSDLLQQRGLFYSMAKDAGLV

SEQ ID NO: 904084 - protein, 605 aa, Homo sapiens
QAALRPRPRLPAPPPPPPPPPPPPPPALAPAAGPDHPPPGARRRPRQQPGPITRRPVPAAARATGMALRGFCSADGSDPLWDWNVTWNTSNPDFTKCFQNTVLVWVPCFYLWACFPFYFLYLSRHDRGYIQMTPLNKTKTALGFLLWIVCWADLFYSFWERSRGIFLAPVFLVSPTLLGITTLLATFLIQLERRKGVQSSGIMLTFWLVALVCALAILRSKIMTALKEDAQVDLFRDITFYVYFSLLLIQLVLSCFSDRSPLFSETIHDPNPCPESSASFLSRITFWWITGLIVRGYRQPLEGSDLWSLNKEDTSEQVVPVLVKNWKKECAKTRKQPVKVVYSSKDPAQPKESSKVDANEEVEALIVKSPQKEWNPSLFKVLYKTFGPYFLMSFFFKAIHDLMMFSGPQILKLLIKFVNDTKAPDWQGYFYTVLLFVTACLQTLVLHQYFHICFVSGMRIKTAVIGAVYRKALVITNSARKSSTVGEIVNLMSVDAQRFMDLATYINMIWSAPLQVILALYLLWLNLGPSVLAGVAVMVLMVPVNAVMAMKTKTYQVRHVSLRAPKPGPRQRPLHEDFSPVPSALSLGFSALPASWTHLGSLNKC

SEQ ID NO: 904085 - protein, 212 aa, Homo sapiens
MRAPRGLGTGSALKEKAVREGTEGHRAERVLCIDQRSTGCKGVIWGITFQEGQPPSAEAWEATLGSRVSERGGQGSHSFTRWTGNSLLSPFTAIEGALANPGDSSAQQLAPGGPSGIPELLPALPRGPGLRSQAHQCHDQWGRKGGYTSPHSLTHSQSGTGCHRAGEPSCSVSPVTHGSTPLLEWLFGGLGVDCGSKSCSERIQLAEVKAFR

SEQ ID NO: 904086 - protein, 437 aa, Homo sapiens
MGRRMRGAAATAGLWLLALGSLLALWGGLLPPRTELPASRPPEDRLPRRPARSGGPAPAPRFPLPPPLAWDARGGSLKTFRALLTLAAGADGPPRQSRSEPRWHVSARQPRPEESAAVHGGVFWSRGLEEQVPPGFSEAQAAAWLEAARGARMVALERGGCGRSSNRLARFADGTRACVRYGINPEQIQGEALSYYLARLLGLQRHVPPLALARVEARGAQWAQVQEELRAAHWTEGSVVSLTRWLPNLTDVVVPAPWRSEDGRLRPLRDAGGELANLSQAELVDLVQWTDLILFDYLTANFDRLVSNLFSLQWDPRVMQRATSNLHRGPGGALVFLDNEAGLVHGYRVAGMWDKYNEPLLQSVCVFRERTARRVLELHRGQDAAARLLRLYRRHEPRFPELAALADPHAQLLQRRLDFLAKHILHCKAKYGRRSGT

SEQ ID NO: 904087 - protein, 437 aa, Homo sapiens; identical to SEQ ID NO: 904086

SEQ ID NO: 904088 - protein, 437 aa, Homo sapiens; identical to SEQ ID NO: 904086

SEQ ID NO: 904089 - protein, 4087 aa, Homo sapiens
MAHAASQLKKNRDLEINAEEEPEKKRKHRKRSRDRKKKSDANASYLRAARAGHLEKALDYIKNGVDINICNQNGLNALHLASKEGHVEVVSELLQREANVDAATKKGNTALHIASLAGQAEVVKVLVTNGANVNAQSQNGFTPLYMAAQENHLEVVKFLLDNGASQSLATEDGFTPLAVALQQGHDQVVSLLLENDTKGKVRLPALHIAARKDDTKAAALLLQNDNNADVESKSGFTPLHIAAHYGNINVATLLLNRAAAVDFTARNDITPLHVASKRGNANMVKLLLDRGAKIDAKTRDGLTPLHCGARSGHEQVVEMLLDRAAPILSKTKNGLSPLHMATQGDHLNCVQLLLQHNVPVDDVTNDYLTALHVAAHCGHYKVAKVLLDKKANPNAKALNGFTPLHIACKKNRIKVMELLLKHGASIQAVTESGLTPIHVAAFMGHVNIVSQLMHHGASPNTTNVRGETALHMAARSGQAEVVRYLVQDGAQVEAKAKDDQTPLHISARLGKADIVQQLLQQGASPNAATTSGYTPLHLSAREGHEDVAAFLLDHGASLSITTKKGFTPLHVAAKYGKLEVANLLLQKSASPDAAGKSGLTPLHVAAHYDNQKVALLLLDQGASPHAAAKNGYTPLHIAAKKNQMDIATTLLEYGADANAVTRQGIASVHLAAQEGHVDMVSLLLGRNANVNLSNKSGLTPLHLAAQEDRVNVAEVLVNQGAHVDAQTKMGYTPLHVGCHYGNIKIVNFLLQHSAKVNAKTKNGYTPLHQAAQQGHTHIINVLLQNNASPNELTVNGNTALGIARRLGYISVVDTLKIVTEETMTTTTVTEKHKMNVPETMNEVLDMSDDEVRKANAPEMLSDGEYISDVEEGEDAMTGDTDKYLGPQDLKELGDDSLPAEGYMGFSLGARSASLRSFSSDRSYTLNRSSYARDSMMIEELLVPSKEQHLTFTREFDSDSLRHYSWAADTLDNVNLVSSPIHSGFLVSFMVDARGGSMRGSRHHGMRIIIPPRKCTAPTRITCRLVKRHKLANPPPMVEGEGLASRLVEMGPAGAQFLGPVIVEIPHFGSMRGKERELIVLRSENGETWKEHQFDSKNEDLTELLNGMDEELDSPEELGKKRICRIITKDFPQYFAVVSRIKQESNQIGPEGGILSSTTVPLVQASFPEGALTKRIRVGLQAQPVPDEIVKKILGNKATFSPIVTVEPRRRKFHKPITMTIPVPPPSGEGVSNGYKGDTTPNLRLLCSITGGTSPAQWEDITGTTPLTFIKDCVSFTTNVSARFWLADCHQVLETVGLATQLYRELICVPYMAKFVVFAKMNDPVESSLRCFCMTDDKVDKTLEQQENFEEVARSKDIEVLEGKPIYVDCYGNLAPLTKGGQQLVFNFYSFKENRLPFSIKIRDTSQEPCGRLSFLKEPKTTKGLPQTAVCNLNITLPAHKKETESDQDDEIEKTDRRQSFASLALRKRYSYLTEPGMIERSTGATRSLPTTYSYKPFFSTRPYQSWTTAPITVPGPAKSGFTSLSSSSSNTPSASPLKSIWSVSTPSPIKSTLGASTTSSVKSISDVASPIRSLRTMSSPIKTVVSQSPYNIQVSSGTLARAPAVTEATPLKGLASNSTFSSRTSPVTTAGSLLERSSITMTPPASPKSNINMYSSSLPFKSIITSAAPLISSPLKSVVSPVKSRVDVISSAKITMASSLSSPVKQMPGHAEVALVNGSISPLKYPSSSTLINGCKATATLQEKISSATNSVSSVVSAATDTVEKVFSTTTAMPFSPLRSYVSAAPSAFQSLRTPSASALYTSLGSSISATTSSVTSSIITVPVYSVVNVLPEPALKKLPDSNSFTKSAAALLSPIKTLTTETHPQPHFSRTSSPVKSSLFLAPSALKLSTPSSLSSSQEILKDVAEMKEDLMRMTAILQTDVPEEKPFQPELPKEGRIDDEEPFKIVEKVKEDLVKVSEILKKDVCVDNKGSPKSPKSDKGHSPEDDWIEFSSEEIREARQQAAASQSPSLPERVQVKAKAASEKDYNLTKVIDYLTNDIGSSSLTNLKYKFEDAKKDGEGGQKRVLKPAIALQEHKLKMPPASMRTSTSEKELCKMADSFFGTDTILESPDDFSQHDQDKSPLSDSGFETRSEKTPSAPQSAETTGPKPLFHEVPIPPVITETRTEVVHVIRSYDPSAGDVPQTQPEEPVSPKPSPTFMELEPKPTTSSIKEKVKAFQMKASSEEDDHNRVLSKGMRVKEETHITTTTRMVYHSPPGGEGASERIEETMSVHDIMKAFQSGRDPSKELAGLFEHKSAVSPDVHKSAAETSAQHAEKDNQMKPKLERIIEVHIEKGNQAEPTEVIIRETKKHPEKEMYVYQKDLSRGDINLKDFLPEKHDAFPCSEEQGQQEEEELTAEESLPSYLESSRVNTPVSQEEDSRPSSAQLISDDSYKTLKLLSQHSIEYHDDELSELRGESYRFAEKMLLSEKLDVSHSDTEESVTDHAGPPSSELQGSDKRSREKIATAPKKEILSKIYKDVSENGVGKVSKDEHFDKVTVLHYSGNVSSPKHAMWMRFTEDRLDRGREKLIYEDRVDRTVKEAEEKLTEVSQFFRDKTEKLNDELQSPEKKARPKNGKEYSSQSPTSSSPEKVLLTELLASNDEWVKARQHGPDGQGFPKAEEKAPSLPSSPEKMVLSQQTEDSKSTVEAKGSISQSKAPDGPQSGFQLKQSKLSSIRLKFEQGTHAKSKDMSQEDRKSDGQSRIPVKKIQESKLPVYQVFAREKQQKAIDLPDESVSVQKDFMVLKTKDEHAQSNEIVVNDSGSDNVKKQRTEMSSKAMPDSFSEQQAKDLACHITSDLATRGPWDKKVFRTWESSGATNNKSQKEKLSHVLVHDVRENHIGHPESKSVDQKNEFMSVTERERKLLTNGSLSEIKEMTVKSPSKKVLYREYVVKEGDHPGGLLDQPSRRSESSAVSHIPVRVADERRMLSSNIPDGFCEQSAFPKHELSQKLSQSSMSKETVETQHFNSIEDEKVTYSEISKVSKHQSYVGLCPPLEETETSPTKSPDSLEFSPGKESPSSDVFDHSPIDGLEKLAPLAQTEGGKEIKTLPVYVSFVQVGKQYEKEIQQGGVKKIISQECKTVQETRGTFYTTRQQKQPPSPQGSPEDDTLEQVSFLDSSGKSPLTPETPSSEEVSYEFTSKTPDSLIAYIPGKPSPIPEVSEESEEEEQAKSTSLKQTTVEETAVEREMPNDVSKDSNQRPKNNRVAYIEFPPPPPLDADQIESDKKHHYLPEKEVDMIEVNLQDEHDKYQLAEPVIRVQPPSPVPPGADVSDSSDDESIYQPVPVKKYTFKLKEVDDEQKEKPKASAEKASNQKELESNGSGKDNEFGLGLDSPQNEIAQNGNNDQSITECSIATTAEFSHDTDATEIDSLDGYDLQDEDDGLTESDSKLPIQAMEIKKDIWNTEGILKPADRSFSQSKLEVIEEEGKVGPDEDKPPSKSSSSEKTPDKTDQKSGAQFFTLEGRHPDRSVFPDTYFSYKVDEEFATPFKTVATKGLDFDPWSNNRGDDEVFDSKSREDETKPFGLAVEDRSPATTPDTTPARTPTDESTPTSEPNPFPFHEGKMFEMTRSGAIDMSKRDFVEERLQFFQIGEHTSEGKSGDQGEGDKSMVTATPQPQSGDTTVETNLERNVETPTVEPNPSIPTSGECQEGTSSSGSLEKSAAATNTSKVDPKLRTPIKMGISASTMTMKKEGPGEITDKIEAVMTSCQGLENETITMISNTANSQMGVRPHEKHDFQKDNFNNNNNLDSSTIQTDNIMSNIVLTEHSAPTCTTEKDNPVKVSSGKKTGVLQGHCVRDKQKVLGEQQKTKELIGIRQKSKLPIKATSPKDTFPPNHMSNTKASKMKQVSQSEKTKALTTSSCVDVKSRIPVKNTPRDNIIAVRKACATQKQGQPEKGKAKQLPSKLPVKVRSTCVTTTTTTATTTTTTTTTTTTSCTVKVRKSQLKEVCKHSIEYFKGISGETLKLVDRLSEEEKKMQSELSDEEESTSRNTSLSETSRGGQPSVTTKSARDKKTEAAPLKSKSEKAGSEKRSSEKDWSTESM

SEQ ID NO: 904090 - protein, 173 aa, Homo sapiens
MSEEPKEKNAKPAHRKRKGKKSDANASYLRAARAGHLEKALDYIKNGVDINICNQNGLNALHLASKEGHVEVVSELLQREANVDAATKKGNTALHIASLAGQAEVVKVLVTNGANVNAQSQNGFTPLYMAAQENHLEVVKFLLDNGASQSLATETLHKVLDILEQPGDGPFFQ

SEQ ID NO: 904091 - protein, 118 aa, Homo sapiens [sequence omitted]

SEQ ID NO: 904092 - protein, 1978 aa, Homo sapiens
MSEEPKEKNAKPAHRKRKGKKSDANASYLRAARAGHLEKALDYIKNGVDINICNQNGLNALHLASKEGHVEVVSELLQREANVDAATKKGNTALHIASLAGQAEVVKVLVTNGANVNAQSQNGFTPLYMAAQENHLEVVKFLLDNGASQSLATEDGFTPLAVALQQGHDQVVSLLLENDTKGKVRLPALHIAARKDDTKAAALLLQNDNNADVESKSGFTPLHIAAHYGNINVATLLLNRAAAVDFTARNDITPLHVASKRGNANMVKLLLDRGAKIDAKTRDGLTPLHCGARSGHEQVVEMLLDRAAPILSKTKNGLSPLHMATQGDHLNCVQLLLQHNVPVDDVTNDYLTALHVAAHCGHYKVAKVLLDKKANPNAKALNGFTPLHIACKKNRIKVMELLLKHGASIQAVTESGLTPIHVAAFMGHVNIVSQLMHHGASPNTTNVRGETALHMAARSGQAEVVRYLVQDGAQVEAKAKDDQTPLHISARLGKADIVQQLLQQGASPNAATTSGYTPLHLSAREGHEDVAAFLLDHGASLSITTKKGFTPLHVAAKYGKLEVANLLLQKSASPDAAGKVKRSPATLKQATSTITKYTLANIHYIATQIITKYLSPTRMKSTWEIKGKCWGPSTVENRNVNMPYVVSNLISFPQSKPLVLRTFDTGCCFCTCFQSGLTPLHVAAHYDNQKVALLLLDQGASPHAAAKNGYTPLHIAAKKNQMDIATTLLEYGADANAVTRQGIASVHLAAQEGHVDMVSLLLGRNANVNLSNKSGLTPLHLAAQEDRVNVAEVLVNQGAHVDAQTKMGYTPLHVGCHYGNIKIVNFLLQHSAKVNAKTKNGYTPLHQAAQQGHTHIINVLLQNNASPNELTVNGNTALGIARRLGYISVVDTLKIVTEETMTTTTVTEKHKMNVPETMNEVLDMSDDEVRKANAPEMLSDGEYISDVEEGEDAMTGDTDKYLGPQDLKELGDDSLPAEGYMGFSLGARSASLRSFSSDRSYTLNRSSYARDSMMIEELLVPSKEQHLTFTREFDSDSLRHYSWAADTLDNVNLVSSPIHSGFLVSFMVDARGGSMRGSRHHGMRIIIPPRKCTAPTRITCRLVKRHKLANPPPMVEGEGLASRLVEMGPAGAQFLGKLHLPTNPPPVNEGESLVSRILQLGPQGTKFIGPVIVEIPHFGSMRGKERELIVLRSENGETWKEHQFDSKNEDLTELLNGMDEELDSPEELGKKRICRIITKDFPQYFAVVSRIKQESNQIGPEGGILSSTTVPLVQASFPEGALTKRIRVGLQAQPVPDEIVKKILGNKATFSPIVTVEPRRRKFHKPITMTIPVPPPSGEGVSNGYKGDTTPNLRLLCSITGGTSPAQWEDITGTTPLTFIKDCVSFTTNVSARFWLADCHQVLETVGLATQLYRELICVPYMAKFVVFAKMNDPVESSLRCFCMTDDKVDKTLEQQENFEEVARSKDIEVLEGKPIYVDCYGNLAPLTKGGQQLVFNFYSFKENRLPFSIKIRDTSQEPCGRLSFLKEPKTTKGLPQTAVCNLNITLPAHKKIEKTDRRQSFASLALRKRYSYLTEPGMSPQSPCERTDIRMAIVADHLGLSWTELARELNFSVDEINQIRVENPNSLISQSFMLLKKWVTRDGKNATTDALTSVLTKINRIDIVTLLEGPIFDYGNISGTRSFADENNVFHDPVDGYPSLQVELETPTGLHYTPPTPFQQDDYFSDISSIESPLRTPSRLSDGLVPSQGNIEHSADGPPVVTAEDASLEDSKLEDSVPLTEMPEAVDVDESQLENVCLSWQNETSSGNLESCAQARRVTGGLLDRLDDSPDQCRDSITSYLKGEAGKFEANGSHTEITPEAKTKSYFPESQNDVGKQSTKETLKPKIHGSGHVEEPASPLAAYQKSLEETSKLIIEETKPCVPVSMKKMSRTSPADGKPRLSLHEEEGSSGSEQKQGEGFKVKTKKEIRHVEKKSHS

SEQ ID NO: 904093 - protein, 4284 aa, Homo sapiens
MSEEPKEKNAKPAHRKRKGKKSDANASYLRAARAGHLEKALDYIKNGVDINICNQNGLNALHLASKEGHVEVVSELLQREANVDAATKKGNTALHIASLAGQAEVVKVLVTNGANVNAQSQNGFTPLYMAAQENHLEVVKFLLDNGASQSLATEDGFTPLAVALQQGHDQVVSLLLENDTKGKVRLPALHIAARKDDTKAAALLLQNDNNADVESKSGFTPLHIAAHYGNINVATLLLNRAAAVDFTARNDITPLHVASKRGNANMVKLLLDRGAKIDAKTRDGLTPLHCGARSGHEQVVEMLLDRAAPILSKTKNGLSPLHMATQGDHLNCVQLLLQHNVPVDDVTNDYLTALHVAAHCGHYKVAKVLLDKKANPNAKALNGFTPLHIACKKNRIKVMELLLKHGASIQAVTESGLTPIHVAAFMGHVNIVSQLMHHGASPNTTNVRGETALHMAARSGQAEVVRYLVQDGAQVEAKAKDDQTPLHISARLGKADIVQQLLQQGASPNAATTSGYTPLHLSAREGHEDVAAFLLDHGASLSITTKKGFTPLHVAAKYGKLEVANLLLQKSASPDAAGKVKRSPATLKQATSTITKYTLANIHYIATQIITKYLSPTRMKSTWEIKGKCWGPSTVENRNVNMPYVVSNLISFPQSKPLVLRTFDTGCCFCTCFQSGLTPLHVAAHYDNQKVALLLLDQGASPHAAAKNGYTPLHIAAKKNQMDIATTLLEYGADANAVTRQGIASVHLAAQEGHVDMVSLLLGRNANVNLSNKSGLTPLHLAAQEDRVNVAEVLVNQGAHVDAQTKMGYTPLHVGCHYGNIKIVNFLLQHSAKVNAKTKNGYTPLHQAAQQGHTHIINVLLQNNASPNELTVNGNTALGIARRLGYISVVDTLKIVTEETMTTTTVTEKHKMNVPETMNEVLDMSDDEVRKANAPEMLSDGEYISDVEEGEDAMTGDTDKYLGPQDLKELGDDSLPAEGYMGFSLGARSASLRSFSSDRSYTLNRSSYARDSMMIEELLVPSKEQHLTFTREFDSDSLRHYSWAADTLDNVNLVSSPIHSGFLVSFMVDARGGSMRGSRHHGMRIIIPPRKCTAPTRITCRLVKRHKLANPPPMVEGEGLASRLVEMGPAGAQFLGPVIVEIPHFGSMRGKERELIVLRSENGETWKEHQFDSKNEDLTELLNGMDEELDSPEELGKKRICRIITKDFPQYFAVVSRIKQESNQIGPEGGILSSTTVPLVQASFPEGALTKRIRVGLQAQPVPDEIVKKILGNKATFSPIVTVEPRRRKFHKPITMTIPVPPPSGEGVSNGYKGDTTPNLRLLCSITGGTSPAQWEDITGTTPLTFIKDCVSFTTNVSARFWLADCHQVLETVGLATQLYRELICVPYMAKFVVFAKMNDPVESSLRCFCMTDDKVDKTLEQQENFEEVARSKDIEVLEGKPIYVDCYGNLAPLTKGGQQLVFNFYSFKENRLPFSIKIRDTSQEPCGRLSFLKEPKTTKGLPQTAVCNLNITLPAHKKETESDQDDEIEKTDRRQSFASLALRKRYSYLTEPGMIERSTGATRSLPTTYSYKPFFSTRPYQSWTTAPITVPGPAKSGFTSLSSSSSNTPSASPLKSIWSVSTPSPIKSTLGASTTSSVKSISDVASPIRSLRTMSSPIKTVVSQSPYNIQVSSGTLARAPAVTEATPLKGLASNSTFSSRTSPVTTAGSLLERSSITMTPPASPKSNINMYSSSLPFKSIITSAAPLISSPLKSVVSPVKSRVDVISSAKITMASSLSSPVKQMPGHAEVALVNGSISPLKYPSSSTLINGCKATATLQEKISSATNSVSSVVSAATDTVEKVFSTTTAMPFSPLRSYVSAAPSAFQSLRTPSASALYTSLGSSISATTSSVTSSIITVPVYSVVNVLPEPALKKLPDSNSFTKSAAALLSPIKTLTTETHPQPHFSRTSSPVKSSLFLAPSALKLSTPSSLSSSQEILKDVAEMKEDLMRMTAILQTDVPEEKPFQPELPKEGRIDDEEPFKIVEKVKEDLVKVSEILKKDVCVDNKGSPKSPKSDKGHSPEDDWIEFSSEEIREARQQAAASQSPSLPERVQVKAKAASEKDYNLTKVIDYLTNDIGSSSLTNLKYKFEDAKKDGEGGQKRVLKPAIALQEHKLKMPPASMRTSTSEKELCKMADSFFGTDTILESPDDFSQHDQDKSPLSDSGFETRSEKTPSAPQSAETTGPKPLFHEVPIPPVITETRTEVVHVIRSYDPSAGDVPQTQPEEPVSPKPSPTFMELEPKPTTSSIKEKVKAFQMKASSEEDDHNRVLSKGMRVKEETHITTTTRMVYHSPPGGEGASERIEETMSVHDIMKAFQSGRDPSKELAGLFEHKSAVSPDVHKSAAETSAQHAEKDNQMKPKLERIIEVHIEKGNQAEPTEVIIRETKKHPEKEMYVYQKDLSRGDINLKDFLPEKHDAFPCSEEQGQQEEEELTAEESLPSYLESSRVNTPVSQEEDSRPSSAQLISDDSYKTLKLLSQHSIEYHDDELSELRGESYRFAEKMLLSEKLDVSHSDTEESVTDHAGPPSSELQGSDKRSREKIATAPKKEILSKIYKDVSENGVGKVSKDEHFDKVTVLHYSGNVSSPKHAMWMRFTEDRLDRGREKLIYEDRVDRTVKEAEEKLTEVSQFFRDKTEKLNDELQSPEKKARPKNGKEYSSQSPTSSSPEKVLLTELLASNDEWVKARQHGPDGQGFPKAEEKAPSLPSSPEKMVLSQQTEDSKSTVEAKGSISQSKAPDGPQSGFQLKQSKLSSIRLKFEQGTHAKSKDMSQEDRKSDGQSRIPVKKIQESKLPVYQVFAREKQQKAIDLPDESVSVQKDFMVLKTKDEHAQSNEIVVNDSGSDNVKKQRTEMSSKAMPDSFSEQQAKDLACHITSDLATRGPWDKKVFRTWESSGATNNKSQKEKLSHVLVHDVRENHIGHPESKSVDQKNEFMSVTERERKLLTNGSLSEIKEMTVKSPSKKVLYREYVVKEGDHPGGLLDQPSRRSESSAVSHIPVRVADERRMLSSNIPDGFCEQSAFPKHELSQKLSQSSMSKETVETQHFNSIEDEKVTYSEISKVSKHQSYVGLCPPLEETETSPTKSPDSLEFSPGKESPSSDVFDHSPIDGLEKLAPLAQTEGGKEIKTLPVYVSFVQVGKQYEKEIQQGGVKKIISQECKTVQETRGTFYTTRQQKQPPSPQGSPEDDTLEQVSFLDSSGKSPLTPETPSSEEVSYEFTSKTPDSLIAYIPGKPSPIPEVSEESEEEEQAKSTSLKQTTVEETAVEREMPNDVSKDSNQRPKNNRVAYIEFPPPPPLDADQIESDKKHHYLPEKEVDMIEVNLQDEHDKYQLAEPVIRVQPPSPVPPGADVSDSSDDESIYQPVPVKKYTFKLKEVDDEQKEKPKASAEKASNQKELESNGSGKDNEFGLGLDSPQNEIAQNGNNDQSITECSIATTAEFSHDTDATEIDSLDGYDLQDEDDGLTESDSKLPIQAMEIKKDIWNTEGILKPADRSFSQSKLEVIEEEGKVGPDEDKPPSKSSSSEKTPDKTDQKSGAQFFTLEGRHPDRSVFPDTYFSYKVDEEFATPFKTVATKGLDFDPWSNNRGDDEVFDSKSREDETKPFGLAVEDRSPATTPDTTPARTPTDESTPTSEPNPFPFHEGKMFEMTRSGAIDMSKRDFVEERLQFFQIGEHTSEGKSGDQGEGDKSMVTATPQPQSGDTTVETNLERNVETPTVEPNPSIPTSGECQEGTSSSGSLEKSAAATNTSKVDPKLRTPIKMGISASTMTMKKEGPGEITDKIEAVMTSCQGLENETITMISNTANSQMGVRPHEKHDFQKDNFNNNNNLDSSTIQTDNIMSNIVLTEHSAPTCTTEKDNPVKVSSGKKTGVLQGHCVRDKQKVLGEQQKTKELIGIRQKSKLPIKATSPKDTFPPNHMSNTKASKMKQVSQSEKTKALTTSSCVDVKSRIPVKNTPRDNIIAVRKACATQKQGQPEKGKAKQLPSKLPVKVRSTCVTTTTTTATTTTTTTTTTTTSCTVKVRKSQLKEVCKHSIEYFKGISGETLKLVDRLSEEEKKMQSELSDEEESTSRNTSLSETSRGGQPSVTTKSARDKKTEAAPLKSKSEKAGSEKRSSRRTGPQSPCERTDIRMAIVADHLGLSWTELARELNFSVDEINQIRVENPNSLISQSFMLLKKWVTRDGKNATTDALTSVLTKINRIDIVTLLEGPIFDYGNISGTRSFADENNVFHDPVDVSPMYCLP

SEQ ID NO: 904094 - protein, 1933 aa, Homo sapiens
MSEEPKEKNAKPAHRKRKGKKSDANASYLRAARAGHLEKALDYIKNGVDINICNQNGLNALHLASKEGHVEVVSELLQREANVDAATKKGNTALHIASLAGQAEVVKVLVTNGANVNAQSQNGFTPLYMAAQENHLEVVKFLLDNGASQSLATEDGFTPLAVALQQGHDQVVSLLLENDTKGKVRLPALHIAARKDDTKAAALLLQNDNNADVESKSGFTPLHIAAHYGNINVATLLLNRAAAVDFTARNDITPLHVASKRGNANMVKLLLDRGAKIDAKTRDGLTPLHCGARSGHEQVVEMLLDRAAPILSKTKNGLSPLHMATQGDHLNCVQLLLQHNVPVDDVTNDYLTALHVAAHCGHYKVAKVLLDKKANPNAKALNGFTPLHIACKKNRIKVMELLLKHGASIQAVTESGLTPIHVAAFMGHVNIVSQLMHHGASPNTTNVRGETALHMAARSGQAEVVRYLVQDGAQVEAKAKDDQTPLHISARLGKADIVQQLLQQGASPNAATTSGYTPLHLSAREGHEDVAAFLLDHGASLSITTKKGFTPLHVAAKYGKLEVANLLLQKSASPDAAGKVKRSPATLKQATSTITKYTLANIHYIATQIITKYLSPTRMKSTWEIKGKCWGPSTVENRNVNMPYVVSNLISFPQSKPLVLRTFDTGCCFCTCFQSGLTPLHVAAHYDNQKVALLLLDQGASPHAAAKNGYTPLHIAAKKNQMDIATTLLEYGADANAVTRQGIASVHLAAQEGHVDMVSLLLGRNANVNLSNKSGLTPLHLAAQEDRVNVAEVLVNQGAHVDAQTKMGYTPLHVGCHYGNIKIVNFLLQHSAKVNAKTKNGYTPLHQAAQQGHTHIINVLLQNNASPNELTVNGNTALGIARRLGYISVVDTLKIVTEETMTTTTVTEKHKMNVPETMNEVLDMSDDEVRKANAPEMLSDGEYISDVEEGEDAMTGDTDKYLGPQDLKELGDDSLPAEGYMGFSLGARSASLRSFSSDRSYTLNRSSYARDSMMIEELLVPSKEQHLTFTREFDSDSLRHYSWAADTLDNVNLVSSPIHSGFLVSFMVDARGGSMRGSRHHGMRIIIPPRKCTAPTRITCRLVKRHKLANPPPMVEGEGLASRLVEMGPAGAQFLGPVIVEIPHFGSMRGKERELIVLRSENGETWKEHQFDSKNEDLTELLNGMDEELDSPEELGKKRICRIITKDFPQYFAVVSRIKQESNQIGPEGGILSSTTVPLVQASFPEGALTKRIRVGLQAQPVPDEIVKKILGNKATFSPIVTVEPRRRKFHKPITMTIPVPPPSGEGVSNGYKGDTTPNLRLLCSITGGTSPAQWEDITGTTPLTFIKDCVSFTTNVSARFWLADCHQVLETVGLATQLYRELICVPYMAKFVVFAKMNDPVESSLRCFCMTDDKVDKTLEQQENFEEVARSKDIEVLEGKPIYVDCYGNLAPLTKGGQQLVFNFYSFKENRLPFSIKIRDTSQEPCGRLSFLKEPKTTKGLPQTAVCNLNITLPAHKKIEKTDRRQSFASLALRPQSPCERTDIRMAIVADHLGLSWTELARELNFSVDEINQIRVENPNSLISQSFMLLKKWVTRDGKNATTDALTSVLTKINRIDIVTLLEGPIFDYGNISGTRSFADENNVFHDPVDGYPSLQVELETPTGLHYTPPTPFQQDDYFSDISSIESPLRTPSRLSDGLVPSQGNIEHSADGPPVVTAEDASLEDSKLEDSVPLTEMPEAVDVDESQLENVCLSWQNETSSGNLESCAQARRVTGGLLDRLDDSPDQCRDSITSYLKGEAGKFEANGSHTEITPEAKTKSYFPESQNDVGKQSTKETLKPKIHGSGHVEEPASPLAAYQKSLEETSKLIIEETKPCVPVSMKKMSRTSPADGKPRLSLHEEEGSSGSEQKQGEGFKVKTKKEIRHVEKKSHS

SEQ ID NO: 904095 - protein, 1945 aa, Homo sapiens
MSEEPKEKNAKPAHRKRKGKKSDANASYLRAARAGHLEKALDYIKNGVDINICNQNGLNALHLASKEGHVEVVSELLQREANVDAATKKGNTALHIASLAGQAEVVKVLVTNGANVNAQSQNGFTPLYMAAQENHLEVVKFLLDNGASQSLATEDGFTPLAVALQQGHDQVVSLLLENDTKGKVRLPALHIAARKDDTKAAALLLQNDNNADVESKSGFTPLHIAAHYGNINVATLLLNRAAAVDFTARNDITPLHVASKRGNANMVKLLLDRGAKIDAKTRDGLTPLHCGARSGHEQVVEMLLDRAAPILSKTKNGLSPLHMATQGDHLNCVQLLLQHNVPVDDVTNDYLTALHVAAHCGHYKVAKVLLDKKANPNAKALNGFTPLHIACKKNRIKVMELLLKHGASIQAVTESGLTPIHVAAFMGHVNIVSQLMHHGASPNTTNVRGETALHMAARSGQAEVVRYLVQDGAQVEAKAKDDQTPLHISARLGKADIVQQLLQQGASPNAATTSGYTPLHLSAREGHEDVAAFLLDHGASLSITTKKGFTPLHVAAKYGKLEVANLLLQKSASPDAAGKVKRSPATLKQATSTITKYTLANIHYIATQIITKYLSPTRMKSTWEIKGKCWGPSTVENRNVNMPYVVSNLISFPQSKPLVLRTFDTGCCFCTCFQSGLTPLHVAAHYDNQKVALLLLDQGASPHAAAKNGYTPLHIAAKKNQMDIATTLLEYGADANAVTRQGIASVHLAAQEGHVDMVSLLLGRNANVNLSNKSGLTPLHLAAQEDRVNVAEVLVNQGAHVDAQTKMGYTPLHVGCHYGNIKIVNFLLQHSAKVNAKTKNGYTPLHQAAQQGHTHIINVLLQNNASPNELTVNGNTALGIARRLGYISVVDTLKIVTEETMTTTTVTEKHKMNVPETMNEVLDMSDDEVRKANAPEMLSDGEYISDVEEGEDAMTGDTDKYLGPQDLKELGDDSLPAEGYMGFSLGARSASLRSFSSDRSYTLNRSSYARDSMMIEELLVPSKEQHLTFTREFDSDSLRHYSWAADTLDNVNLVSSPIHSGFLVSFMVDARGGSMRGSRHHGMRIIIPPRKCTAPTRITCRLVKRHKLANPPPMVEGEGLASRLVEMGPAGAQFLGPVIVEIPHFGSMRGKERELIVLRSENGETWKEHQFDSKNEDLTELLNGMDEELDSPEELGKKRICRIITKDFPQYFAVVSRIKQESNQIGPEGGILSSTTVPLVQASFPEGALTKRIRVGLQAQPVPDEIVKKILGNKATFSPIVTVEPRRRKFHKPITMTIPVPPPSGEGVSNGYKGDTTPNLRLLCSITGGTSPAQWEDITGTTPLTFIKDCVSFTTNVSARFWLADCHQVLETVGLATQLYRELICVPYMAKFVVFAKMNDPVESSLRCFCMTDDKVDKTLEQQENFEEVARSKDIEVLEGKPIYVDCYGNLAPLTKGGQQLVFNFYSFKENRLPFSIKIRDTSQEPCGRLSFLKEPKTTKGLPQTAVCNLNITLPAHKKIEKTDRRQSFASLALRKRYSYLTEPGMSPQSPCERTDIRMAIVADHLGLSWTELARELNFSVDEINQIRVENPNSLISQSFMLLKKWVTRDGKNATTDALTSVLTKINRIDIVTLLEGPIFDYGNISGTRSFADENNVFHDPVDGYPSLQVELETPTGLHYTPPTPFQQDDYFSDISSIESPLRTPSRLSDGLVPSQGNIEHSADGPPVVTAEDASLEDSKLEDSVPLTEMPEAVDVDESQLENVCLSWQNETSSGNLESCAQARRVTGGLLDRLDDSPDQCRDSITSYLKGEAGKFEANGSHTEITPEAKTKSYFPESQNDVGKQSTKETLKPKIHGSGHVEEPASPLAAYQKSLEETSKLIIEETKPCVPVSMKKMSRTSPADGKPRLSLHEEEGSSGSEQKQGEGFKVKTKKEIRHVEKKSHS

SEQ ID NO: 904096 - protein, 1962 aa, Homo sapiens
MSEEPKEKNAKPAHRKRKGKKSDANASYLRAARAGHLEKALDYIKNGVDINICNQNGLNALHLASKEGHVEVVSELLQREANVDAATKKGNTALHIASLAGQAEVVKVLVTNGANVNAQSQNGFTPLYMAAQENHLEVVKFLLDNGASQSLATEDGFTPLAVALQQGHDQVVSLLLENDTKGKVRLPALHIAARKDDTKAAALLLQNDNNADVESKSGFTPLHIAAHYGNINVATLLLNRAAAVDFTARNDITPLHVASKRGNANMVKLLLDRGAKIDAKTRDGLTPLHCGARSGHEQVVEMLLDRAAPILSKTKNGLSPLHMATQGDHLNCVQLLLQHNVPVDDVTNDYLTALHVAAHCGHYKVAKVLLDKKANPNAKALNGFTPLHIACKKNRIKVMELLLKHGASIQAVTESGLTPIHVAAFMGHVNIVSQLMHHGASPNTTNVRGETALHMAARSGQAEVVRYLVQDGAQVEAKAKDDQTPLHISARLGKADIVQQLLQQGASPNAATTSGYTPLHLSAREGHEDVAAFLLDHGASLSITTKKGFTPLHVAAKYGKLEVANLLLQKSASPDAAGKVKRSPATLKQATSTITKYTLANIHYIATQIITKYLSPTRMKSTWEIKGKCWGPSTVENRNVNMPYVVSNLISFPQSKPLVLRTFDTGCCFCTCFQSGLTPLHVAAHYDNQKVALLLLDQGASPHAAAKNGYTPLHIAAKKNQMDIATTLLEYGADANAVTRQGIASVHLAAQEGHVDMVSLLLGRNANVNLSNKSGLTPLHLAAQEDRVNVAEVLVNQGAHVDAQTKMGYTPLHVGCHYGNIKIVNFLLQHSAKVNAKTKNGYTPLHQAAQQGHTHIINVLLQNNASPNELTVNGNTALGIARRLGYISVVDTLKIVTEETMTTTTVTEKHKMNVPETMNEVLDMSDDEVRKANAPEMLSDGEYISDVEEGEDAMTGDTDKYLGPQDLKELGDDSLPAEGYMGFSLGARSASLRSFSSDRSYTLNRSSYARDSMMIEELLVPSKEQHLTFTREFDSDSLRHYSWAADTLDNVNLVSSPIHSGFLVSFMVDARGGSMRGSRHHGMRIIIPPRKCTAPTRITCRLVKRHKLANPPPMVEGEGLASRLVEMGPAGAQFLGPVIVEIPHFGSMRGKERELIVLRSENGETWKEHQFDSKNEDLTELLNGMDEELDSPEELGKKRICRIITKDFPQYFAVVSRIKQESNQIGPEGGILSSTTVPLVQASFPEGALTKRIRVGLQAQPVPDEIVKKILGNKATFSPIVTVEPRRRKFHKPITMTIPVPPPSGEGVSNGYKGDTTPNLRLLCSITGGTSPAQWEDITGTTPLTFIKDCVSFTTNVSARFWLADCHQVLETVGLATQLYRELICVPYMAKFVVFAKMNDPVESSLRCFCMTDDKVDKTLEQQENFEEVARSKDIEVLEGKPIYVDCYGNLAPLTKGGQQLVFNFYSFKENRLPFSIKIRDTSQEPCGRLSFLKEPKTTKGLPQTAVCNLNITLPAHKKIEKTDRRQSFASLALRKRYSYLTEPGMSPQSPCERTDIRMAIVADHLGLSWTELARELNFSVDEINQIRVENPNSLISQSFMLLKKWVTRDGKNATTDALTSVLTKINRIDIVTLLEGPIFDYGNISGTRSFADENNVFHDPVDGYPSLQVELETPTGLHYTPPTPFQQDDYFSDISSIESPLRTPSRLSDGLVPSQGNIEHSADGPPVVTAEDASLEDSKLEDSVPLTEMPEAVDVDESQLENVCLSWQNETSSGNLESCAQARRVTGGLLDRLDDSPDQCRDSITSYLKGEAGKFEANGSHTEITPEAKTKSYFPESQNDVGKQSTKETLKPKIHGSGHVEEPASPLAAYQKSLEETSKLIIEETKPCVPVSMKKMSRTSPADGKPRLSLHEEEGSSGSEQKVKSPGAAPTRMTACCYKQGEGFKVKTKKEIRHVEKKSHS

SEQ ID NO: 904097 - protein, 534 aa, Homo sapiens
EAVIAQADDERGDVRRAPRRSAAAARADEMRRRGIGRVADDRRDYGRRRRAMTCVKGAEARDDRREHRGYGTQEVMAEWCGGYRGAAGRWAWAAIGVATDIVRRMGHGGRPEMRGVWAVETGGEREIRGERKAAVMARTEAADNKRRGGTGGEETGVGVLGGAERANGRYAGVILGVGKDGGGTQGGGDAPPTPFQQDDYFSDISSIESPLRTPSRLSDGLVPSQGNIEHSADGPPVVTAEDASLEDSKLEDSVPLTEMPEAVDVDESQLENVCLSEYPQYLGNLAGSPKDVKPAEPRKLGVSSEQQEKGKSGPDEEMMEEKLKSLFEDIQLEEGVESEEMTEEKVQAILKRVQQAELEMSSITGWQNETSSGNLESCAQARRVTGGLLDRLDDSSYLKGEAGKFEANGSHTEITPEAKTKSYFPESQNDVGKQSTKETLKPKIHGSGHVEEPASPLAAYQKSLEETSKLIIEETKPCVPVSMKKMSRTSPADGKPRLSLHEEEGSSGSEQKQGEGFKVKTKKEIRHVEKKSHS

SEQ ID NO: 904098 - protein, 4357 aa, Homo sapiens
MSEEPKEKNAKPAHRKRKGKKSDANASYLRAARAGHLEKALDYIKNGVDINICNQNGLNALHLASKEGHVEVVSELLQREANVDAATKKGNTALHIASLAGQAEVVKVLVTNGANVNAQSQNGFTPLYMAAQENHLEVVKFLLDNGASQSLATEDGFTPLAVALQQGHDQVVSLLLENDTKGKVRLPALHIAARKDDTKAAALLLQNDNNADVESKSGFTPLHIAAHYGNINVATLLLNRAAAVDFTARNDITPLHVASKRGNANMVKLLLDRGAKIDAKTRDGLTPLHCGARSGHEQVVEMLLDRAAPILSKTKNGLSPLHMATQGDHLNCVQLLLQHNVPVDDVTNDYLTALHVAAHCGHYKVAKVLLDKKANPNAKALNGFTPLHIACKKNRIKVMELLLKHGASIQAVTESGLTPIHVAAFMGHVNIVSQLMHHGASPNTTNVRGETALHMAARSGQAEVVRYLVQDGAQVEAKAKDDQTPLHISARLGKADIVQQLLQQGASPNAATTSGYTPLHLSAREGHEDVAAFLLDHGASLSITTKKGFTPLHVAAKYGKLEVANLLLQKSASPDAAGKVKRSPATLKQATSTITKYTLANIHYIATQIITKYLSPTRMKSTWEIKGKCWGPSTVENRNVNMPYVVSNLISFPQSKPLVLRTFDTGCCFCTCFQSGLTPLHVAAHYDNQKVALLLLDQGASPHAAAKNGYTPLHIAAKKNQMDIATTLLEYGADANAVTRQGIASVHLAAQEGHVDMVSLLLGRNANVNLSNKSGLTPLHLAAQEDRVNVAEVLVNQGAHVDAQTKMGYTPLHVGCHYGNIKIVNFLLQHSAKVNAKTKNGYTPLHQAAQQGHTHIINVLLQNNASPNELTVNGNTALGIARRLGYISVVDTLKIVTEETMTTTTVTEKHKMNVPETMNEVLDMSDDEVRKANAPEMLSDGEYISDVEEGEDAMTGDTDKYLGPQDLKELGDDSLPAEGYMGFSLGARSASLRSFSSDRSYTLNRSSYARDSMMIEELLVPSKEQHLTFTREFDSDSLRHYSWAADTLDNVNLVSSPIHSGFLVSFMVDARGGSMRGSRHHGMRIIIPPRKCTAPTRITCRLVKRHKLANPPPMVEGEGLASRLVEMGPAGAQFLGPVIVEIPHFGSMRGKERELIVLRSENGETWKEHQFDSKNEDLTELLNGMDEELDSPEELGKKRICRIITKDFPQYFAVVSRIKQESNQIGPEGGILSSTTVPLVQASFPEGALTKRIRVGLQAQPVPDEIVKKILGNKATFSPIVTVEPRRRKFHKPITMTIPVPPPSGEGVSNGYKGDTTPNLRLLCSITGGTSPAQWEDITGTTPLTFIKDCVSFTTNVSARFWLADCHQVLETVGLATQLYRELICVPYMAKFVVFAKMNDPVESSLRCFCMTDDKVDKTLEQQENFEEVARSKDIEVLEGKPIYVDCYGNLAPLTKGGQQLVFNFYSFKENRLPFSIKIRDTSQEPCGRLSFLKEPKTTKGLPQTAVCNLNITLPAHKKETESDQDDEIEKTDRRQSFASLALRKRYSYLTEPGMIERSTGATRSLPTTYSYKPFFSTRPYQSWTTAPITVPGPAKSGFTSLSSSSSNTPSASPLKSIWSVSTPSPIKSTLGASTTSSVKSISDVASPIRSLRTMSSPIKTVVSQSPYNIQVSSGTLARAPAVTEATPLKGLASNSTFSSRTSPVTTAGSLLERSSITMTPPASPKSNINMYSSSLPFKSIITSAAPLISSPLKSVVSPVKSRVDVISSAKITMASSLSSPVKQMPGHAEVALVNGSISPLKYPSSSTLINGCKATATLQEKISSATNSVSSVVSAATDTVEKVFSTTTAMPFSPLRSYVSAAPSAFQSLRTPSASALYTSLGSSISATTSSVTSSIITVPVYSVVNVLPEPALKKLPDSNSFTKSAAALLSPIKTLTTETHPQPHFSRTSSPVKSSLFLAPSALKLSTPSSLSSSQEILKDVAEMKEDLMRMTAILQTDVPEEKPFQPELPKEGRIDDEEPFKIVEKVKEDLVKVSEILKKDVCVDNKGSPKSPKSDKGHSPEDDWIEFSSEEIREARQQAAASQSPSLPERVQVKAKAASEKDYNLTKVIDYLTNDIGSSSLTNLKYKFEDAKKDGEGGQKRVLKPAIALQEHKLKMPPASMRTSTSEKELCKMADSFFGTDTILESPDDFSQHDQDKSPLSDSGFETRSEKTPSAPQSAETTGPKPLFHEVPIPPVITETRTEVVHVIRSYDPSAGDVPQTQPEEPVSPKPSPTFMELEPKPTTSSIKEKVKAFQMKASSEEDDHNRVLSKGMRVKEETHITTTTRMVYHSPPGGEGASERIEETMSVHDIMKAFQSGRDPSKELAGLFEHKSAVSPDVHKSAAETSAQHAEKDNQMKPKLERIIEVHIEKGNQAEPTEVIIRETKKHPEKEMYVYQKDLSRGDINLKDFLPEKHDAFPCSEEQGQQEEEELTAEESLPSYLESSRVNTPVSQEEDSRPSSAQLISDDSYKTLKLLSQHSIEYHDDELSELRGESYRFAEKMLLSEKLDVSHSDTEESVTDHAGPPSSELQGSDKRSREKIATAPKKEILSKIYKDVSENGVGKVSKDEHFDKVTVLHYSGNVSSPKHAMWMRFTEDRLDRGREKLIYEDRVDRTVKEAEEKLTEVSQFFRDKTEKLNDELQSPEKKARPKNGKEYSSQSPTSSSPEKVLLTELLASNDEWVKARQHGPDGQGFPKAEEKAPSLPSSPEKMVLSQQTEDSKSTVEAKGSISQSKAPDGPQSGFQLKQSKLSSIRLKFEQGTHAKSKDMSQEDRKSDGQSRIPVKKIQESKLPVYQVFAREKQQKAIDLPDESVSVQKDFMVLKTKDEHAQSNEIVVNDSGSDNVKKQRTEMSSKAMPDSFSEQQAKDLACHITSDLATRGPWDKKVFRTWESSGATNNKSQKEKLSHVLVHDVRENHIGHPESKSVDQKNEFMSVTERERKLLTNGSLSEIKEMTVKSPSKKVLYREYVVKEGDHPGGLLDQPSRRSESSAVSHIPVRVADERRMLSSNIPDGFCEQSAFPKHELSQKLSQSSMSKETVETQHFNSIEDEKVTYSEISKVSKHQSYVGLCPPLEETETSPTKSPDSLEFSPGKESPSSDVFDHSPIDGLEKLAPLAQTEGGKEIKTLPVYVSFVQVGKQYEKEIQQGGVKKIISQECKTVQETRGTFYTTRQQKQPPSPQGSPEDDTLEQVSFLDSSGKSPLTPETPSSEEVSYEFTSKTPDSLIAYIPGKPSPIPEVSEESEEEEQAKSTSLKQTTVEETAVEREMPNDVSKDSNQRPKNNRVAYIEFPPPPPLDADQIESDKKHHYLPEKEVDMIEVNLQDEHDKYQLAEPVIRVQPPSPVPPGADVSDSSDDESIYQPVPVKKYTFKLKEVDDEQKEKPKASAEKASNQKELESNGSGKDNEFGLGLDSPQNEIAQNGNNDQSITECSIATTAEFSHDTDATEIDSLDGYDLQDEDDGLTESDSKLPIQAMEIKKDIWNTEGILKPADRSFSQSKLEVIEEEGKVGPDEDKPPSKSSSSEKTPDKTDQKSGAQFFTLEGRHPDRSVFPDTYFSYKVDEEFATPFKTVATKGLDFDPWSNNRGDDEVFDSKSREDETKPFGLAVEDRSPATTPDTTPARTPTDESTPTSEPNPFPFHEGKMFEMTRSGAIDMSKRDFVEERLQFFQIGEHTSEGKSGDQGEGDKSMVTATPQPQSGDTTVETNLERNVETPTVEPNPSIPTSGECQEGTSSSGSLEKSAAATNTSKVDPKLRTPIKMGISASTMTMKKEGPGEITDKIEAVMTSCQGLENETITMISNTANSQMGVRPHEKHDFQKDNFNNNNNLDSSTIQTDNIMSNIVLTEHSAPTCTTEKDNPVKVSSGKKTGVLQGHCVRDKQKVLGEQQKTKELIGIRQKSKLPIKATSPKDTFPPNHMSNTKASKMKQVSQSEKTKALTTSSCVDVKSRIPVKNTPRDNIIAVRKACATQKQGQPEKGKAKQLPSKLPVKVRSTCVTTTTTTATTTTTTTTTTTTSCTVKVRKSQLKEVCKHSIEYFKGISGETLKLVDRLSEEEKKMQSELSDEEESTSRNTSLSETSRGGQPSVTTKSARDKKTEAAPLKSKSEKAGSEKRSSRRTGPQSPCERTDIRMAIVADHLGLSWTELARELNFSVDEINQIRVENPNSLISQSFMLLKKWVTRDGKNATTDALTSVLTKINRIDIVTLLEGPIFDYGNISGTRSFADENNVFHDPVDGNYFTPAILLKSSVTSFVTQLNDISQDSDHYSSCSIAPRNSLMHLSIMLQSPLNCWLSQHLLFSLSLSVFPLLFPFTLSVS

SEQ ID NO: 904099 - protein, 586 aa, Homo sapiens
MSEEPKEKNAKPAHRKRKGKKSDANASYLRAARAGHLEKALDYIKNGVDINICNQNGLNALHLASKEGHVEVVSELLQREANVDAATKKGNTALHIASLAGQAEVVKVLVTNGANVNAQSQNGFTPLYMAAQENHLEVVKFLLDNGASQSLATEDGFTPLAVALQQGHDQVVSLLLENDTKGKVRLPALHIAARKDDTKAAALLLQNDNNADVESKSGFTPLHIAAHYGNINVATLLLNRAAAVDFTARNDITPLHVASKRGNANMVKLLLDRGAKIDAKTRDGLTPLHCGARSGHEQVVEMLLDRAAPILSKTKNGLSPLHMATQGDHLNCVQLLLQHNVPVDDVTNDYLTALHVAAHCGHYKVAKVLLDKKANPNAKALNGFTPLHIACKKNRIKVMELLLKHGASIQAVTESGLTPIHVAAFMGHVNIVSQLMHHGASPNTTNVRGETALHMAARSGQAEVVRYLVQDGAQVEAKAKDDQTPLHISARLGKADIVQQLLQQGASPNAATTSGYTPLHLSAREGHEDVAAFLLDHGASLSITTKKGFTPLHVAAKYGKLEVANLLLQKSASPDAAGKVRGHQPL

SEQ ID NO: 904100 - protein, 586 aa, Homo sapiens; identical to SEQ ID NO: 904099

SEQ ID NO: 904101 - protein, 1094 aa, Homo sapiens
MNLRCVLLDKKANPNAKALNGFTPLHIACKKNRIKVMELLLKHGASIQAVTESGLTPIHVAAFMGHVNIVSQLMHHGASPNTTNVRGETALHMAARSGQAEVVRYLVQDGAQVEAKAKDDQTPLHISARLGKADIVQQLLQQGASPNAATTSGYTPLHLSAREGHEDVAAFLLDHGASLSITTKKGFTPLHVAAKYGKLEVANLLLQKSASPDAAGKSGLTPLHVAAHYDNQKVALLLLDQGASPHAAAKNGYTPLHIAAKKNQMDIATTLLEYGADANAVTRQGIASVHLAAQEGHVDMVSLLLGRNANVNLSNKSGLTPLHLAAQEDRVNVAEVLVNQGAHVDAQTKMGYTPLHVGCHYGNIKIVNFLLQHSAKVNAKTKNGYTPLHQAAQQGHTHIINVLLQNNASPNELTVNGNTALGIARRLGYISVVDTLKIVTEETMTTTTVTEKHKMNVPETMNEVLDMSDDEGEDAMTGDTDKYLGPQDLKELGDDSLPAEGYMGFSLGARSASLRSFSSDRSYTLNRSSYARDSMMIEELLVPSKEQHLTFTREFDSDSLRHYSWAADTLDNVNLVSSPIHSGFLVSFMVDARGGSMRGSRHHGMRIIIPPRKCTAPTRITCRLVKRHKLANPPPMVEGEGLASRLVEMGPAGAQFLGPVIVEIPHFGSMRGKERELIVLRSENGETWKEHQFDSKNEDLTELLNGMDEELDSPEELGKKRICRIITKDFPQYFAVVSRIKQESNQIGPEGGILSSTTVPLVQASFPEGALTKRIRVGLQAQPVPDEIVKKILGNKATFSPIVTVEPRRRKFHKPITMTIPVPPPSGEGVSNGYKGDTTPNLRLLCSITGGTSPAQWEDITGTTPLTFIKDCVSFTTNVSARFWLADCHQVLETVGLATQLYRELICVPYMAKFVVFAKMNDPVESSLRCFCMTDDKVDKTLEQQENFEEVARSKDIEVLEGKPIYVDCYGNLAPLTKGGQQLVFNFYSFKENRLPFSIKIRDTSQEPCGRLSFLKEPKTTKGLPQTAVCNLNITLPAHKKIEKTDRRQSFASLALRKRYSYLTEPGMSEFPDTSTNPGQCFRRRDIFSMRSKL

SEQ ID NO: 904102 - protein, 1945 aa, Homo sapiens; identical to SEQ ID NO: 904095

SEQ ID NO: 904103 - protein, 1224 aa, Homo sapiens
MDIATTLLEYGADANAVTRQGIASVHLAAQEGHVDMVSLLLGRNANVNLSNKSGLTPLHLAAQEDRVNVAEVLVNQGAHVDAQTKMGYTPLHVGCHYGNIKIVNFLLQHSAKVNAKTKNGYTPLHQAAQQGHTHIINVLLQNNASPNELTVNGNTALGIARRLGYISVVDTLKIVTEETMTTTTVTEKHKMNVPETMNEVLDMSDDEVRKANAPEMLSDGEYISDVEEGEDAMTGDTDKYLGPQDLKELGDDSLPAEGYMGFSLGARSASLRSFSSDRSYTLNRSSYARDSMMIEELLVPSKEQHLTFTREFDSDSLRHYSWAADTLDNVNLVSSPIHSGFLVSFMVDARGGSMRGSRHHGMRIIIPPRKCTAPTRITCRLVKRHKLANPPPMVEGEGLASRLVEMGPAGAQFLGPVIVEIPHFGSMRGKERELIVLRSENGETWKEHQFDSKNEDLTELLNGMDEELDSPEELGKKRICRIITKDFPQYFAVVSRIKQESNQIGPEGGILSSTTVPLVQASFPEGALTKRIRVGLQAQPVPDEIVKKILGNKATFSPIVTVEPRRRKFHKPITMTIPVPPPSGEGVSNGYKGDTTPNLRLLCSITGGTSPAQWEDITGTTPLTFIKDCVSFTTNVSARFWLADCHQVLETVGLATQLYRELICVPYMAKFVVFAKMNDPVESSLRCFCMTDDKVDKTLEQQENFEEVARSKDIEVLEGKPIYVDCYGNLAPLTKGGQQLVFNFYSFKENRLPFSIKIRDTSQEPCGRLSFLKEPKTTKGLPQTAVCNLNITLPAHKKIEKTDRRQSFASLALRKRYSYLTEPGMSPQSPCERTDIRMAIVADHLGLSWTELARELNFSVDEINQIRVENPNSLISQSFMLLKKWVTRDGKNATTDALTSVLTKINRIDIVTLLEGPIFDYGNISGTRSFADENNVFHDPVDGYPSLQVELETPTGLHYTPPTPFQQDDYFSDISSIESPLRTPSRLSDGLVPSQGNIEHSADGPPVVTAEDASLEDSKLEDSVPLTEMPEAVDVDESQLENVCLSWQNETSSGNLESCAQARRVTGGLLDRLDDSPDQCRDSITSYLKGEAGKFEANGSHTEITPEAKTKSYFPESQNDVGKQSTKETLKPKIHGSGHVEEPASPLAAYQKSLEETSKLIIEETKPCVPVSMKKMSRTSPADGKPRLSLHEEEGSSGSEQKQGEGFKVKTKKEIRHVEKKSHS

SEQ ID NO: 904104 - protein, 2034 aa, Homo sapiens
MSEEPKEKNAKPAHRKRKGKKSDANASYLRAARAGHLEKALDYIKNGVDINICNQNGLNALHLASKEGHVEVVSELLQREANVDAATKKGNTALHIASLAGQAEVVKVLVTNGANVNAQSQNGFTPLYMAAQENHLEVVKFLLDNGASQSLATEDGFTPLAVALQQGHDQVVSLLLENDTKGKVRLPALHIAARKDDTKAAALLLQNDNNADVESKSGFTPLHIAAHYGNINVATLLLNRAAAVDFTARNDITPLHVASKRGNANMVKLLLDRGAKIDAKTRDGLTPLHCGARSGHEQVVEMLLDRAAPILSKTKNGLSPLHMATQGDHLNCVQLLLQHNVPVDDVTNDYLTALHVAAHCGHYKVAKVLLDKKANPNAKALNGFTPLHIACKKNRIKVMELLLKHGASIQAVTESGLTPIHVAAFMGHVNIVSQLMHHGASPNTTNVRGETALHMAARSGQAEVVRYLVQDGAQVEAKAKDDQTPLHISARLGKADIVQQLLQQGASPNAATTSGYTPLHLSAREGHEDVAAFLLDHGASLSITTKKGFTPLHVAAKYGKLEVANLLLQKSASPDAAGKVKRSPATLKQATSTITKYTLANIHYIATQIITKYLSPTRMKSTWEIKGKCWGPSTVENRNVNMPYVVSNLISFPQSKPLVLRTFDTGCCFCTCFQSGLTPLHVAAHYDNQKVALLLLDQGASPHAAAKNGYTPLHIAAKKNQMDIATTLLEYGADANAVTRQGIASVHLAAQEGHVDMVSLLLGRNANVNLSNKSGLTPLHLAAQEDRVNVAEVLVNQGAHVDAQTKMGYTPLHVGCHYGNIKIVNFLLQHSAKVNAKTKNGYTPLHQAAQQGHTHIINVLLQNNASPNELTVNGNTALGIARRLGYISVVDTLKIVTEETMTTTTVTEKHKMNVPETMNEVLDMSDDEVRKANAPEMLSDGEYISDVEEGEDAMTGDTDKYLGPQDLKELGDDSLPAEGYMGFSLGARSASLRSFSSDRSYTLNRSSYARDSMMIEELLVPSKEQHLTFTREFDSDSLRHYSWAADTLDNVNLVSSPIHSGFLVSFMVDARGGSMRGSRHHGMRIIIPPRKCTAPTRITCRLVKRHKLANPPPMVEGEGLASRLVEMGPAGAQFLGPVIVEIPHFGSMRGKERELIVLRSENGETWKEHQFDSKNEDLTELLNGMDEELDSPEELGKKRICRIITKDFPQYFAVVSRIKQESNQIGPEGGILSSTTVPLVQASFPEGALTKRIRVGLQAQPVPDEIVKKILGNKATFSPIVTVEPRRRKFHKPITMTIPVPPPSGEGVSNGYKGDTTPNLRLLCSITGGTSPAQWEDITGTTPLTFIKDCVSFTTNVSARFWLADCHQVLETVGLATQLYRELICVPYMAKFVVFAKMNDPVESSLRCFCMTDDKVDKTLEQQENFEEVARSKDIEVLEGKPIYVDCYGNLAPLTKGGQQLVFNFYSFKENRLPFSIKIRDTSQEPCGRLSFLKEPKTTKGLPQTAVCNLNITLPAHKKIEKTDRRQSFASLALRKRYSYLTEPGMSPQSPCERTDIRMAIVADHLGLSWTELARELNFSVDEINQIRVENPNSLISQSFMLLKKWVTRDGKNATTDALTSVLTKINRIDIVTLLEGPIFDYGNISGTRSFADENNVFHDPVDGYPSLQVELETPTGLHYTPPTPFQQDDYFSDISSIESPLRTPSRLSDGLVPSQGNIEHSADGPPVVTAEDASLEDSKLEDSVPLTEMPEAVDVDESQLENVCLSEYPQYLGNLAGSPKDVKPAEPRKLGVSSEQQEKGKSGPDEEMMEEKLKSLFEDIQLEEGVESEEMTEEKVQAILKRVQQAELEMSSITGWQNETSSGNLESCAQARRVTGGLLDRLDDSPDQCRDSITSYLKGEAGKFEANGSHTEITPEAKTKSYFPESQNDVGKQSTKETLKPKIHGSGHVEEPASPLAAYQKSLEETSKLIIEETKPCVPVSMKKMSRTSPADGKPRLSLHEEEGSSGSEQKQGEGFKVKTKKEIRHVEKKSHS

SEQ ID NO: 904105 - protein, 2025 aa, Homo sapiens
MSEEPKEKNAKPAHRKRKGKKSDANASYLRAARAGHLEKALDYIKNGVDINICNQNGLNALHLASKEGHVEVVSELLQREANVDAATKKGNTALHIASLAGQAEVVKVLVTNGANVNAQSQNGFTPLYMAAQENHLEVVKFLLDNGASQSLATEDGFTPLAVALQQGHDQVVSLLLENDTKGKVRLPALHIAARKDDTKAAALLLQNDNNADVESKSGFTPLHIAAHYGNINVATLLLNRAAAVDFTARNDITPLHVASKRGNANMVKLLLDRGAKIDAKTRDGLTPLHCGARSGHEQVVEMLLDRAAPILSKTKNGLSPLHMATQGDHLNCVQLLLQHNVPVDDVTNDYLTALHVAAHCGHYKVAKVLLDKKANPNAKALNGFTPLHIACKKNRIKVMELLLKHGASIQAVTESGLTPIHVAAFMGHVNIVSQLMHHGASPNTTNVRGETALHMAARSGQAEVVRYLVQDGAQVEAKAKDDQTPLHISARLGKADIVQQLLQQGASPNAATTSGYTPLHLSAREGHEDVAAFLLDHGASLSITTKKGFTPLHVAAKYGKLEVANLLLQKSASPDAAGKVKRSPATLKQATSTITKYTLANIHYIATQIITKYLSPTRMKSTWEIKGKCWGPSTVENRNVNMPYVVSNLISFPQSKPLVLRTFDTGCCFCTCFQSGLTPLHVAAHYDNQKVALLLLDQGASPHAAAKNGYTPLHIAAKKNQMDIATTLLEYGADANAVTRQGIASVHLAAQEGHVDMVSLLLGRNANVNLSNKSGLTPLHLAAQEDRVNVAEVLVNQGAHVDAQTKMGYTPLHVGCHYGNIKIVNFLLQHSAKVNAKTKNGYTPLHQAAQQGHTHIINVLLQNNASPNELTVNGNTALGIARRLGYISVVDTLKIVTEETMTTTTVTEKHKMNVPETMNEVLDMSDDEVRKANAPEMLSDGEYISDVEEGEDAMTGDTDKYLGPQDLKELGDDSLPAEGYMGFSLGARSASLRSFSSDRSYTLNRSSYARDSMMIEELLVPSKEQHLTFTREFDSDSLRHYSWAADTLDNVNLVSSPIHSGFLVSFMVDARGGSMRGSRHHGMRIIIPPRKCTAPTRITCRLVKRHKLANPPPMVEGEGLASRLVEMGPAGAQFLGPVIVEIPHFGSMRGKERELIVLRSENGETWKEHQFDSKNEDLTELLNGMDEELDSPEELGKKRICRIITKDFPQYFAVVSRIKQESNQIGPEGGILSSTTVPLVQASFPEGALTKRIRVGLQAQPVPDEIVKKILGNKATFSPIVTVEPRRRKFHKPITMTIPVPPPSGEGVSNGYKGDTTPNLRLLCSITGGTSPAQWEDITGTTPLTFIKDCVSFTTNVSARFWLADCHQVLETVGLATQLYRELICVPYMAKFVVFAKMNDPVESSLRCFCMTDDKVDKTLEQQENFEEVARSKDIEVLEGKPIYVDCYGNLAPLTKGGQQLVFNFYSFKENRLPFSIKIRDTSQEPCGRLSFLKEPKTTKGLPQTAVCNLNITLPAHKKIEKTDRRQSFASLALRKRYSYLTEPGMSPQSPCERTDIRMAIVADHLGLSWTELARELNFSVDEINQIRVENPNSLISQSFMLLKKWVTRDGKNATTDALTSVLTKINRIDIVTLLEGPIFDYGNISGTRSFADENNVFHDPVDGYPSLQVELETPTGLHYTPPTPFQQDDYFSDISSIESPLRTPSRLSDGLVPSQGNIEHSADGPPVVTAEDASLEDSKLEDSVPLTEMPEAVDVDESQLENVCLSEYPQYLGNLAGSPKDVKPAEPRKLGVSSEQQEKGKSGPDEEMMEEKLKSLFEDIQLEEGVESEEMTEEKVQAILKRVQQAELEMSSITGWQNETSSGNLESCAQARRVTGGLLDRLDDSSYLKGEAGKFEANGSHTEITPEAKTKSYFPESQNDVGKQSTKETLKPKIHGSGHVEEPASPLAAYQKSLEETSKLIIEETKPCVPVSMKKMSRTSPADGKPRLSLHEEEGSSGSEQKQGEGFKVKTKKEIRHVEKKSHS

SEQ ID NO: 904106 - protein, 543 aa, Homo sapiens
EAVIAQADDERGDVRRAPRRSAAAARADEMRRRGIGRVADDRRDYGRRRRAMTCVKGAEARDDRREHRGYGTQEVMAEWCGGYRGAAGRWAWAAIGVATDIVRRMGHGGRPEMRGVWAVETGGEREIRGERKAAVMARTEAADNKRRGGTGGEETGVGVLGGAERANGRYAGVILGVGKDGGGTQGGGDAPPTPFQQDDYFSDISSIESPLRTPSRLSDGLVPSQGNIEHSADGPPVVTAEDASLEDSKLEDSVPLTEMPEAVDVDESQLENVCLSEYPQYLGNLAGSPKDVKPAEPRKLGVSSEQQEKGKSGPDEEMMEEKLKSLFEDIQLEEGVESEEMTEEKVQAILKRVQQAELEMSSITGWQNETSSGNLESCAQARRVTGGLLDRLDDSPDQCRDSITSYLKGEAGKFEANGSHTEITPEAKTKSYFPESQNDVGKQSTKETLKPKIHGSGHVEEPASPLAAYQKSLEETSKLIIEETKPCVPVSMKKMSRTSPADGKPRLSLHEEEGSSGSEQKQGEGFKVKTKKEIRHVEKKSHS

SEQ ID NO: 904107 - protein, 1377 aa, Homo sapiens
MSEEPKEKNAKPAHRKRKGKKSDANASYLRAARAGHLEKALDYIKNGVDINICNQNGLNALHLASKEGHVEVVSELLQREANVDAATKKGNTALHIASLAGQAEVVKVLVTNGANVNAQSQNGFTPLYMAAQENHLEVVKFLLDNGASQSLATEDGFTPLAVALQQGHDQVVSLLLENDTKGKVRLPALHIAARKDDTKAAALLLQNDNNADVESKSGFTPLHIAAHYGNINVATLLLNRAAAVDFTARNDITPLHVASKRGNANMVKLLLDRGAKIDAKTRDGLTPLHCGARSGHEQVVEMLLDRAAPILSKTKNGLSPLHMATQGDHLNCVQLLLQHNVPVDDVTNDYLTALHVAAHCGHYKVAKVLLDKKANPNAKALNGFTPLHIACKKNRIKVMELLLKHGASIQAVTESGLTPIHVAAFMGHVNIVSQLMHHGASPNTTNVRGETALHMAARSGQAEVVRYLVQDGAQVEAKAKDDQTPLHISARLGKADIVQQLLQQGASPNAATTSGYTPLHLSAREGHEDVAAFLLDHGASLSITTKKGFTPLHVAAKYGKLEVANLLLQKSASPDAAGKVKRSPATLKQATSTITKYTLANIHYIATQIITKYLSPTRMKSTWEIKGKCWGPSTVENRNVNMPYVVSNLISFPQSKPLVLRTFDTGCCFCTCFQSGLTPLHVAAHYDNQKVALLLLDQGASPHAAAKNGYTPLHIAAKKNQMDIATTLLEYGADANAVTRQGIASVHLAAQEGHVDMVSLLLGRNANVNLSNKSGLTPLHLAAQEDRVNVAEVLVNQGAHVDAQTKMGYTPLHVGCHYGNIKIVNFLLQHSAKVNAKTKNGYTPLHQAAQQGHTHIINVLLQNNASPNELTVNGNTALGIARRLGYISVVDTLKIVTEETMTTTTVTEKHKMNVPETMNEVLDMSDDEVRKANAPEMLSDGEYISDVEEGEDAMTGDTDKYLGPQDLKELGDDSLPAEGYMGFSLGARSASLRSFSSDRSYTLNRSSYARDSMMIEELLVPSKEQHLTFTREFDSDSLRHYSWAADTLDNVNLVSSPIHSGFLVSFMVDARGGSMRGSRHHGMRIIIPPRKCTAPTRITCRLVKRHKLANPPPMVEGEGLASRLVEMGPAGAQFLGPVIVEIPHFGSMRGKERELIVLRSENGETWKEHQFDSKNEDLTELLNGMDEELDSPEELGKKRICRIITKDFPQYFAVVSRIKQESNQIGPEGGILSSTTVPLVQASFPEGALTKRIRVGLQAQSGCVIAILGKRCSRPWRTWRGRTPSTRHICSWCTMVSGTSAAAPKGPRASPRPRNWERAWKSTVVNLVRKYMHWWLGGAKWGGPLRVPCLWIRLVAPIGFTAAKGGRGKAPDRLWVS

SEQ ID NO: 904108 - protein, 1363 aa, Homo sapiens
MSEEPKEKNAKPAHRKRKGKKSDANASYLRAARAGHLEKALDYIKNGVDINICNQNGLNALHLASKEGHVEVVSELLQREANVDAATKKGNTALHIASLAGQAEVVKVLVTNGANVNAQSQNGFTPLYMAAQENHLEVVKFLLDNGASQSLATEDGFTPLAVALQQGHDQVVSLLLENDTKGKVRLPALHIAARKDDTKAAALLLQNDNNADVESKSGFTPLHIAAHYGNINVATLLLNRAAAVDFTARNDITPLHVASKRGNANMVKLLLDRGAKIDAKTRDGLTPLHCGARSGHEQVVEMLLDRAAPILSKTKNGLSPLHMATQGDHLNCVQLLLQHNVPVDDVTNDYLTALHVAAHCGHYKVAKVLLDKKANPNAKALNGFTPLHIACKKNRIKVMELLLKHGASIQAVTESGLTPIHVAAFMGHVNIVSQLMHHGASPNTTNVRGETALHMAARSGQAEVVRYLVQDGAQVEAKAKDDQTPLHISARLGKADIVQQLLQQGASPNAATTSGYTPLHLSAREGHEDVAAFLLDHGASLSITTKKGFTPLHVAAKYGKLEVANLLLQKSASPDAAGKVKRSPATLKQATSTITKYTLANIHYIATQIITKYLSPTRMKSTWEIKGKCWGPSTVENRNVNMPYVVSNLISFPQSKPLVLRTFDTGCCFCTCFQSGLTPLHVAAHYDNQKVALLLLDQGASPHAAAKNGYTPLHIAAKKNQMDIATTLLEYGADANAVTRQGIASVHLAAQEGHVDMVSLLLGRNANVNLSNKSGLTPLHLAAQEDRVNVAEVLVNQGAHVDAQTKMGYTPLHVGCHYGNIKIVNFLLQHSAKVNAKTKNGYTPLHQAAQQGHTHIINVLLQNNASPNELTVNGNTALGIARRLGYISVVDTLKIVTEETMTTTTVTEKHKMNVPETMNEVLDMSDDEVRKANAPEMLSDGEYISDVEEGEDAMTGDTDKYLGPQDLKELGDDSLPAEGYMGFSLGARSASLRSFSSDRSYTLNRSSYARDSMMIEELLVPSKEQHLTFTREFDSDSLRHYSWAADTLDNVNLVSSPIHSGFLVSFMVDARGGSMRGSRHHGMRIIIPPRKCTAPTRITCRLVKRHKLANPPPMVEGEGLASRLVEMGPAGAQFLGPVIVEIPHFGSMRGKERELIVLRSENGETWKEHQFDSKNEDLTELLNGMDEELDSPEELGKKRICRIITKDFPQYFAVVSRIKQESNQIGPEGGILSSTTVPLVQASFPEGALTKRIRVGLQAQPVPDEIVKKILGNKATFSPIVTVEPRRRKFHKPITMTIPVPPPSGEGVSNGYKGDTTPNLRLLCSITGLVKSLLYFLLIHKDCVQRYICVQRYKTFEISMPTL

SEQ ID NO: 904109 - protein, 835 aa, Homo sapiens
MGDPGSEVSSRVRVLAFSEANREGLCFLRSEAWCSVAASGRYLFSVLGRAQLWGLIIESVPPAGPEASESTTDENEDDIQFVSEGPSRPVLEYIDLVCGDDENPSAYYSDILFPKMPKRQGDFLHFLNVKKVKTDTENNEVSKNHCRLSKAKEPHFEYIEQPIIEEKPSLSSKKEIDNLVLPDCWNEKQAFMFTEQYKWLEIKEGKLGCKDCSAVRHLGSKAEKHVHVSKEWIAYLVTPNGSNKTTRQASLRKKIREHDVSKAHGKIQDLLKESTNDSICNLVHKQNNKNIDATVKVFNTVYSLVKHNRPLSDIEGARELQEKNGEVNCLNTRYSATRIAEHIAKEMKMKIFKNIIEENAKICIIIDEASTVSKKTTLVIYLQCTIQSAPAPVMLFVALKELVSTIAECIVNTLLTTLNDCGFTNEYLKANLIAFCSDGANTILGRKSGVATKLLENFPEIIIWNCLNHRLQLSLDDSISEIKQINHLKIFIDKIYSIYHQPNKNQTKLLGTVAKELETEIIKIGRVMGPRWAACSLQAATAVWHAYPILYMHFSHSYSGLAKRLANINFLQDLALMIDILEEFSVLSTALQSRSTNIKKAQKLIKRTIRALENLKIGTGKYESQIEDLIKSDKFKDIPFNKNNKFNALPRSILLDNIIQHMNLRLLSDRNHEDIFNYFDLLEPSTWPYEEITSPWIAGEKTLFHLCKILKYEVDLNDFREFVNNNIKSNNVSIPTTIYKAKKIVSTIAINSAEAERGFNLMNIICTRVRNSLTIDHVSDLMTINLLGKELADWDATPFVKSWSNCNHRLATDTRVRQKSTKVFHENQLAIWNLK

SEQ ID NO: 904110 - protein, 281 aa, Homo sapiens
MGDPGSEIIESVPPAGPEASESTTDENEDDIQFVSEGPSRPVLEYIDLVCGDDENPSAYYSDILFPKMPKRQGDFLHFLNVKKVKTDTENNEVSKNHCRLSKAKEPHFEYIEQPIIEEKPSLSSKKEIDNLVLPDCWNEKQAFMFTEQYKWLEIKEGKLGCKDCSAVRHLGSKAEKHVHVSKEWIAYLVTPNGSNKTTRQASLRKKIREHDVSKAHGKIQDLLKESTNDSICNLVHKQNNKNIDATVKVFNTVYSLVKHNRPLSDIEGARELQEKNGEVNV

SEQ ID NO: 904111 - protein, 720 aa, Homo sapiens
MPKRQGDFLHFLNVKKVKTDTENNEVSKNHCRLSKAKEPHFEYIEQPIIEEKPSLSSKKEIDNLVLPDCWNEKQAFMFTEQYKWLEIKEGKLGCKDCSAVRHLGSKAEKHVHVSKEWIAYLVTPNGSNKTTRQASLRKKIREHDVSKAHGKIQDLLKESTNDSICNLVHKQNNKNIDATVKVFNTVYSLVKHNRPLSDIEGARELQEKNGEVNCLNTRYSATRIAEHIAKEMKMKIFKNIIEENAKICIIIDEASTVSKKTTLVIYLQCTIQSAPAPVMLFVALKELVSTIAECIVNTLLTTLNDCGFTNEYLKANLIAFCSDGANTILGRKSGVATKLLENFPEIIIWNCLNHRLQLSLDDSISEIKQINHLKIFIDKIYSIYHQPNKNQTKLLGTVAKELETEIIKIGRVMGPRWAACSLQAATAVWHAYPILYMHFSHSYSGLAKRLANINFLQDLALMIDILEEFSVLSTALQSRSTNIKKAQKLIKRTIRALENLKIGTGKYESQIEDLIKSDKFKDIPFNKNNKFNALPRSILLDNIIQHMNLRLLSDRNHEDIFNYFDLLEPSTWPYEEITSPWIAGEKTLFHLCKILKYEVDLNDFREFVNNNIKSNNVSIPTTIYKAKKIVSTIAINSAEAERGFNLMNIICTRVRNSLTIDHVSDLMTINLLGKELADWDATPFVKSWSNCNHRLATDTRVRQKSTKVFHENQLAIWNLK

SEQ ID NO: 904112 - protein, 603 aa, Homo sapiens
MSCGNEFVETLKKIGYPKADNLNGEDFDWLFEGVEDESFLKWFCGNVNEQNVLSERELEAFSILQKSGKPILEGAALDEALKTCKTSDLKTPRLDDKELEKLEDEVQTLLKLKNLKIQRRNKCQLMASVTSHKSLRLNAKEEEATKKLKQSQGILNAMITKISNELQALTDEVTQLMMFFRHSNLGQGTNPLVFLSQFSLEKYLSQEEQSTAALTLYTKKQFFQGIHEVVESSNEDNFQLLDIQTPSICDNQEILEERRLEMARLQLAYICAQHQLIHLKASNSSMKSSIKWAEESLHSLTSKAVDKENLDAKISSLTSEIMKLEKEVTQIKDRSLPAVVRENAQLLNMPVVKGDFDLQIAKQDYYTARQELVLNQLIKQKASFELLQLSYEIELRKHRDIYRQLENLVQELSQSNMMLYKQLEMLTDPSVSQQINPRNTIDTKDYSTHRLYQVLEGENKKKELFLTHGNLEEVAEKLKQNISLVQDQLAVSAQEHSFFLSKRNKDVDMLCDTLYQGGNQLLLSDQELTEQFHKVESQLNKLNHLLTDILADVKTKRKTLANNKLHQMEREFYVYFLKDEDYLKDIVENLETQSKIKAVSLED

SEQ ID NO: 904113 - protein, 163 aa, Homo sapiens
RQCEARGARRAVAAGSCEKQAELPEVTDAGLGSGRRGVGLEEWPRSPSAPRCLFFFLRSWGLLPGAPAAARGSGPGPLGEELGRGLCGACHPRLLQLGVDGDSVGLCVCFVSVLRCHSWVTLRRKVLPLARLVYRGLGAADPWGLPLPLGFARPWRRGCLSAG

SEQ ID NO: 904114 - protein, 585 aa, Homo sapiens
MSCGNEFVETLKKIGYPKADNLNGEDFDWLFEGVEDESFLKWFCGNVNEQNVLSERELEAFSILQKSGKPILEGAALDEALKTCKTSDLKTPRLDDKELEKLEDEVQTLLKLKNLKIQRRNKCQLMASVTSHKSLRLNAKEEEATKKLKQSQGILNAMITKISNELQALTDEVTQLMMFFRHSNLGQGTNPLVFLSQFSLEKYLSQEEQSTAALTLYTKKQFFQGIHEVVESSNEDNFQLLDIQTPSICDNQEILEERRLEMARLQLAYICAQHQLIHLKASNSSMKSSIKWAEESLHSLTSKAVDKENLDAKISSLTSEIMKLEKEVTQIKDRSLPAVVRENAQLLNMPVVKGDFDLQIAKQDYYTARQELVLNQLIKQKASFELLQLSYEIELRKHRDIYRQLENLVQELSQSNMMLYKQLEMLTDPSVSQQINPRNTIDTKDYSTHRLYQVLEGENKKKNISLVQDQLAVSAQEHSFFLSKRNKDVDMLCDTLYQGGNQLLLSDQELTEQFHKVESQLNKLNHLLTDILADVKTKRKTLANNKLHQMEREFYVYFLKDEDYLKDIVENLETQSKIKAVSLED

SEQ ID NO: 904115 - protein, 529 aa, Homo sapiens
MKLLPKILAHSIEHNQHIEESRQLLSYALIHPATSLEDRSALAMWLNHLEDRTSTSFGGQNRGRSDSVDYGQTHYYHQRQNSDDKLNGWQNSRDSGICINASNWQDKSMGCENGHVPLYSSSSVPTTINTIGTSTSTNVPAWLKSLRLHKYAALFSQMTYEEMMALTECQLEAQNVTKGARHKIVISIQKLKERQNLLKSLERDIIEGGSLRIPLQELHQMILTPIKAYSSPSTTPEARRREPQAPRQPSLMGPESQSPDCKDGAAATGATATPSAGASGGLQPHQLSSCDGELAVAPLPEGDLPGQFTRVMGKVCTQLLVSRPDEENISSYLQLIDKCLIHEAFTETQKKRLLSWKQQVQKLFRSFPRKTLLDISGYRQQRNRGFGQSNSLPTAGSVGGGMGRRNPRQYQIPSRNVPSARLGLLGTSGFVSSNQRNTTATPTIMKQGRQNLWFANPGGSNSMPSRTHSSVQRTRSLPVHTSPQNMLMFQQPEFQLPVTEPDINNRLESLCLSMTEHALGDGVDRTSTI

SEQ ID NO: 904116 - protein, 651 aa, Homo sapiens
MKLLPKILAHSIEHNQHIEESRQLLSYALIHPATSLEDRSALAMWLNHLEDRTSTSFGGQNRGRSDSVDYGQTHYYHQRQNSDDKLNGWQNSRDSGICINASNWQDKSMGCENGHVPLYSSSSVPTTINTIGTSTSTILSGQAHHSPLKRSVSLTPPMNVPNQPLGHGWMSHEDLRARGPQCLPSDHAPLSPQSSVASSGSGGSEHLEDQTTARNTFQEEGSGMKDVPAWLKSLRLHKYAALFSQMTYEEMMALTECQLEAQNVTKGARHKIVISIQKLKERQNLLKSLERDIIEGGSLRIPLQELHQMILTPIKAYSSPSTTPEARRREPQAPRQPSLMGPESQSPDCKDGAAATGATATPSAGASGGLQPHQLSSCDGELAVAPLPEGDLPGQFTRVMGKVCTQLLVSRPDEENISSYLQLIDKCLIHEAFTETQKKRLLSWKQQVQKLFRSFPRKTLLDISGYRQQRNRGFGQSNSLPTAGSVGGGMGRRNPRQYQIPSRNVPSARLGLLGTSGFVSSNQRNTTATPTIMKQGRQNLWFANPGGSNSMPSRTHSSVQRTRSLPVHTSPQNMLMFQQPGSQVHSGLCLTDLRGWLSLSGAPSMPALTVPKSSQGGTPDLSPEGGTRWHPAYLLLVTNITLYRLQNSSFP

SEQ ID NO: 904117 - protein, 653 aa, Homo sapiens
MKLLPKILAHSIEHNQHIEESRQLLSYALIHPATSLEDRSALAMWLNHLEDRTSTSFGGQNRGRSDSVDYGQTHYYHQRQNSDDKLNGWQNSRDSGICINASNWQDKSMGCENGHVPLYSSSSVPTTINTIGTSTSTILSGQAHHSPLKRSVSLTPPMNVPNQPLGHGWMSHEDLRARGPQCLPSDHAPLSPQSSVASSGSGGSEHLEDQTTARNTFQEEGSGMKDVPAWLKSLRLHKYAALFSQMTYEEMMALTECQLEAQNVTKGARHKIVISIQKLKERQNLLKSLERDIIEGGSLRIPLQELHQMILTPIKAYSSPSTTPEARRREPQAPRQPSLMGPESQSPDCKDGAAATGATATPSAGASGGLQPHQLSSCDGELAVAPLPEGDLPGQFTRVMGKVCTQLLVSRPDEENISSYLQLIDKCLIHEAFTETQKKRLLSWKQQVQKLFRSFPRKTLLDISGYRQQRNRGFGQSNSLPTAGSVGGGMGRRNPRQYQIPSRNVPSARLGLLGTSGFVSSNQRNTTATPTIMKQGRQNLWFANPGGSNSMPSRTHSSVQRTRSLPVHTSPQNMLMFQQPGSQVHSGLCLTDLRGWLSLSGAPSMPALTVPKSSQGEFQLPVTEPDINNRLESLCLSMTEHALGDGVDRTSTI

SEQ ID NO: 904118 - protein, 396 aa, Homo sapiens
QWWLSEFCVQSSFVQLLNPYQAAAWDSICPIHWRLTDIIEGGSLRIPLQELHQMILTPIKAYSSPSTTPEARRREPQAPRQPSLMGPESQSPDCKDGAAATGATATPSAGASGGLQPHQLSSCDGELAVAPLPEGDLPGQFTRVMGKVCTQLLVSRPDEENISSYLQLIDKCLIHEAFTETQKKRLLSWKQQVQKLFRSFPRKTLLDISGYRQQRNRGFGQSNSLPTAGSVGGGMGRRNPRQYQIPSRNVPSARLGLLGTSGFVSSNQRNTTATPTIMKQGRQNLWFANPGGSNSMPSRTHSSVQRTRSLPVHTSPQNMLMFQQPGSQVHSGLCLTDLRGWLSLSGAPSMPALTVPKSSQGGTPDLSPEGGTRWHPAYLLLVTNITLYRLQNSSFP

SEQ ID NO: 904119 - protein, 529 aa, Homo sapiens; identical to SEQ ID NO: 904115

SEQ ID NO: 904120 - protein, 372 aa, Homo sapiens
MTSPWVTEVLKMQIHVQKEMAFFELIIFNQVPLTFIPHIPFLNKLSCYLGNVLGWTITCKAGRIGQRLKAKGEDQRVCECGFVGYLRKLIKRRKNHGITHLAEKGKHSDLLQKTHISIKTHVIQKTDCEHNHIRMNPLKGRRPKVSANLNFYYSFTEYRNNGYLIIRDIILDMLLINLLWLVTMIKSVINNNIILFLKKKSLFFIDSDRFIYLVVFCYECFNFFFEVECLINFKTLSPPCFESCVDYRYIAQFKNPKAKEVLFIKESNSCMHEADEVRYLVIKAAVPFLYLPIDPHQMQLFYIKKIVTILKSQSKIYFTTCFSPLVLIEAVCTWHLYIVLGTVVFYNIIMYDVLLVLFIHSGFLPETVGRNT

SEQ ID NO: 904121 - protein, 529 aa, Homo sapiens; identical to SEQ ID NO: 904115

SEQ ID NO: 904122 - protein, 146 aa, Homo sapiens
MKLLPKILAHSIEHNQHIEESRQLLSYALIHPATSLEDRSALAMWLNHLEDRTSTSFGGQNRGRSDSVDYGQTHYYHQRQNSDDKLNGWQNSRDSGICINASNWQDKSMGCENGHVPLYSSSSVPTTINTIGTSTSTSKFPGIPLT

SEQ ID NO: 904123 - protein, 717 aa, Homo sapiens
MFRDQVGVLAGWFKGWNECEQTVALLSLLKRVSQTQARFLQLCLEHSLADCAELHVLEREANSPGIINQWQQESKDKVISLLLTHLPLLKPGNLDAKVEYMKLLPKILAHSIEHNQHIEESRQLLSYALIHPATSLEDRSALAMWLNHLEDRTSTSFGGQNRGRSDSVDYGQTHYYHQRQNSDDKLNGWQNSRDSGICINASNWQDKSMGCENGHVPLYSSSSVPTTINTIGTSTSTILSGQAHHSPLKRSVSLTPPMNVPNQPLGHGWMSHEDLRARGPQCLPSDHAPLSPQSSVASSGSGGSEHLEDQTTARNTFQEEGSGMKDVPAWLKSLRLHKYAALFSQMTYEEMMALTECQLEAQNVTKGARHKIVISIQKLKERQNLLKSLERDIIEGGSLRIPLQELHQMILTPIKAYSSPSTTPEARRREPQAPRQPSLMGPESQSPDCKDGAAATGATATPSAGASGGLQPHQLSSCDGELAVAPLPEGDLPGQFTRVMGKVCTQLLVSRPDEENISSYLQLIDKCLIHEAFTETQKKRLLSWKQQVQKLFRSFPRKTLLDISGYRQQRNRGFGQSNSLPTAGSVGGGMGRRNPRQYQIPSRNVPSARLGLLGTSGFVSSNQRNTTATPTIMKQGRQNLWFANPGGSNSMPSRTHSSVQRTRSLPVHTSPQNMLMFQQPEFQLPVTEPDINNRLESLCLSMTEHALGDGVDRTSTI

SEQ ID NO: 904124 - protein, 529 aa, Homo sapiens; identical to SEQ ID NO: 904115

SEQ ID NO: 904125 - protein, 378 aa, Homo sapiens
YARYEAWVWANLLKSLERDIIEGGSLRIPLQELHQMILTPIKAYSSPSTTPEARRREPQAPRQPSLMGPESQSPDCKDGAAATGATATPSAGASGGLQPHQLSSCDGELAVAPLPEGDLPGQFTRVMGKVCTQLLVSRPDEENISSYLQLIDKCLIHEAFTETQKKRLLSWKQQVQKLFRSFPRKTLLDISGYRQQRNRGFGQSNSLPTAGSVGGGMGRRNPRQYQIPSRNVPSARLGLLGTSGFVSSNQRNTTATPTIMKQGRQNLWFANPGGSNSMPSRTHSSVQRTRSLPVHTSPQNMLMFQQPGSQVHSGLCLTDLRGWLSLSGAPSMPALTVPKSSQGGTPDLSPEGGTRWHPAYLLLVTNITLYRLQNSSFP

SEQ ID NO: 904126 - protein, 162 aa, Homo sapiens
MGRRNPRQYQIPSRNVPSARLGLLGTSGFVSSNQRNTTATPTIMKQGRQNLWFANPGGSNSMPSRTHSSVQRTRSLPVHTSPQNMLMFQQPGSQVHSGLCLTDLRGWLSLSGAPSMPALTVPKSSQGGTPDLSPEGGTRWHPAYLLLVTNITLYRLQNSSFP

SEQ ID NO: 904127 - protein, 529 aa, Homo sapiens; identical to SEQ ID NO: 904115

SEQ ID NO: 904128 - protein, 114 aa, Homo sapiens
MFSRAGVAGLSAWTLQPQWIQVRNMATLKDITRRLKSIKNIQKITKSMKMVAAAKYARAERELKPARIYGLGSLALYEKADIKGPEDKKKHLLMWCVLRSRTVWCYSFLHVLNR

SEQ ID NO: 904129 - protein, 114 aa, Homo sapiens; identical to SEQ ID NO: 904128

SEQ ID NO: 904130 - protein, 114 aa, Homo sapiens; identical to SEQ ID NO: 904128

SEQ ID NO: 904131 - protein, 114 aa, Homo sapiens; identical to SEQ ID NO: 904128

SEQ ID NO: 904132 - protein, 114 aa, Homo sapiens; identical to SEQ ID NO: 904128

SEQ ID NO: 904133 - protein, 114 aa, Homo sapiens; identical to SEQ ID NO: 904128

SEQ ID NO: 904134 - protein, 114 aa, Homo sapiens; identical to SEQ ID NO: 904128

SEQ ID NO: 904135 - protein, 114 aa, Homo sapiens; identical to SEQ ID NO: 904128

SEQ ID NO: 904136 - protein, 114 aa, Homo sapiens; identical to SEQ ID NO: 904128

SEQ ID NO: 904137 - protein, 114 aa, Homo sapiens; identical to SEQ ID NO: 904128

SEQ ID NO: 904138 - protein, 135 aa, Homo sapiens
RARWEGRAGELRRMRAEACLSLPDRPSAGLWLPCSLARVSLGCRPGPCSRNVTRRLKSIKNIQKITKSMKMVAAAKYARAERELKPARIYGLGSLALYEKADIKGPEDKKKHLLMWCVLRSRTVWCYSFLHVLNR

SEQ ID NO: 904139 - protein, 114 aa, Homo sapiens; identical to SEQ ID NO: 904128

SEQ ID NO: 904140 - protein, 114 aa, Homo sapiens; identical to SEQ ID NO: 904128

SEQ ID NO: 904141 - protein, 91 aa, Homo sapiens
RARWEGRAGELRRMRAEACLSLPDRPSAGLWLPCSLARVSLGCRPGPCSRNALYEKADIKGPEDKKKHLLMWCVLRSRTVWCYSFLHVLNR

SEQ ID NO: 904142 - protein, 114 aa, Homo sapiens; identical to SEQ ID NO: 904128

SEQ ID NO: 904143 - protein, 114 aa, Homo sapiens; identical to SEQ ID NO: 904128

SEQ ID NO: 904144 - protein, 114 aa, Homo sapiens; identical to SEQ ID NO: 904128

SEQ ID NO: 904145 - protein, 135 aa, Homo sapiens; identical to SEQ ID NO: 904138

SEQ ID NO: 904146 - protein, 114 aa, Homo sapiens; identical to SEQ ID NO: 904128

SEQ ID NO: 904147 - protein, 114 aa, Homo sapiens; identical to SEQ ID NO: 904128

SEQ ID NO: 904148 - protein, 114 aa, Homo sapiens; identical to SEQ ID NO: 904128

SEQ ID NO: 904149 - protein, 114 aa, Homo sapiens; identical to SEQ ID NO: 904128

SEQ ID NO: 904150 - protein, 114 aa, Homo sapiens; identical to SEQ ID NO: 904128

SEQ ID NO: 904151 - protein, 114 aa, Homo sapiens; identical to SEQ ID NO: 904128

SEQ ID NO: 904152 - protein, 114 aa, Homo sapiens; identical to SEQ ID NO: 904128

SEQ ID NO: 904153 - protein, 114 aa, Homo sapiens; identical to SEQ ID NO: 904128

SEQ ID NO: 904154 - protein, 126 aa, Homo sapiens
KDTKYDRTTPGVNRHEGAGVAELSAGPAAAMDSSSKYGNLKDITRRLKSIKNIQKITKSMKMVAAAKYARAERELKPARIYGLGSLALYEKADIKGPEDKKKHLLMWCVLRSRTVWCYSFLHVLNR

SEQ ID NO: 904155 - protein, 114 aa, Homo sapiens; identical to SEQ ID NO: 904128

SEQ ID NO: 904156 - protein, 114 aa, Homo sapiens; identical to SEQ ID NO: 904128

SEQ ID NO: 904157 - protein, 114 aa, Homo sapiens; identical to SEQ ID NO: 904128

SEQ ID NO: 904158 - protein, 155 aa, Homo sapiens
MFSRAGVAGLSAWTLQPQWIQVRNMATLKDITRRLKSIKNIQKITKSMKMVAAAKYARAERELKPARIYGLGSLALYEKADIKGPEDKKKHLLMWCVLRSRTVWCYSFLHVLNRPFSELLQSYHVYTQSACRFVAQSTPYRTHLPSYLRHSMTSS

SEQ ID NO: 904159 - protein, 83 aa, Homo sapiens
RARWEGRAGELRRMRAEACLSLPDRPSAGLWLPCSLARVSLGCRPGPCSRNDSSNRKQERSRTRSCRKGKDQTLEHFWDLQPK

SEQ ID NO: 904160 - protein, 216 aa, Homo sapiens
LLKRGQNGRRGRGGTESERRCAGCQHAVTSQYDLIRKKRPWRYNIYFTGFYVDHFGFNTVKTFNQRYLVADKYWKKNGGSILFYTGNEGDIIWFCNNTGFMWDVAEELKAMLVFAEHRYYGESLPFGDNSFKDSRHLNFLTSEQALADFAELIKHLKRTIPGAENQPVIAIGGSYGGMLAAWFRMKYPHMVVGVFEVLALLAVEDLELVGVFTEGS

SEQ ID NO: 904161 - protein, 496 aa, Homo sapiens
MGRRALLLLLLSFLAPWATIALRPALRALGSLHLPTNPTSLPAVAKNYSVLYFQQKVDHFGFNTVKTFNQRYLVADKYWKKNGGSILFYTGNEGDIIWFCNNTGFMWDVAEELKAMLVFAEHRYYGESLPFGDNSFKDSRHLNFLTSEQALADFAELIKHLKRTIPGAENQPVIAIGGSYGGMLAAWFRMKYPHMVVGALAASAPIWQFEDLVPCGVFMKIVTTDFRKSGPHCSESIHRSWDAINRLSNTGSGLQWLTGALHLCSPLTSQDIQHLKDWISETWVNLAMVDYPYASNFLQPLPAWPIKVVCQYLKNPNVSDSLLLQNIFQALNVYYNYSGQVKCLNISETATSSLGTLGWSYQACTEVVMPFCTNGVDDMFEPHSWNLKELSDDCFQQWGVRPRPSWITTMYGGKNISSHTNIVFSNGELDPWSGGGVTKDITDTLVAVTISEGAHHLDLRTKNALDPMSVLLARSLEVRHMKNWIRDFYDSAGKQH

SEQ ID NO: 904162 - protein, 465 aa, Homo sapiens
RRRRGWSLARKSYKHLETTIFVKLRVDHFGFNTVKTFNQRYLVADKYWKKNGGSILFYTGNEGDIIWFCNNTGFMWDVAEELKAMLVFAEHRYYGESLPFGDNSFKDSRHLNFLTSEQALADFAELIKHLKRTIPGAENQPVIAIGGSYGGMLAAWFRMKYPHMVVGALAASAPIWQFEDLVPCGVFMKIVTTDFRKSGPHCSESIHRSWDAINRLSNTGSGLQWLTGALHLCSPLTSQDIQHLKDWISETWVNLAMVDYPYASNFLQPLPAWPIKVVCQYLKNPNVSDSLLLQNIFQALNVYYNYSGQVKCLNISETATSSLGTLGWSYQACTEVVMPFCTNGVDDMFEPHSWNLKELSDDCFQQWGVRPRPSWITTMYGGKNISSHTNIVFSNGELDPWSGGGVTKDITDTLVAVTISEGAHHLDLRTKNALDPMSVLLARSLEVRHMKNWIRDFYDSAGKQH

SEQ ID NO: 904163 - protein, 457 aa, Homo sapiens
FGASLSLLGVGFPGKCGVDHFGFNTVKTFNQRYLVADKYWKKNGGSILFYTGNEGDIIWFCNNTGFMWDVAEELKAMLVFAEHRYYGESLPFGDNSFKDSRHLNFLTSEQALADFAELIKHLKRTIPGAENQPVIAIGGSYGGMLAAWFRMKYPHMVVGALAASAPIWQFEDLVPCGVFMKIVTTDFRKSGPHCSESIHRSWDAINRLSNTGSGLQWLTGALHLCSPLTSQDIQHLKDWISETWVNLAMVDYPYASNFLQPLPAWPIKVVCQYLKNPNVSDSLLLQNIFQALNVYYNYSGQVKCLNISETATSSLGTLGWSYQACTEVVMPFCTNGVDDMFEPHSWNLKELSDDCFQQWGVRPRPSWITTMYGGKNISSHTNIVFSNGELDPWSGGGVTKDITDTLVAVTISEGAHHLDLRTKNALDPMSVLLARSLEVRHMKNWIRDFYDSAGKQH

SEQ ID NO: 904164 - protein, 391 aa, Homo sapiens
MWDVAEELKAMLVFAEHRYYGESLPFGDNSFKDSRHLNFLTSEQALADFAELIKHLKRTIPGAENQPVIAIGGSYGGMLAAWFRMKYPHMVVGALAASAPIWQFEDLVPCGVFMKIVTTDFRKSGPHCSESIHRSWDAINRLSNTGSGLQWLTGALHLCSPLTSQDIQHLKDWISETWVNLAMVDYPYASNFLQPLPAWPIKVVCQYLKNPNVSDSLLLQNIFQALNVYYNYSGQVKCLNISETATSSLGTLGWSYQACTEVVMPFCTNGVDDMFEPHSWNLKELSDDCFQQWGVRPRPSWITTMYGGKNISSHTNIVFSNGELDPWSGGGVTKDITDTLVAVTISEGAHHLDLRTKNALDPMSVLLARSLEVRHMKNWIRDFYDSAGKQH

SEQ ID NO: 904165 - protein, 302 aa, Homo sapiens [sequence omitted]

SEQ ID NO: 904166 - protein, 256 aa, Homo sapiens
MGRRALLLLLLSFLAPWATIALRPALRALGSLHLPTNPTSLPAVAKNYSVLYFQQKVDHFGFNTVKTFNQRYLVADKYWKKNGGSILFYTGNEGDIIWFCNNTGFMWDVAEELKAMLVFAEHRYYGESLPFGDNSFKDSRHLNFLTSEQALADFAELIKHLKRTIPGAENQPVIAIGGSYGGMLAAWFRMKYPHMVVGALAASAPIWQFEDLVPCGVFMKIVTTDFRQWFAVAYWSPSLMQPINFSGHPTFERLDL

SEQ ID NO: 904167 - protein, 128 aa, Homo sapiens
MPFCTNGVDDMFEPHSWNLKELSDDCFQQWGVRPRPSWITTMYGGKNISSHTNIVFSNGELDPWSGGGVTKDITDTLVAVTISEGAHHLDLRTKNALDPMSVLLARSLEVRHMKNWIRDFYDSAGKQH

SEQ ID NO: 904168 - protein, 306 aa, Homo sapiens
MGRRALLLLLLSFLAPWATIALRPALRALGSLHLPTNPTSLPAVAKNYSVLYFQQKVDHFGFNTVKTFNQRYLVADKYWKKNGGSILFYTGNEGDIIWFCNNTGFMWDVAEELKAMLVFAEHRYYGESLPFGDNSFKDSRHLNFLTSEQALADFAELIKHLKRTIPGAENQPVIAIGGSYGGMLAAWFRMKYPHMVVGALAASAPIWQFEDLVPCGVFMKIVTTDFRKSGPHCSESIHRSWDAINRLSNTAGLPGYCGPSFCAITSPASTLGDCPPTRRTGLVAILGPTLKLAVGISEAPGNPVFT

SEQ ID NO: 904169 - protein, 496 aa, Homo sapiens; identical to SEQ ID NO: 904161

SEQ ID NO: 904170 - protein, 496 aa, Homo sapiens; identical to SEQ ID NO: 904161

SEQ ID NO: 904171 - protein, 391 aa, Homo sapiens; identical to SEQ ID NO: 904164

SEQ ID NO: 904172 - protein, 496 aa, Homo sapiens; identical to SEQ ID NO: 904161

SEQ ID NO: 904173 - protein, 496 aa, Homo sapiens; identical to SEQ ID NO: 904161

SEQ ID NO: 904174 - protein, 357 aa, Homo sapiens
TPPPPPPPPPPPRPTHTHTLRTGPRVNSATRQPVIAIGGSYGGMLAAWFRMKYPHMVVGALAASAPIWQFEDLVPCGVFMKIVTTDFRKSGPHCSESIHRSWDAINRLSNTGSGLQWLTGALHLCSPLTSQDIQHLKDWISETWVNLAMVDYPYASNFLQPLPAWPIKVVCQYLKNPNVSDSLLLQNIFQALNVYYNYSGQVKCLNISETATSSLGTLGWSYQACTEVVMPFCTNGVDDMFEPHSWNLKELSDDCFQQWGVRPRPSWITTMYGGKNISSHTNIVFSNGELDPWSGGGVTKDITDTLVAVTISEGAHHLDLRTKNALDPMSVLLARSLEVRHMKNWIRDFYDSAGKQH

SEQ ID NO: 904175 - protein, 128 aa, Homo sapiens; identical to SEQ ID NO: 904167

SEQ ID NO: 904176 - protein, 100 aa, Homo sapiens
MGRRALLLLLLSFLAPWATIALRPALRALGSLHLPTNPTSLPAVAKNYSVLYFQQKVDHFGFNTVKTFNQRYLVADKYWKKCNNTDRTMESLSPLVTLHQ

SEQ ID NO: 904177 - protein, 73 aa, Homo sapiens
KLAAAAMVFGGVLLVANILRILFWFGRRFESPLLWQSAIMILTMLLMLKLCTEVRVPRVFLGNTLECLSEGPA

SEQ ID NO: 904178 - protein, 253 aa, Homo sapiens
MEAEGLDWLLVPLHQLVSWGAAAAMVFGGVVPYVPQYRDIRRTQNADGFSTYVCLVLLVANILRILFWFGRRFESPLLWQSAIMILTMLLMLKLCTEVRVANELNARRRSFTDFDPHHFWQWSSFSDYVQCVLAFTGVAGYITYLSIDSALFVETLGFLAVLTEAMLGVPQLYRNHRHQSTEGMSIKMVLMWTSGDAFKTAYFLLKGAPLQFSVCGLLQVLVDLAILGQAYAFARHPQKPAPHAVHPTGTKAL

SEQ ID NO: 904179 - protein, 271 aa, Homo sapiens
MEAEGLDWLLVPLHQLVSWGAAAAMVFGGVVPYVPQYRDIRRTQNADGFSTYVCLVLLVANILRILFWFGRRFESPLLWQSAIMILTMLLMLKLCTEVRVANELNARRRSFTAADSKDEEVKVAPRRSFLDFDPHHFWQWSSFSDYVQCVLAFTGVAGYITYLSIDSALFVETLGFLAVLTEAMLGVPQLYRNHRHQSTEGMSIKMVLMWTSGDAFKTAYFLLKGAPLQFSVCGLLQVLVDLAILGQAYAFARHPQKPAPHAVHPTGTKAL

SEQ ID NO: 904180 - protein, 218 aa, Homo sapiens
MEAEGLDWLLVPLHQLVSWGAAAAMVFGGVVPYVPQYRDIRRTQNADGFSTYVCLVLLVANILRILFWFGRRFESPLLWQSAIMILTMLLMLKLCTEVRVANELNARRRSFTAADSKDEEVKVAPRRSFLDFDPHHFWQWSSFSDYVQCVLAFTGVAGYITYLSIDSALFVETLGFLAVLTEAMLGVPQLYRNHRHQSTEGMRLLPPGCRQDPLWNEG

SEQ ID NO: 904181 - protein, 113 aa, Homo sapiens [sequence omitted]

SEQ ID NO: 904182 - protein, 299 aa, Homo sapiens
MEAEGLDWLLVPLHQLVSWGAAAAMVFGGVVPYVPQYRDIRRTQNADGFSTYVCLVLLVANILRILFWFGRRFESPLLWQSAIMILTMLLMLKLCTEVRVANELNARRRSFTAADSKDEEVKVAPRRSFLVLRICYSTALWTPLFLMRSQLLILLGFPYFDPHHFWQWSSFSDYVQCVLAFTGVAGYITYLSIDSALFVETLGFLAVLTEAMLGVPQLYRNHRHQSTEGMSIKMVLMWTSGDAFKTAYFLLKGAPLQFSVCGLLQVLVDLAILGQAYAFARHPQKPAPHAVHPTGTKAL

SEQ ID NO: 904183 - protein, 278 aa, Homo sapiens
MEAEGLDWLLVPLHQLVSWGAAAAMVFGGVVPYVPQYRDIRRTQNADGFSTYVCLVLLVANILRILFCPYYHFAKPAFSRSHSVECQHSGFGRFGRRFESPLLWQSAIMILTMLLMLKLCTEVRVANELNARRRSFTDFDPHHFWQWSSFSDYVQCVLAFTGVAGYITYLSIDSALFVETLGFLAVLTEAMLGVPQLYRNHRHQSTEGMSIKMVLMWTSGDAFKTAYFLLKGAPLQFSVCGLLQVLVDLAILGQAYAFARHPQKPAPHAVHPTGTKAL

SEQ ID NO: 904184 - protein, 113 aa, Homo sapiens [sequence omitted]

SEQ ID NO: 904185 - protein, 271 aa, Homo sapiens; identical to SEQ ID NO: 904179

SEQ ID NO: 904186 - protein, 113 aa, Homo sapiens [sequence omitted]

SEQ ID NO: 904187 - protein, 271 aa, Homo sapiens; identical to SEQ ID NO: 904179

SEQ ID NO: 904188 - protein, 271 aa, Homo sapiens; identical to SEQ ID NO: 904179

SEQ ID NO: 904189 - protein, 104 aa, Homo sapiens
MTYPACIAEQIIVRSGIDLSVMPHCGCSYAQWTAVYHVPHALPPPRCKRSHHVSSLALTAAGPQASEFWMLPCGSNRHRLPFRRWRGRFPQASELSSSFPRKHS

SEQ ID NO: 904190 - protein, 155 aa, Homo sapiens
MEAEGLDWLLVPLHQLVSWGAAAAMVFGGVVPYVPQYRDIRRTQNADGFSTYVCLVLLVANILRILFWFGRRFESPLLWQSAIMILTMLLMLKLCTEVRVANELNARRRSFTESSQRVQNGFWKRESPLDLQGSHVQTSTTFDLLTSLLLAKTRL

SEQ ID NO: 904191 - protein, 113 aa, Homo sapiens [sequence omitted]

SEQ ID NO: 904192 - protein, 188 aa, Homo sapiens
MILTMLLMLKLCTEVRVANELNARRRSFTAADSKDEEVKVAPRRSFLDFDPHHFWQWSSFSDYVQCVLAFTGVAGYITYLSIDSALFVETLGFLAVLTEAMLGVPQLYRNHRHQSTEGMSIKMVLMWTSGDAFKTAYFLLKGAPLQFSVCGLLQVLVDLAILGQAYAFARHPQKPAPHAVHPTGTKAL

SEQ ID NO: 904193 - protein, 132 aa, Homo sapiens
MEAEGLDWLLVPLHQLVSWGAAAAMVFGGVVPYVPQYRDIRRTQNADGFSTYVCLVLLVANILRILFWFGRRFESPLLWQSAIMILTMLLMLKLCTEVRVANELNARRRSFTASRWCSCGPVVTPSRRPTSC

SEQ ID NO: 904194 - protein, 250 aa, Homo sapiens
MSACHTQPSLGGGGSAGSGLGEAAWAGLPPDTGSFLLQVRDQERRHGFGRRFESPLLWQSAIMILTMLLMLKLCTEVRVANELNARRRSFTAADSKDEEVKVAPRRSFLDFDPHHFWQWSSFSDYVQCVLAFTGVAGYITYLSIDSALFVETLGFLAVLTEAMLGVPQLYRNHRHQSTEGMSIKMVLMWTSGDAFKTAYFLLKGAPLQFSVCGLLQVLVDLAILGQAYAFARHPQKPAPHAVHPTGTKAL

SEQ ID NO: 904195 - protein, 150 aa, Homo sapiens
MEAEGLDWLLVPLHQLVSWGAAAAMVFGGVVPYVPQYRDIRRTQNADGFSTYVCLVLLVANILRILFWFGRRFESPLLWQSAIMILTMLLMLKLCTEVRVANELNARRRSFTAADSKDEEVKVAPRRSFLASRWCSCGPVVTPSRRPTSC

SEQ ID NO: 904196 - protein, 113 aa, Homo sapiens [sequence omitted]

SEQ ID NO: 904197 - protein, 113 aa, Homo sapiens [sequence omitted]

SEQ ID NO: 904198 - protein, 271 aa, Homo sapiens; identical to SEQ ID NO: 904179

SEQ ID NO: 904199 - protein, 271 aa, Homo sapiens; identical to SEQ ID NO: 904179

SEQ ID NO: 904200 - protein, 105 aa, Homo sapiens
MEAEGLDWLLVPLHQLVSWGAAAAMVFGGVVPYVPQYRDIRRTQNADGFSTYVCLVLLVANILRILFWFGRRFESPLLWQSAIMILTMLSSPCAACCRGPLPAGI

SEQ ID NO: 904201 - protein, 142 aa, Homo sapiens
MATSLDFKTYVDQACRAAEEFVNIYYETMDKRRRALTRLYLDKATLIWNGNAVSGLDALNNFFDTLPSSEFQVNMLDCQPVHEQATQSQTTVLVVTSGTVKFDGNKQHFFNQNFLLTAQSTPNNTVWKIASDCFRFQDWSSS

SEQ ID NO: 904202 - protein, 172 aa, Homo sapiens
MRGHTPATQDRTREEVVTPTLPEHTATRSQMATSLDFKTYVDQACRAAEEFVNIYYETMDKRRRALTRLYLDKATLIWNGNAVSGLDALNNFFDTLPSSEFQVNMLDCQPVHEQATQSQTTVLVVTSGTVKFDGNKQHFFNQNFLLTAQSTPNNTVWKIASDCFRFQDWSSS

SEQ ID NO: 904203 - protein, 114 aa, Homo sapiens
MDKRRRALTRLYLDKATLIWNGNAVSGLDALNNFFDTLPSSEFQVNMLDCQPVHEQATQSQTTVLVVTSGTVKFDGNKQHFFNQNFLLTAQSTPNNTVWKIASDCFRFQDWSSS

SEQ ID NO: 904204 - protein, 142 aa, Homo sapiens; identical to SEQ ID NO: 904201

SEQ ID NO: 904205 - protein, 142 aa, Homo sapiens; identical to SEQ ID NO: 904201

SEQ ID NO: 904206 - protein, 128 aa, Homo sapiens
MATSLDFKTYVDQACRAAEEFVNIYYETMDKRRRNGNAVSGLDALNNFFDTLPSSEFQVNMLDCQPVHEQATQSQTTVLVVTSGTVKFDGNKQHFFNQNFLLTAQSTPNNTVWKIASDCFRFQDWSSS

SEQ ID NO: 904207 - protein, 232 aa, Homo sapiens
MQQHITSKPTGHPGQHQQQGITKSKHSNSFMQRAKTPAHSKPLRDRTHRDGRYVTADHVPDTTTAYTGPKMAHVIWAFKNLLSDHGMIDAELTDVSTNIITHDDNVAYTRQHRATKTMACYLGTQAHTLTTQDMSKHAGYHGAWTAPYTHVIVMRTTIGTIIDEDTNGYKIHVHDSAPNTSNQSADNTPTIQVTQKLNHEYQGEADPRRDDIGDTTQTSSTQTKNNSHAKHK

SEQ ID NO: 904208 - protein, 142 aa, Homo sapiens; identical to SEQ ID NO: 904201

SEQ ID NO: 904209 - protein, 188 aa, Homo sapiens
VTNHVPALCTAGRGPRFAARPAGPTPSLVSSRFLIPERTLSWEIARGGDVGDFKTYVDQACRAAEEFVNIYYETMDKRRRALTRLYLDKATLIWNGNAVSGLDALNNFFDTLPSSEFQVNMLDCQPVHEQATQSQTTVLVVTSGTVKFDGNKQHFFNQNFLLTAQSTPNNTVWKIASDCFRFQDWSSS

SEQ ID NO: 904210 - protein, 188 aa, Homo sapiens; identical to SEQ ID NO: 904209

SEQ ID NO: 904211 - protein, 2179 aa, Homo sapiens
MMMMMKKMQHQRQQQADHANEANYARGTRLPLSGEGPTSQPNSSKQTVLSWQAAIDAARQAKAAQTMSTSAPPPVGSLSQRKRQQYAKSKKQGNSSNSRPARALFCLSLNNPIRRACISIVEWKPFDIFILLAIFANCVALAIYIPFPEDDSNSTNHNLEKVEYAFLIIFTVETFLKIIAYGLLLHPNAYVRNGWNLLDFVIVIVGLFSVILEQLTKETEGGNHSSGKSGGFDVKALRAFRVLRPLRLVSGVPSLQVVLNSIIKAMVPLLHIALLVLFVIIIYAIIGLELFIGKMHKTCFFADSDIVAEEDPAPCAFSGNGRQCTANGTECRSGWVGPNGGITNFDNFAFAMLTVFQCITMEGWTDVLYWVNDAIGWEWPWVYFVSLIILGSFFVLNLVLGVLSGEFSKEREKAKARGDFQKLREKQQLEEDLKGYLDWITQAEDIDPENEEEGGEEGKRNTSMPTSETESVNTENVSGEGENRGCCGSLWCWWRRRGAAKAGPSGCRRWGQAISKSKLSRRWRRWNRFNRRRCRAAVKSVTFYWLVIVLVFLNTLTISSEHYNQPDWLTQIQDIANKVLLALFTCEMLVKMYSLGLQAYFVSLFNRFDCFVVCGGITETILVELEIMSPLGISVFRCVRLLRIFKVTRHWTSLSNLVASLLNSMKSIASLLLLLFLFIIIFSLLGMQLFGGKFNFDETQTKRSTFDNFPQALLTVFQILTGEDWNAVMYDGIMAYGGPSSSGMIVCIYFIILFICGNYILLNVFLAIAVDNLADAESLNTAQKEEAEEKERKKIARKESLENKKNNKPEVNQIANSDNKVTIDDYREEDEDKDPYPPCDVPVGEEEEEEEEDEPEVPAGPRPRRISELNMKEKIAPIPEGSAFFILSKTNPIRVGCHKLINHHIFTNLILVFIMLSSAALAAEDPIRSHSFRNTILGYFDYAFTAIFTVEILLKMTTFGAFLHKGAFCRNYFNLLDMLVVGVSLVSFGIQSSAISVVKILRVLRVLRPLRAINRAKGLKHVVQCVFVAIRTIGNIMIVTTLLQFMFACIGVQLFKGKFYRCTDEAKSNPEECRGLFILYKDGDVDSPVVRERIWQNSDFNFDNVLSAMMALFTVSTFEGWPALLYKAIDSNGENIGPIYNHRVEISIFFIIYIIIVAFFMMNIFVGFVIVTFQEQGEKEYKNCELDKNQRQCVEYALKARPLRRYIPKNPYQYKFWYVVNSSPFEYMMFVLIMLNTLCLAMQHYEQSKMFNDAMDILNMVFTGVFTVEMVLKVIAFKPKGYFSDAWNTFDSLIVIGSIIDVALSEADPTESENVPVPTATPGNSEESNRISITFFRLFRVMRLVKLLSRGEGIRTLLWTFIKSFQALPYVALLIAMLFFIYAVIGMQMFGKVAMRDNNQINRNNNFQTFPQAVLLLFRCATGEAWQEIMLACLPGKLCDPESDYNPGEEYTCGSNFAIVYFISFYMLCAFLIINLFVAVIMDNFDYLTRDWSILGPHHLDEFKRIWSEYDPEAKGRIKHLDVVTLLRRIQPPLGFGKLCPHRVACKRLVAMNMPLNSDGTVMFNATLFALVRTALKIKTEGNLEQANEELRAVIKKIWKKTSMKLLDQVVPPAGDDEVTVGKFYATFLIQDYFRKFKKRKEQGLVGKYPAKNTTIALQAGLRTLHDIGPEIRRAISCDLQDDEPEETKREEEDDVFKRNGALLGNHVNHVNSDRRDSLQQTNTTHRPLHVQRPSIPPASDTEKPLFPPAGNSVCHNHHNHNSIGKQVPTSTNANLNNANMSKAAHGKRPSIGNLEHVSENGHHSSHKHDREPQRRSSVKRTRYYETYIRSDSGDEQLPTICREDPEIHGYFRDPHCLGEQEYFSSEECYEDDSSPTWSRQNYGYYSRYPGRNIDSERPRGYHHPQGFLEDDDSPVCYDSRRSPRRRLLPPTPASHRRSSFNFECLRRQSSQEEVPSSPIFPHRTALPLHLMQQQIMAVAGLDSSKAQKYSPSHSTRSWATPPATPPYRDWTPCYTPLIQVEQSEALDQVNGSLPSLHRSSWYTDEPDISYRTFTPASLTVPSSFRNKNSDKQRSADSLVEAVLISEGLGRYARDPKFVSATKHEIADACDLTIDEMESAASTLLNGNVRPRANGDVGPLSHRQDYELQDFGPGYSDEEPDPGRDEEDLADEMICITTL

SEQ ID NO: 904212 - protein, 2159 aa, Homo sapiens
MMMMMKKMQHQRQQQADHANEANYARGTRLPLSGEGPTSQPNSSKQTVLSWQAAIDAARQAKAAQTMSTSAPPPVGSLSQRKRQQYAKSKKQGNSSNSRPARALFCLSLNNPIRRACISIVEWKPFDIFILLAIFANCVALAIYIPFPEDDSNSTNHNLEKVEYAFLIIFTVETFLKIIAYGLLLHPNAYVRNGWNLLDFVIVIVGLFSVILEQLTKETEGGNHSSGKSGGFDVKALRAFRVLRPLRLVSGVPSLQVVLNSIIKAMVPLLHIALLVLFVIIIYAIIGLELFIGKMHKTCFFADSDIVAEEDPAPCAFSGNGRQCTANGTECRSGWVGPNGGITNFDNFAFAMLTVFQCITMEGWTDVLYWMNDAMGFELPWVYFVSLVIFGSFFVLNLVLGVLSGEFSKEREKAKARGDFQKLREKQQLEEDLKGYLDWITQAEDIDPENEEEGGEEGKRNTSMPTSETESVNTENVSGEGENRGCCGSLCQAISKSKLSRRWRRWNRFNRRRCRAAVKSVTFYWLVIVLVFLNTLTISSEHYNQPDWLTQIQDIANKVLLALFTCEMLVKMYSLGLQAYFVSLFNRFDCFVVCGGITETILVELEIMSPLGISVFRCVRLLRIFKVTRHWTSLSNLVASLLNSMKSIASLLLLLFLFIIIFSLLGMQLFGGKFNFDETQTKRSTFDNFPQALLTVFQILTGEDWNAVMYDGIMAYGGPSSSGMIVCIYFIILFICGNYILLNVFLAIAVDNLADAESLNTAQKEEAEEKERKKIARKESLENKKNNKPEVNQIANSDNKVTIDDYREEDEDKDPYPPCDVPVGEEEEEEEEDEPEVPAGPRPRRISELNMKEKIAPIPEGSAFFILSKTNPIRVGCHKLINHHIFTNLILVFIMLSSAALAAEDPIRSHSFRNTILGYFDYAFTAIFTVEILLKMTTFGAFLHKGAFCRNYFNLLDMLVVGVSLVSFGIQSSAISVVKILRVLRVLRPLRAINRAKGLKHVVQCVFVAIRTIGNIMIVTTLLQFMFACIGVQLFKGKFYRCTDEAKSNPEECRGLFILYKDGDVDSPVVRERIWQNSDFNFDNVLSAMMALFTVSTFEGWPALLYKAIDSNGENIGPIYNHRVEISIFFIIYIIIVAFFMMNIFVGFVIVTFQEQGEKEYKNCELDKNQRQCVEYALKARPLRRYIPKNPYQYKFWYVVNSSPFEYMMFVLIMLNTLCLAMQHYEQSKMFNDAMDILNMVFTGVFTVEMVLKVIAFKPKGYFSDAWNTFDSLIVIGSIIDVALSEADPTESENVPVPTATPGNSEESNRISITFFRLFRVMRLVKLLSRGEGIRTLLWTFIKSFQALPYVALLIAMLFFIYAVIGMQMFGKVAMRDNNQINRNNNFQTFPQAVLLLFRCATGEAWQEIMLACLPGKLCDPESDYNPGEEYTCGSNFAIVYFISFYMLCAFLIINLFVAVIMDNFDYLTRDWSILGPHHLDEFKRIWSEYDPEAKGRIKHLDVVTLLRRIQPPLGFGKLCPHRVACKRLVAMNMPLNSDGTVMFNATLFALVRTALKIKTEGNLEQANEELRAVIKKIWKKTSMKLLDQVVPPAGDDEVTVGKFYATFLIQDYFRKFKKRKEQGLVGKYPAKNTTIALQAGLRTLHDIGPEIRRAISCDLQDDEPEETKREEEDDVFKRNGALLGNHVNHVNSDRRDSLQQTNTTHRPLHVQRPSIPPASDTEKPLFPPAGNSVCHNHHNHNSIGKQVPTSTNANLNNANMSKAAHGKRPSIGNLEHVSENGHHSSHKHDREPQRRSSVKRTRYYETYIRSDSGDEQLPTICREDPEIHGYFRDPHCLGEQEYFSSEECYEDDSSPTWSRQNYGYYSRYPGRNIDSERPRGYHHPQGFLEDDDSPVCYDSRRSPRRRLLPPTPASHRRSSFNFECLRRQSSQEEVPSSPIFPHRTALPLHLMQQQIMAVAGLDSSKAQKYSPSHSTRSWATPPATPPYRDWTPCYTPLIQVEQSEALDQVNGSLPSLHRSSWYTDEPDISYRTFTPASLTVPSSFRNKNSDKQRSADSLVEAVLISEGLGRYARDPKFVSATKHEIADACDLTIDEMESAASTLLNGNVRPRANGDVGPLSHRQDYELQDFGPGYSDEEPDPGRDEEDLADEMICITTL

SEQ ID NO: 904213 - protein, 2170 aa, Homo sapiens
MMMMMKKMQHQRQQQADHANEANYARGTRLPLSGEGPTSQPNSSKQTVLSWQAAIDAARQAKAAQTMSTSAPPPVGSLSQRKRQQYAKSKKQGNSSNSRPARALFCLSLNNPIRRACISIVEWKPFDIFILLAIFANCVALAIYIPFPEDDSNSTNHNLEKVEYAFLIIFTVETFLKIIAYGLLLHPNAYVRNGWNLLDFVIVIVGLFSVILEQLTKETEGGNHSSGKSGGFDVKALRAFRVLRPLRLVSGVPSLQVVLNSIIKAMVPLLHIALLVLFVIIIYAIIGLELFIGKMHKTCFFADSDIVAEEDPAPCAFSGNGRQCTANGTECRSGWVGPNGGITNFDNFAFAMLTVFQCITMEGWTDVLYWVNDAIGWEWPWVYFVSLIILGSFFVLNLVLGVLSGEFSKEREKAKARGDFQKLREKQQLEEDLKGYLDWITQAEDIDPENEEEGGEEGKRNTSMPTSETESVNTENVSGEGENRGCCGSLWCWWRRRGAAKAGPSGCRRWGQAISKSKLSRRWRRWNRFNRRRCRAAVKSVTFYWLVIVLVFLNTLTISSEHYNQPDWLTQIQDIANKVLLALFTCEMLVKMYSLGLQAYFVSLFNRFDCFVVCGGITETILVELEIMSPLGISVFRCVRLLRIFKVTRHWTSLSNLVASLLNSMKSIASLLLLLFLFIIIFSLLGMQLFGGKFNFDETQTKRSTFDNFPQALLTVFQILTGEDWNAVMYDGIMAYGGPSSSGMIVCIYFIILFICGNYILLNVFLAIAVDNLADAESLNTAQKEEAEEKERKKIARKESLENKKNNKPEVNQIANSDNKVTIDDYREEDEDKDPYPPCDVPVGEEEEEEEEDEPEVPAGPRPRRISELNMKEKIAPIPEGSAFFILSKTNPIRVGCHKLINHHIFTNLILVFIMLSSAALAAEDPIRSHSFRNTILGYFDYAFTAIFTVEILLKMTTFGAFLHKGAFCRNYFNLLDMLVVGVSLVSFGIQSSAISVVKILRVLRVLRPLRAINRAKGLKHVVQCVFVAIRTIGNIMIVTTLLQFMFACIGVQLFKGKFYRCTDEAKSNPEECRGLFILYKDGDVDSPVVRERIWQNSDFNFDNVLSAMMALFTVSTFEGWPALLYKAIDSNGENIGPIYNHRVEISIFFIIYIIIVAFFMMNIFVGFVIVTFQEQGEKEYKNCELDKNQRQCVEYALKARPLRRYIPKNPYQYKFWYVVNSSPFEYMMFVLIMLNTLCLAMQHYEQSKMFNDAMDILNMVFTGVFTVEMVLKVIAFKPKGYFSDAWNTFDSLIVIGSIIDVALSEADPTESENVPVPTATPGNSEESNRISITFFRLFRVMRLVKLLSRGEGIRTLLWTFIKSFQALPYVALLIAMLFFIYAVIGMQMFGKVAMRDNNQINRNNNFQTFPQAVLLLFRCATGEAWQEIMLACLPGKLCDPESDYNPGEEYTCGSNFAIVYFISFYMLCAFLIINLFVAVIMDNFDYLTRDWSILGPHHLDEFKRIWSEYDPEAKGRIKHLDVVTLLRRIQPPLGFGKLCPHRVACKRLVAMNMPLNSDGTVMFNATLFALVRTALKIKTEGNLEQANEELRAVIKKIWKKTSMKLLDQVVPPAGDDEVTVGKFYATFLIQDYFRKFKKRKEQGLVGKYPAKNTTIALQAGLRTLHDIGPEIRRAISCDLQDDEPEETKREEEDDVFKRNGALLGNHVNHVNSDRRDSLQQTNTTHRPLHVQRPSIPPASDTEKPLFPPAGNSVCHNHHNHNSIGKQVPTSTNANLNNANMSKAAHGKRPSIGNLEHVSENGHHSSHKHDREPQRRSSVKRSDSGDEQLPTICREDPEIHGYFRDPHCLGEQEYFSSEECYEDDSSPTWSRQNYGYYSRYPGRNIDSERPRGYHHPQGFLEDDDSPVCYDSRRSPRRRLLPPTPASHRRSSFNFECLRRQSSQEEVPSSPIFPHRTALPLHLMQQQIMAVAGLDSSKAQKYSPSHSTRSWATPPATPPYRDWTPCYTPLIQVEQSEALDQVNGSLPSLHRSSWYTDEPDISYRTFTPASLTVPSSFRNKNSDKQRSADSLVEAVLISEGLGRYARDPKFVSATKHEIADACDLTIDEMESAASTLLNGNVRPRANGDVGPLSHRQDYELQDFGPGYSDEEPDPGRDEEDLADEMICITTL

SEQ ID NO: 904214 - protein, 405 aa, Homo sapiens
MMMMMKKMQHQRQQQADHANEANYARGTRLPLSGEGPTSQPNSSKQTVLSWQAAIDAARQAKAAQTMSTSAPPPVGSLSQRKRQQYAKSKKQGNSSNSRPARALFCLSLNNPIRRACISIVEWKPFDIFILLAIFANCVALAIYIPFPEDDSNSTNHNLEKVEYAFLIIFTVETFLKIIAYGLLLHPNAYVRNGWNLLDFVIVIVGLFSVILEQLTKETEGGNHSSGKSGGFDVKALRAFRVLRPLRLVSGVPSLQVVLNSIIKAMVPLLHIALLVLFVIIIYAIIGLELFIGKMHKTCFFADSDIVAEEDPAPCAFSGNGRQCTANGTECRSGWVGPNGGITNFDNFAFAMLTVFQCITMEGWTDVLYWVNDAIGWEWPWVYFVSLIILGSFFVLNLVLGVLSG

SEQ ID NO: 904215 - protein, 2179 aa, Homo sapiens; identical to SEQ ID NO: 904211

SEQ ID NO: 904216 - protein, 2170 aa, Homo sapiens; identical to SEQ ID NO: 904213

SEQ ID NO: 904217 - protein, 405 aa, Homo sapiens
MMMMMKKMQHQRQQQADHANEANYARGTRLPLSGEGPTSQPNSSKQTVLSWQAAIDAARQAKAAQTMSTSAPPPVGSLSQRKRQQYAKSKKQGNSSNSRPARALFCLSLNNPIRRACISIVEWKPFDIFILLAIFANCVALAIYIPFPEDDSNSTNHNLEKVEYAFLIIFTVETFLKIIAYGLLLHPNAYVRNGWNLLDFVIVIVGLFSVILEQLTKETEGGNHSSGKSGGFDVKALRAFRVLRPLRLVSGVPSLQVVLNSIIKAMVPLLHIALLVLFVIIIYAIIGLELFIGKMHKTCFFADSDIVAEEDPAPCAFSGNGRQCTANGTECRSGWVGPNGGITNFDNFAFAMLTVFQCITMEGWTDVLYWMNDAMGFELPWVYFVSLVIFGSFFVLNLVLGVLSG

SEQ ID NO: 904218 - protein, 300 aa, Homo sapiens
MAKDQAVENILVSPVVVASSLGLVSLGGKATTASQAKAVLSAEQLRDEEVHAGLGELLRSLSNSTARNVTWKLGSRLYGPSSVSFADDFVRSSKQHYNCEHSKINFRDKRSALQSINEWAAQTTDGKLPEVTKDVERTDGALLVNAMFFKPHWDEKFHHKMVDNRGFMVTRSYTVGVMMMHRTGLYNYYDDEKEKLQIVEMPLAHKLSSLIILMPHHVEPLERLEKLLTKEQLKIWMGKMQKKAVAISLPKGVVEVTHDLQKHLAGLGLTEAIDKNKADLSRMSGKKDLYLAQRVPRHRL

SEQ ID NO: 904219 - protein, 300 aa, Homo sapiens; identical to SEQ ID NO: 904218

SEQ ID NO: 904220 - protein, 300 aa, Homo sapiens; identical to SEQ ID NO: 904218

SEQ ID NO: 904221 - protein, 300 aa, Homo sapiens; identical to SEQ ID NO: 904218

SEQ ID NO: 904222 - protein, 411 aa, Homo sapiens
GLPAEIFFLYWLCNRTPHAALRRGSVLLMKKAGIDLPLRQFPGPPWCTQTTSWPCAPSCFSAPSASWRRPWPPRVKKPAAAAAPGTAEKLSPKAATLAERSAGLAFSLYQAMAKDQAVENILVSPVVVASSLGLVSLGGKATTASQAKAVLSAEQLRDEEVHAGLGELLRSLSNSTARNVTWKLGSRLYGPSSVSFADDFVRSSKQHYNCEHSKINFRDKRSALQSINEWAAQTTDGKLPEVTKDVERTDGALLVNAMFFKPHWDEKFHHKMVDNRGFMVTRSYTVGVMMMHRTGLYNYYDDEKEKLQIVEMPLAHKLSSLIILMPHHVEPLERLEKLLTKEQLKIWMGKMQKKAVAISLPKGVVEVTHDLQKHLAGLGLTEAIDKNKADLSRMSGKKDLYLAQRVPRHRL

SEQ ID NO: 904223 - protein, 426 aa, Homo sapiens
ARAGRDSRSRAFCLLEAALAAEVKKPAAAAAPGTAEKLSPKAATLAERSAGLAFSLYRPPWCTQTTSWPCAPSCFSAPSASWRRPWPPRVKKPAAAAAPGTAEKLSPKAATLAERSAGLAFSLYQAMAKDQAVENILVSPVVVASSLGLVSLGGKATTASQAKAVLSAEQLRDEEVHAGLGELLRSLSNSTARNVTWKLGSRLYGPSSVSFADDFVRSSKQHYNCEHSKINFRDKRSALQSINEWAAQTTDGKLPEVTKDVERTDGALLVNAMFFKPHWDEKFHHKMVDNRGFMVTRSYTVGVMMMHRTGLYNYYDDEKEKLQIVEMPLAHKLSSLIILMPHHVEPLERLEKLLTKEQLKIWMGKMQKKAVAISLPKGVVEVTHDLQKHLAGLGLTEAIDKNKADLSRMSGKKDLYLAQRVPRHRL

SEQ ID NO: 904224 - protein, 300 aa, Homo sapiens; identical to SEQ ID NO: 904218

SEQ ID NO: 904225 - protein, 300 aa, Homo sapiens; identical to SEQ ID NO: 904218

SEQ ID NO: 904226 - protein, 300 aa, Homo sapiens; identical to SEQ ID NO: 904218

SEQ ID NO: 904227 - protein, 54 aa, Homo sapiens
TVGSLAPISRGLVAARELRVVVGEEGLGLQDHPVCAILTAHRGARKPLPGHALP

SEQ ID NO: 904228 - protein, 143 aa, Homo sapiens
MAKDQAVENILVSPVVVASSLGLVSLGGKATTASQAKAVLSAEQLRDEEVHAGLGELLRSLSNSTARNVTWKLGSRLYGPSSVSFADDFVRSSKQHYNCEHSKINFRDKRSALQSINEWAAQTTDGKLPEVTKDVERTDGAPC

SEQ ID NO: 904229 - protein, 300 aa, Homo sapiens; identical to SEQ ID NO: 904218

SEQ ID NO: 904230 - protein, 383 aa, Homo sapiens
MKKAGIDLPLRQFPGPPWCTQTTSWPCAPSCFSAPSASWRRPWPPRVKKPAAAAAPGTAEKLSPKAATLAERSAGLAFSLYQAMAKDQAVENILVSPVVVASSLGLVSLGGKATTASQAKAVLSAEQLRDEEVHAGLGELLRSLSNSTARNVTWKLGSRLYGPSSVSFADDFVRSSKQHYNCEHSKINFRDKRSALQSINEWAAQTTDGKLPEVTKDVERTDGALLVNAMFFKPHWDEKFHHKMVDNRGFMVTRSYTVGVMMMHRTGLYNYYDDEKEKLQIVEMPLAHKLSSLIILMPHHVEPLERLEKLLTKEQLKIWMGKMQKKAVAISLPKGVVEVTHDLQKHLAGLGLTEAIDKNKADLSRMSGKKDLYLAQRVPRHRL

SEQ ID NO: 904231 - protein, 300 aa, Homo sapiens; identical to SEQ ID NO: 904218

SEQ ID NO: 904232 - protein, 300 aa, Homo sapiens; identical to SEQ ID NO: 904218

SEQ ID NO: 904233 - protein, 159 aa, Homo sapiens
LTLCFAPTTAHWDEKFHHKMVDNRGFMVTRSYTVGVMMMHRTGLYNYYDDEKEKLQIVEMPLAHKLSSLIILMPHHVEPLERLEKLLTKEQLKIWMGKMQKKAVAISLPKGVVEVTHDLQKHLAGLGLTEAIDKNKADLSRMSGKKDLYLAQRVPRHRL

SEQ ID NO: 904234 - protein, 88 aa, Homo sapiens
DVRRRQKGGEGVGGGAGHGPVDQQPAFELDTDGNPFDQDIYGREELRSPKLFYADHPFIFLVRDTQSGSLLFIGRLVRPKGDKMRDEL

SEQ ID NO: 904235 - protein, 199 aa, Homo sapiens
MADLEEQLSDEEKVRIAAKFIIHAPPGEFNEVFNDVRLLLNNDNLLREGAAHAFAQYNLDQFTPVKIEGYEDQVLITEHGDLGNGKFLDPKNRICFKFDHLRKEATDPRPCEVENAVESWRTSVETALRAYVKEHYPNGVCTVYGKKIDGQQTIIACIESHQFQAKNFWNGRWRSEWKFTITPFNHSSGWHLENSGSLL

SEQ ID NO: 904236 - protein, 199 aa, Homo sapiens; identical to SEQ ID NO: 904235

SEQ ID NO: 904237 - protein, 155 aa, Homo sapiens
MADLEEQLSDEEKVRIAAKFIIHAPPGEFNEVFNDVRLLLNNDNLLREGAAHAFAQYNLDQFTPVKIEGYEDQVLITEHGDLGNGKFLDPKNRICFKFDHLRKEATDPRPCEVENAVESWRTSVETALRAYVKEHYPNGVCTCKSSVAALCVCFV

SEQ ID NO: 904238 - protein, 147 aa, Homo sapiens
MADLEEQLSDEEKVRIAAKFIIHAPPGEFNEVFNDCFGYCLIMQSSQGQGSSPMAFATAINLGGTQGFNRSPRLTNTTSTRVTERISATWIKPEPWRLGKWQSFRIQRTESVLNLVHTDTEGPKNLLGKFSPKRETPPFWGFGAKRG

SEQ ID NO: 904239 - protein, 199 aa, Homo sapiens; identical to SEQ ID NO: 904235

SEQ ID NO: 904240 - protein, 199 aa, Homo sapiens; identical to SEQ ID NO: 904235

SEQ ID NO: 904241 - protein, 199 aa, Homo sapiens; identical to SEQ ID NO: 904235

SEQ ID NO: 904242 - protein, 199 aa, Homo sapiens; identical to SEQ ID NO: 904235

SEQ ID NO: 904243 - protein, 199 aa, Homo sapiens; identical to SEQ ID NO: 904235

SEQ ID NO: 904244 - protein, 117 aa, Homo sapiens
MVVGGQNGSLQSLLSTTQVVGILKIQVHYYEDGNVQLVSHKDIQDSLTVSNEVQTAKEFIKIVEAAENEYQTAISENYQTMSDTTFKALRRQLPVTRTKIDWNKILSYKIGKEMQNA

SEQ ID NO: 904245 - protein, 117 aa, Homo sapiens; identical to SEQ ID NO: 904244

SEQ ID NO: 904246 - protein, 268 aa, Homo sapiens
MADLEEQLSDEEKVRIAAKFIIHAPPGEFNEVFNDVRLLLNNDNLLREGAAHAFAQYNLDQFTPVKIEGYEDQVLITEHGDLGNGKFLDPKNRICFKFDHLRKEATDPRPCEVENAVESWRTSVETALRAYVKEHYPNGVCTVYGKKIDGQQTIIACIESHQFQAKNFWNGRWRSEWKFTITPFNHSSGWHLENSDSLTVSNEVQTAKEFIKIVEAAENEYQTAISENYQTMSDTTFKALRRQLPVTRTKIDWNKILSYKIGKEMQNA

SEQ ID NO: 904247 - protein, 199 aa, Homo sapiens; identical to SEQ ID NO: 904235

SEQ ID NO: 904248 - protein, 233 aa, Homo sapiens
MADLEEQLSDEEKVRIAAKFIIHAPPGEFNEVFNDVRLLLNNDNLLREGAAHAFAQYNLDQFTPVKIEGYEDQVLITEHGDLGNGKFLDPKNRICFKFDHLRKEATDPRPCEVENAVESWRTSVETALRAYVKEHYPNGVCTVYGKKIDGQQTIIACIESHQFQAKNFWNGRWRSEWKFTITPFNHSSGWHLENSDSLTVSIESATKEFIKIVEAAEMNTRLPSVRIIRPMST

SEQ ID NO: 904249 - protein, 162 aa, Homo sapiens
MADLEEQLSDEEKVRIAAKFIIHAPPGEFNEVFNDVRLLLNNDNLLREGAAHAFAQYNLDQFTPVKIEGYEDQVLITEHGDLGNGKFLDPKNRICFKFDHLRKEATDPRPCEVENAVESWRTSVETALRAYVKEHYPNGVCTRSYANAASAPKKLAVRTAKS

SEQ ID NO: 904250 - protein, 199 aa, Homo sapiens; identical to SEQ ID NO: 904235

SEQ ID NO: 904251 - protein, 199 aa, Homo sapiens; identical to SEQ ID NO: 904235

SEQ ID NO: 904252 - protein, 199 aa, Homo sapiens; identical to SEQ ID NO: 904235

SEQ ID NO: 904253 - protein, 117 aa, Homo sapiens; identical to SEQ ID NO: 904244

SEQ ID NO: 904254 - protein, 174 aa, Homo sapiens
MADLEEQLSDEEKVRIAAKFIIHAPPGEFNEVFNDVRLLLNNDNLLREGAAHAFAQYNLDQFTPVKIEGYEDQVLITEHGDLGNGKFLDPKNRICFKFDHLRKEATDPRPCEVENAVESWRTSVETALRAYVKEHYPNGVCTVYGKKIDGQQTIIACIESHQFQAKNFCCCFYF

SEQ ID NO: 904255 - protein, 179 aa, Homo sapiens
MADLEEQLSDEEKVRIAAKFIIHAPPGEFNEVFNDVRLLLNNDNLLREGAAHAFAQYNLDQFTPVKIEGYEDQVLITEHGDLGNGKFLDPKNRICFKFDHLRKEATDPRPCEVENAVESWRTSVETALRAYVKEHYPNGVCTLLFLFLRNGRWRSEWKFTITPFNHSSGWHLENSGSLL

SEQ ID NO: 904256 - protein, 248 aa, Homo sapiens
MWLCPLALNLILMAASGAVCEVKDVCVGSPGIPGTPGSHGLPGRDGRDGLKGDPGPPGPMGPPGEMPCPPGNDGLPGAPGIPGECGEKGEPGERGPPGLPAHLDEELQATLHDFRHQILQTRGALSLQGSIMTVGEKVFSSNGQSITFDAIQEACARAGGRIAVPRNPEENEAIASFVKKYNTYAYVGLTEGPSPGDFRYSDGTPVNYTNWYRGEPAGRGKEQCVEMYTDGQWNDRNCLYSRLTICEF

SEQ ID NO: 904257 - protein, 263 aa, Homo sapiens
MRPCQVPGAATGPRAMWLCPLALNLILMAASGAVCEVKDVCVGSPGIPGTPGSHGLPGRDGRDGLKGDPGPPGPMGPPGEMPCPPGNDGLPGAPGIPGECGEKGEPGERGPPGLPAHLDEELQATLHDFRHQILQTRGALSLQGSIMTVGEKVFSSNGQSITFDAIQEACARAGGRIAVPRNPEENEAIASFVKKYNTYAYVGLTEGPSPGDFRYSDGTPVNYTNWYRGEPAGRGKEQCVEMYTDGQWNDRNCLYSRLTICEF

SEQ ID NO: 904258 - protein, 275 aa, Homo sapiens
LPYPLTGRQRPKQLEALCVGAATGPRAMWLCPLALNLILMAASGAVCEVKDVCVGSPGIPGTPGSHGLPGRDGRDGLKGDPGPPGPMGPPGEMPCPPGNDGLPGAPGIPGECGEKGEPGERGPPGLPAHLDEELQATLHDFRHQILQTRGALSLQGSIMTVGEKVFSSNGQSITFDAIQEACARAGGRIAVPRNPEENEAIASFVKKYNTYAYVGLTEGPSPGDFRYSDGTPVNYTNWYRGEPAGRGKEQCVEMYTDGQWNDRNCLYSRLTICEF

SEQ ID NO: 904259 - protein, 117 aa, Homo sapiens
MTVGEKVFSSNGQSITFDAIQEACARAGGRIAVPRNPEENEAIASFVKKYNTYAYVGLTEGPSPGDFRYSDGTPVNYTNWYRGEPAGRGKEQCVEMYTDGQWNDRNCLYSRLTICEF

SEQ ID NO: 904260 - protein, 226 aa, Homo sapiens
SPARDSWSKRPKQLEALCVGAATGPRAMWLCPLALNLILMAASGAVCEVKDVCVGSPGIPGECGEKGEPGERGPPGLPAHLDEELQATLHDFRHQILQTRGALSLQGSIMTVGEKVFSSNGQSITFDAIQEACARAGGRIAVPRNPEENEAIASFVKKYNTYAYVGLTEGPSPGDFRYSDGTPVNYTNWYRGEPAGRGKEQCVEMYTDGQWNDRNCLYSRLTICEF

SEQ ID NO: 904261 - protein, 248 aa, Homo sapiens; identical to SEQ ID NO: 904256

SEQ ID NO: 904262 - protein, 248 aa, Homo sapiens; identical to SEQ ID NO: 904256

SEQ ID NO: 904263 - protein, 248 aa, Homo sapiens; identical to SEQ ID NO: 904256

SEQ ID NO: 904264 - protein, 248 aa, Homo sapiens; identical to SEQ ID NO: 904256

SEQ ID NO: 904265 - protein, 248 aa, Homo sapiens; identical to SEQ ID NO: 904256

SEQ ID NO: 904266 - protein, 125 aa, Homo sapiens
MLQLVKNLRCIRRIVSPVEPVCMTSSVDDDMEPHLIPHLVQFLHLQMAAVRSWGRRTLQSHTKCLPPGPLSSLSATQCHQDEQSWPSIMTERGRLRGSPDCAELRTQWRFSGTLRSLWQAWSGSP

SEQ ID NO: 904267 - protein, 248 aa, Homo sapiens; identical to SEQ ID NO: 904256

SEQ ID NO: 904268 - protein, 157 aa, Homo sapiens
MRPCQVPGAATGPRAMWLCPLALNLILMAASGAVCEVKDVCVGSPGIPGTPGSHGLPGRDGRDGLKGDPGPPGPMGPPGEMPCPPGNDGLPGAPGIPGECGEKGEPGERGPPAMWTTGKRRPLSSSSLKKSFPSGIRSDLSTVGRTPPATRASYRIR

SEQ ID NO: 904269 - protein, 248 aa, Homo sapiens; identical to SEQ ID NO: 904256

SEQ ID NO: 904270 - protein, 248 aa, Homo sapiens; identical to SEQ ID NO: 904256

SEQ ID NO: 904271 - protein, 275 aa, Homo sapiens
RQHGIPGARDPKQLEALCVGAATGPRAMWLCPLALNLILMAASGAVCEVKDVCVGSPGIPGTPGSHGLPGRDGRDGLKGDPGPPGPMGPPGEMPCPPGNDGLPGAPGIPGECGEKGEPGERGPPGLPAHLDEELQATLHDFRHQILQTRGALSLQGSIMTVGEKVFSSNGQSITFDAIQEACARAGGRIAVPRNPEENEAIASFVKKYNTYAYVGLTEGPSPGDFRYSDGTPVNYTNWYRGEPAGRGKEQCVEMYTDGQWNDRNCLYSRLTICEF

SEQ ID NO: 904272 - protein, 248 aa, Homo sapiens; identical to SEQ ID NO: 904256

SEQ ID NO: 904273 - protein, 248 aa, Homo sapiens; identical to SEQ ID NO: 904256

SEQ ID NO: 904274 - protein, 248 aa, Homo sapiens; identical to SEQ ID NO: 904256

SEQ ID NO: 904275 - protein, 248 aa, Homo sapiens; identical to SEQ ID NO: 904256

SEQ ID NO: 904276 - protein, 248 aa, Homo sapiens; identical to SEQ ID NO: 904256

SEQ ID NO: 904277 - protein, 76 aa, Homo sapiens
GYRGPYATLSDSHSSDGPRYSFRPYIQLIMACRTPVGILTPVMNARRPLLSIGLSTVVDVRRRPYIGICLPGCPSR

SEQ ID NO: 904278 - protein, 260 aa, Homo sapiens
MRPCQVPGAATGPRAMWLCPLALNLILMAASGAVCEVKDVCVGSPGIPGTPGSHGLPGRDGRDGLKGDPGPPGPMGPPGEMPCPPGNDGLPGAPGIPGECGEKGEPGERGPPGLPAHLDEELQATLHDFRHQILQTRGALSLQGSIMTVGEKVFSSNGQSITFDAIQEACARAGGRIAVPRNPEENEAIASFVKKYNTYAYVGLTEGPSPGDFRYSDGTPVNYTNWYRGEPAGRGKEQCVEMYTDGQWNDRNCLYSRLTI

SEQ ID NO: 904279 - protein, 156 aa, Homo sapiens
RACDPPSGRKRLTMATATEQWVLVEMVQALYEAPAYHLILEGILILWIIRLLFSKTYKLQERSDLTVKEKEELIEEWQPEPLVPPVPKDHPALNYNIVSGPPSHKTVVNGKECINFASFNFLGLLDNPRVKAAALASLKKYGVGTCGPRGFYGTFE

SEQ ID NO: 904280 - protein, 486 aa, Homo sapiens
RACDPPSGRKRLTMATATEQWVLVEMVQALYEAPAYHLILEGILILWIIRLLFSKTYKLQERSDLTVKEKEELIEEWQPEPLVPPVPKDHPALNYNIVSGPPSHKTVVNGKECINFASFNFLGLLDNPRVKAAALASLKKYGVGTCGPRGFYGTFDVHLDLEDRLAKFMKTEEAIIYSYGFATIASAIPAYSKRGDIVFVDRAACFAIQKGLQASRSDIKLFKHNDMADLERLLKEQEIEDQKNPRKARVTRRFIVVEGLYMNTGTICPLPELVKLKYKYKARIFLEESLSFGVLGEHGRGVTEHYGINIDDIDLISANMENALASIGGFCCGRSFVIDHQRLSGQGYCFSASLPPLLAAAAIEALNIMEENPGIFAVLKEKCGQIHKALQGISGLKVVGESLSPAFHLQLEESTGSREQDVRLLQEIVDQCMNRSIALTQARYLEKEEKCLPPPSIRVVVTVEQTEEELERAASTIKEVAQAVLL

SEQ ID NO: 904281 - protein, 351 aa, Homo sapiens
MYDFKYSEFPGSHQRRPAFYDVHLDLEDRLAKFMKTEEAIIYSYGFATIASAIPAYSKRGDIVFVDRAACFAIQKGLQASRSDIKLFKHNDMADLERLLKEQEIEDQKNPRKARVTRRFIVVEGLYMNTGTICPLPELVKLKYKYKARIFLEESLSFGVLGEHGRGVTEHYGINIDDIDLISANMENALASIGGFCCGRSFVIDHQRLSGQGYCFSASLPPLLAAAAIEALNIMEENPGIFAVLKEKCGQIHKALQGISGLKVVGESLSPAFHLQLEESTGSREQDVRLLQEIVDQCMNRSIALTQARYLEKEEKCLPPPSIRVVVTVEQTEEELERAASTIKEVAQAVLL

SEQ ID NO: 904282 - protein, 260 aa, Homo sapiens [sequence omitted]

SEQ ID NO: 904283 - protein, 366 aa, Homo sapiens
VVTSGWFARVKAAALASLKKYGVGTCGPRGFYGTFDVHLDLEDRLAKFMKTEEAIIYSYGFATIASAIPAYSKRGDIVFVDRAACFAIQKGLQASRSDIKLFKHNDMADLERLLKEQEIEDQKNPRKARVTRRFIVVEGLYMNTGTICPLPELVKLKYKYKARIFLEESLSFGVLGEHGRGVTEHYGINIDDIDLISANMENALASIGGFCCGRSFVIDHQRLSGQGYCFSASLPPLLAAAAIEALNIMEENPGIFAVLKEKCGQIHKALQGISGLKVVGESLSPAFHLQLEESTGSREQDVRLLQEIVDQCMNRSIALTQARYLEKEEKCLPPPSIRVVVTVEQTEEELERAASTIKEVAQAVLL

SEQ ID NO: 904284 - protein, 112 aa, Homo sapiens
MWGRRISQLSGVYRCHQGISGLKVVGESLSPAFHLQLEESTGSREQDVRLLQEIVDQCMNRSIALTQARYLEKEEKCLPPPSIRVVVTVEQTEEELERAASTIKEVAQAVLL

SEQ ID NO: 904285 - protein, 280 aa, Homo sapiens
RACDPPSGRKRLTMATATEQWVLVEMVQALYEAPAYHLILEGILILWIIRLLFSKTYKLQERSDLTVKEKEELIEEWQPEPLVPPVPKDHPALNYNIVSGPPSHKTVVNGKECINFASFNFLGLLDNPRVKAAALASLKKYGVGTCGPRGFYGTFDVHLDLEDRLAKFMKTEEAIIYSYGFATIASAIPAYSKRGDIVFVDRAACFAIQKGLQASRSDIKLFKHNDMADLERLLKEQEIEDQKNPRKARVTRRFIVVEGLYMNTGTICPLPELVSNHVQL

SEQ ID NO: 904286 - protein, 137 aa, Homo sapiens
RACDPPSGRKRLTMATATEQWVLVEMVQALYEAPAYHLILEGILILWIIRLLFSKTYKLQERSDLTVKEKEELIEEWQPEPLVPPVPKDHPALNYNIVSGPPSHKTVVNGKECINFASFNFLGLLDNPRVKVSSTYC

SEQ ID NO: 904287 - protein, 150 aa, Homo sapiens
MATATEQWVLVEMVQALYEAPAYHLILEGILILWIIRLLFSKTYKLQERSDLTVKEKEELIEEWQPEPLVPPVPKDHPALNYNIVSGPPSHKTVVNGKECINFASFNFLGLLDNPRVKAAALASLKKYGVGTCGPRGFYGTFGKFLLCSL

SEQ ID NO: 904288 - protein, 486 aa, Homo sapiens; identical to SEQ ID NO: 904280

SEQ ID NO: 904289 - protein, 486 aa, Homo sapiens; identical to SEQ ID NO: 904280

SEQ ID NO: 904290 - protein, 318 aa, Homo sapiens
MKTEEAIIYSYGFATIASAIPAYSKRGDIVFVDRAACFAIQKGLQASRSDIKLFKHNDMADLERLLKEQEIEDQKNPRKARVTRRFIVVEGLYMNTGTICPLPELVKLKYKYKARIFLEESLSFGVLGEHGRGVTEHYGINIDDIDLISANMENALASIGGFCCGRSFVIDHQRLSGQGYCFSASLPPLLAAAAIEALNIMEENPGIFAVLKEKCGQIHKALQGISGLKVVGESLSPAFHLQLEESTGSREQDVRLLQEIVDQCMNRSIALTQARYLEKEEKCLPPPSIRVVVTVEQTEEELERAASTIKEVAQAVLL

SEQ ID NO: 904291 - protein, 486 aa, Homo sapiens
RACDPPSGRKRLTMATATEQWVLVEMVQALYEAPAYHLILEGILILWIIRLLFSKTYKLQERSDLTVKEKEELIEEWQPEPLVPPVPKDHPALNYNIVSGPPSHKTVVNGKECINFASFNFLGLLDNPRVKAAALASLKKYGVGTCGPRGFYGTFDVHLDLEDRLAKFMKTEEAIIYSYGFATIASAIPAYSKRGDIVFVDRAACFAIQKGLQASRSDIKLFKHNDMADLERLLKEQEIEDQKNPRKARVTRRFIVVEGLYMNTGTICPLPELVKLKYKYKARIFLEESLSFGVLGEHGRGVTEHYGINIDDIDLISANMENALASIGGFCCGRSFVIDHQRLSGQGYCFSASLPPLLAAAAIEALNIMEENPGIFAVLKEKCGQIHKALQGISGLKVVGESLSPAFHLQLEESTGSREQDVRLLQEIVDQCMNRSIALTQARYLEKEEKCLPPPSIRVVVTVEQTEHNWSSFRTKAATFTPPLRS

SEQ ID NO: 904292 - protein, 239 aa, Homo sapiens
RACDPPSGRKRLTMATATEQWVLVEMVQALYEAPAYHLILEGILILWIIRLLFSKTYKLQERSDLTVKEKEELIEEWQPEPLVPPVPKDHPALNYNIVSGPPSHKTVVNGKECINFASFNFLGLLDNPRVKAAALASLKKYGVGTCGPRGFYGTFDVHLDLEDRLAKFMKTEEAIIYSYGFATIASAIPAYSKRGDIVFVYSTTRAASYAKSRRGVTRMKEATGGYPKQNEMAVPEKRR

SEQ ID NO: 904293 - protein, 100 aa, Homo sapiens
RACDPPSGRKRLTMATATEQWVLVEMVQALYEAPAYHLILEGILILWIIRLLFSKTYKLQERSDLTVKEKEELIEEWQPEPLVPPVPKDHPALNYNIVSG

SEQ ID NO: 904294 - protein, 105 aa, Homo sapiens
MLDYRRPEVLIYNGQLDIIVAAALTERSLMGMDWKGSQEYKKAEKKVWKIFKSDSEVAGYIRQAGDFHQVIIRGGGHILPYDQPLRAFDMINRFIYGKGWDPYVG

SEQ ID NO: 904295 - protein, 472 aa, Homo sapiens [sequence omitted]

SEQ ID NO: 904296 - protein, 472 aa, Homo sapiens [sequence omitted]

SEQ ID NO: 904297 - protein, 406 aa, Homo sapiens
MGCFAPYTEVFPCHLRETQDSHYFSPIQPEDAPVVLWLQGGPGGSSMFGLFVEHGPYVVTSNMTLRDRDFPWTTTLSMLYIDNPVGTGFSFTDDTHGYAVNEDDVARDLYSALIQFFQIFPEYKNNDFYVTGESYAGKYVPAIAHLIHSLNPVREVKINLNGIAIGDGYSDPESIIGGYAEFLYQIGLLDEKQKKYFQKQCHECIEHIRKQNWFEAFEILDKLLDGDLTSDPSYFQNVTGCSNYYNFLRCTEPEDQLYYVKFLSLPEVRQAIHVGNQTFNDGTIVEKYLREDTVQSVKPWLTEIMNNYKVLIYNGQLDIIVAAALTERSLMGMDWKGSQEYKKAEKKVWKIFKSDSEVAGYIRQAGDFHQVIIRGGGHILPYDQPLRAFDMINRFIYGKGWDPYVG

SEQ ID NO: 904298 - protein, 472 aa, Homo sapiens [sequence omitted]

SEQ ID NO: 904299 - protein, 91 aa, Homo sapiens
MNFSGLTFSPIDNRDYLFPSIGVLIYNGQLDIIVAAALTERSLMGMDWKGSQEYKKAEKKVWKIFKSDSEVAGYIRQAGDFHQVGRCLGAG

SEQ ID NO: 904300 - protein, 406 aa, Homo sapiens
MKSYAGFLTVNKTYNSNLFFWFFPAQIQPEDAPVVLWLQGGPGGSSMFGLFVEHGPYVVTSNMTLRDRDFPWTTTLSMLYIDNPVGTGFSFTDDTHGYAVNEDDVARDLYSALIQFFQIFPEYKNNDFYVTGESYAGKYVPAIAHLIHSLNPVREVKINLNGIAIGDGYSDPESIIGGYAEFLYQIGLLDEKQKKYFQKQCHECIEHIRKQNWFEAFEILDKLLDGDLTSDPSYFQNVTGCSNYYNFLRCTEPEDQLYYVKFLSLPEVRQAIHVGNQTFNDGTIVEKYLREDTVQSVKPWLTEIMNNYKVLIYNGQLDIIVAAALTERSLMGMDWKGSQEYKKAEKKVWKIFKSDSEVAGYIRQAGDFHQVIIRGGGHILPYDQPLRAFDMINRFIYGKGWDPYVG

SEQ ID NO: 904301 - protein, 406 aa, Homo sapiens; identical to SEQ ID NO: 904297

SEQ ID NO: 904302 - protein, 131 aa, Homo sapiens
GGCSGAGARAAAVALLGAPAVTAMAAPCLLRQGRAGALKTMLQEAQVFRGLASTVSLSAESGKSEKGQPQNSKKQSPPKKPAPVPAEPFDNTTYKNLQHHDYSTYTFLDLNLELSKFRMPQPSSGRESPRH

SEQ ID NO: 904303 - protein, 517 aa, Homo sapiens
GGCSGAGARAAAVALLGAPAVTAMAAPCLLRQGRAGALKTMLQEAQVFRGLASTVSLSAESGKSEKGQPQNSKKQSPPKNVVEPKERGKLLATQTAAELSKNLSSPSSYPPAVNKGRKVASPSPSGSVLFTDEGVPKFLSRKTLVEFPQKVLSPFRKQGSDSEARQVGRKVTSPSSSSSSSSSDSESDDEADVSEVTPRVVSKGRGGLRKPEASHSFENRAPRVTVSAKEKTLLQKPHVDITDPEKPHQPKKKGSPAKPSEGRENARPKTTMPRSQVDEEFLKQSLKEKQLQKTFRLNEIDKESQKPFEVKGPLPVHTKSGLSAPPKGSPAPAVLAEEARAEGQLQASPPGAAEGHLEKPVPEPQRKAAPPLPRKETSGTQGIEGHLKGGQAIVEDQIPPSNLETVPVENNHGFHEKTAALKLEAEGEAMEDAAAPGNDRGGTQGVPTPHRRYSPCGDWKDASSLKPAPVPAEPFDNTTYKNLQHHDYSTYTFLDLNLELSKFRMPQPSSGRESPRH

SEQ ID NO: 904304 - protein, 443 aa, Homo sapiens
GGCSGAGARAAAVALLGAPAVTAMAAPCLLRQGRAGALKTMLQEAQVFRGLASTVSLSAESGKSEKGQPQNSKKQSPPKNVVEPKERGKLLATQTAAELSKNLSSPSSYPPAVNKGRKVASPSPSGSVLFTDEGVPKFLSRKTLVEFPQKVLSPFRKQGSDSEARQVGRKVTSPSSSSSSSSSDSESDDEADVSEVTPRVVSKGRGGLRKPEASHSFENRAPRVTVSAKEKTLLQKPHVDITDPEKPHQPKKKGSPAKPSEGRENARPKTTMPRSQVDEEFLKQSLKEKQLQKTFRLNEIDKESQKPFEVKGPLPVHTKSGLSAPPKGSPAPAVLAEEARAEGQLQASPPGAAEGHLEKPVPEPQRKAAPPLPRKETSGTQGIEGHLKGGQAIVEDQIPPSNLETVPVENNHGFHEKTAALKNLELSKFRMPQPSSGRESPRH

SEQ ID NO: 904305 - protein, 455 aa, Homo sapiens
RLFRRGCARSCCGPAWCARCHRHGCPVFAAARTSRGAEDVVEPKERGKLLATQTAAELSKNLSSPSSYPPAVNKGRKVASPSPSGSVLFTDEGVPKFLSRKTLVEFPQKVLSPFRKQGSDSEARQVGRKVTSPSSSSSSSSSDSESDDEADVSEVTPRVVSKGRGGLRKPEASHSFENRAPRVTVSAKEKTLLQKPHVDITDPEKPHQPKKKGSPAKPSEGRENARPKTTMPRSQVDEEFLKQSLKEKQLQKTFRLNEIDKESQKPFEVKGPLPVHTKSGLSAPPKGSPAPAVLAEEARAEGQLQASPPGAAEGHLEKPVPEPQRKAAPPLPRKETSGTQGIEGHLKGGQAIVEDQIPPSNLETVPVENNHGFHEKTAALKLEAEGEAMEDAAAPGNDRGGTQEPAPVPAEPFDNTTYKNLQHHDYSTYTFLDLNLELSKFRMPQPSSGRESPRH

SEQ ID NO: 904306 - protein, 112 aa, Homo sapiens
GGCSGAGARAAAVALLGAPAVTAMAAPCLLRQGRAGALKTMLQEAQVFRGLASTVSLSAESGKSEKGQPQNSKKQSPPKNVVEPKERGKLLATQTAAELSKNLSSPSSYPPA

SEQ ID NO: 904307 - protein, 496 aa, Homo sapiens
GGCSGAGARAAAVALLGAPAVTAMAAPCLLRQGRAGALKTMLQEAQVFRGLASTVSLSAESGKSEKGQPQNSKKQSPPKNVVEPKERGKLLATQTAAELSKNLSSPSSYPPAVNKGRKVASPSPSGSVLFTDEGVPKFLSRKTLVEFPQKVLSPFRKQGSDSEARQVGRKVTSPSSSSSSSSSDSESDDEADVSEVTPRVVSKGRGGLRKPEASHSFENRAPRVTVSAKEKTLLQKPHVDITDPEKPHQPKKKGSPAKPSEGRENARPKTTMPRSQVDEEFLKQSLKEKQLQKTFRLNEIDKESQKPFEVKGPLPVHTKSGLSAPPKGSPAPAVLAEEARAEGQLQASPPGAAEGHLEKPVPEPQRKAAPPLPRKETSGTQGIEGHLKGGQAIVEDQIPPSNLETVPVENNHGFHEKTAALKLEAEGEAMEDAAAPGNDRGGTQEPAPVPAEPFDNTTYKNLQHHDYSTYTFLDLNLELSKFRMPQPSSGRESPRH

SEQ ID NO: 904308 - protein, 382 aa, Homo sapiens
GGCSGAGARAAAVALLGAPAVTAMAAPCLLRQGRAGALKTMLQEAQVFRGLASTVSLSAESGKSEKGQPQNSKKQSPPKNVVEPKERGKLLATQTAAELSKNLSSPSSYPPAVNKGRKVASPSPSGSVLFTDEGVPKFLSRKTLVEFPQKVLSPFRKQGSDSEARQVGRKVTSPSSSSSSSSSDSESDDEADVSEVTPRVVSKGRGGLRKPEASHSFENRAPRVTVSAKEKTLLQKPHVDITDPEKPHQPKKKGSPAKPSEGRENARPKTTMPRSQVDEEFLKQSLKEKQLQKTFRLNEIDKESQKPFEVKGPLPVHTKSGLSAPPKGSQRLLCWQKRPEQRGSCKPVLLGRQRGIWKNPCQSPSARRPLPCPERKPQGRRE

SEQ ID NO: 904309 - protein, 131 aa, Homo sapiens; identical to SEQ ID NO: 904302

SEQ ID NO: 904310 - protein, 762 aa, Homo sapiens
QGERYILVKKTNDDWWQVKPDENSKAFYVPAQYVKEVTRKALMPPVKQVAGLPNNSTKIMQSLHLQRSTENVNKLPELSSFGKPSSSVQGTGLIRDANQNFGPSYNQGQTVNLSLDLTHNNGKFNNDSHSPKVSSQNRTRSFGHFPGPEFLDVEKTSFSQEQSCDSAGEGSERIHQDSESGDELSSSSTEQIRATTPPNQGRPDSPVYANLQELKISQSALPPLPGSPAIQINGEWETHKDSSGRCYYYNRGTQERTWKPPRWTRDASISKGDFQNPGDQEWLKHVDDQGRQYYYSADGSRSEWELPKYNASSQQQREIIKSRSLDRRLQEPIVLTKWRHSTIVLDTNDKESPTASKPCFPENESSPSSPKHQDTAASDQEKYGLLNVTKIAENGKKVRKNWLSSWAVLQGSSLLFTKTQGSSTSWFGSNQSKPEFTVDLKGATIEMASKDKSSKKNVFELKTRQGTELLIQSDNDTVINDWFKVLSSTINNQAVETDEGIEEEIPDSPGIEKHDKEKEQKDPKKLRSFKVSSIDSSEQKKTKKNLKKFLTRRPTLQAVREKGYIKDQVFGSNLANLCQRENGTVPKFVKLCIEHVEEHGLDIDGIYRVSGNLAVIQKLRFAVNHDEKLDLNDSKWEDIHVITGALKMFFRELPEPLFTFNHFNDFVNAIKQEPRQRVAAVKDLIRQLPKPNQDTMQILFRHLRRVIENGEKNRMTYQSIAIVFGPTLLKPEKETGNIAVHTVYQNQIVELILLELSSIFGR

SEQ ID NO: 904311 - protein, 316 aa, Homo sapiens
MASKDKSSKKNVFELKTRQGTELLIQSDNDTVINDWFKVLSSTINNQAVETDEGIEEEIPDSPGIEKHDKEKEQKDPKKLRSFKVSSIDSSEQKKTKKNLKKFLTRRPTLQAVREKGYIKDQVFGSNLANLCQRENGTVPKFVKLCIEHVEEHGLDIDGIYRVSGNLAVIQKLRFAVNHDEKLDLNDSKWEDIHVITGALKMFFRELPEPLFTFNHFNDFVNAIKQEPRQRVAAVKDLIRQLPKPNQDTMQILFRHLRRVIENGEKNRMTYQSIAIVFGPTLLKPEKETGNIAVHTVYQNQIVELILLELSSIFGR

SEQ ID NO: 904312 - protein, 809 aa, Homo sapiens
QGERYILVKKTNDDWWQVKPDENSKAFYVPAQYVKEVTRKALMPPVKQVAGLPNNSTKIMQSLHLQRSTENVNKLPELSSFGKPSSSVQGTGLIRDANQNFGPSYNQGQTVNLSLDLTHNNGKFNNDSHSPKVSSQNRTRSFGHFPGPEFLDVEKTSFSQEQSCDSAGEGSERIHQDSESGDELSSSSTEQIRATTPPNQGRPDSPVYANLQELKISQSALPPLPGSPAIQINGEWETHKDSSGRCYYYNRGTQERTWKPPRWTRDASISKGDFQNPGDQELLSSEENYYSTSYSQSDSQCGSPPRGWSEELDERGHTLYTSDYTNEKWLKHVDDQGRQYYYSADGSRSEWELPKYNASSQQQREIIKSRSLDRRLQEPIVLTKWRHSTIVLDTNDKESPTASKPCFPENESSPSSPKHQDTAASDQEKYGLLNVTKIAENGKKVRKNWLSSWAVLQGSSLLFTKTQGSSTSWFGSNQSKPEFTVDLKGATIEMASKDKSSKKNVFELKTRQGTELLIQSDNDTVINDWFKVLSSTINNQAVETDEGIEEEIPDSPGIEKHDKEKEQKDPKKLRSFKVSSIDSSEQKKTKKNLKKFLTRRPTLQAVREKGYIKDQVFGSNLANLCQRENGTVPKFVKLCIEHVEEHGLDIDGIYRVSGNLAVIQKLRFAVNHDEKLDLNDSKWEDIHVITGALKMFFRELPEPLFTFNHFNDFVNAIKQEPRQRVAAVKDLIRQLPKPNQDTMQILFRHLRRVIENGEKNRMTYQSIAIVFGPTLLKPEKETGNIAVHTVYQNQIVELILLELSSIFGR

SEQ ID NO: 904313 - protein, 588 aa, Homo sapiens
GSLLRIGHAHCSSSTEQIRATTPPNQGRPDSPVYANLQELKISQSALPPLPGSPAIQINGEWETHKDSSGRCYYYNRGTQERTWKPPRWTRDASISKGDFQNPGDQEWLKHVDDQGRQYYYSADGSRSEWELPKYNASSQQQREIIKSRSLDRRLQEPIVLTKWRHSTIVLDTNDKESPTASKPCFPENESSPSSPKHQDTAASDQEKYGLLNVTKIAENGKKVRKNWLSSWAVLQGSSLLFTKTQGSSTSWFGSNQSKPEFTVDLKGATIEMASKDKSSKKNVFELKTRQGTELLIQSDNDTVINDWFKVLSSTINNQAVETDEGIEEEIPDSPGIEKHDKEKEQKDPKKLRSFKVSSIDSSEQKKTKKNLKKFLTRRPTLQAVREKGYIKDQVFGSNLANLCQRENGTVPKFVKLCIEHVEEHGLDIDGIYRVSGNLAVIQKLRFAVNHDEKLDLNDSKWEDIHVITGALKMFFRELPEPLFTFNHFNDFVNAIKQEPRQRVAAVKDLIRQLPKPNQDTMQILFRHLRRVIENGEKNRMTYQSIAIVFGPTLLKPEKETGNIAVHTVYQNQIVELILLELSSIFGR

SEQ ID NO: 904314 - protein, 307 aa, Homo sapiens
TRKDKGQMMSEVGEVDIREEEETSNNIVVQRYKTINNQAVETDEGIEEEIPDSPGIEKHDKEKEQKDPKKLRSFKVSSIDSSEQKKTKKNLKKFLTRRPTLQAVREKGYIKDQVFGSNLANLCQRENGTVPKFVKLCIEHVEEHGLDIDGIYRVSGNLAVIQKLRFAVNHDEKLDLNDSKWEDIHVITGALKMFFRELPEPLFTFNHFNDFVNAIKQEPRQRVAAVKDLIRQLPKPNQDTMQILFRHLRRVIENGEKNRMTYQSIAIVFGPTLLKPEKETGNIAVHTVYQNQIVELILLELSSIFGR

SEQ ID NO: 904315 - protein, 145 aa, Homo sapiens
MSNSCCFSDEKLDLNDSKWEDIHVITGALKMFFRELPEPLFTFNHFNDFVNAIKQEPRQRVAAVKDLIRQLPKPNQDTMQILFRHLRRVIENGEKNRMTYQSIAIVFGPTLLKPEKETGNIAVHTVYQNQIVELILLELSSIFGR

SEQ ID NO: 904316 - protein, 616 aa, Homo sapiens
QGERYILVKKTNDDWWQVKPDENSKAFYVPAQYVKEVTRKALMPPVKQVAGLPNNSTKIMQSLHLQRSTENVNKLPELSSFGKPSSSVQGTGLIRDANQNFGPSYNQGQTVNLSLDLTHNNGKFNNDSHSPKVSSQNRTRSFGHFPGPEFLDVEKTSFSQEQSCDSAGEGSERIHQDSESGDELSSSSTEQIRATTPPNQGRPDSPVYANLQELKISQSALPPLPGSPAIQINGEWETHKDSSGRCYYYNRGTQERTWKPPRWTRDASISKGDFQNPGDQELLSSEENYYSTSYSQSDSQCGSPPRGWSEELDERGHTLYTSDYTNEKWLKHVDDQGRQYYYSADGSRSEWELPKYNASSQQQREIIKSRSLDRRLQEPIVLTKWRHSTIVLDTNDKESPTASKPCFPENESSPSSPKHQDTAASDQEKYGLLNVTKIAENGKKVRKNWLSSWAVLQGSSLLFTKTQGSSTSWFGSNQSKPEFTVDLKGATIEMASKDKSSKKNVFELKTRQGTELLIQSDNDTVINDWFKVLSSTINNQAVETDEGIEEEIPDSPGIEKHDKEKEQKDPKKLRSFKVSSIDSSEQKKTKKNLKKFLTRRPTLQAVREKGYIKEGW

SEQ ID NO: 904317 - protein, 194 aa, Homo sapiens
QGERYILVKKTNDDWWQVKPDENSKAFYVPAQYVKEVTRKALMPPVKQVAGLPNNSTKIMQSLHLQRSTENVNKLPELSSFGKPSSSVQGTGLIRDANQNFGPSYNQGQTVNLSLDLTHNNGKFNNDSHSPKVSSQNRTRSFGHFPGPEFLDVEKTSFSQEQSCDSAGEGSERIHQDSESGDELSSSSTEQIRV

SEQ ID NO: 904318 - protein, 316 aa, Homo sapiens; identical to SEQ ID NO: 904311

SEQ ID NO: 904319 - protein, 795 aa, Homo sapiens
QGERYILVKKTNDDWWQVKPDENSKAFYVPAQYVKEVTRKALMPPVKQVAGLPNNSTKIMQSLHLQRSTENVNKLPELSSFGKPSSSVQGTGLIRDANQNFGPSYNQGQTVNLSLDLTHNNGKFNNDSHSPKVSSQNRTRSFGHFPGPEFLDVEKTSFSQEQSCDSAGEGSERIHQDSESGDELSSSSTEQIRATTPPNQGRPDSPVYANLQELKISQSALPPLPGSPAIQINGEWETHKDSSGRCYYYNRGTQERTWKPPRWTRDASISKGDFQNPGDQELLSSEENYYSTSYSQSDSQCGSPPRGWSEELDERGHTLYTSDYTNEKWLKHVDDQGRQYYYSADGSRSEWELPKYNASSQQQREIIKSRSLDRRLQEPIVLTKWRHSTIVLDTNDKESPTASKPCFPENESSPSSPKHQDTAASDQEKYGLLNVTKIAENGKKVRKNWLSSWAVLQGSSLLFTKTQGSSTSWFGSNQSKPEFTVDLKGATIEMASKDKSSKKNVFELKTRQGTELLIQSDNDTVINDWFKVLSSTINNQAVETDEGIEEEIPDSPGIEKHDKEKEQKDPKKLRSFKVSSIDSSEQKKTKKNLKKFLTRRPTLQAVREKGYIKENGTVPKFVKLCIEHVEEHGLDIDGIYRVSGNLAVIQKLRFAVNHDEKLDLNDSKWEDIHVITGALKMFFRELPEPLFTFNHFNDFVNAIKQEPRQRVAAVKDLIRQLPKPNQDTMQILFRHLRRVIENGEKNRMTYQSIAIVFGPTLLKPEKETGNIAVHTVYQNQIVELILLELSSIFGR

SEQ ID NO: 904320 - protein, 809 aa, Homo sapiens; identical to SEQ ID NO: 904312

SEQ ID NO: 904321 - protein, 590 aa, Homo sapiens
QGERYILVKKTNDDWWQVKPDENSKAFYVPAQYVKEVTRKALMPPVKQVAGLPNNSTKIMQSLHLQRSTENVNKLPELSSFGKPSSSVQGTGLIRDANQNFGPSYNQGQTVNLSLDLTHNNGKFNNDSHSPKVSSQNRTRSFGHFPGPEFLDVEKTSFSQEQSCDSAGEGSERIHQDSESGDELSSSSTEQIRATTPPNQGRPDSPVYANLQELKISQSALPPLPGSPAIQINGEWETHKDSSGRCYYYNRGTQERTWKPPRWTRDASISKGDFQNPGDQELLSSEENYYSTSYSQSDSQCGSPPRGWSEELDERGHTLYTSDYTNEKWLKHVDDQGRQYYYSADGSRSEWELPKYNASSQQQREIIKSRSLDRRLQEPIVLTKWRHSTIVLDTNDKASDQEKYGLLNVTKIAENGKKVRKNWLSSWAVLQGSSLLFTKTQGSSTSWFGSNQSKPEFTVDLKGATIEMASKDKSSKKNVFELKTRQGTELLIQSDNDTVINDWFKVLSSTINNQAVETDEGIEEEIPDSPGIEKHDKEKEQKDPKKLRSFKVSSIDSSEQKKTKKNLKKFLTRRPTLQAVREKGYIKEGW

SEQ ID NO: 904322 - protein, 145 aa, Homo sapiens; identical to SEQ ID NO: 904315

SEQ ID NO: 904323 - protein, 191 aa, Homo sapiens
MCFSRADAADNYPFGTCQQRKLFPHFHPPNLIGNKFVPLRGSPHRGPGCYFSDGYGLAYDLSKIPTSIKGYTLGARTAVRFKPIQKEMTPHAGRYQKVSPQQEKHKQNFAPFNVLVPRFKNYPKDTYYPSPGAYNPEKKPPPKIAWPMKFGSPDWAQVPCLQKRTLKAELSTDKDFRKHRNRVAYLSLYYN

SEQ ID NO: 904324 - protein, 139 aa, Homo sapiens
MSFTQRHYTLVEPGTEEGGFKPNSQKETDILSCKCDGYARKLDPSMTGINNMDMSLAPVNNVLVPRFKNYPKDTYYPSPGAYNPEKKPPPKIAWPMKFGSPDWAQVPCLQKRTLKAELSTDKDFRKHRNRVAYLSLYYN

SEQ ID NO: 904325 - protein, 155 aa, Homo sapiens
MCFSRADAADNYPFGTCQQRKLFPHFHPPNLIGNKFVPLRGSPHRGPGCYFSDGYGLAYDLSKIPTSIKGYTLGARTAVRFKPIQKEMTPHAGRYQKVSPQQEKHKQNFAPFNVLVPRFKNYPKDTYYPSMSPPFWCTSTKKAIGGKEVRNKRST

SEQ ID NO: 904326 - protein, 177 aa, Homo sapiens
MCFSRADAADNYPFGTCQQRKLFPHFHPPNLIGNKFVPLRGSPHRGPGCYFSDGYGLAYDLSKIPTSIKGYTLGARTAVRFKPIQKEMTPHAGRYQKVSPQQEKHKQNFAPFNVLVPRFKNYPKDTYYPSAWPMKFGSPDWAQVPCLQKRTLKAELSTDKDFRKHRNRVAYLSLYYN

SEQ ID NO: 904327 - protein, 191 aa, Homo sapiens; identical to SEQ ID NO: 904323

SEQ ID NO: 904328 - protein, 158 aa, Homo sapiens
MCFSRADAADNYPFGTCQQRKLFPHFHPPNLIGNKFVPLRGSPHRGPGCYFSDEMTPHAGRYQKVSPQQEKHKQNFAPFNVLVPRFKNYPKDTYYPSPGAYNPEKKPPPKIAWPMKFGSPDWAQVPCLQKRTLKAELSTDKDFRKHRNRVAYLSLYYN

SEQ ID NO: 904329 - protein, 175 aa, Homo sapiens
PPPRAPQLGITGLAFVSLATQYTSASPSSSRCASAEQGYGLAYDLSKIPTSIKGYTLGARTAVRFKPIQKEMTPHAGRYQKVSPQQEKHKQNFAPFNVLVPRFKNYPKDTYYPSPGAYNPEKKPPPKIAWPMKFGSPDWAQVPCLQKRTLKAELSTDKDFRKHRNRVAYLSLYYN

SEQ ID NO: 904330 - protein, 560 aa, Homo sapiens
MWGRFLAPEASGRDSPGGARSFPAGPDYSSAWLPANESLWQATTVPSNHRNNHIRRHSIASDSGDTGIGTSCSDSVEDHSTSSGTLSFKPSQSLITLPTAHVMPSNSSASISKLRESLTPDGSKWSTSLMQTLGNHSRGEQDSSLDMKDFRPLRKWSSLSKLTAPDNCGQGGTVCREESRNGLEKIGKAKALTSQLRTIGPSCLHDSMEMLRLEDKEINKKRSSTLDCKYKFESCSKEDFRASSSTLRRQTVDMTYSALPESKPIMTSSEAFEPPKYLMLGQQAVGGVPIQPSVRTQMWLTEQLRTNPLEGRNTEDSYSLAPWQQQQIEDFRQGSETPMQVLTGSSRQSYSPGYQDFSKWESMLKIKEGLLRQKEIVIDRQKQQITHLHERIRDNELRAQHAMLGHYVNCEDSYVASLQPQYENTSLQTPFSEESVSHSQQGEFEQKLASTEKEVLQLNEFLKQRLSLFSEEKKKLEEKLKTRDRYISSLKKKCQKESEQNKEKQRRIETLEKYLADLPTLDDVQSQSLQLQILEEKNKNLQEALIDTEKKLEEIKKQLS

SEQ ID NO: 904331 - protein, 805 aa, Homo sapiens [sequence omitted]

SEQ ID NO: 904332 - protein, 808 aa, Homo sapiens [sequence omitted]

SEQ ID NO: 904333 - protein, 753 aa, Homo sapiens
CTKQETKGALKKNLLSLTPAFHLALYHSTSSGTLSFKPSQSLITLPTAHVMPSNSSASISKLRESLTPDGSKWSTSLMQTLGNHSRGEQDSSLDMKDFRPLRKWSSLSKLTAPDNCGQGGTVCREESRNGLEKIGKAKALTSQLRTIGPSCLHDSMEMLRLEDKEINKKRSSTLDCKYKFESCSKEDFRASSSTLRRQTVDMTYSALPESKPIMTSSEAFEPPKYLMLGQQAVGGVPIQPSVRTQMWLTEQLRTNPLEGRNTEDSYSLAPWQQQQIEDFRQGSETPMQVLTGSSRQSYSPGYQDFSKWESMLKIKEGLLRQKEIVIDRQKQQITHLHERIRDNELRAQHAMLGHYVNCEDSYVASLQPQYENTSLQTPFSEESVSHSQQGEFEQKLASTEKEVLQLNEFLKQRLSLFSEEKKKLEEKLKTRDRYISSLKKKCQKESEQNKEKQRRIETLEKYLADLPTLDDVQSQSLQLQILEEKNKNLQEALIDTEKKLEEIKKQCQDKETQLICQKKKEKELVTTVQSLQQKVERCLEDGIRLPMLDAKQLQNENDNLRQQNETASKIIDSQQDEIDRMILEIQSMQGKLSKEKLTTQKMMEELEKKERNVQRLTKALLENQRQTDETCSLLDQGQEPDQSRQQTVLSKRPLFDLTVIDQLFKEMSCCLFDLKALCSILNQRAQGKEPNLSLLLGIRSMNCSAEETENDHSTETLTKKLSDVCQLRRDIDELRTTISDRYAQDMGDNCITQ

SEQ ID NO: 904334 - protein, 716 aa, Homo sapiens
MWGRFLAPEASGRDSPGGARSFPAGPDYSSAWLPANESLWQATTVPSNHRNNHIRRHSIASDSGDTGIGTSCSDSVEDHSTSSGTLSFKPSQSLITLPTAHVMPSNSSASISKLRESLTPDGSKWSTSLMQTLGNHSRGEQDSSLDMKDFRPLRKWSSLSKLTAPDNCGQGGTVCREESRNGLEKIGKAKALTSQLRTIGPSCLHDSMEMLRLEDKEINKKRSSTLDCKYKFESCSKEDFRASSSTLRRQTVDMTYSALPESKPIMTSSEAFEPPKYLMLGQQAVGGVPIQPSVRTQMWLTEQLRTNPLEGRNTEDSYSLAPWQQQQIEDFRQGSETPMQVLTGSSRQSYSPGYQDFSKWESMLKIKEGLLRQKEIVIDRQKQQITHLHERIRDNELRAQHAMLGHYVNCEDSYVASLQPQYENTSLQTPFSEESVSHSQQGEFEQKLASTEKEVLQLNEFLKQRLSLFSEEKKKLEEKLKTRDRYISSLKKKCQKESEQNKEKQRRIETLEKYLADLPTLDDVQSQSLQLQILEEKNKNLQEALIDTEKKLEEIKKQCQDKETQLICQKKKEKELVTTVQSLQQKVERCLEDGIRLPMLDAKQLQNENDNLRQQNETASKIIDSQQDEIDRMILEIQSMQGKLSKEKLTTQKMMEELEKKERNVQRLTKALLENQRQTDETCSLLDQGQEHIHKAFSQIFTKPSGDVKAPSQKAL

SEQ ID NO: 904335 - protein, 132 aa, Homo sapiens
PRLWLCRRRGRREPAAATSPGAFEPGLSRGSSSRHRRVAASPARASAQPAWPWQAPAVRRIWPLRSPPVAEQPLTSHPAFPPARVAEAHAPRKFPPPKKQEDGREESGVPGPPGPLARDVGALPGSGGQRPG

SEQ ID NO: 904336 - protein, 132 aa, Homo sapiens; identical to SEQ ID NO: 904335

SEQ ID NO: 904337 - protein, 160 aa, Homo sapiens
MFLQVLTGSSRQSYSPGYQDFSKWESMLKIKEGLLRQKEIVIDRQKQQITHLHERIRDNELRAQHAMLGHYVNCEDSYVASLQPQYENTSLQTPFSEESVSHSQQGEFEQKLASTEKEVLQLNEFLKQRLSLFSEEKKKLEEKVGFSNKVELGQQHFLSI

SEQ ID NO: 904338 - protein, 703 aa, Homo sapiens
MPSNSSASISKLRESLTPDGSKWSTSLMQTLGNHSRGEQDSSLDMKDFRPLRKWSSLSKLTAPDNCGQGGTVCREESRNGLEKIGKAKALTSQLRTIGPSCLHDSMEMLRLEDKEINKKRSSTLDCKYKFESCSKEDFRASSSTLRRQTVDMTYSALPESKPIMTSSEAFEPPKYLMLGQQAVGGVPIQPSVRTQMWLTEQLRTNPLEGRNTEDSYSLAPWQQQQIEDFRQGSETPMQVLTGSSRQSYSPGYQDFSKWESMLKIKEGLLRQKEIVIDRQKQQITHLHERIRDNELRAQHAMLGHYVNCEDSYVASLQPQYENTSLQTPFSEESVSHSQQGEFEQKLASTEKEVLQLNEFLKQRLSLFSEEKKKLEEKLKTRDRYISSLKKKCQKESEQNKEKQRRIETLEKYLADLPTLDDVQSQSLQLQILEEKNKNLQEALIDTEKKLEEIKKQCQDKETQLICQKKKEKELVTTVQSLQQKVERCLEDGIRLPMLDAKQLQNENDNLRQQNETASKIIDSQQDEIDRMILEIQSMQGKLSKEKLTTQKMMEELEKKERNVQRLTKALLENQRQTDETCSLLDQGQEPDQSRQQTVLSKRPLFDLTVIDQLFKEMSCCLFDLKALCSILNQRAQGKEPNLSLLLGIRSMNCSAEETENDHSTETLTKKLSDVCQLRRDIDELRTTISDRYAQDMGDNCITQ

SEQ ID NO: 904339 - protein, 496 aa, Homo sapiens
MWGRFLAPEASGRDSPGGARSFPAGPDYSSAWLPANESLWQATTVPSNHRNNHIRRHSIASDSGDTGIGTSCSDSVEDHSTSSGTLSFKPSQSLITLPTAHVMPSNSSASISKLRESLTPDGSKWSTSLMQTLGNHSRGEQDSSLDMKDFRPLRKWSSLSKLTAPDNCGQGGTVCREESRNGLEKIGKAKALTSQLRTIGPSCLHDSMEMLRLEDKEINKKRSSTLDCKYKFESCSKEDFRASSSTLRRQTVDMTYSALPESKPIMTSSEAFEPPKYLMLGQQAVGGVPIQPSVRTQMWLTEQLRTNPLEGRNTEDSYSLAPWQQQQIEDFRQGSETPMQVLTGSSRQSYSPGYQDFSKWESMLKIKEGLLRQKEIVIDRQKQQITHLHERIRDNELRAQHAMLGHYVNCEDSYVASLQPQYENTSLQTPFSEESVSHSQQGEFEQKLASTEKEVLQLNEFLKQRLSLFSEEKKKLEEKVGFSNKVELGQQHFLSI

SEQ ID NO: 904340 - protein, 345 aa, Homo sapiens
MWGRFLAPEASGRDSPGGARSFPAGPDYSSAWLPANESLWQATTVPSNHRNNHIRRHSIASDSGDTGIGTSCSDSVEDHSTSSGTLSFKPSQSLITLPTAHVMPSNSSASISKLRESLTPDGSKWSTSLMQTLGNHSRGEQDSSLDMKDFRPLRKWSSLSKLTAPDNCGQGGTVCREESRNGLEKIGKAKALTSQLRTIGPSCLHDSMEMLRLEDKEINKKRSSTLDCKYKFESCSKEDFRASSSTLRRQTVDMTYSALPESKPIMTSSEAFEPPKYLMLGQQAVGGVPIQPSVRTQMWLTEQLRTNPLEGRNTEDSYSLAPWQQQQIEDFRQGSETPMQVRCKI

SEQ ID NO: 904341 - protein, 712 aa, Homo sapiens
MAELGAGGDGHRGGDGAVRSETAPDSYKVQDKKNASSRPASAISGQNNNHSGNKPDPPPVLRVDDRQRLARERREEREKQLAAREIVWLEREERARQHYEKHLEERKKRLEEQRQKEERRRAAVEEKRRQRLEEDKERHEAVVRRTMERSQKPKQKHNRWSWGGSLHGSPSIHSAARRLQLSPWESSVVNRLLTPTHSFLARSKSTAALSGEAASCSPIIMPYKAAHSRNSMDRPKLFVTPPEGSSRRRIIHGTASYKKERERENVLFLTSGTRRAVSPSNPKARQPARSRLWLPSKSLPHLPGTPRPTSSLPPGSVKAAPAQVRPPSPGNIRPVKREVKVEPEKKDPEKEPQKVANEPSLKGRAPLVKVEEATVEERTPAEPEVGPAAPAMAPAPASAPAPASAPAPAPVPTPAMVSAPSSTVNASASVKTSAGTTDPEEATRLLAEKRRLAREQREKEERERREQEELERQKREELAQRVAEERTTRREEESRRLEAEQAREKEEQLQRQAEERALREREEAERAQRQKEEEARVREEAERVRQEREKHFQREEQERLERKKRLEEIMKRTRRTEATDKKTSDQRNGDIAKGALTGGTEVSALPCTTNAPGNGKPVGSPHVVTSHQSKVTVESTPDLEKQPNENGVSVQNENFEEIINLPIGSKPSRLDVTNSESPEIPLNPILAFDDEGTLGPLPQVDGVQTQQTAEVI

SEQ ID NO: 904342 - protein, 729 aa, Homo sapiens
MAAPDSYKVQDKKNASSRPASAISGQNNNHSGNKPDPPPVLRVDDRQRLARERREEREKQLAAREIVWLEREERARQHYEKHLEERKKRLEEQRQKEERRRAAVEEKRRQRLEEDKERHEAVVRRTMERSQKPKQKHNRWSWGGSLHGSPSIHSADPDRRSVSTMNLSKYVDPVISKRLSSSSATLLNSPDRARRLQLSPWESSVVNRLLTPTHSFLARSKSTAALSGEAASCSPIIMPYKAAHSRNSMDRPKLFVTPPEGSSRRRIIHGTASYKKERERENVLFLTSGTRRAVSPSNPKARQPARSRLWLPSKSLPHLPGTPRPTSSLPPGSVKAAPAQVRPPSPGNIRPVKREVKVEPEKKDPEKEPQKVANEPSLKGRAPLVKVEEATVEERTPAEPEVGPAAPAMAPAPASAPAPASAPAPAPVPTPAMVSAPSSTVNASASVKTSAGTTDPEEATRLLAEKRRLAREQREKEERERREQEELERQKREELAQRVAEERTTRREEESRRLEAEQAREKEEQLQRQAEERALREREEAERAQRQKEEEARVREEAERVRQEREKHFQREEQERLERKKRLEEIMKRTRRTEATDKKTSDQRNGDIAKGALTGGTEVSALPCTTNAPGNGKPVGSPHVVTSHQSKVTVESTPDLEKQPNENGVSVQNENFEEIINLPIGSKPSRLDVTNSESPEIPLNPILAFDDEGTLGPLPQVDGVQTQQTAEVI

SEQ ID NO: 904343 - protein, 250 aa, Homo sapiens
AAAPHPGPGPSPAGRRPSPAEEGADWTAGAPAFHTFSIRHLAPTSGHPLGDPGSPPVCQRQTPTFCFQKEEEARVREEAERVRQEREKHFQREEQERLERKKRLEEIMKRTRRTEATDKKTSDQRNGDIAKGALTGGTEVSALPCTTNAPGNGKPVGSPHVVTSHQSKVTVESTPDLEKQPNENGVSVQNENFEEIINLPIGSKPSRLDVTNSESPEIPLNPILAFDDEGTLGPLPQVDGVQTQQTAEVI

SEQ ID NO: 904344 - protein, 712 aa, Homo sapiens; identical to SEQ ID NO: 904341

SEQ ID NO: 904345 - protein, 605 aa, Homo sapiens
MAELGAGGDGHRGGDGAVRSETAPDSYKVQDKKNASSRPASAISGQNNNHSGNKPDPPPVLRVDDRQRLARERREEREKQLAAREIVWLEREERARQHYEKHLEERKKRLEEQRQKEERRRAAVEEKRRQRLEEDKERHEAVVRRTMERSQKPKQKHNRWSWGGSLHGSPSIHSADPDRRSVSTMNLSKYVDPVISKRLSSSSATLLNSPDRARRLQLSPWESSVVNRLLTPTHSFLARSKSTAALSGEAASCSPIIMPYKAAHSRNSMDRPKLFVTPPEGSSRRRIIHGTASYKKERERENVLFLTSGTRRAVSPSNPKARQPARSRLWLPSKSLPHLPGTPRPTSSLPPGSVKAAPAQVRPPSPGNIRPVKREVKVEPEKKDPEKEPQKVANEPSLKGRAPLVKVEEATVEERTPAEPEVGPAAPAMAPAPASAPAPASAPAPAPVPTPAMVSAPSSTVNASASVKTSAGTTDPEEATRLLAEKRRLAREQREKEERERREQEELERQKREELAQRVAEERTTRREEESRRLEAEQAREKEEQLQRQAEERALREREEAERAQRQKEEEARVREEAERVRQEREKHFQREEQERLERKKVAAS

SEQ ID NO: 904346 - protein, 749 aa, Homo sapiens
MAELGAGGDGHRGGDGAVRSETAPDSYKVQDKKNASSRPASAISGQNNNHSGNKPDPPPVLRVDDRQRLARERREEREKQLAAREIVWLEREERARQHYEKHLEERKKRLEEQRQKEERRRAAVEEKRRQRLEEDKERHEAVVRRTMERSQKPKQKHNRWSWGGSLHGSPSIHSADPDRRSVSTMNLSKYVDPVISKRLSSSSATLLNSPDRARRLQLSPWESSVVNRLLTPTHSFLARSKSTAALSGEAASCSPIIMPYKAAHSRNSMDRPKLFVTPPEGSSRRRIIHGTASYKKERERENVLFLTSGTRRAVSPSNPKARQPARSRLWLPSKSLPHLPGTPRPTSSLPPGSVKAAPAQVRPPSPGNIRPVKREVKVEPEKKDPEKEPQKVANEPSLKGRAPLVKVEEATVEERTPAEPEVGPAAPAMAPAPASAPAPASAPAPAPVPTPAMVSAPSSTVNASASVKTSAGTTDPEEATRLLAEKRRLAREQREKEERERREQEELERQKREELAQRVAEERTTRREEESRRLEAEQAREKEEQLQRQAEERALREREEAERAQRQKEEEARVREEAERVRQEREKHFQREEQERLERKKRLEEIMKRTRRTEATDKKTSDQRNGDIAKGALTGGTEVSALPCTTNAPGNGKPVGSPHVVTSHQSKVTVESTPDLEKQPNENGVSVQNENFEEIINLPIGSKPSRLDVTNSESPEIPLNPILAFDDEGTLGPLPQVDGVQTQQTAEVI

SEQ ID NO: 904347 - protein, 655 aa, Homo sapiens
MAELGAGGDGHRGGDGAVRSETAPDSYKVQDKKNASSRPASAISGQNNNHSGNKPDPPPVLRVDDRQRLARERREEREKQLDPDRRSVSTMNLSKYVDPVISKRLSSSSATLLNSPDRARRLQLSPWESSVVNRLLTPTHSFLARSKSTAALSGEAASCSPIIMPYKAAHSRNSMDRPKLFVTPPEGSSRRRIIHGTASYKKERERENVLFLTSGTRRAVSPSNPKARQPARSRLWLPSKSLPHLPGTPRPTSSLPPGSVKAAPAQVRPPSPGNIRPVKREVKVEPEKKDPEKEPQKVANEPSLKGRAPLVKVEEATVEERTPAEPEVGPAAPAMAPAPASAPAPASAPAPAPVPTPAMVSAPSSTVNASASVKTSAGTTDPEEATRLLAEKRRLAREQREKEERERREQEELERQKREELAQRVAEERTTRREEESRRLEAEQAREKEEQLQRQAEERALREREEAERAQRQKEEEARVREEAERVRQEREKHFQREEQERLERKKRLEEIMKRTRRTEATDKKTSDQRNGDIAKGALTGGTEVSALPCTTNAPGNGKPVGSPHVVTSHQSKVTVESTPDLEKQPNENGVSVQNENFEEIINLPIGSKPSRLDVTNSESPEIPLNPILAFDDEGTLGPLPQVDGVQTQQTAEVI

SEQ ID NO: 904348 - protein, 712 aa, Homo sapiens; identical to SEQ ID NO: 904341

SEQ ID NO: 904349 - protein, 649 aa, Homo sapiens
MAELGAGGDGHRGGDGAVRSETAPDSYKVQDKKNASSRPASAISGQNNNHSGNKPDPPPVLRVDDRQRLARERREEREKQLAAREIVWLEREERARQHYEKHLEERKKRLEEQRQKEERRRAAVEEKRRQRLEEDKERHEAVVRRTMERSQKPKQKHNRWSWGGSLHGSPSIHSADPDRRSVSTMNLSKYVDPVISKRLSSSSATLLNSPDRARRLQLSPWESSVVNRLLTPTHSFLARSKSTAALSGEAASCSPIIMPYKAAHSRNSMDRPKLFVTPPEGSSRRRIIHGTASYKKERERENVLFLTSGTRRAVSPSNPKARQPARSRLWLPSKSLPHLPGTPRPTSSLPPGSVKAAPAQVRPPSPGNIRPVKREVKVEPEKKDPEKEPQKVANEPSLKGRAPLVKVEEATVEERTPAEPEVGPAAPAMAPAPASAPAPASAPAPAPVPTPAMVSAPSSTVNASASVKTSAGTTDPEEATRLLAEKRRLAREQREKEERERREQEELERQKREELAQRVAEERTTRREEESRRLEAEQAREKEEQLQRQAEERALREREEAERAQRQKEEEARVREEAERVRQEREKHFQREEQERLERKKRLEEIMKRTRRTEATDKKTSDQRNGDIAKGALTGGTGISVNELKPIYI

SEQ ID NO: 904350 - protein, 113 aa, Homo sapiens
LPSKSLPHLPGTPRPTSSLPPGSVKAAPAQVRPPSPGNIRPVKREVKVEPEKKDPEKEPQKVANEPSLKGRAPLVKVEEATVEERTPAEPEVGPGKSKLTCGLGALSFSPALF

SEQ ID NO: 904351 - protein, 863 aa, Homo sapiens
MTIPVFLIPVSLDNQAMLHYIRDKTAVPYFSNLVWFIGSHVIELDDCVQTDEEHRNRGKLSDLVAEHLDHLHYLNDILIINCEFLNDVLTDHLLNRLFLPLYVYSLENQDKGGERPKISLPVSLYLLSQVFLIIHHAPLVNSLAEVILNGDLSEMYAKTEQDIQRSSAKPSIRCFIKPTETLERSLEMNKHKGKRRVQKRPNYKNVGEEEDEEKGPTEDAQEDAEKAKGTEGGSKGIKTSGESEEIEMVIMERSKLSELAASTSVQEQNTTDEEKSAAATCSESTQWSRPFLDMVYHALDSPDDDYHALFVLCLLYAMSHNKGMDPEKLERIQLPVPNAAEKTTYNHPLAERLIRIMNNAAQPDGKIRLATLELSCLLLKQQVLMSAGCIMKDVHLACLEGAREESVHLVRHFYKGEDIFLDMFEDEYRSMTMKPMNVEYLMMDASILLPPTGTPLTGIDFVKRLPCGDVEKTRRAIRVFFMLRSLSLQLRGEPETQLPLTREEDLIKTDDVLDLNNSDLIACTVITKDGGMVQRFLAVDIYQMSLVEPDVSRLGWGVVKFAGLLQDMQVTGVEDDSRALNITIHKPASSPHSKPFPILQATFIFSDHIRCIIAKQRLAKGRIQARRMKMQRIAALLDLPIQPTTEVLGFGLGSSTSTQHLPFRFYDQGRRGSSDPTVQRSVFASVDKVPGFAVAQCINQHSSPSLSSQSPPSASGSPSGSGSTSHCDSGGTSSSSTPSTAQSPADAPMSPELPKPHLPDQLVIVNETEADSKPSKNVARSAAVETASLSPSLVPARQPTISLLCEDTADTLSVESLTLVPPVDPHSLRSLTGMPPLSTPAAACTEPVGEEAACAEPVGTAED

SEQ ID NO: 904352 - protein, 683 aa, Homo sapiens
MEREALASVLFPPQCVSGVQVAAVGHVLDVFGVIYAYLFSNMSMCINLGLKSCLDSSQSPFWLPEIEMVIMERSKLSELAASTSVQEQNTTDEEKSAAATCSESTQWSRPFLDMVYHALDSPDDDYHALFVLCLLYAMSHNKGMDPEKLERIQLPVPNAAEKTTYNHPLAERLIRIMNNAAQPDGKIRLATLELSCLLLKQQVLMSAGCIMKDVHLACLEGAREESVHLVRHFYKGEDIFLDMFEDEYRSMTMKPMNVEYLMMDASILLPPTGTPLTGIDFVKRLPCGDVEKTRRAIRVFFMLRSLSLQLRGEPETQLPLTREEDLIKTDDVLDLNNSDLIACTVITKDGGMVQRFLAVDIYQMSLVEPDVSRLGWGVVKFAGLLQDMQVTGVEDDSRALNITIHKPASSPHSKPFPILQATFIFSDHIRCIIAKQRLAKGRIQARRMKMQRIAALLDLPIQPTTEVLGFGLGSSTSTQHLPFRFYDQGRRGSSDPTVQRSVFASVDKVPGFAVAQCINQHSSPSLSSQSPPSASGSPSGSGSTSHCDSGGTSSSSTPSTAQSPADAPMSPELPKPHLPDQLVIVNETEADSKPSKNVARSAAVETASLSPSLVPARQPTISLLCEDTADTLSVESLTLVPPVDPHSLRSLTGMPPLSTPAAACTEPVGEEAACAEPVGTAED

SEQ ID NO: 904353 - protein, 159 aa, Homo sapiens
SGVAGKDADECSACRRPTVMAATGFSAPNGSCHGTSRTVNSDAPMSPELPKPHLPDQLVIVNETEADSKPSKNVARSAAVETASLSPSLVPARQPTISLLCEDTADTLSVESLTLVPPVDPHSLRSLTGMPPLSTPAAACTEPVGEEAACAEPVGTAED

SEQ ID NO: 904354 - protein, 1051 aa, Homo sapiens
MFGRSRSWVGGGHGKTSRNIHSLDHLKYLYHVLTKNTTVTEQNRNLLVETIRSITEILIWGDQNDSSVFDFFLEKNMFVFFLNILRQKSGRYVCVQLLQTLNILFENISHETSLYYLLSNNYVNSIIVHKFDFSDEEIMAYYISFLKTLSLKLNNHTVHFFYNEHTNDFALYTEAIKFFNHPESMVRIAVRTITLNVYKVDNQAMLHYIRDKTAVPYFSNLVWFIGSHVIELDDCVQTDEEHRNRGKLSDLVAEHLDHLHYLNDILIINCEFLNDVLTDHLLNRLFLPLYVYSLENQDKGGERPKISLPVSLYLLSQVFLIIHHAPLVNSLAEVILNGDLSEMYAKTEQDIQRSSAKPSIRCFIKPTETLERSLEMNKHKGKRRVQKRPNYKNVGEEEDEEKGPTEDAQEDAEKAKGTEGGSKGIKTSGESEEIEMVIMERSKLSELAASTSVQEQNTTDEEKSAAATCSESTQWSRPFLDMVYHALDSPDDDYHALFVLCLLYAMSHNKGMDPEKLERIQLPVPNAAEKTTYNHPLAERLIRIMNNAAQPDGKIRLATLELSCLLLKQQVLMSAGCIMKDVHLACLEGAREESVHLVRHFYKGEDIFLDMFEDEYRSMTMKPMNVEYLMMDASILLPPTGTPLTGIDFVKRLPCGDVEKTRRAIRVFFMLRSLSLQLRGEPETQLPLTREEDLIKTDDVLDLNNSDLIACTVITKDGGMVQRFLAVDIYQMSLVEPDVSRLGWGVVKFAGLLQDMQVTGVEDDSRALNITIHKPASSPHSKPFPILQATFIFSDHIRCIIAKQRLAKGRIQARRMKMQRIAALLDLPIQPTTEVLGFGLGSSTSTQHLPFRFYDQGRRGSSDPTVQRSVFASVDKVPGFAVAQCINQHSSPSLSSQSPPSASGSPSGSGSTSHCDSGGTSSSSTPSTAQSPADAPMSPELPKPHLPDQLVIVNETEADSKPSKNVARSAAVETASLSPSLVPARQPTISLLCEDTADTLSVESLTLVPPVDPHSLRSLTGMPPLSTPAAACTEPVGEEAACAEPVGTAED

SEQ ID NO: 904355 - protein, 940 aa, Homo sapiens [sequence omitted]

SEQ ID NO: 904356 - protein, 882 aa, Homo sapiens
MFGRSRSWVGGGHGKTSRNIHSLDHLKYLYHVLTKNTTVTEQNRNLLVETIRSITEILIWGDQNDSSVFDFFLEKNMFVFFLNILRQKSGRYVCVQLLQTLNILFENISHETSLYYLLSNNYVNSIIVHKFDFSDEEIMAYYISFLKTLSLKLNNHTVHFFYNEHTNDFALYTEAIKFFNHPESMVRIAVRTITLNVYKVDNQAMLHYIRDKTAVPYFSNLVWFIGSHVIELDDCVQTDEEHRNRGKLSDLVAEHLDHLHYLNDILIINCEFLNDVLTDHLLNRLFLPLYVYSLENQDKGGERPKISLPVSLYLLSQVFLIIHHAPLVNSLAEVILNGDLSEMYAKTEQDIQRSSAKPSIRCFIKPTETLERSLEMNKHKGKRRVQKRPNYKNVGEEEDEEKGPTEDAQEDAEKAKGTEGGSKGIKTSGESEEIEMVIMERSKLSELAASTSVQEQNTTDEEKSAAATCSESTQWSRPFLDMVYHALDSPDDDYHALFVLCLLYAMSHNKGMDPEKLERIQLPVPNAAEKTTYNHPLAERLIRIMNNAAQPDGKIRLATLELSCLLLKQQVLMSAGCIMKDVHLACLEGAREESVHLVRHFYKGEDIFLDMFEDEYRSMTMKPMNVEYLMMDASILLPPTGTPLTGIDFVKRLPCGDVEKTRRAIRVFFMLRSLSLQLRGEPETQLPLTREEDLIKTDDVLDLNNSDLIACTVITKDGGMVQRFLAVDIYQMSLVEPDVSRLGWGVVKFAGLLQDMQVTGVEDDSRALNITIHKPASSPHSKPFPILQATFIFSDHIRCIIAKQRLAKGRIQARRMKMQRIAALLDLPIQPTTEVLGFGLGSSTSTQHLPFRFYDQGRRGSSDPTVQRSVFASVDKVPGFQG

SEQ ID NO: 904357 - protein, 1051 aa, Homo sapiens; identical to SEQ ID NO: 904354

SEQ ID NO: 904358 - protein, 629 aa, Homo sapiens
MFGRSRSWVGGGHGKTSRNIHSLDHLKYLYHVLTKNTTVTEQNRNLLVETIRSITEILIWGDQNDSSVFDFFLEKNMFVFFLNILRQKSGRYVCVQLLQTLNILFENISHETSLYYLLSNNYVNSIIVHKFDFSDEEIMAYYISFLKTLSLKLNNHTVHFFYNEHTNDFALYTEAIKFFNHPESMVRIAVRTITLNVYKVDNQAMLHYIRDKTAVPYFSNLVWFIGSHVIELDDCVQTDEEHRNRGKLSDLVAEHLDHLHYLNDILIINCEFLNDVLTDHLLNRLFLPLYVYSLENQDKGGERPKISLPVSLYLLSQVFLIIHHAPLVNSLAEVILNGDLSEMYAKTEQDIQRSSAKPSIRCFIKPTETLERSLEMNKHKGKRRVQKRPNYKNVGEEEDEEKGPTEDAQEDAEKAKGTEGGSKGIKTSGESEEIEMVIMERSKLSELAASTSVQEQNTTDEEKSAAATCSESTQWSRPFLDMVYHALDSPDDDYHALFVLCLLYAMSHNKGMDPEKLERIQLPVPNAAEKTTYNHPLAERLIRIMNNAAQPDGKIRLATLELSCLLLKQQVLMSAGCIMKDVHLACLEGAREESVHLVRHFYKVIGRAQMDSSMVCIVETEVWCLVLCR

SEQ ID NO: 904359 - protein, 60 aa, Homo sapiens
MPFPLLLTVQDMQVTGVEDDSRALNITIHKPASSPHSKPFPILQATFIFSDHIRCIIAKQ

SEQ ID NO: 904360 - protein, 1051 aa, Homo sapiens; identical to SEQ ID NO: 904354

SEQ ID NO: 904361 - protein, 755 aa, Homo sapiens
RGSCRRENAKISCGALYLLSQVFLIIHHAPLVNSLAEVILNGDLSEMYAKTEQDIQRSSAKPSIRCFIKPTETLERSLEMNKHKGKRRVQKRPNYKNVGEEEDEEKGPTEDAQEDAEKAKGTEGGSKGIKTSGESEEIEMVIMERSKLSELAASTSVQEQNTTDEEKSAAATCSESTQWSRPFLDMVYHALDSPDDDYHALFVLCLLYAMSHNKGMDPEKLERIQLPVPNAAEKTTYNHPLAERLIRIMNNAAQPDGKIRLATLELSCLLLKQQVLMSAGCIMKDVHLACLEGAREESVHLVRHFYKGEDIFLDMFEDEYRSMTMKPMNVEYLMMDASILLPPTGTPLTGIDFVKRLPCGDVEKTRRAIRVFFMLRSLSLQLRGEPETQLPLTREEDLIKTDDVLDLNNSDLIACTVITKDGGMVQRFLAVDIYQMSLVEPDVSRLGWGVVKFAGLLQDMQVTGVEDDSRALNITIHKPASSPHSKPFPILQATFIFSDHIRCIIAKQRLAKGRIQARRMKMQRIAALLDLPIQPTTEVLGFGLGSSTSTQHLPFRFYDQGRRGSSDPTVQRSVFASVDKVPGFAVAQCINQHSSPSLSSQSPPSASGSPSGSGSTSHCDSGGTSSSSTPSTAQSPADAPMSPELPKPHLPDQLVIVNETEADSKPSKNVARSAAVETASLSPSLVPARQPTISLLCEDTADTLSVESLTLVPPVDPHSLRSLTGMPPLSTPAAACTEPVGEEAACAEPVGTAED

SEQ ID NO: 904362 - protein, 570 aa, Homo sapiens
MVYHALDSPDDDYHALFVLCLLYAMSHNKGMDPEKLERIQLPVPNAAEKTTYNHPLAERLIRIMNNAAQPDGKIRLATLELSCLLLKQQVLMSAGCIMKDVHLACLEGAREESVHLVRHFYKGEDIFLDMFEDEYRSMTMKPMNVEYLMMDASILLPPTGTPLTGIDFVKRLPCGDVEKTRRAIRVFFMLRSLSLQLRGEPETQLPLTREEDLIKTDDVLDLNNSDLIACTVITKDGGMVQRFLAVDIYQMSLVEPDVSRLGWGVVKFAGLLQDMQVTGVEDDSRALNITIHKPASSPHSKPFPILQATFIFSDHIRCIIAKQRLAKGRIQARRMKMQRIAALLDLPIQPTTEVLGFGLGSSTSTQHLPFRFYDQGRRGSSDPTVQRSVFASVDKVPGFAVAQCINQHSSPSLSSQSPPSASGSPSGSGSTSHCDSGGTSSSSTPSTAQSPADAPMSPELPKPHLPDQLVIVNETEADSKPSKNVARSAAVETASLSPSLVPARQPTISLLCEDTADTLSVESLTLVPPVDPHSLRSLTGMPPLSTPAAACTEPVGEEAACAEPVGTAED

SEQ ID NO: 904363 - protein, 922 aa, Homo sapiens
MFGRSRSWVGGGHGKTSRNIHSLDHLKYLYHVLTKNTTVTEQNRNLLVETIRSITEILIWGDQNDSSVFDFFLEKNMFVFFLNILRQKSGRYVCVQLLQTLNILFENISHETSLYYLLSNNYVNSIIVHKFDFSDEEIMAYYISFLKTLSLKLNNHTVHFFYNEHTNDFALYTEAIKFFNHPESMVRIAVRTITLNVYKVDNQAMLHYIRDKTAVPYFSNLVWFIGSHVIELDDCVQTDEEHRNRGKLSDLVAEHLDHLHYLNDILIINCEFLNDVLTDHLLNRLFLPLYVYSLENQDKGGERPKISLPVSLYLLSQVFLIIHHAPLVNSLAEVILNGDLSEMYAKTEQDIQRSSAKPSIRCFIKPTETLERSLEMNKHKGKRRVQKRPNYKNVGEEEDEEKGPTEDAQEDAEKAKGTEGGSKGIKTSGESEEIEMVIMERSKLSELAASTSVQEQNTTDEEKSAAATCSESTQWSRPFLDMVYHALDSPDDDYHALFVLCLLYAMSHNKGMDPEKLERIQLPVPNAAEKTTYNHPLAERLIRIMNNAAQPDGKIRLATLELSCLLLKQQVLMSAGCIMKDVHLACLEGAREESVHLVRHFYKGEDIFLDMFEDEYRSMTMKPMNVEYLMMDASILLPPTGTPLTGIDFVKRLPCGDVEKTRRAIRVFFMLRSLSLQLRGEPETQLPLTREEDLIKTDDVLDLNNSDLIACTVITKDGGMVQRFLAVDIYQMSLVEPDVSRLGWGVVKFAGLLQDMQVTGVEDDSRALNITIHKPASSPHSKPFPILQATFIFSDHIRCIIAKQRLAKGRIQARRMKMQRIAALLDLPIQPTTEVLGFGLGSSTSTQHLPFRFYDQGRRGSSDPTVQRSVFASVDKVPGEPAPRPAPQLVHHGGRSRSFSLWSLCELPFLSQKPRRLAAPAS

SEQ ID NO: 904364 - protein, 923 aa, Homo sapiens
MFGRSRSWVGGGHGKTSRNIHSLDHLKYLYHVLTKNTTVTEQNRNLLVETIRSITEILIWGDQNDSSVFDFFLEKNMFVFFLNILRQKSGRYVCVQLLQTLNILFENISHETSLYYLLSNNYVNSIIVHKFDFSDEEIMAYYISFLKTLSLKLNNHTVHFFYNEHTNDFALYTEAIKFFNHPESMVRIAVRTITLNVYKVDNQAMLHYIRDKTAVPYFSNLVWFIGSHVIELDDCVQTDEEHRNRGKLSDLVAEHLDHLHYLNDILIINCEFLNDVLTDHLLNRLFLPLYVYSLENQDKGGERPKISLPVSLYLLSQVFLIIHHAPLVNSLAEVILNGDLSEMYAKTEQDIQRSSAKPSIRCFIKPTETLERSLEMNKHKGKRRVQKRPNYKNVGEEEDEEKGPTEDAQEDAEKAKGTEGGSKGIKTSGESEEIEMVIMERSKLSELAASTSVQEQNTTDEEKSAAATCSESTQWSRPFLDMVYHALDSPDDDYHALFVLCLLYAMSHNKGMDPEKLERIQLPVPNAAEKTTYNHPLAERLIRIMNNAAQPDGKIRLATLELSCLLLKQQVLMSAGCIMKDVHLACLEGAREESVHLVRHFYKGEDIFLDMFEDEYRSMTMKPMNVEYLMMDASILLPPTGTPLTGIDFVKRLPCGDVEKTRRAIRVFFMLRSLSLQLRGEPETQLPLTREEDLIKTDDVLDLNNSDLIACTVITKDGGMVQRFLAVDIYQMSLVEPDVSRLGWGVVKFAGLLQDMQVTGVEDDSRALNITIHKPASSPHSKPFPILQATFIFSDHIRCIIAKQRLAKGRIQARRMKMQRIAALLDLPIQPTTEVLGFGLGSSTSTQHLPFRFYDQGRRGSSDPTVQRSVFASVDKVPALLTAAVERQPRWPLPSLLVPWLTDCCGGLCLLIYRRFSRIVFKI

SEQ ID NO: 904365 - protein, 892 aa, Homo sapiens
MFGRSRSWVGGGHGKTSRNIHSLDHLKYLYHVLTKNTTVTEQNRNLLVETIRSITEILIWGDQNDSSVFDFFLEKNMFVFFLNILRQKSGRYVCVQLLQTLNILFENISHETSLYYLLSNNYVNSIIVHKFDFSDEEIMAYYISFLKTLSLKLNNHTVHFFYNEHTNDFALYTEAIKFFNHPESMVRIAVRTITLNVYKVDNQAMLHYIRDKTAVPYFSNLVWFIGSHVIELDDCVQTDEEHRNRGKLSDLVAEHLDHLHYLNDILIINCEFLNDVLTDHLLNRLFLPLYVYSLENQDKGGERPKISLPVSLYLLSQVFLIIHHAPLVNSLAEVILNGDLSEMYAKTEQDIQRSSAKPSIRCFIKPTETLERSLEMNKHKGKRRVQKRPNYKNVGEEEDEEKGPTEDAQEDAEKAKGTEGGSKGIKTSGESEEIEMVIMERSKLSELAASTSVQEQNTTDEEKSAAATCSESTQWSRPFLDMVYHALDSPDDDYHALFVLCLLYAMSHNKGMDPEKLERIQLPVPNAAEKTTYNHPLAERLIRIMNNAAQPDGKIRLATLELSCLLLKQQVLMSAGCIMKDVHLACLEGAREESVHLVRHFYKGEDIFLDMFEDEYRSMTMKPMNVEYLMMDASILLPPTGTPLTGIDFVKRLPCGDVEKTRRAIRVFFMLRSLSLQLRGEPETQLPLTREEDLIKTDDVLDLNNSDLIACTVITKDGGMVQRFLAVDIYQMSLVEPDVSRLGWGVVKFAGLLQDMQVTGVEDDSRALNITIHKPASSPHSKPFPILQATFIFSDHIRCIIAKQRLAKGRIQARRMKMQRIAALLDLPIQPTTEVLGFGLGSSTSTQHLPFRFYDQGRRGSSDPTVQRSVFASVDKVPDPSLCSCISYMCQS

SEQ ID NO: 904366 - protein, 212 aa, Homo sapiens
MFGRSRSWVGGGHGKTSRNIHSLDHLKYLYHVLTKNTTVTEQNRNLLVETIRSITEILIWGDQNDSSVFDFFLEKNMFVFFLNILRQKSGRYVCVQLLQTLNILFENISHETSLYYLLSNNYVNSIIVHKFDFSDEEIMAYYISFLKTLSLKLNNHTVHFFYNEHTNDFALYTEAIKFFNHPESMVRIAVRTITLNVYKVDNTSRGGPHRVS

SEQ ID NO: 904367 - protein, 129 aa, Homo sapiens
SVCFRFFSPNPDAPMSPELPKPHLPDQLVIVNETEADSKPSKNVARSAAVETASLSPSLVPARQPTISLLCEDTADTLSVESLTLVPPVDPHSLRSLTGMPPLSTPAAACTEPVGEEAACAEPVGTAED

SEQ ID NO: 904368 - protein, 399 aa, Homo sapiens
MVSTAPSSASIGWVVPTAPAPGLSWPTDPHGPLLEASAALIFLQPACGAGLERPVPSAAAARLALPATTSLGPAAVPLASLAPAASRDVRPGGMGQAVNSCVGALNGGSCDAATGACRCPTGFLGTDCNLTCPQGRFGPNCTHVCGCGQGAACDPVTGTCLCPPGRAGVRCERGCPQNRFGVGCEHTCSCRNGGLCHASNGSCSCGLGWTGRHCELACPPGRYGAACHLECSCHNNSTCEPATGTCRCGPGFYGQAASTPVPLASTGLAARGCAGVNMEPPATPSVADASALPASTATSVRGGVSQVHLERAATSAVTVTGGHPVTLSPVSAFAHQGAQEPPVTWIAEGASLGPAAPCTVTAGVGLTATLSVGSVTVWMATWGPRAGKVGPSGSPRTRP

SEQ ID NO: 904369 - protein, 203 aa, Homo sapiens
RAGGGFSRAPGLAGFTHSGQTGHFCHRVPLSRGNRRPSACPPGFHGAGCQGLCWCQHGAPCDPISGRCLCPAGFHGHFCERGCEPGSFGEGCHQRCDCDGGAPCDPVTGLCLCPPGRSGATCNLDCRRGQFGPSCTLHCDCGGGADCDPVSGQCHCVDGYMGPTCREGGPLRLPENPSLAQGSAGTLPASSRPTSRSGGPARH

SEQ ID NO: 904370 - protein, 240 aa, Homo sapiens [sequence omitted]

SEQ ID NO: 904371 - protein, 240 aa, Homo sapiens [sequence omitted]

SEQ ID NO: 904372 - protein, 162 aa, Homo sapiens
MTVGKSSKMLQHIDYRMRCILQDGRIFIGTFKAFDKHMNLILCDCDEFRKIKPKNAKQPEREEKRVLGLVLLRGENLVSMTVEGPPPKDTGIARVPLAGAAGGPGVGRAAGRGVLGFNFPALFDGAVRWGPAVAPRKPSWFRVWPRRGPPGPRFPYRPAGSR

SEQ ID NO: 904373 - protein, 71 aa, Homo sapiens
MTVGKSSKMLQHIDYRMRCILQDGRIFIGTFKAFDKHMNLILCDCDEFRKINKECDSTQSVKVEGHPPRYC

SEQ ID NO: 904374 - protein, 77 aa, Homo sapiens
RPHTTTTKFAADRHPNTVPTRTGHSAPTRRQSNPTSRHYGSSTWYETTHGPTNWASPCSRDANRHAASGNETPSTRH

SEQ ID NO: 904375 - protein, 240 aa, Homo sapiens [sequence omitted]

SEQ ID NO: 904376 - protein, 240 aa, Homo sapiens [sequence omitted]

SEQ ID NO: 904377 - protein, 240 aa, Homo sapiens [sequence omitted]

SEQ ID NO: 904378 - protein, 240 aa, Homo sapiens [sequence omitted]

SEQ ID NO: 904379 - protein, 240 aa, Homo sapiens [sequence omitted]

SEQ ID NO: 904380 - protein, 240 aa, Homo sapiens [sequence omitted]

SEQ ID NO: 904381 - protein, 193 aa, Homo sapiens
MTVGKSSKMLQHIDYRMRCILQDGRIFIGTFKAFDKHMNLILCDCDEFRKIKPKNAKQPEREEKRVLGLVLLRGENLVSMTVEGPPPKDTGIARVPLAGAAGGPGVGRAAGRGVPAGVPIPQAPAGLAGPVRGVGGPSQQVMTPQGRGTVAAAAVAATASIAGAPTQYPPGRGTPPPPVGRATPPPGKGSLST

SEQ ID NO: 904382 - protein, 240 aa, Homo sapiens [sequence omitted]

SEQ ID NO: 904383 - protein, 240 aa, Homo sapiens [sequence omitted]

SEQ ID NO: 904384 - protein, 240 aa, Homo sapiens [sequence omitted]

SEQ ID NO: 904385 - protein, 232 aa, Homo sapiens
MLQHIDYRMRCILQDGRIFIGTFKAFDKHMNLILCDCDEFRKIKPKNAKQPEREEKRVLGLVLLRGENLVSMTVEGPPPKDTGIARVPLAGAAGGPGVGRAAGRGVPAGVPIPQAPAGLAGPVRGVGGPSQQVMTPQGRGTVAAAAVAATASIAGAPTQYPPGRGTPPPPVGRATPPPGIMAPPPGMRPPMGPPIGLPPARGTPIGMPPPGMRPPPPGIRGPPPPGMRPPRP

SEQ ID NO: 904386 - protein, 232 aa, Homo sapiens; identical to SEQ ID NO: 904385

SEQ ID NO: 904387 - protein, 161 aa, Homo sapiens
MTVEGPPPKDTGIARVPLAGAAGGPGVGRAAGRGVPAGVPIPQAPAGLAGPVRGVGGPSQQVMTPQGRGTVAAAAVAATASIAGAPTQYPPGRGTPPPPVGRATPPPGIMAPPPGMRPPMGPPIGLPPARGTPIGMPPPGMRPPPPGIRGPPPPGMRPPRP

SEQ ID NO: 904388 - protein, 232 aa, Homo sapiens; identical to SEQ ID NO: 904385

SEQ ID NO: 904389 - protein, 88 aa, Homo sapiens
MTVGKSSKMLQHIDYRMRCILQDGRIFIGTFKAFDKHMNLILCDCDEFRKIKPKNAKQPEREEKRVLGLALLRRRCYGGARYGGARYG

SEQ ID NO: 904390 - protein, 156 aa, Homo sapiens
MERARDRLHLRRTTEQHVPEVEVQVKRRRTASLSNQECQLYPRRSQQQQVPVVDFQAELRQAFLAETPRGNDSTGKRHCSSCCCCCDCQYCWSPNTVPTRTGHSAPTRRQSNPTSRHYGSSTWYETTHGPTNWASPCSRDANRHAASGNETPSTRH

SEQ ID NO: 904391 - protein, 240 aa, Homo sapiens [sequence omitted]

SEQ ID NO: 904392 - protein, 240 aa, Homo sapiens [sequence omitted]

SEQ ID NO: 904393 - protein, 240 aa, Homo sapiens [sequence omitted]

SEQ ID NO: 904394 - protein, 240 aa, Homo sapiens [sequence omitted]

SEQ ID NO: 904395 - protein, 240 aa, Homo sapiens [sequence omitted]

SEQ ID NO: 904396 - protein, 240 aa, Homo sapiens [sequence omitted]

SEQ ID NO: 904397 - protein, 240 aa, Homo sapiens [sequence omitted]

SEQ ID NO: 904398 - protein, 240 aa, Homo sapiens [sequence omitted]

SEQ ID NO: 904399 - protein, 283 aa, Homo sapiens
MTVGKSSKMLQHIDYRMRCILQDGRIFIGTFKAFDKHMNLILCDCDEFRKIKPKNAKQPEREEKRVLGLVLLRGENLVSMTVEGPPPKDTGIARVPLAGAAGGPGVGRAAGRGVPAGVPIPQAPAGLAGPVRGVGGPSQQVMTPQGRGTVAAAAVAATASIAGAPTQYPPGRGTPPPPVGRATPPPGIMAPPPGMRPPMGPPIGLPPARGTPIGMPASCQGAKRPARPLLRLCVPGVVALRCDPAHVWAQPGSAPQEGGQLDNKKENSVNGYYEKKKSFIAEV

SEQ ID NO: 904400 - protein, 213 aa, Homo sapiens
MTVGKSSKMLQHIDYRMRCILQDGRIFIGTFKAFDKHMNLILCDCDEFRKIKPKNAKQPEREEKRVLGLVLLRGENLVSMTVEGPPPKDTGIARVPLAGAAGGPGVGRAAGRGVPAGVPIPQAPAGLAGPVRGVGGPSQQVMTPQGRGTVAAAAVAATASIAGAPTQYPPGRGTPPPPVGRATPPPGIMAPPIGGPMGGLIPGGGAIMPGGGV

SEQ ID NO: 904401 - protein, 240 aa, Homo sapiens [sequence omitted]

SEQ ID NO: 904402 - protein, 240 aa, Homo sapiens [sequence omitted]

SEQ ID NO: 904403 - protein, 240 aa, Homo sapiens [sequence omitted]

SEQ ID NO: 904404 - protein, 162 aa, Homo sapiens; identical to SEQ ID NO: 904372

SEQ ID NO: 904405 - protein, 137 aa, Homo sapiens
MTVGKSSKMLQHIDYRMRCILQDGRIFIGTFKAFDKHMNLILCDCDEFRKIKPKNAKQPEREEKRVLGLVLLRGENLVSMTVEGPPPKDTGGRTLGSRGRVEEGEIQGETPPGGGAEGDPVGRRRRIGQQRARHPRR

SEQ ID NO: 904406 - protein, 813 aa, Homo sapiens
MAGVVLHFASCSDTLFYLYRYSEFLFFSTCCTLSKAKRKLILGSRKAEAFGEMETRMCKNETTTSRIKKKKCQSSRVLSDVQEGGGIIFMEHILWNTVSIVPAFNEYCWFFRTVAFFSFFFSCVQLINLYRAYHTIDVYEILSELNEAALLIFVYVRRYLTVQAGVSGINITHCSLEHLSSNDPFTLSSRVAGTAVACQHAWLILVFNFFRVGISLCCLDWSWTPGLMPSSCLSWYCRCEPLCQVLIFFMLENKFLGILYYFLMTISHQNLGLSDICLHTFIPCSQPFPDRGHLSYLVFTSTCLLPCDDIYSVFLGMVLGFLVVVKMPVIPALWEVEAGGSPEVRSSSPAWPTWRNPTSTKNTKISLAWWQAPVIPTTQEAKAGELLEPEEAEVAVSRDRANGTPFSLSDRGGDSHLKVKKKNRNQQLLFEFTGVRSPLLHGEMGNIYSIEIFETRYGGSEPVIPALWEAELGGSPDIRSLRLAWPTEQYPVSKIQKLPRLGGVCLWSQLLRRLRQENHLNLGGKGCSEPRPCHCTPAWVTSETPSGKKKKKMRYKVQRMYLLSQYKVKKVGNVVEVYVDKGIRWLYNEEGGCRHGETVLLALPLSVSSVWVTGILFHNACLPMSFKNYYSVEMISRKNLAGLICFAEPIQLKKRGPYYVPKNQEGGSHLNLMFSYCESFSVELNENTVTLRVEVVHLNCSGCFLSFGCFVCIDIFILCYIICSLVAKIELKDTVPEIYDFMFRRYVSGIIVWVLMRKSGLHYCATLVSCQKVSSLDLLQNPFFGLCVSYVVPALILFVCPLSFYTICLHLTL

SEQ ID NO: 904407 - protein, 72 aa, Homo sapiens
MTVGKSSKMLQHIDYRMRCILQDGRIFIGTFKAFDKHMNLILCDCDEFRKINQRMRQHTRSVKVEGHPPRYC

SEQ ID NO: 904408 - protein, 124 aa, Homo sapiens
MTPQGRGTVAAAAVAATASIAGAPTQYPPGRGTPPPPVGRATPPPGIMAPPPGMRPPMGPPIGLPPARGTPIGMPPPGMRPPPPGIRGEAFLLALVCWYGWPLDFGMSDYAAYLKKTCFQDLFN

SEQ ID NO: 904409 - protein, 112 aa, Homo sapiens
MGSRLSQPFESYITAPPGTAAAPAKPAPPATPGAPTSPAEHRLLKTCWSCRVLSGLGLMGAGGYVYWVARKPMKMGYPPSPWTITQMVIGLSIATWGIVVMADPKGKAYRVV

SEQ ID NO: 904410 - protein, 112 aa, Homo sapiens; identical to SEQ ID NO: 904409

SEQ ID NO: 904411 - protein, 112 aa, Homo sapiens; identical to SEQ ID NO: 904409

SEQ ID NO: 904412 - protein, 112 aa, Homo sapiens; identical to SEQ ID NO: 904409

SEQ ID NO: 904413 - protein, 112 aa, Homo sapiens; identical to SEQ ID NO: 904409

SEQ ID NO: 904414 - protein, 105 aa, Homo sapiens
MGSRLSQPFESYITAPPGTAAAPAKPAPPATPGAPTSPAEHRLLKTCWSCRVLSGLGLMGAGGYVYWVARKPMKMGYPPSPWTITQMVIGLSENQGTALGRVGYL

SEQ ID NO: 904415 - protein, 112 aa, Homo sapiens; identical to SEQ ID NO: 904409

SEQ ID NO: 904416 - protein, 129 aa, Homo sapiens
MGSRLSQPFESYITAPPGTAAAPAKPAPPATPGAPTSPAEHRLLKTCWSCRVLSGLGLMGAGGHCHLGYRCHGRPQREGLPRCLKVPPVNLSSVSVPFPVTHRAGMEFNGCSGQTLVHGQTSLLWILQD

SEQ ID NO: 904417 - protein, 129 aa, Homo sapiens; identical to SEQ ID NO: 904416

SEQ ID NO: 904418 - protein, 910 aa, Homo sapiens
MGVRGLQGFVGSTCPHICTVVNFKELAEHHRSKYPGCTPTIVVDAMCCLRYWYTPESWICGGQWREYFSALRDFVKTFTAAGIKLIFFFDGMVEQDKRDEWVKRRLKNNREISRIFHYIKSHKEQPGRNMFFIPSGLAVFTRFALKTLGQETLCSLQEADYEVASYGLQHNCLGILGEDTDYLIYDTCPYFSISELCLESLDTVMLCREKLCESLGLCVADLPLLACLLGNDIIPEGMFESFRYKCLSSYTSVKENFDKKGNIILAVSDHISKVLYLYQGEKKLEEILPLGPNKALFYKGMASYLLPGQKSPWFFQKPKGVITLDKQVISTSSDAESREEVPMCSDAESRQEVPMCTGPESRREVPVYTDSEPRQEVPMCSDPEPRQEVPTCTGPESRREVPMCSDPEPRQEVPMCTGPEARQEVPMYTDSEPRQEVPMYTDSEPRQEVPMYTGSEPRQEVPMYTGPESRQEVPMYTGPESRQEVLIRTDPESRQEIMCTGHESKQEVPICTDPISKQEDSMCTHAEINQKLPVATDFEFKLEALMCTNPEIKQEDPTNVGPEVKQQVTMVSDTEILKVARTHHVQAESYLVYNIMSSGEIECSNTLEDELDQALPSQAFIYRPIRQRVYSLLLEDCQDVTSTCLAVKEWFVYPGNPLRHPDLVRPLQMTIPGGTPSLKILWLNQEPEIQVRRLDTLLACFNLSSSREELQAVESPFQALCCLLIYLFVQVDTLCLEDLHAFIAQALCLQGKSTSQLVNLQPDYINPRAVQLGSLLVRGLTTLVLVNSACGFPWKTSDFMPWNVFDGKLFHQKYLQSEKGYAVEVLLEQNRSRLTKFHNLKAVVCKACMKENRRITGRAHWGSHHAGRWGRQGSSYHRTGSGYSRSSQGQPWRDQGPGSRQYEHDQWRRY

SEQ ID NO: 904419 - protein, 910 aa, Homo sapiens; identical to SEQ ID NO: 904418

SEQ ID NO: 904420 - protein, 910 aa, Homo sapiens; identical to SEQ ID NO: 904418

SEQ ID NO: 904421 - protein, 910 aa, Homo sapiens; identical to SEQ ID NO: 904418

SEQ ID NO: 904422 - protein, 493 aa, Homo sapiens
MGVRGLQGFVGSTCPHICTVVNFKELAEHHRSKYPGCTPTIVVDAMCCLRYWYTPESWICGGQWREYFSALRDFVKTFTAAGIKLIFFFDGMVEQDKRDEWVKRRLKNNREISRIFHYIKSHKEQPGRNMFFIPSGLAVFTRFALKTLGQETLCSLQEADYEVASYGLQHNCLGILGEDTDYLIYDTCPYFSISELCLESLDTVMLCREKLCESLGLCVADLPLLACLLGNDIIPEGMFESFRYKCLSSYTSVKENFDKKGNIILAVSDHISKVLYLYQGEKKLEEILPLGPNKALFYKGMASYLLPGQKSPWFFQKPKGVITLDKQVISTSSDAESREEVPMCSDAESRQEVPMCTGPESRREVPVYTDSEPRQEVPMCSDPEPRQEVPTCTGPESRREVPMCSDPEPRQEVPMCTGPEARQEVPMYTDSEPRQEVPMYTDSEPRQEVPMYTGSEPRQEVPMYTGPESRQEVPKTIIVNIFMCFILIFHSYI

SEQ ID NO: 904423 - protein, 167 aa, Homo sapiens
HRVPEKARAEGSERENNYGCGVVGGEMTTLVLDNGAYNAKIGYSHENVSVIPNCQFRSKTARLKTFTANQIDEIKDPSGLFYILPFQKGYLVNWDVQRQVWDYLFGKEMYQVDFLDTNIIITEPYFNFTSIQESMNEILFEEYQFQAVLRVNVPYCRSKKKKEAIIR

SEQ ID NO: 904424 - protein, 291 aa, Homo sapiens
HRVPEKARAEGSERENNYGCGVVGGEMTTLVLDNGAYNAKIGYSHENVSVIPNCQFRSKTARLKTFTANQIDEIKDPSGLFYILPFQKGYLVNWDVQRQVWDYLFGKEMYQVDFLDTNIIITEPYFNFTSIQESMNEILFEEYQFQAVLRVNAGALSAHRYFRDNPSELCCIIVDSGYSFTHIVPYCRSKKKKEAIIRINVGGKLLTNHLKEIISYRQLHVMDETHVINQVKEDVCYVSQDFYRDMDIAKLKGEENTVMIDYVLPDFSTIKKGFCKPYYLCLGRWKIDIRE

SEQ ID NO: 904425 - protein, 314 aa, Homo sapiens
MYQVDFLDTNIIITEPYFNFTSIQESMNEILFEEYQFQAVLRVNAGALSAHRYFRDNPSELCCIIVDSGYSFTHIVPYCRSKKKKEAIIRINVGGKLLTNHLKEIISYRQLHVMDETHVINQVKEDVCYVSQDFYRDMDIAKLKGEENTVMIDYVLPDFSTIKKGFCKPREEMVLSGKYKSGEQILRLANERFAVPEILFNPSDIGIQEMGIPEAIVYSIQNLPEEMQPHFFKNIVLTGGNSLFPGFRDRVYSEVRCLTPTDYDVSVVLPENPITYAWEGGKLISENDDFEDMVVTREDYEENGHSVCEEKFDI

SEQ ID NO: 904426 - protein, 391 aa, Homo sapiens
HRVPEKARAEGSERENNYGCGVVGGEMTTLVLDNGAYNAKIGYSHENVSVIPNCQFRSKTARLKTFTANQIDEIKDPSGLFYILPFQKGYLVNWDVQRQVWDYLFGKEMYQVDFLDTNIIITEPYFNFTSIQESMNEILFEEYQFQAVLRVNVPYCRSKKKKEAIIRINVGGKLLTNHLKEIISYRQLHVMDETHVINQVKEDVCYVSQDFYRDMDIAKLKGEENTVMIDYVLPDFSTIKKGFCKPREEMVLSGKYKSGEQILRLANERFAVPEILFNPSDIGIQEMGIPEAIVYSIQNLPEEMQPHFFKNIVLTGGNSLFPGFRDRVYSEVRCLTPTDYDVSVVLPENPITYAWEGGKLISENDDFEDMVVTREDYEENGHSVCEEKFDI

SEQ ID NO: 904427 - protein, 422 aa, Homo sapiens
HRVPEKARAEGSERENNYGCGVVGGEMTTLVLDNGAYNAKIGYSHENVSVIPNCQFRSKTARLKTFTANQIDEIKDPSGLFYILPFQKGYLVNWDVQRQVWDYLFGKEMYQVDFLDTNIIITEPYFNFTSIQESMNEILFEEYQFQAVLRVNAGALSAHRYFRDNPSELCCIIVDSGYSFTHIVPYCRSKKKKEAIIRINVGGKLLTNHLKEIISYRQLHVMDETHVINQVKEDVCYVSQDFYRDMDIAKLKGEENTVMIDYVLPDFSTIKKGFCKPREEMVLSGKYKSGEQILRLANERFAVPEILFNPSDIGIQEMGIPEAIVYSIQNLPEEMQPHFFKNIVLTGGNSLFPGFRDRVYSEVRCLTPTDYDVSVVLPENPITYAWEGGKLISENDDFEDMVVTREDYEENGHSVCEEKFDI

SEQ ID NO: 904428 - protein, 402 aa, Homo sapiens
HRVPEKARAEGSERENNYGCGVVGGEMTTLVLDNGAYNAKIGYSHENVSVIPNCQFRSKTARLKTFTANQIDEIKDPSGLFYILPFQKGYLVNWDVQRQVWDYLFGKEMYQVDFLDTNIIITEPYFNFTSIQESMNEILFEEYQFQAVLRVNAGALSAHRYFRDNPSELCCIIVDSGYSFTHIVPYCRSKKKKEAIIRINVGGKLLTNHLKEIISYRQLHVMDETHVINQVKEDVCYVSQDFYRDMDIAKLKGEENTVMIDYVLPDFSTIKKGFCKPREEMVLSGKYKSGEQILRLANERFAVPEILFNPSDIGIQEMGIPEAIVYSIQNLPEGFRDRVYSEVRCLTPTDYDVSVVLPENPITYAWEGGKLISENDDFEDMVVTREDYEENGHSVCEEKFDI

SEQ ID NO: 904429 - protein, 288 aa, Homo sapiens
MNEILFEEYQFQAVLRVNAGALSAHRYFRDNPSELCCIIVDSGYSFTHIVPYCRSKKKKEAIIRINVGGKLLTNHLKEIISYRQLHVMDETHVINQVKEDVCYVSQDFYRDMDIAKLKGEENTVMIDYVLPDFSTIKKGFCKPREEMVLSGKYKSGEQILRLANERFAVPEILFNPSDIGIQEMGIPEAIVYSIQNLPEEMQPHFFKNIVLTGGNSLFPGFRDRVYSEVRCLTPTDYDVSVVLPENPITYAWEGGKLISENDDFEDMVVTREDYEENGHSVCEEKFDI

SEQ ID NO: 904430 - protein, 153 aa, Homo sapiens
HRVPEKARAEGSERENNYGCGVVGGEMTTLVLDNGAYNAKIGYSHENVSVIPNCQFRSKTARLKTFTANQIDEIKDPSGLFYILPFQKGYLVNWDVQRQVWDYLFGKEMYQVDFLDTNIIITEPYFNFTSIQESMNEILFEEYQFQAVLRVNG

SEQ ID NO: 904431 - protein, 251 aa, Homo sapiens
DCVHTLHSRDTWLKKARVVRLGEVPYKMVKGFSNRARKARLAEPQLREENDLGLFGYWQTEEYQPPVAVDGKVPRNEFGNVYLFLPSMMPIGCVQLNLPNLHRVARKLDIDCVQAITGFDFHGGYSHPVTDGYIVCEEFKDVLLTAWENEQAVIERKEKEKKEKRALGNWKLLAKGLLIRERLKRRYGPKVSAGSLQRRQAQGQFLGDAAQKGLAQILPQPQVRDSFVLGHLSLLSLRPLVFTLLGKVSLE

SEQ ID NO: 904432 - protein, 153 aa, Homo sapiens
MWPTVFHKLGREERQSRQQVRGFDIALCPHRTDGYIVCEEFKDVLLTAWENEQAVIERKEKEKKEKRALGNWKLLAKGLLIRERLKRRYGPKVSAGSLQRRQAQGQFLGDAAQKGLAQILPQPQVRDSFVLGHLSLLSLRPLVFTLLGKVSLE

SEQ ID NO: 904433 - protein, 241 aa, Homo sapiens
DCVHTLHSRDTWLKKARVVRLGEVPYKMVKGFSNRARKARLAEPQLREENDLGLFGYWQTEEYQPPVAVDGKVPRNEFGNVYLFLPSMMPIGCVQLNLPNLHRVARKLDIDCVQAITGFDFHGGYSHPVTDGYIVCEEFKDVLLTAWENEQAVIERKEKERLKRRYGPKSEAAAPHTDAGGGLSSDEEEGTSSQAEAARILAASWPQNREDEEKQKLKGGPKKTKREKKAAASHLFPFEQL

SEQ ID NO: 904434 - protein, 262 aa, Homo sapiens
DCVHTLHSRDTWLKKARVVRLGEVPYKMVKGFSNRARKARLAEPQLREENDLGLFGYWQTEEYQPPVAVDGKVPRNEFGNVYLFLPSMMPIGCVQLNLPNLHRVARKLDIDCVQAITGFDFHGGYSHPVTDGYIVCEEFKDVLLTAWENEQAVIERKEKEKKEKRALGNWKLLAKGLLIRERLKRRYGPKSEAAAPHTDAGGGLSSDEEEGTSSQAEAARILAASWPQNREDEEKQKLKGGPKKTKREKKAAASHLFPFEQL

SEQ ID NO: 904435 - protein, 251 aa, Homo sapiens; identical to SEQ ID NO: 904431

SEQ ID NO: 904436 - protein, 105 aa, Homo sapiens
SYLFLWLSGIVYHFVNQINFLEVRLGVKERLYSKVVYISVFTFTVSILIFFLKMSVLNTFLPLHFCLQKKEKRALGNWKLLAKGLLIRERLKRRYGPKVSAGSLQ

SEQ ID NO: 904437 - protein, 262 aa, Homo sapiens; identical to SEQ ID NO: 904434

SEQ ID NO: 904438 - protein, 251 aa, Homo sapiens; identical to SEQ ID NO: 904431

SEQ ID NO: 904439 - protein, 251 aa, Homo sapiens; identical to SEQ ID NO: 904431

SEQ ID NO: 904440 - protein, 251 aa, Homo sapiens; identical to SEQ ID NO: 904431

SEQ ID NO: 904441 - protein, 452 aa, Homo sapiens
TFNRRNPRERSPTPPAPQPPQPPQPVRPAPSSAMAKEGVEKAEETEQMIEKEAGKEPAEGGGGDGSHRLGDAQEMRAVVLAGFGGLNKLRLFRKAMPEPQDGELKIRVKACGLNFIDLMVRQGNIDNPPKTPLVPGFECSGIVEALGDSVKGYEIGDRVMAFVNYNAWAEVVCTPVEFVYKIPDDMSFSEAAAFPMNFVTAYVMLFEVANLREGMSVLVHSAGGGVGQAVAQLCSTVPNVTVFGTASTFKHEAIKDSVTHLFDRNADYVQEVKRISAEGVDIVLDCLCGDNTGKGLSLLKPLGTYILYGSSNMVTGETKSFFSFAKSWWQVEKVNPIKLYEENKVIAGFSLLNLLFKQGRAGLIRGVVEKLIGLYNQKKIKPVVDSLWALEEVKEAMQRIHDRGNIGKLILDVEKTPTPLMANDSTETSEAGEEEEDHEGDSENKERMPFIQ

SEQ ID NO: 904442 - protein, 452 aa, Homo sapiens; identical to SEQ ID NO: 904441

SEQ ID NO: 904443 - protein, 452 aa, Homo sapiens; identical to SEQ ID NO: 904441

SEQ ID NO: 904444 - protein, 2298 aa, Homo sapiens [sequence omitted]

SEQ ID NO: 904445 - protein, 2152 aa, Homo sapiens
TREIPLRSHIFILANSTRTDALLLRLSLVVGKEVFYTALWGSVLASPSIRLPASVFVVGHINRDAPGREQKYMLGTNHQLTVKSLRASLLDSNVLVQRNNLEIVLFFFPFYTCLDSNERAIPLLRSDIVRILSAATQTLLRRDMSLNRRLYAWLLGSDIKGNTVVPESEISNSYEDQSSYFFEKYSKDLLVEGLAEILHQKFIDADVEERHHAYLKPFRVLISLLDKPEIGPQVVGNLFLEVIRAFYSYCRDALGSDLKLSYTQSGNSLISAIKENRNASEIVKTVNLLITSLSTDFLWDYMTRCFEECFRPVKQRYSVRNSVSPPPTVSELCALLVFLLDVIPLELYSEVQTQYLPQVLGCLVQPLAEDMEALSLPELTHALKTCFKVLSKVQMPPSYLDTESTSGTSSPVKGENGKIILETKAVIPGDEDASFPPLKSEDSGIGLSASSPELSEHLRVPRVSLERDDVWKKGGSMQRTFLCIQELIANFASKNIFGVQLTASGEESKSEEPAGKRDRDGTQSLAANDSSRKNSWEPKPITVPQFKQMLSDLFTARGSPFKTKSSESPSSSPSSPARKNGGEWDVEKVVIDLGGSREERREAFAAACHLLLDCATFPVYLSEEETEQLCATLFQLPGAGDSSFPSWLKSLMTICCCVTDCYLQNVAISTLLEVINHSQSLALVIEDKMKRYKSSGHNPFFGKLQMVTVPPIAPGILKVIAEKTDFYQRVARVLWNQLNKETREHHVTCVELFYRLHCLAPTANICEDIICHALLDPDKGTRLEALFRFSVIWHLTREIQGSRVTSHNRSFDRSLFVVLDSLACTDGAIGAAAQGWLVRALSLGDVARILEPVLLLLLQPKTQRTSIHCLKQENSADDLHRWFNRKKTSFREACAVPEPQESGSEEHLPLSQFTTVDREAIWAEVEKEPEKYPLRGELSEEELPYYVELPDRTAHGAPDSSEHTESADTSSGHTDSENTSSFSSPSHDLQELSNEENCCAPIHMGGRAYPKRSALLAAFQSESFKAGAKLSLVRVDSDKTQASESFSSDEEADLELQALTTSRLLKQQRERQEAVEALFKHILLYLQPYDSRRVLYAFSVLEAVLKTNPKEFIEAVSRTSMDTSSTAHLNLISNLLARHQEALIGQSFYGKLQTQVPNVCPHSLLLELLTYLCLSFLRSYYPCYLKVSHRDILGNRDVQVKSVEVLIRIMMQLVSVAKSSEGKNVEFIHSLLQRCKVQEFVLLSLSASMYTSQKRYGLATAHHGRALPEDSLFEESLINLGQDQIWSEHPLQIELLKLLQVLIVLEHHLGRAHEEAENQPDLSREWQRALNFQQAISALQYVQPHPLTSQGLLVSAVVRGLQPAYGYGMHPAWVSLVTHSLPYFGKSLGWTVTPFVVQICKNLDDLVKQYESESVKLSVSTTSKRENISPDYPLTLLEGLTTISHFCLLEQANQNKKTMAAGDPANLRNARNAILEELPRTVNTMALLWNVLRKEETQKRPVDLLGATKGSSSVYFKTTKTIRQKILDFLNPLTAHLGVQLTAAVAAVWSRKKAQRHSKMKIIPTASASQLTLVDLVCALSTLQTDTLLHLVKEVVKRPPQVKGGDEKSPLVDIPVLQFCYAFLQRLPVPALQENFSSLLGVLKESVQLNLAPPGYFLLLSMLNDFVTRTPNLENKKDQKDLQEITQKILEAVGNIAGSSLEQTSWLSRNLEVKAQPQASLEESDAEEDLYDAAAASAMVSSSAPSVYSVQALSLLAEVLASLLDMVYRSDEKEKAVPLISRLLYYVFPYLRNHSAYNAPSFRAGAQLLSSLSGYAYTKRAWRKEVLELFLDPAFFQMDTSCVHWKSIIDHLLTHEKTMFKDLMNMQSSSLKLFSSFEQKAMLLKRQAFAVFSGELDQYHLYLPLIQERLTDNLRVGQTSIVAAQMFLFFRVLLLRISPQHLTSLWPIMVSELIQTFTQLEEDLKDEDESLRSTNKVNRTKVSVPDANGPSVGEIPQSELILYLSACKFLDTALSFPPDKMPLFQIYRWAFIPEVDTEGPAFLSDVEENHQECKPHTVRILELLKLKFGEISSSDEITMKSEFPLLRQHSVSSIRQLMPFFMTLNGAFKTQRQLPADSPGTPFLDFPVTDSPRILKQLEECIEYDFLEHPEC

SEQ ID NO: 904446 - protein, 1772 aa, Homo sapiens
MDPEEQELLNDYRYRSYSSVIEKALRNFESSSEWADLISSLGKLNKALQSNLRYSLLPRRLLISKRLAQCLHPALPSGVHLKALETYEIIFKIVGTKWLAKDLFLYSCGLFPLLAHAAVSVRPVLLTLYEKYFLPLQKLLLPSLQAFIVGLLPGLEEGSEISDRTDALLLRLSLVVGKEVFYTALWGSVLASPSIRLPASVFVVGHINRDAPGREQKYMLGTNHQLTVKSLRASLLDSNVLVQRNNLEIVLFFFPFYTCLDSNERAIPLLRSDIVRILSAATQTLLRRDMSLNRRLYAWLLGSDIKGNTVVPESEISNSYEDQSSYFFEKYSKDLLVEGLAEILHQKFIDADVEERHHAYLKPFRVLISLLDKPEIGPQVVGNLFLEVIRAFYSYCRDALGSDLKLSYTQSGNSLISAIKENRNASEIVKTVNLLITSLSTDFLWDYMTRCFEECFRPVKQRYSVRNSVSPPPTVSELCALLVFLLDVIPLELYSEVQTQYLPQVLGCLVQPLAEDMEALSLPELTHALKTCFKVLSKVQMPPSYLDTESTSGTSSPVKGENGKIILETKAVIPGDEDASFPPLKSEDSGIGLSASSPELSEHLRVPRVSLERDDVWKKGGSMQRTFLCIQELIANFASKNIFGVQLTASGEESKSEEPAGKRDRDGTQSLAANDSSRKNSWEPKPITVPQFKQMLSDLFTARGSPFKTKSSESPSSSPSSPARKNGGEWDVEKVVIDLGGSREERREAFAAACHLLLDCATFPVYLSEEETEQLCATLFQLPGAGDSSFPSWLKSLMTICCCVTDCYLQNVAISTLLEVINHSQSLALVIEDKMKRYKSSGHNPFFGKLQMVTVPPIAPGILKVIAEKTDFYQRVARVLWNQLNKETREHHVTCVELFYRLHCLAPTANICEDIICHALLDPDKGTRLEALFRFSVIWHLTREIQGSRVTSHNRSFDRSLFVVLDSLACTDGAIGAAAQGWLVRALSLGDVARILEPVLLLLLQPKTQRTSIHCLKQENSADDLHRWFNRKKTSFREACAVPEPQESGSEEHLPLSQFTTVDREAIWAEVEKEPEKYPLRGELSEEELPYYVELPDRTAHGAPDSSEHTESADTSSGHTDSENTSSFSSPSHDLQELSNEENCCAPIHMGGRAYPKRSALLAAFQSESFKAGAKLSLVRVDSDKTQASESFSSDEEADLELQALTTSRLLKQQRERQEAVEALFKHILLYLQPYDSRRVLYAFSVLEAVLKTNPKEFIEAVSRTSMDTSSTAHLNLISNLLARHQEALIGQSFYGKLQTQVPNVCPHSLLLELLTYLCLSFLRSYYPCYLKVSHRDILGNRDVQVKSVEVLIRIMMQLVSVAKSSEGKNVEFIHSLLQRCKVQEFVLLSLSASMYTSQKRYGLATAHHGRALPEDSLFEESLINLGQDQIWSEHPLQIELLKLLQVLIVLEHHLGRAHEEAENQPDLSREWQRALNFQQAISALQYVQPHPLTSQGLLVSAVVRGLQPAYGYGMHPAWVSLVTHSLPYFGKSLGWTVTPFVVQICKNLDDLVKQYESESVKLSVSTTSKRENISPDYPLTLLEGLTTISHFCLLEQANQNKKTMAAGDPANLRNARNAILEELPRTVNTMALLWNVLRKEETQKRPVDLLGATKGSSSVYFKTTKTIRQKILDFLNPLTAHLGVQLTAAVAAVWSRKKAQRHSKMKIIPTASASQLTLVDLVCALSTLQTDTLLHLVKEVVKRPPQVKGGDEKSPLVDIPVLQFCYAFLQR

SEQ ID NO: 904447 - protein, 2171 aa, Homo sapiens
MDPEEQELLNDYRYRSYSSVIEKALRNFESSSEWADLISSLGKLNKALQSNLRYSLLPRRLLISKRLAQCLHPALPSGVHLKALETYEIIFKIVGTKWLAKDLFLYSCGLFPLLAHAAVSVRPVLLTLYEKYFLPLQKLLLPSLQAFIVGLLPGLEEGSEISDRTDALLLRLSLVVGKEVFYTALWGSVLASPSIRLPASVFVVGHINRDAPGREQKYMLGTNHQLTVKSLRASLLDSNVLVQRNNLEIVLFFFPFYTCLDSNERAIPLLRSDIVRILSAATQTLLRRDMSLNRRLYAWLLGSDIKGNTVVPESEISNSYEDQSSYFFEKYSKDLLVEGLAEILHQKFIDADVEERHHAYLKPFRVLISLLDKPEIGPQVVGNLFLEVIRAFYSYCRDALGSDLKLSYTQSGNSLISAIKENRNASEIVKTVNLLITSLSTDFLWDYMTRCFEECFRPVKQRYSVRNSVSPPPTVSELCALLVFLLDVIPLELYSEVQTQYLPQVLGCLVQPLAEDMEALSLPELTHALKTCFKVLSKVQMPPSYLDTESTSGTSSPVKGENGKIILETKAVIPGDEDASFPPLKSEDSGIGLSASSPELSEHLRVPRVSLERDDVWKKGGSMQRTFLCIQELIANFASKNIFGVQLTASGEESKSEEPAGKRDRDGTQSLAANDSSRKNSWEPKPITVPQFKQMLSDLFTARGSPFKTKSSESPSSSPSSPARKNGGEWDVEKVVIDLGGSREERREAFAAACHLLLDCATFPVYLSEEETEQLCATLFQLPGAGDSSFPSWLKSLMTICCCVTDCYLQNVAISTLLEVINHSQSLALVIEDKMKRYKSSGHNPFFGKLQMVTVPPIAPGILKVIAEKTDFYQRVARVLWNQLNKETREHHVTCVELFYRLHCLAPTANICEDIICHALLDPDKGTRLEALFRFSVIWHLTREIQGSRVTSHNRSFDRSLFVVLDSLACTDGAIGAAAQGWLVRALSLGDVARILEPVLLLLLQPKTQRTSIHCLKQENSADDLHRWFNRKKTSFREACAVPEPQESGSEEHLPLSQFTTVDREAIWAEVEKEPEKYPLRGELSEEELPYYVELPDRTAHGAPDSSEHTESADTSSGHTDSENTSSFSSPSHDLQELSNEENCCAPIHMGGRAYPKRSALLAAFQSESFKAGAKLSLVRVDSDKTQASESFSSDEEADLELQALTTSRLLKQQRERQEAVEALFKHILLYLQPYDSRRVLYAFSVLEAVLKTNPKEFIEAVSRTSMDTSSTAHLNLISNLLARHQEALIGQSFYGKLQTQVPNVCPHSLLLELLTYLCLSFLRSYYPCYLKVSHRDILGNRDVQVKSVEVLIRIMMQLVSVAKSSEGKNVEFIHSLLQRCKVQEFVLLSLSASMYTSQKRYGLATAHHGRALPEDSLFEESLINLGQDQIWSEHPLQIELLKLLQVLIVLEHHLGRAHEEAENQPDLSREWQRALNFQQAISALQYVQPHPLTSQGLLVSAVVRGLQPAYGYGMHPAWVSLVTHSLPYFGKSLGWTVTPFVVQICKNLDDLVKQYESESVKLSVSTTSKRENISPDYPLTLLEGLTTISHFCLLEQANQNKKTMAAGDPANLRNARNAILEELPRTVNTMALLWNVLRKEETQKRPVDLLGATKGSSSVYFKTTKTIRQKILDFLNPLTAHLGVQLTAAVAAVWSRKKAQRHSKMKIIPTASASQLTLVDLVCALSTLQTDTLLHLVKEVVKRPPQVKGGDEKSPLVDIPVLQFCYAFLQRLPVPALQENFSSLLGVLKESVQLNLAPPGYFLLLSMLNDFVTRTPNLENKKDQKDLQEITQKILEAVGNIAGSSLEQTSWLSRNLEVKAQPQASLEESDAEEDLYDAAAASAMVSSSAPSVYSVQALSLLAEVLASLLDMVYRSDEKEKAVPLISRLLYYVFPYLRNHSAYNAPSFRAGAQLLSSLSGYAYTKRAWRKEVLELFLDPAFFQMDTSCVHWKSIIDHLLTHEKTMFKDLMNMQSSSLKLFSSFEQKAMLLKRQAFAVFSGELDQYHLYLPLIQERLTDNLRVGQTSIVAAQMFLFFRVLLLRISPQHLTSLWPIMVSELIQTFTQLEEDLKDEDESLRSTHQVNRTKVSVRSNPGRFLSTSNSSLYDGQRNKAYFTKRLPPSVFLRSSNQP

SEQ ID NO: 904448 - protein, 64 aa, Homo sapiens
CCCSFSNGVFIRPVGVQRASPLSPGRGKYTPDLSSFMEMSAITNCCKDICSFPGASERGPHPPR

SEQ ID NO: 904449 - protein, 120 aa, Homo sapiens [sequence omitted]

SEQ ID NO: 904450 - protein, 2298 aa, Homo sapiens [sequence omitted]

SEQ ID NO: 904451 - protein, 2291 aa, Homo sapiens
MDPEEQELLNDYRYRSYSSVIEKALRNFESSSEWADLISSLGKLNKALQSNLRYSLLPRRLLISKRLAQCLHPALPSGVHLKALETYEIIFKIVGTKWLAKDLFLYSCGLFPLLAHAAVSVRPVLLTLYEKYFLPLQKLLLPSLQAFIVGLLPGLEEGSEISDRTDALLLRLSLVVGKEVFYTALWGSVLASPSIRLPASVFVVGHINRDAPGREQKYMLGTNHQLTVKSLRASLLDSNVLVQRNNLEIVLFFFPFYTCLDSNERAIPLLRSDIVRILSAATQTLLRRDMSLNRRLYAWLLGSDIKGNTVVPESEISNSYEDQSSYFFEKYSKDLLVEGLAEILHQKFIDADVEERHHAYLKPFRVLISLLDKPEIGPQVVGNLFLEVIRAFYSYCRDALGSDLKLSYTQSGNSLISAIKENRNASEIVKTVNLLITSLSTDFLWDYMTRCFEECFRPVKQRYSVRNSVSPPPTVSELCALLVFLLDVIPLELYSEVQTQYLPQVLGCLVQPLAEDMEALSLPELTHALKTCFKVLSKVQMPPSYLDTESTSGTSSPVKGENGKIILETKAVIPGDEDASFPPLKSEDSGIGLSASSPELSEHLRVPRVSLERDDVWKKGGSMQRTFLCIQELIANFASKNIFGVQLTASGEESKSEEPAGKRDRDGTQSLAANDSSRKNSWEPKPITVPQFKQMLSDLFTARGSPFKTKSSESPSSSPSSPARKNGGEWDVEKVVIDLGGSREERREAFAAACHLLLDCATFPVYLSEEETEQLCATLFQLPGAGDSSFPSWLKSLMTICCCVTDCYLQNVAISTLLEVINHSQSLALVIEDKMKRYKSSGHNPFFGKLQMVTVPPIAPGILKVIAEKTDFYQRVARVLWNQLNKETREHHVTCVELFYRLHCLAPTANICEDIICHALLDPDKGTRLEALFRFSVIWHLTREIQGSRVTSHNRSFDRSLFVVLDSLACTDGAIGAAAQGWLVRALSLGDVARILEPVLLLLLQPKTQRTSIHCLKQENSADDLHRWFNRKKTSFREACAVPEPQESGSEEHLPLSQFTTVDREAIWAEVEKEPEKYPLRGELSEEELPYYVELPDRTAHGAPDSSEHTESADTSSGHTDSENTSSFSSPSHDLQELSNEENCCAPIHMGGRAYPKRSALLAAFQSESFKAGAKLSLVRVDSDKTQASESFSSDEEADLELQALTTSRLLKQQRERQEAVEALFKHILLYLQPYDSRRVLYAFSVLEAVLKTNPKEFIEAVSRTSMDTSSTAHLNLISNLLARHQEALIGQSFYGKLQTQVPNVCPHSLLLELLTYLCLSFLRSYYPCYLKVSHRDILGNRDVQVKSVEVLIRIMMQLVSVAKSSEGKNVEFIHSLLQRCKVQEFVLLSLSASMYTSQKRYGLATAHHGRALPEDSLFEESLINLGQDQIWSEHPLQIELLKLLQVLIVLEHHLGRAHEEAENQPDLSREWQRALNFQQAISALQYVQPHPLTSQGLLVSAVVRGLQPAYGYGMHPAWVSLVTHSLPYFGKSLGWTVTPFVVQICKNLDDLVKQYESESVKLSVSTTSKRENISPDYPLTLLEGLTTISHFCLLEQANQNKKTMAAGDPANLRNARNAILEELPRTVNTMALLWNVLRKEETQKRPVDLLGATKGSSSVYFKTTKTIRQKILDFLNPLTAHLGVQLTAAVAAVWSRKKAQRHSKMKIIPTASASQLTLVDLVCALSTLQTDTLLHLVKEVVKRPPQVKGGDEKSPLVDIPVLQFCYAFLQRLPVPALQENFSSLLGVLKESVQLNLAPPGYFLLLSMLNDFVTRTPNLENKKDQKDLQEITQKILEAVGNIAGSSLEQTSWLSRNLEVKAQPQASLEESDAAAASAMVSSSAPSVYSVQALSLLAEVLASLLDMVYRSDEKEKAVPLISRLLYYVFPYLRNHSAYNAPSFRAGAQLLSSLSGYAYTKRAWRKEVLELFLDPAFFQMDTSCVHWKSIIDHLLTHEKTMFKDLMNMQSSSLKLFSSFEQKAMLLKRQAFAVFSGELDQYHLYLPLIQERLTDNLRVGQTSIVAAQMFLFFRVLLLRISPQHLTSLWPIMVSELIQTFTQLEEDLKDEDESLRSTNKVNRTKVSVPDANGPSVGEIPQSELILYLSACKFLDTALSFPPDKMPLFQIYRWAFIPEVDTEGPAFLSDVEENHQECKPHTVRILELLKLKFGEISSSDEITMKSEFPLLRQHSVSSIRQLMPFFMTLNGAFKTQRQLPADSPGTPFLDFPVTDSPRILKQLEECIEYDFLEHPEC

SEQ ID NO: 904452 - protein, 2298 aa, Homo sapiens [sequence omitted]

SEQ ID NO: 904453 - protein, 1792 aa, Homo sapiens
MDPEEQELLNDYRYRSYSSVIEKALRNFESSSEWADLISSLGKLNKALQSNLRYSLLPRRLLISKRLAQCLHPALPSGVHLKALETYEIIFKIVGTKWLAKDLFLYSCGLFPLLAHAAVSVRPVLLTLYEKYFLPLQKLLLPSLQAFIVGLLPGLEEGSEISDRTDALLLRLSLVVGKEVFYTALWGSVLASPSIRLPASVFVVGHINRDAPGREQKYMLGTNHQLTVKSLRASLLDSNVLVQRNNLEIVLFFFPFYTCLDSNERAIPLLRSDIVRILSAATQTLLRRDMSLNRRLYAWLLGSDIKGNTVVPESEISNSYEDQSSYFFEKYSKDLLVEGLAEILHQKFIDADVEERHHAYLKPFRVLISLLDKPEIGPQVVGNLFLEVIRAFYSYCRDALGSDLKLSYTQSGNSLISAIKENRNASEIVKTVNLLITSLSTDFLWDYMTRCFEECFRPVKQRYSVRNSVSPPPTVSELCALLVFLLDVIPLELYSEVQTQYLPQVLGCLVQPLAEDMEALSLPELTHALKTCFKVLSKVQMPPSYLDTESTSGTSSPVKGENGKIILETKAVIPGDEDASFPPLKSEDSGIGLSASSPELSEHLRVPRVSLERDDVWKKGGSMQRTFLCIQELIANFASKNIFGVQLTASGEESKSEEPAGKRDRDGTQSLAANDSSRKNSWEPKPITVPQFKQMLSDLFTARGSPFKTKSSESPSSSPSSPARKNGGEWDVEKVVIDLGGSREERREAFAAACHLLLDCATFPVYLSEEETEQLCATLFQLPGAGDSSFPSWLKSLMTICCCVTDCYLQNVAISTLLEVINHSQSLALVIEDKMKRYKSSGHNPFFGKLQMVTVPPIAPGILKVIAEKTDFYQRVARVLWNQLNKETREHHVTCVELFYRLHCLAPTANICEDIICHALLDPDKGTRLEALFRFSVIWHLTREIQGSRVTSHNRSFDRSLFVVLDSLACTDGAIGAAAQGWLVRALSLGDVARILEPVLLLLLQPKTQRTSIHCLKQENSADDLHRWFNRKKTSFREACAVPEPQESGSEEHLPLSQFTTVDREAIWAEVEKEPEKYPLRGELSEEELPYYVELPDRTAHGAPDSSEHTESADTSSGHTDSENTSSFSSPSHDLQELSNEENCCAPIHMGGRAYPKRSALLAAFQSESFKAGAKLSLVRVDSDKTQASESFSSDEEADLELQALTTSRLLKQQRERQEAVEALFKHILLYLQPYDSRRVLYAFSVLEAVLKTNPKEFIEAVSRTSMDTSSTAHLNLISNLLARHQEALIGQSFYGKLQTQVPNVCPHSLLLELLTYLCLSFLRSYYPCYLKVSHRDILGNRDVQVKSVEVLIRIMMQLVSVAKSSEGKNVEFIHSLLQRCKVQEFVLLSLSASMYTSQKRYGLATAHHGRALPEDSLFEESLINLGQDQIWSEHPLQIELLKLLQVLIVLEHHLGRAHEEAENQPDLSREWQRALNFQQAISALQYVQPHPLTSQGLLVSAVVRGLQPAYGYGMHPAWVSLVTHSLPYFGKSLGWTVTPFVVQICKNLDDLVKQYESESVKLSVSTTSKRENISPDYPLTLLEGLTTISHFCLLEQANQNKKTMAAGDPANLRNARNAILEELPRTVNTMALLWNVLRKEETQKRPVDLLGATKGSSSVYFKTTKTIRQKILDFLNPLTAHLGVQLTAAVAAVWSRKKAQRHSKMKIIPTASASQLTLVDLVCALSTLQTDTLLHLVKEVVKRPPQVKGGDEKSPLVDIPVLQFCYAFLQSVFTLPPTTLFRSHLAMSLTL

SEQ ID NO: 904454 - protein, 898 aa, Homo sapiens
MAAAGGAEGRRAALEAAAAAAPERGGGSCVLCCGDLEATALGRCDHPVCYRCSTKMRVLCEQRYCAVCREELRQVVFGKKLPAFATIPIHQLQHEKKYDIYFADGKVYALYRQLLQHECPRCPELPPFSLFGDLEQHMRRQHELFCCRLCLQHLQIFTYERKWYSRKDLARHRMQGDPDDTSHRGHPLCKFCDERYLDNDELLKHLRRDHYFCHFCDSDGAQDYYSDYAYLREHFREKHFLCEEGRCSTEQFTHAFRTEIDLKAHRTACHSRSRAEARQNRHIDLQFSYAPRHSRRNEGVVGGEDYEEVDRYSRQGRVARAGTRGAQQSRRGSWRYKREEEDREVAAAVRASVAAQQQEEARRSEDQEEGGRPKKEEAAARGPEDPRGPRRSPRTQGEGPGPKETSTNGPVSQEAFSVTGPAAPGALPPPSPKLKDEDFPSLSASTSSSCSTAATPGPVGLALPYAIPARGRSAFQEEDFPALVSSVPKPGTAPTSLVSAWNSSSSSKKVAQPPLSAQATGSGQPTRKAGKGSRGGRKGGPPFTQEEEEDGGPALQELLSTRPTGSVSSTLGLASIQPSKVGKKKKVGSEKPGTTLPQPPPATCPPGALQAPEAPASRAEGPVAVVVNGHTEGPAPARSAPKEPPGLPRPLGSFPCPTPQEDFPALGGPCPPRMPPPPGFSAVVLLKGTPPPPPPGLVPPISKPPPGFSGLLPSPHPACVPSPATTTTTKAPRLLPAPRAYLVPENFRERNLQLIQSIRDFLQSDEARFSEFKSHSGEFRQGLISAAQYYKSCRDLLGENFQKVFNELLVLLPDTAKQQELLSAHTDFCNREKPLSTKSKKNKKSAWQATTQQAGLDCRVCPTCQQVLAHGDASSHQALHAARDDDFPSLQAIARIIT

SEQ ID NO: 904455 - protein, 1294 aa, Homo sapiens
GSQAARRRAGREGAGSRTMAAAGGAEGRRAALEAAAAAAPERGGGSCVLCCGDLEATALGRCDHPVCYRCSTKMRVLCEQRYCAVCREELRQVVFGKKLPAFATIPIHQLQHEKKYDIYFADGKVYALYSVSRASPWVLASLWLWPFTSHSPHNRRHFGGHLVHQCWGQAPGFPSCDWGGLPGPPGGRAGGCAGERHAQVVQHLPRGHLEGHTRCVSQARGLKILERVQLSQGWSLRGGAAHGLRARARLLTQAMCTAMALHLSWVTGLGLVSGPAPGGDTECPGAVGGSRCLPRQLLQHECPRCPELPPFSLFGDLEQHMRRQHELFCCRLCLQHLQVCPPSDPGESLGGWVVQGMWPHGWEGLVHLLLLAPDGPLRVRLHVAGRPLAAGGALSRPLLLRHWPVGRGRRLGVPQPVPSLLCLVIFTYERKWYSRKDLARHRMQGDPDDTSHRGHPLCKFCDERYLDNDELLKHLRRDHYFCHFCDSDGAQDYYSDYAYLREHFREKHFLCEEGRCSTEQFTHAFRTEIDLKAHRTACHSRSRAEARQNRHIDLQFSYAPRHSRRNEGVVGGEDYEEVDRYSRQGRVARAGTRGAQQSRRGSWRYKREEEDREVAAAVRASVAAQQQEEARRSEDQEEGGRPKKEEAAARGPEDPRGPRRSPRTQGEGPGPKETSTNGPVSQEAFSVTGPAAPGCVGVPGLRVWAPRGEWCMVGGCGQPQVGAGRAGMEPRGLIAVDQLCFPAPSALPPPSPKLKDEDFPSLSASTSSSCSTAATPGPVGLALPYAIPARGRSAFQEEDFPALVSSVPKPGTAPTSLVSAWNSSSSSKKVAQPPLSAQATGSGQPTRKAGKGSRGGRKGGPPFTQEEEEDGGPALQELLSTRPTGSVSSTLGLASIQPSKVGKKKKVGSEKPGTTLPQPPPATCPPGALQAPEAPASRAEGPVAVVVNGHTEGPAPARSAPKEPPGLPRPLGSFPCPTPQEDFPALGGPCPPRMPPPPGFSAVVLLKGTPPPPPPGLVPPISKPPPGFSGLLPSPHPACVPSPATTTTTKASVWVSCLVSTGGGGTVPSPWATVKAEASTSSLPSDPQTQAAACPTGVPSPRELPGEEPSAHPVHQGLPAERRGPLQRVQEPLRGVQTGQAGPGSPDGSGGPGAGCQPVFIQGPGQRGWLSPALRWQGLISAAQYYKSCRDLLGENFQKVFNELLVLLPDTAKQQELLSAHTDFCNREKPLSTKSKKNKKSAWQATTQQAGLDCRVCPTCQQVLAHGDASSHQALHAARDDDFPSLQAIARIIT

SEQ ID NO: 904456 - protein, 533 aa, Homo sapiens
MYEAGGESAEGAEDPRGPRRSPRTQGEGPGPKETSTNGPVSQEAFSVTGPAAPGCVGVPGALPPPSPKLKDEDFPSLSASTSSSCSTAATPGPVGLALPYAIPARGRSAFQEEDFPALVSSVPKPGTAPTSLVSAWNSSSSSKKVAQPPLSAQATGSGQPTRKAGKGSRGGRKGGPPFTQEEEEDGGPALQELLSTRPTGSVSSTLGLASIQPSKVGKKKKVGSEKPGTTLPQPPPATCPPGALQAPEAPASRAEGPVAVVVNGHTEGPAPARSAPKEPPGLPRPLGSFPCPTPQEDFPALGGPCPPRMPPPPGFSAVVLLKGTPPPPPPGLVPPISKPPPGFSGLLPSPHPACVPSPATTTTTKAPRLLPAPRAYLVPENFRERNLQLIQSIRDFLQSDEARFSEFKSHSGEFRQGLISAAQYYKSCRDLLGENFQKVFNELLVLLPDTAKQQELLSAHTDFCNREKPLSTKSKKNKKSAWQATTQQAGLDCRVCPTCQQVLAHGDASSHQALHAARDDDFPSLQAIARIIT

SEQ ID NO: 904457 - protein, 244 aa, Homo sapiens
KLALEARQPAVSEGPLWVLSCHPSGFSAVVLLKGTPPPPPPGLVPPISKPPPGFSGLLPSPHPACVPSPATTTTTKAPRLLPAPRAYLVPENFRERNLQLIQSIRDFLQSDEARFSEFKSHSGEFRQGLISAAQYYKSCRDLLGENFQKVFNELLVLLPDTAKQQELLSAHTDFCNREKPLSTKSKKNKKSAWQATTQQAGLDCRVCPTCQQVLAHGDASSHQALHAARDDDFPSLQAIARIIT

SEQ ID NO: 904458 - protein, 144 aa, Homo sapiens
LKRASSLCRKSLRDFLKRASSSGEFRQGLISAAQYYKSCRDLLGENFQKVFNELLVLLPDTAKQQELLSAHTDFCNREKPLSTKSKKNKKSAWQATTQQAGLDCRVCPTCQQVLAHGDASSHQALHAARDDDFPSLQAIARIIT

SEQ ID NO: 904459 - protein, 837 aa, Homo sapiens
GSQAARRRAGREGAGSRTMAAAGGAEGRRAALEAAAAAAPERGGGSCVLCCGDLEATALGRCDHPVCYRCSTKMRVLCEQRYCAVCREELRQVVFGKKLPAFATIPIHQLQHEKKYDIYFADGKVYALYRQLLQHECPRCPELPPFSLFGDLEQHMRRQHELFCCRLCLQHLQIFTYERKWYSRKDLARHRMQGDPDDTSHRGHPLCKFCDERYLDNDELLKHLRRDHYFCHFCDSDGAQDYYSDYAYLREHFREKHFLCEEGRCSTEQFTHAFRTEIDLKAHRTACHSRSRAEARQNRHIDLQFSYAPRHSRRNEGVVGGEDYEEVDRYSRQGRVARAGTRGAQQSRRGSWRYKREEEDREVAAAVRASVAAQQQEEARRSEDQEEGGRPKKEEAAARGPEDPRGPRRSPRTQGEGPGPKETSTNGPVSQEAFSVTGPAAPGALPPPSPKLKDEDFPSLSASTSSSCSTAATPGPVGLALPYAIPARGRSAFQEEDFPALVSSVPKPGTAPTSLVSAWNSSSSSKKVAQPPLSAQATGSGQPTRKAGKGSRGGRKGGPPFTQEEEEDGGPALQELLSTRPTGSVSSTLGLASIQPSKVGKKKKVGSEKPGTTLPQPPPATCPPGALQAPEAPASRAEGPVAVVVNGHTEGPAPARSAPKEPPGLPRPLGSFPCPTPQEDFPALGGPCPPRMPPPPGFSSCGAPEGHACARDREGNRRGAQSGGASGAGSEEGTETRKKREAKRTKKEGEEAGRERKKRESGRSARTEETRREEAENSTRGEEGREGRGRREAGKEPRGQDRRSKEERTRRRQRREQSRRPSEGRAAREDEAKGGKT

SEQ ID NO: 904460 - protein, 240 aa, Homo sapiens
GSQAARRRAGREGAGSRTMAAAGGAEGRRAALEAAAAAAPERGGGSCVLCCGDLEATALGRCDHPVCYRCSTKMRVLCEQRYCAVCREELRQVVFGKKLPAFATIPIHQLQHEKKYDIYFADGKVYALYRQPAARHVVPACAPELSTCIRSSSGDLESDEHAVMAATEASYLLPVADAHSEGNRIRQRSPCPTSKWTPAKRLGYPPPANGTPWSSGLSAMLGVVAPQMTTVVYQCGTRLL

SEQ ID NO: 904461 - protein, 196 aa, Homo sapiens
GSQAARRRAGREGAGSRTMAAAGGAEGRRAALPYAIPARGRSAFQEEDFPALVSSVPKPGTEDTRLVLVPSPPGNTEPPRVTLQDPRPCQPYDPAQRGRPNTRRPTHTNTSHSTEATRSTRHQATDTPPQASPQYATKPSVPARKPHRWRQQDQRNSHTQTQPEKKSRDTENSRTPDPTTESQLTARQANHQVRNK

SEQ ID NO: 904462 - protein, 1294 aa, Homo sapiens; identical to SEQ ID NO: 904455

SEQ ID NO: 904463 - protein, 904 aa, Homo sapiens
MAAAGGAEGRRAALEAAAAAAPERGGGSCVLCCGDLEATALGRCDHPVCYRCSTKMRVLCEQRYCAVCREELRQVVFGKKLPAFATIPIHQLQHEKKYDIYFADGKVYALYRQLLQHECPRCPELPPFSLFGDLEQHMRRQHELFCCRLCLQHLQIFTYERKWYSRKDLARHRMQGDPDDTSHRGHPLCKFCDERYLDNDELLKHLRRDHYFCHFCDSDGAQDYYSDYAYLREHFREKHFLCEEGRCSTEQFTHAFRTEIDLKAHRTACHSRSRAEARQNRHIDLQFSYAPRHSRRNEGVVGGEDYEEVDRYSRQGRVARAGTRGAQQSRRGSWRYKREEEDREVAAAVRASVAAQQQEEARRSEDQEEGGRPKKEEAAARGPEDPRGPRRSPRTQGEGPGPKETSTNGPVSQEAFSVTGPAAPGCVGVPGALPPPSPKLKDEDFPSLSASTSSSCSTAATPGPVGLALPYAIPARGRSAFQEEDFPALVSSVPKPGTAPTSLVSAWNSSSSSKKVAQPPLSAQATGSGQPTRKAGKGSRGGRKGGPPFTQEEEEDGGPALQELLSTRPTGSVSSTLGLASIQPSKVGKKKKVGSEKPGTTLPQPPPATCPPGALQAPEAPASRAEGPVAVVVNGHTEGPAPARSAPKEPPGLPRPLGSFPCPTPQEDFPALGGPCPPRMPPPPGFSAVVLLKGTPPPPPPGLVPPISKPPPGFSGLLPSPHPACVPSPATTTTTKAPRLLPAPRAYLVPENFRERNLQLIQSIRDFLQSDEARFSEFKSHSGEFRQGLISAAQYYKSCRDLLGENFQKVFNELLVLLPDTAKQQELLSAHTDFCNREKPLSTKSKKNKKSAWQATTQQAGLDCRVCPTCQQVLAHGDASSHQALHAARDDDFPSLQAIARIIT

SEQ ID NO: 904464 - protein, 157 aa, Homo sapiens
MYEAGGESAEGGLIQSIRDFLQSDEARFSEFKSHSGEFRQGLISAAQYYKSCRDLLGENFQKVFNELLVLLPDTAKQQELLSAHTDFCNREKPLSTKSKKNKKSAWQATTQQAGLDCRVCPTCQQVLAHGDASSHQALHAARDDDFPSLQAIARIIT

SEQ ID NO: 904465 - protein, 898 aa, Homo sapiens; identical to SEQ ID NO: 904454

SEQ ID NO: 904466 - protein, 698 aa, Homo sapiens
GSQAARRRAGREGAGSRTMAAAGGAEGRRAALEAAAAAAPERGGGSCVLCCGDLEATALGRCDHPVCYRCSTKMRVLCEQRYCAVCREELRQVVFGKKLPAFATIPIHQLQHEKKYDIYFADGKVYALYRQLLQHECPRCPELPPFSLFGDLEQHMRRQHELFCCRLCLQHLQIFTYERKWYSRKDLARHRMQGDPDDTSHRGHPLCKFCDERYLDNDELLKHLRRDHYFCHFCDSDGAQDYYSDYAYLREHFREKHFLCEEGRCSTEQFTHAFRTEIDLKAHRTACHSRSRAEARQNRHIDLQFSYAPRHSRRNEGVVGGEDYEEVDRYSRQGRVARAGTRGAQQSRRGSWRYKREEEDREVAAAVRASVAAQQQEEARRSEDQEEGGRPKKEEAAARGPEDPRGPRRSPRTQGEGPGPKETSTNGPVSQEAFSVTGPAAPGALPPPSPKLKDEDFPSLSASTSSSCSTAATPGPVGLALPYAIPARGRSAFQEEDFPALVSSVPKPGTAPTSLVSAWNSSSSSKKVAQPPLSAQATGSGQPTRKAGKGSRGGRKGGPPFTQEEEEDGGPALQELLSTRPTGSVSSTLGLASIQPSKVGKKKKVGSEKPGTTLPQPPPATCPPGALQAPEAPASRAEGPVAVVVNGHTEGPAPARSAPKEPPGLPRPLGSFPCPTPQEDFPALGGPCPPRMPPPPAP

SEQ ID NO: 904467 - protein, 124 aa, Homo sapiens
SEAVDGKLSIFIHKREDQSSHEVLQPLLSSSEGRPFRLGTGANMEKVVKMDRDRTNGGCCEVITEEAAAALRKATKWAQSGLIVSIGPPVESINPETVSGLSTGDKKKTAQTSICRERNSELAR

SEQ ID NO: 904468 - protein, 150 aa, Homo sapiens
MSRLGLRRRQEFLSVTTIAVMSGRGKQGGKARAKAKSRSSRAGLQFPVGRVHRLLRKGNYAERVGAGAPVYMAAVLEYLTAEILELAGNAARDNKKTRIIPRHLQLAIRNDEELNKLLGKVTIAQGGVLPNIQAVLLPKKTESHHKAKGK

SEQ ID NO: 904469 - protein, 160 aa, Homo sapiens
PISNITPLNFFFSALSSGRQEFLSVTTIAVMSGRGKQGGKARAKAKSRSSRAGLQFPVGRVHRLLRKGNYAERVGAGAPVYMAAVLEYLTAEILELAGNAARDNKKTRIIPRHLQLAIRNDEELNKLLGKVTIAQGGVLPNIQAVLLPKKTESHHKAKGK

SEQ ID NO: 904470 - protein, 153 aa, Homo sapiens
AAAFSATFPIARQEFLSVTTIAVMSGRGKQGGKARAKAKSRSSRAGLQFPVGRVHRLLRKGNYAERVGAGAPVYMAAVLEYLTAEILELAGNAARDNKKTRIIPRHLQLAIRNDEELNKLLGKVTIAQGGVLPNIQAVLLPKKTESHHKAKGK

SEQ ID NO: 904471 - protein, 153 aa, Homo sapiens; identical to SEQ ID NO: 904470

SEQ ID NO: 904472 - protein, 153 aa, Homo sapiens; identical to SEQ ID NO: 904470

SEQ ID NO: 904473 - protein, 301 aa, Homo sapiens
MSRLGLRRRQEFLSVTTIAVMSGRGKQGGKARAKAKSRSSRAGLQFPVGRVHRLLRKGNYAERVGAGAPVYMAAVLEYLTAEILELAGNAARDNKKTRIIPRHLQLAIRNDEELNKLLGKVTIRQRASEADVRPKWAQPGPRLEGAPVNSKGSFQSHPRFQIKELLMLATLSPAFLKKKNERTTTRKSKKGAHEKKRTPVRSTKGSRTHSSVARGGPQRVARHKNRRRARADTTAETTRKQESMGTSERRTTLVGETIVGHTPAHDKTRKKANNKNQRDKADTRDDTAGQQEGDEVRENNI

SEQ ID NO: 904474 - protein, 70 aa, Homo sapiens
FSFGNGYLSQAPKPSKKTYSRAQAGQQQKAPRGHGGQLGLEKTEMSPEATCPGQTPFPLAVQFRVKGTGG

SEQ ID NO: 904475 - protein, 1409 aa, Homo sapiens
GTPGGGAGCVLAGGLAEPESGSGHGAGLSPGKRDALRRRRAGKQSGRERGRPRWLQSRRSPCCPARALRVLLGAVSRQERWEPGLGGSRSSVGRRVAGGAAGAGTGGAGPAGRLLPPPAPGSPAAPAAVSPAAGQPRPPAPASRGPMPARIGYYEIDRTIGKGNFAVVKRATHLVTKAKVAIKIIDKTQLDEENLKKIFREVQIMKMLCHPHIIRLYQVMETERMIYLVTEYASGGEIFDHLVAHGRMAEKEARRKFKQIVTAVYFCHCRNIVHRDLKAENLLLDANLNIKIADFGFSNLFTPGQLLKTWCGSPPYAAPELFEGKEYDGPKVDIWSLGVVLYVLVCGALPFDGSTLQNLRARVLSGKFRIPFFMSTECEHLIRHMLVLDPNKRLSMEQICKHKWMKLGDADPNFDRLIAECQQLKEERQVDPLNEDVLLAMEDMGLDKEQTLQSLRSDAYDHYSAIYSLLCDRHKRHKTLRLGALPSMPRALAFQAPVNIQAEQAGTAMNISVPQVQLINPENQIVEPDGTLNLDSDEGEEPSPEALVRYLSMRRHTVGVADPRTEVMEDLQKLLPGFPGVNPQAPFLQVAPNVNFMHNLLPMQNLQPTGQLEYKEQSLLQPPTLQLLNGMGPLGRRASDGGANIQLHAQQLLKRPRGPSPLVTMTPAVPAVTPVDEESSDGEPDQEAVQSSTYKDSNTLHLPTERFSPVRRFSDGAASIQAFKAHLEKMGNNSSIKQLQQECEQLQKMYGGQIDERTLEKTQQQHMLYQQEQHHQILQQQIQDSICPPQPSPPLQAACENQPALLTHQLQRLRIQPSSPPPNHPNNHLFRQPSNSPPPMSSAMIQPHGAASSSQFQGLPSRSAIFQQQPENCSSPPNVALTCLGMQQPAQSQQVTIQVQEPVDMLSNMPGTAAGSSGRGISISPSAGQMQMQHRTNLMATLSYGHRPLSKQLSADSAEAHSLNVNRFSPANYDQAHLHPHLFSDQSRGSPSSYSPSTGVGFSPTQALKVPPLDQFPTFPPSAHQQPPHYTTSALQQALLSPTPPDYTRHQQVPHILQGLLSPRHSLTGHSDIRLPPTEFAQLIKRQQQQRQQQQQQQQQQEYQELFRHMNQGDAGSLAPSLGGQSMTERQALSYQNADSYHHHTSPQHLLQIRAQECVSQASSPTPPHGYAHQPALMHSESMEEDCSCEGAKDGFQDSKSSSTLTKGCHDSPLLLSTGGPGDPESLLGTVSHAQELGIHPYGHQPTAAFSKNKVPSREPVIGNCMDRSSPGQAVELPDHNGLGYPARPSVHEHHRPRALQRHHTIQNSDDAYVQLDNLPGMSLVAGKALSSARMSDAVLSQSSLMGSQQFQDGENEECGASLGGHEHPDLSDGSQHLNSSCYPSTCITDILLSYKHPEVSFSMEQAGV

SEQ ID NO: 904476 - protein, 69 aa, Homo sapiens
REEMRETGKKMQPVRLDHGTAHGSSTIKFSSNKFKTLSVLLSHLHLFRLHVKISQPSLPISSRGMSHFV

SEQ ID NO: 904477 - protein, 1311 aa, Homo sapiens
NKMAAAAASGAGGAAGAGTGGAGPAGRLLPPPAPGSPAAPAAVSPAAGQPRPPAPASRGPMPARIGYYEIDRTIGKGNFAVVKRATHLVTKAKVAIKIIDKTQLDEENLKKIFREVQIMKMLCHPHIIRLYQVMETERMIYLVTEYASGGEIFDHLVAHGRMAEKEARRKFKQIVTAVYFCHCRNIVHRDLKAENLLLDANLNIKIADFGFSNLFTPGQLLKTWCGSPPYAAPELFEGKEYDGPKVDIWSLGVVLYVLVCGALPFDGSTLQNLRARVLSGKFRIPFFMSTECEHLIRHMLVLDPNKRLSMEQICKHKWMKLGDADPNFDRLIAECQQLKEERQVDPLNEDVLLAMEDMGLDKEQTLQSLRSDAYDHYSAIYSLLCDRHKRHKTLRLGALPSMPRALAFQAPVNIQAEQAGTAMNISVPQVQLINPENQIVEPDGTLNLDSDEGEEPSPEALVRYLSMRRHTVGVADPRTEVMEDLQKLLPGFPGVNPQAPFLQVAPNVNFMHNLLPMQNLQPTGQLEYKEQSLLQPPTLQLLNGMGPLGRRASDGGANIQLHAQQLLKRPRGPSPLVTMTPAVPAVTPVDEESSDGEPDQEAVQRYLANRSKRHTLAMTNPTAEIPPDLQRQLGQQPFRSRVWPPHLVPDQHRSTYKDSNTLHLPTERFSPVRRFSDGAASIQAFKAHLEKMGNNSSIKQLQQECEQLQKMYGGQIDERTLEKTQQQHMLYQQEQHHQILQQQIQDSICPPQPSPPLQAACENQPALLTHQLQRLRIQPSSPPPNHPNNHLFRQPSNSPPPMSSAMIQPHGAASSSQFQGLPSRSAIFQQQPENCSSPPNVALTCLGMQQPAQSQQVTIQVQEPVDMLSNMPGTAAGSSGRGISISPSAGQMQMQHRTNLMATLSYGHRPLSKQLSADSAEAHSAHQQPPHYTTSALQQALLSPTPPDYTRHQQVPHILQGLLSPRHSLTGHSDIRLPPTEFAQLIKRQQQQRQQQQQQQQQQEYQELFRHMNQGDAGSLAPSLGGQSMTERQALSYQNADSYHHHTSPQHLLQIRAQECVSQASSPTPPHGYAHQPALMHSESMEEDCSCEGAKDGFQDSKSSSTLTKGCHDSPLLLSTGGPGDPESLLGTVSHAQELGIHPYGHQPTAAFSKNKVPSREPVIGNCMDRSSPGQAVELPDHNGLGYPARPSVHEHHRPRALQRHHTIQNSDDAYVQLDNLPGMSLVAGKALSSARMSDAVLSQSSLMGSQQFQDGENEECGASLGGHEHPDLSDGSQHLNSSCYPSTCITDILLSYKHPEVSFSMEQAGV

SEQ ID NO: 904478 - protein, 1297 aa, Homo sapiens
MAAAAASGAGGAAGAGTGGAGPAGRLLPPPAPGSPAAPAAVSPAAGQPRPPAPASRGPMPARIGYYEIDRTIGKGNFAVVKRATHLVTKAKVAIKIIDKTQLDEENLKKIFREVQIMKMLCHPHIIRLYQVMETERMIYLVTEYASGGEIFDHLVAHGRMAEKEARRKFKQIVTAVYFCHCRNIVHRDLKAENLLLDANLNIKIADFGFSNLFTPGQLLKTWCGSPPYAAPELFEGKEYDGPKVDIWSLGVVLYVLVCGALPFDGSTLQNLRARVLSGKFRIPFFMSTECEHLIRHMLVLDPNKLNAECQQLKEERQVDPLNEDVLLAMEDMGLDKEQTLQAEQAGTAMNISVPQVQLINPENQIVEPDGTLNLDSDEGEEPSPEALVRYLSMRRHTVGVADPRTEVMEDLQKLLPGFPGVNPQAPFLQVAPNVNFMHNLLPMQNLQPTGQLEYKEQSLLQPPTLQLLNGMGPLGRRASDGGANIQLHAQQLLKRPRGPSPLVTMTPAVPAVTPVDEESSDGEPDQEAVQRYLANRSKRHTLAMTNPTAEIPPDLQRQLGQQPFRSRVWPPHLVPDQHRSTYKDSNTLHLPTERFSPVRRFSDGAASIQAFKAHLEKMGNNSSIKQLQQECEQLQKMYGGQIDERTLEKTQQQHMLYQQEQHHQILQQQIQDSICPPQPSPPLQAACENQPALLTHQLQRLRIQPSSPPPNHPNNHLFRQPSNSPPPMSSAMIQPHGAASSSQFQGLPSRSAIFQQQPENCSSPPNVALTCLGMQQPAQSQQVTIQVQEPVDMLSNMPGTAAGSSGRGISISPSAGQMQMQHRTNLMATLSYGHRPLSKQLSADSAEAHSLNVNRFSPANYDQAHLHPHLFSDQSRGSPSSYSPSTGVGFSPTQALKVPPLDQFPTFPPSAHQQPPHYTTSALQQALLSPTPPDYTRHQQVPHILQGLLSPRHSLTGHSDIRLPPTEFAQLIKRQQQQRQQQQQQQQQQEYQELFRHMNQGDAGSLAPSLGGQSMTERQALSYQNADSYHHHTSPQHLLQIRAQECVSQASSPTPPHGYAHQPALMHSESMEEDCSCEGAKDGFQDSKSSSTLTKGCHDSPLLLSTGGPGDPESLLGTVSHAQELGIHPYGHQPTAAFSKNKVPSREPVIGNCMDRSSPGQAVELPDHNGLGYPARPSVHEHHRPRALQRHHTIQNSDDAYVQLDNLPGMSLVAGKALSSARMSDAVLSQSSLMGSQQFQDGENEECGASLGGHEHPDLSDGSQHLNSSCYPSTCITDILLSYKHPEVSFSMEQAGV

SEQ ID NO: 904479 - protein, 997 aa, Homo sapiens
FSIAHCKGQTLRRIPMQLDVGSSHLMPSGQGGPFHSTAVAWAAVGETAPCTHVPQVQLINPENQIVEPDGTLNLDSDEGEEPSPEALVRYLSMRRHTVGVADPRTEVMEDLQKLLPGFPGVNPQAPFLQVAPNVNFMHNLLPMQNLQPTGQLEYKEQSLLQPPTLQLLNGMGPLGRRASDGGANIQLHAQQLLKRPRGPSPLVTMTPAVPAVTPVDEESSDGEPDQEAVQRYLANRSKRHTLAMTNPTAEIPPDLQRQLGQQPFRSRVWPPHLVPDQHRSTYKDSNTLHLPTERFSPVRRFSDGAASIQAFKAHLEKMGNNSSIKQLQQECEQLQKMYGGQIDERTLEKTQQQHMLYQQEQHHQILQQQIQDSICPPQPSPPLQAACENQPALLTHQLQRLRIQPSSPPPNHPNNHLFRQPSNSPPPMSSAMIQPHGAASSSQFQGLPSRSAIFQQQPENCSSPPNVALTCLGMQQPAQSQQVTIQVQEPVDMLSNMPGTAAGSSGRGISISPSAGQMQMQHRTNLMATLSYGHRPLSKQLSADSAEAHSLNVNRFSPANYDQAHLHPHLFSDQSRGSPSSYSPSTGVGFSPTQALKVPPLDQFPTFPPSAHQQPPHYTTSALQQALLSPTPPDYTRHQQVPHILQGLLSPRHSLTGHSDIRLPPTEFAQLIKRQQQQRQQQQQQQQQQEYQELFRHMNQGDAGSLAPSLGGQSMTERQALSYQNADSYHHHTSPQHLLQIRAQECVSQASSPTPPHGYAHQPALMHSESMEEDCSCEGAKDGFQDSKSSSTLTKGCHDSPLLLSTGGPGDPESLLGTVSHAQELGIHPYGHQPTAAFSKNKVPSREPVIGNCMDRSSPGQAVELPDHNGLGYPARPSVHEHHRPRALQRHHTIQNSDDAYVQLDNLPGMSLVAGKALSSARMSDAVLSQSSLMGSQQFQDGENEECGASLGGHEHPDLSDGSQHLNSSCYPSTCITDILLSYKHPEVSFSMEQAGV

SEQ ID NO: 904480 - protein, 110 aa, Homo sapiens
SGGAQTGQSSDDAYVQLDNLPGMSLVAGKALSSARMSDAVLSQSSLMGSQQFQDGENEECGASLGGHEHPDLSDGSQHLNSSCYPSTCITDILLSYKHPEVSFSMEQAGV

SEQ ID NO: 904481 - protein, 1339 aa, Homo sapiens
NKMAAAAASGAGGAAGAGTGGAGPAGRLLPPPAPGSPAAPAAVSPAAGQPRPPAPASRGPMPARIGYYEIDRTIGKGNFAVVKRATHLVTKAKVAIKIIDKTQLDEENLKKIFREVQIMKMLCHPHIIRLYQVMETERMIYLVTEYASGGEIFDHLVAHGRMAEKEARRKFKQIVTAVYFCHCRNIVHRDLKAENLLLDANLNIKIADFGFSNLFTPGQLLKTWCGSPPYAAPELFEGKEYDGPKVDIWSLGVVLYVLVCGALPFDGSTLQNLRARVLSGKFRIPFFMSTECEHLIRHMLVLDPNKRLSMEQICKHKWMKLGDADPNFDRLIAECQQLKEERQVDPLNEDVLLAMEDMGLDKEQTLQSLRSDAYDHYSAIYSLLCDRHKRHKTLRLGALPSMPRALAFQAPVNIQAEQAGTAMNISVPQVQLINPENQIVEPDGTLNLDSDEGEEPSPEALVRYLSMRRHTVGVADPRTEVMEDLQKLLPGFPGVNPQAPFLQVAPNVNFMHNLLPMQNLQPTGQLEYKEQSLLQPPTLQLLNGMGPLGRRASDGGANIQLHAQQLLKRPRGPSPLVTMTPAVPAVTPVDEESSDGEPDQEAVQRYLANRSKRHTLAMTNPTAEIPPDLQRQLGQQPFRSRVWPPHLVPDQHRSTYKDSNTLHLPTERFSPVRRFSDGAASIQAFKAHLEKMGNNSSIKQLQQECEQLQKMYGGQIDERTLEKTQQQHMLYQQEQHHQILQQQIQDSICPPQPSPPLQAACENQPALLTHQLQRLRIQPSSPPPNHPNNHLFRQPSNSPPPMSSAMIQPHGAASSSQFQGLPSRSAIFQQQPENCSSPPNVALTCLGMQQPAQSQQVTIQVQEPVDMLSNMPGTAAGSSGRGISISPSAGQMQMQHRTNLMATLSYGHRPLSKQLSADSAEAHSLNVNRFSPANYDQAHLHPHLFSDQSRGSPSSYSPSTGVGFSPTQALKVPPLDQFPTFPPSAHQQPPHYTTSALQQALLSPTPPDYTRHQQVPHILQGLLSPRHSLTGHSDIRLPPTEFAQLIKRQQQQRQQQQQQQQQQEYQELFRHMNQGDAGSLAPSLGGQSMTERQALSYQNADSYHHHTSPQHLLQIRAQECVSQASSPTPPHGYAHQPALMHSESMEEDCSCEGAKDGFQDSKSSSTLTKGCHDSPLLLSTGGPGDPESLLGTVSHAQELGIHPYGHQPTAAFSKNKVPSREPVIGNCMDRSSPGQAVELPDHNGLGYPARPSVHEHHRPRALQRHHTIQNSDDAYVQLDNLPGMSLVAGKALSSARMSDAVLSQSSLMGSQQFQDGENEDILLSYKHPEVSFSMEQAGV

SEQ ID NO: 904482 - protein, 1371 aa, Homo sapiens
NKMAAAAASGAGGAAGAGTGGAGPAGRLLPPPAPGSPAAPAAVSPAAGQPRPPAPASRGPMPARIGYYEIDRTIGKGNFAVVKRATHLVTKAKVAIKIIDKTQLDEENLKKIFREVQIMKMLCHPHIIRLYQVMETERMIYLVTEYASGGEIFDHLVAHGRMAEKEARRKFKQIVTAVYFCHCRNIVHRDLKAENLLLDANLNIKIADFGFSNLFTPGQLLKTWCGSPPYAAPELFEGKEYDGPKVDIWSLGVVLYVLVCGALPFDGSTLQNLRARVLSGKFRIPFFMSTECEHLIRHMLVLDPNKRLSMEQICKHKWMKLGDADPNFDRLIAECQQLKEERQVDPLNEDVLLAMEDMGLDKEQTLQSLRSDAYDHYSAIYSLLCDRHKRHKTLRLGALPSMPRALAFQAPVNIQAEQAGTAMNISVPQVQLINPENQIVEPDGTLNLDSDEGEEPSPEALVRYLSMRRHTVGVADPRTEVMEDLQKLLPGFPGVNPQAPFLQVAPNVNFMHNLLPMQNLQPTGQLEYKEQSLLQPPTLQLLNGMGPLGRRASDGGANIQLHAQQLLKRPRGPSPLVTMTPAVPAVTPVDEESSDGEPDQEAVQRYLANRSKRHTLAMTNPTAEIPPDLQRQLGQQPFRSRVWPPHLVPDQHRSTYKDSNTLHLPTERFSPVRRFSDGAASIQAFKAHLEKMGNNSSIKQLQQECEQLQKMYGGQIDERTLEKTQQQHMLYQQEQHHQILQQQIQDSICPPQPSPPLQAACENQPALLTHQLQRLRIQPSSPPPNHPNNHLFRQPSNSPPPMSSAMIQPHGAASSSQFQGLPSRSAIFQQQPENCSSPPNVALTCLGMQQPAQSQQVTIQVQEPVDMLSNMPGTAAGSSGRGISISPSAGQMQMQHRTNLMATLSYGHRPLSKQLSADSAEAHSLNVNRFSPANYDQAHLHPHLFSDQSRGSPSSYSPSTGVGFSPTQALKVPPLDQFPTFPPSAHQQPPHYTTSALQQALLSPTPPDYTRHQQVPHILQGLLSPRHSLTGHSDIRLPPTEFAQLIKRQQQQRQQQQQQQQQQEYQELFRHMNQGDAGSLAPSLGGQSMTERQALSYQNADSYHHHTSPQHLLQIRAQECVSQASSPTPPHGYAHQPALMHSESMEEDCSCEGAKDGFQDSKSSSTLTKGCHDSPLLLSTGGPGDPESLLGTVSHAQELGIHPYGHQPTAAFSKNKVPSREPVIGNCMDRSSPGQAVELPDHNGLGYPARPSVHEHHRPRALQRHHTIQNSDDAYVQLDNLPGMSLVAGKALSSARMSDAVLSQSSLMGSQQFQDGENEECGASLGGHEHPDLSDGSQHLNSSCYPSTCITDILLSYKHPEVSFSMEQAGV

SEQ ID NO: 904483 - protein, 427 aa, Homo sapiens
NKMAAAAASGAGGAAGAGTGGAGPAGRLLPPPAPGSPAAPAAVSPAAGQPRPPAPASRGPMPARIGYYEIDRTIGKGNFAVVKRATHLVTKAKVAIKIIDKTQLDEENLKKIFREVQIMKMLCHPHIIRLYQVMETERMIYLVTEYASGGEIFDHLVAHGRMAEKEARRKFKQIVTAVYFCHCRNIVHRDLKAENLLLDANLNIKIADFGFSNLFTPGQLLKTWCGSPPYAAPELFEGKEYDGPKVDIWSLGVVLYVLVCGALPFDGSTLQNLRARVLSGKFRIPFFMSTECEHLIRHMLVLDPNKRLSMEQICKHKWMKLGDADPNFDRLIAECQQLKEERQVDPLNEDVLLAMEDMGLDKEQTLQSLRSDAYDHYSAIYSLLCDRHKRHKTLRLGALPSMPRALAFQRKTNRCERKQLTGAVPLR

SEQ ID NO: 904484 - protein, 93 aa, Homo sapiens
KMEEKVCSIIVCMTHHHLHTHTTVVFFVSPDVINCTSSLFGMQSLGVVLYVLVCGALPFDGSTLQNLRARVLSGKFRIPFFMSTGKGVASTQL

SEQ ID NO: 904485 - protein, 1371 aa, Homo sapiens; identical to SEQ ID NO: 904482

SEQ ID NO: 904486 - protein, 1323 aa, Homo sapiens
NKMAAAAASGAGGAAGAGTGGAGPAGRLLPPPAPGSPAAPAAVSPAAGQPRPPAPASRGPMPARIGYYEIDRTIGKGNFAVVKRATHLVTKAKVAIKIIDKTQLDEENLKKIFREVQIMKMLCHPHIIRLYQVMETERMIYLVTEYASGGEIFDHLVAHGRMAEKEARRKFKQIVTAVYFCHCRNIVHRDLKAENLLLDANLNIKIADFGFSNLFTPGQLLKTWCGSPPYAAPELFEGKEYDGPKVDIWSLGVVLYVLVCGALPFDGSTLQNLRARVLSGKFRIPFFMSTECEHLIRHMLVLDPNKRLSMEQICKHKWMKLGDADPNFDRLIAECQQLKEERQVDPLNEDVLLAMEDMGLDKEQTLQAEQAGTAMNISVPQVQLINPENQIVEPDGTLNLDSDEGEEPSPEALVRYLSMRRHTVGVADPRTEVMEDLQKLLPGFPGVNPQAPFLQVAPNVNFMHNLLPMQNLQPTGQLEYKEQSLLQPPTLQLLNGMGPLGRRASDGGANIQLHAQQLLKRPRGPSPLVTMTPAVPAVTPVDEESSDGEPDQEAVQRYLANRSKRHTLAMTNPTAEIPPDLQRQLGQQPFRSRVWPPHLVPDQHRSTYKDSNTLHLPTERFSPVRRFSDGAASIQAFKAHLEKMGNNSSIKQLQQECEQLQKMYGGQIDERTLEKTQQQHMLYQQEQHHQILQQQIQDSICPPQPSPPLQAACENQPALLTHQLQRLRIQPSSPPPNHPNNHLFRQPSNSPPPMSSAMIQPHGAASSSQFQGLPSRSAIFQQQPENCSSPPNVALTCLGMQQPAQSQQVTIQVQEPVDMLSNMPGTAAGSSGRGISISPSAGQMQMQHRTNLMATLSYGHRPLSKQLSADSAEAHSLNVNRFSPANYDQAHLHPHLFSDQSRGSPSSYSPSTGVGFSPTQALKVPPLDQFPTFPPSAHQQPPHYTTSALQQALLSPTPPDYTRHQQVPHILQGLLSPRHSLTGHSDIRLPPTEFAQLIKRQQQQRQQQQQQQQQQEYQELFRHMNQGDAGSLAPSLGGQSMTERQALSYQNADSYHHHTSPQHLLQIRAQECVSQASSPTPPHGYAHQPALMHSESMEEDCSCEGAKDGFQDSKSSSTLTKGCHDSPLLLSTGGPGDPESLLGTVSHAQELGIHPYGHQPTAAFSKNKVPSREPVIGNCMDRSSPGQAVELPDHNGLGYPARPSVHEHHRPRALQRHHTIQNSDDAYVQLDNLPGMSLVAGKALSSARMSDAVLSQSSLMGSQQFQDGENEECGASLGGHEHPDLSDGSQHLNSSCYPSTCITDILLSYKHPEVSFSMEQAGV

SEQ ID NO: 904487 - protein, 976 aa, Homo sapiens
DSLFLSSVKGMRVYVCTAFQAEQAGTAMNISVPQVQLINPENQIVEPDGTLNLDSDEGEEPSPEALVRYLSMRRHTVGVADPRTEVMEDLQKLLPGFPGVNPQAPFLQVAPNVNFMHNLLPMQNLQPTGQLEYKEQSLLQPPTLQLLNGMGPLGRRASDGGANIQLHAQQLLKRPRGPSPLVTMTPAVPAVTPVDEESSDGEPDQEAVQRYLANRSKRHTLAMTNPTAEIPPDLQRQLGQQPFRSRVWPPHLVPDQHRSTYKDSNTLHLPTERFSPVRRFSDGAASIQAFKAHLEKMGNNSSIKQLQQECEQLQKMYGGQIDERTLEKTQQQHMLYQQEQHHQILQQQIQDSICPPQPSPPLQAACENQPALLTHQLQRLRIQPSSPPPNHPNNHLFRQPSNSPPPMSSAMIQPHGAASSSQFQGLPSRSAIFQQQPENCSSPPNVALTCLGMQQPAQSQQVTIQVQEPVDMLSNMPGTAAGSSGRGISISPSAGQMQMQHRTNLMATLSYGHRPLSKQLSADSAEAHSLNVNRFSPANYDQAHLHPHLFSDQSRGSPSSYSPSTGVGFSPTQALKVPPLDQFPTFPPSAHQQPPHYTTSALQQALLSPTPPDYTRHQQVPHILQGLLSPRHSLTGHSDIRLPPTEFAQLIKRQQQQRQQQQQQQQQQEYQELFRHMNQGDAGSLAPSLGGQSMTERQALSYQNADSYHHHTSPQHLLQIRAQECVSQASSPTPPHGYAHQPALMHSESMEEDCSCEGAKDGFQDSKSSSTLTKGCHDSPLLLSTGGPGDPESLLGTVSHAQELGIHPYGHQPTAAFSKNKVPSREPVIGNCMDRSSPGQAVELPDHNGLGYPARPSVHEHHRPRALQRHHTIQNSDDAYVQLDNLPGMSLVAGKALSSARMSDAVLSQSSLMGSQQFQDGENEECGASLGGHEHPDLSDGSQHLNSSCYPSTCITDILLSYKHPEVSFSMEQAGV

SEQ ID NO: 904488 - protein, 1339 aa, Homo sapiens; identical to SEQ ID NO: 904481

SEQ ID NO: 904489 - protein, 76 aa, Homo sapiens
GAYTCRTSDEADVQLDNLPGMSLVAGKALSSARMSDAVLSQSSLMGSQQFQDGENEDILLSYKHPEVSFSMEQAGV

SEQ ID NO: 904490 - protein, 651 aa, Homo sapiens
MAAAAASGAGGAAGAGTGGAGPAGRLLPPPAPGSPAAPAAVSPAAGQPRPPAPASRGPMPARIGYYEIDRTIGKGNFAVVKRATHLVTKAKVAIKIIDKTQLDEENLKKIFREVQIMKMLCHPHIIRLYQVMETERMIYLVTEYASGGEIFDHLVAHGRMAEKEARRKFKQIVTAVYFCHCRNIVHRDLKAENLLLDANLNIKIADFGFSNLFTPGQLLKTWCGSPPYAAPELFEGKEYDGPKVDIWSLGVVLYVLVCGALPFDGSTLQNLRARVLSGKFRIPFFMSTECEHLIRHMLVLDPNKRLSMEQICKHKWMKLGDADPNFDRLIAECQQLKEERQVDPLNEDVLLAMEDMGLDKEQTLQSLRSDAYDHYSAIYSLLCDRHKRHKTLRLGALPSMPRALAFQAPVNIQAEQAGTAMNISVPQVQLINPENQIVEPDGTLNLDSDEGEEPSPEALVRYLSMRRHTVGVADPRTEVMEDLQKLLPGFPGVNPQAPFLQVAPNVNFMHNLLPMQNLQPTGQLEYKEQSLLQPPTLQLLNGMGPLGRRASDGGANIQLHAQQLLKRPRGPSPLVTMTPAVPAVTPVDEESSDGEPDQEAVQRYLANRSKRHTLAMTNPTAEIPPDLQRQLGQQPFRSRVWPPHLVPDQHR

SEQ ID NO: 904491 - protein, 263 aa, Homo sapiens
MFGSSRGGVRGGQDQFNWEDVKTDKQRENYLGNSLMAPVGRWQKGRDLTWYAKGRAPCAGPSREEELAAVREAEREALLAALGYKNVKKQPTGLSKEDFAEVCKREGGDPEEKGVDRLLGLGSASGSVGRVAMSREDKEAAKLGLSVFTHHRVESGGPGTSAASARRKPRAEDQTESSCESHRKSKKEKKKKKKRKHKKEKKKKDKEHRRPAEATSSPTSPERPRHHHHDSDSNSPCCKRRKRGHSGDRRSPSRRWHDRGSEA

SEQ ID NO: 904492 - protein, 155 aa, Homo sapiens
MFGSSRGGVRGGQDQFNWEDVKTDKQRENYLGNSLMAPVGRWQKGRDLTWYAKGRAPCAGPSREEELAAVREAEREALLAALGYKNVKKQPTGLSKEDFAEVCKREGGDPEEKGVDRLLGLGSASGSVGRVAMSREDKEAAKLGLSVFTVIPRPA

SEQ ID NO: 904493 - protein, 295 aa, Homo sapiens
MFGSSRGGVRGGQDQFNWEDVKTDKQRENYLGNSLMAPVGRWQKGRDLTWYAKGRAPCAGPSREEELAAVREAEREALLAALGYKNVKKQPTGLSKEDFAEVCKREGGDPEEKGVDRLLGLGSARCGRVSRGGQHWALIARVRRTPAVLSSSPCPCSGSVGRVAMSREDKEAAKLGLSVFTHHRVESGGPGTSAASARRKPRAEDQTESSCESHRKSKKEKKKKKKRKHKKEKKKKDKEHRRPAEATSSPTSPERPRHHHHDSDSNSPCCKRRKRGHSGDRRSPSRRWHDRGSEA

SEQ ID NO: 904494 - protein, 191 aa, Homo sapiens
MRGPEPRGGTGSRAGGGARGAAGRPDFAEVCKREGGDPEEKGVDRLLGLGSASGSVGRVAMSREDKEAAKLGLSVFTHHRVESGGPGTSAASARRKPRAEDQTESSCESHRKSKKEKKKKKKRKHKKEKKKKDKEHRRPAEATSSPTSPERPRHHHHDSDSNSPCCKRRKRGHSGDRRSPSRRWHDRGSEA

SEQ ID NO: 904495 - protein, 90 aa, Homo sapiens
KRGPKYWQWSGAVPWEGTQDLGRGLFLPWVAPPGLLLDGEPGPDPKSGLVGAGRKVSTCQGHGWGGAGGAVEMGILHLFLTHVATGHVTT

SEQ ID NO: 904496 - protein, 263 aa, Homo sapiens; identical to SEQ ID NO: 904491

SEQ ID NO: 904497 - protein, 228 aa, Homo sapiens
MAPVGRWQKGRDLTWYAKGRAPCAGPSREEELAAVREAEREALLAALGYKNVKKQPTGLSKEDFAEVCKREGGDPEEKGVDRLLGLGSASGSVGRVAMSREDKEAAKLGLSVFTHHRVESGGPGTSAASARRKPRAEDQTESSCESHRKSKKEKKKKKKRKHKKEKKKKDKEHRRPAEATSSPTSPERPRHHHHDSDSNSPCCKRRKRGHSGDRRSPSRRWHDRGSEA

SEQ ID NO: 904498 - protein, 370 aa, Homo sapiens
MFGSSRGGVRGGQDQFNWEDVKTDKQRENYLGNSLMAPVGRWQKGRDLTWYAKGRAPCAGPSREEELAAVREAEREALLAALGYKNVKKQPTGLSKEVTPRGGGRVEGRGCGADSSAPCALAPAGLRGGLQAGRRRPRGEGRGPAAGAGERKVRAGFQGRAALGSIARVRRTPAVLSSSPCPCSGSVGRVAMSREDKEAAKLGLSVFTVIPRPACPQQGLTGVGRGGGTERSSPGRCGAWCGAGPQTPPQSSLLPQHHRVESGGPGTSAASARRKPRAEDQTESSCESHRKSKKEKKKKKKRKHKKEKKKKDKEHRRPAEATSSPTSPERPRHHHHDSDSNSPCCKRRKRGHSGDRRSPSRRWHDRGSEA

SEQ ID NO: 904499 - protein, 196 aa, Homo sapiens
MFGSSRGGVRGGQDQFNWEDVKTDKQRENYLGNSLMAPVGRWQKGRDLTWYAKGRAPCAGPSREEELAAVREAEREALLAALGYKNVKKQPTGLSKEDFAEVCKREGGDPEEKGVDRLLGLGSASGSVGRVAMSREDKEAAKLGLSVFTHHRVESGGPGTSAASARRKPRAEDQTESSCESHRKSKKEKKKKKKRL

SEQ ID NO: 904500 - protein, 157 aa, Homo sapiens
MFGSSRGGVRGGQDQFNWEDVKTDKQRENYLGNSLMAPVGRWQKGRDLTWYAKGRAPCAGPSREEELAAVREAEREALLAALGYKNVKKQPTGLSKEDFAEVCKREGGDPEEKGVDQAQEVPVRKGWCAPNMVRRYTQLPIRDQDQQDRTRLPGPRT

SEQ ID NO: 904501 - protein, 104 aa, Homo sapiens
SRRGFRVASRSAASLAGARVRAVAGLAAGQDSRQEPCLSGGGLCDPARWTGQKAVPGSPAPLSDPTEAACPPWEPEVGPTRISSSTPSWDPSPGEVALACLLFH

SEQ ID NO: 904502 - protein, 97 aa, Homo sapiens
RGGTTGRGPRRSDFWARGHARAVQSWPGPPVGLLCSLPCLPPDAGPCCSLRTIRSSCSCHPHLETCLCAHLKMGSVPVLKCPVAAPVVEDQGLRFGT

SEQ ID NO: 904503 - protein, 512 aa, Homo sapiens
LPPWLPRRFPVSCVLSGSPSAGGGGLGGGAGFQAGALPLRWRALRPCEMDGTEGSAGQPGPAERSHRSSVSSVGARAADVLVYLADDTVVPLAVENLPSLSAHELHRAVREVLQLPDIALDVFALWLVSPLLEVQLKPKHQPYKLGRQWPELLLRFTSAPDDDVAMDEPFLQFRRNVFFPKRRELQIHDEEVLRLLYEEAKGNVLAARYPCDVEDCEALGALVCRVQLGPYQPGRRQACDLREKLDSFLPAHLCKRGQSLFAALRGRGARAGPGEQGLLNAYRQVQEVSSDGGCEAALGTHYRAYLLKCHELPFYGCAFFHGEVDKPAQGFLHRGGRKPVSVAISLEGVHVIDSREKHVLLGLRFQELSWDHTSPEEEEPILWLEFDGDSEGTPVNKLLKIYSKQAELMSSLIEYCIELSQAAEPAGPQDSATGSPSDPSSSLAPVQRPKLRRQGSVVSSRIQHLSTIDYVEDGKGIRRVKPKRTTSFFSRQLSLGQGSYTVVQPGDSLEQG

SEQ ID NO: 904504 - protein, 512 aa, Homo sapiens; identical to SEQ ID NO: 904503

SEQ ID NO: 904505 - protein, 187 aa, Homo sapiens
KQRQQWLVLTVAEPPAPGICSPGEPQTAARTRWRSGAGGMVSTYRVAVLGARGVGKSAIVRQFLYNEFSEVCVPTTARRLYLPAVVMNGHVHDLQILDFPPISAFPVNTLQMESPSVAQAGVQWHDLGSLQSSPPGFKRFSCLSLLSSWITGTCDHTQLIFVFLVEMGFHHVGQAGLKLLTSSDPPA

SEQ ID NO: 904506 - protein, 242 aa, Homo sapiens
KQRQQWLVLTVAEPPAPGICSPGEPQTAARTRWRSGAGGMVSTYRVAVLGARGVGKSAIVRQFLYNEFSEVCVPTTARRLYLPAVVMNGHVHDLQILDFPPISAFPVNTLQEWADTCCRGLRSVHAYILVYDICCFDSFEYVKTIRQQILETRVIGTSETPIIIVGNKRDLQRGRVIPRWNVSHLVRKTWKCGYVECSAKYNWHILLLFSELLKSVGCARCKHVHAALRFQGALRRNRCAIM

SEQ ID NO: 904507 - protein, 242 aa, Homo sapiens; identical to SEQ ID NO: 904506

SEQ ID NO: 904508 - protein, 242 aa, Homo sapiens; identical to SEQ ID NO: 904506

SEQ ID NO: 904509 - protein, 180 aa, Homo sapiens
MTNFDVTYNWIQDKCVPLVREITFENGEELTEEGLPFLILFHMKEDTESLEIFQNEVARQLISEKGTINFLHADCDKFRHPLLHIQKTPADCPVIAIDSFRHMYVFGDFKDVLIPGKLKQFVFDLHSGKLHREFHHGPDPTDTAPGEQAQDVASSPPESSFQKLAPSEYRYTLLRDRDEL

SEQ ID NO: 904510 - protein, 180 aa, Homo sapiens; identical to SEQ ID NO: 904509

SEQ ID NO: 904511 - protein, 180 aa, Homo sapiens; identical to SEQ ID NO: 904509

SEQ ID NO: 904512 - protein, 180 aa, Homo sapiens; identical to SEQ ID NO: 904509

SEQ ID NO: 904513 - protein, 180 aa, Homo sapiens; identical to SEQ ID NO: 904509

SEQ ID NO: 904514 - protein, 504 aa, Homo sapiens
APPPAAEPARAPAPPPLARPRVQKTRLHTPGPPPRSLMGVGVPKVSFVRSIGGALDYHSHKAPRPPPAPRPLAAGFQSPPRLHFPTGLPALPPSLPRHEPNWASGRGAGRVPAHRRRRRPLQPLSRLYRRGSCIVHSGRRWNRQSGVTELEKRRAEPPITSSPGDPSRVRPRPAQPPEPPAPGGPAPASQLLHSRSRRRPPPGTWTLTLAPPPSDPEEYSPSCKRRRTVEDFNKFCTFVLAYAGYIPYPKEELPLRSSPSPANSTAGTIDSDGWDAGFSDIASSVPLPVSDRCFSHLQPTLLQRAKPSNFLLDRKKTDKLKKKKKRKRRDSDAPGKEGYRGGLLKLEAADPYVETPTSPTLQDIPQAPSDPCSGWDSDTPSSGSCATVSPDQVKEIKTEGKRTIVRQGKQVVFRDEDSTGNDEDIMVDSDDDSWDLVTCFCMKPFAGRPMIECNECHTWIHLSCAKIRKSNVPEVFVCQKCRDSKFDIRRSNRSRTGSRKLFLD

SEQ ID NO: 904515 - protein, 138 aa, Homo sapiens
MLSQDDYTKQLQNPSSGSCATVSPDQVKEIKTEGKRTIVRQGKQVVFRDEDSTGNDEDIMVDSDDDSWDLVTCFCMKPFAGRPMIECNECHTWIHLSCAKIRKSNVPEVFVCQKCRDSKFDIRRSNRSRTGSRKLFLD

SEQ ID NO: 904516 - protein, 504 aa, Homo sapiens; identical to SEQ ID NO: 904514

SEQ ID NO: 904517 - protein, 504 aa, Homo sapiens; identical to SEQ ID NO: 904514

SEQ ID NO: 904518 - protein, 504 aa, Homo sapiens; identical to SEQ ID NO: 904514

SEQ ID NO: 904519 - protein, 504 aa, Homo sapiens; identical to SEQ ID NO: 904514

SEQ ID NO: 904520 - protein, 504 aa, Homo sapiens; identical to SEQ ID NO: 904514

SEQ ID NO: 904521 - protein, 504 aa, Homo sapiens; identical to SEQ ID NO: 904514

SEQ ID NO: 904522 - protein, 202 aa, Homo sapiens
AGLPVGRVRPLSRPLLGPDTGSVANIFKGLVILPEMSLVIRNLQRVIPIRRAPLRSKIEIVRRILGVQKFDLGIICVDNKNIQHINRIYRDRNVPTDVLSFPFHEHLKAGEFPQPDFPDDYNLGDIFLGVEYIFHQCKENEDYNDVLTVTATHGLCHLLGFTHGTEAEWQQMFQKEKAVLDELGRRTGTRLQPLTRGLFGGS

SEQ ID NO: 904523 - protein, 213 aa, Homo sapiens
RSFRSARLESFWPDSAASFHRPSLLLPPCGKCSVANIFKGLVILPEMSLVIRNLQRVIPIRRAPLRSKIEIVRRILGVQKFDLGIICVDNKNIQHINRIYRDRNVPTDVLSFPFHEHLKAGEFPQPDFPDDYNLGDIFLGVEYIFHQCKENEDYNDVLTVTATHGLCHLLGFTHGTEAEWQQMFQKEKAVLDELGRRTGTRLQPLTRGLFGGS

SEQ ID NO: 904524 - protein, 156 aa, Homo sapiens
AGLPVGRVRPLSRPLLGPDTGSVANIFKGLVILPEMSLVIRNLQRVIPIRRAPLRSKIEIVRRILGVQKFDLGIICVDNKNIQHINRIYRDRNVPTDVLSFPFHEHLKAGEFPQPDFPDDYNLGDIFLGVEYIFHQCKENEDYNDVLTVSGDAEII

SEQ ID NO: 904525 - protein, 170 aa, Homo sapiens
RSFRSARLESFWPDSAASFHRPSLLLPPCGKCSVANIFKGLVILPEMSLVIRNLQRVIPIRRAPLRSKIEIVRRILGVQKFDLGIICVDNKNIQHINRIYRDRNVPTDVLSFPFHEVTATHGLCHLLGFTHGTEAEWQQMFQKEKAVLDELGRRTGTRLQPLTRGLFGGS

SEQ ID NO: 904526 - protein, 161 aa, Homo sapiens
PGLASRQKFGTRPPLSRPLLGPDTGSVANIFKGLVILPEMSLVIRNLQRVIPIRRAPLRSKIEIHLKAGEFPQPDFPDDYNLGDIFLGVEYIFHQCKENEDYNDVLTVTATHGLCHLLGFTHGTEAEWQQMFQKEKAVLDELGRRTGTRLQPLTRGLFGGS

SEQ ID NO: 904527 - protein, 202 aa, Homo sapiens; identical to SEQ ID NO: 904522

SEQ ID NO: 904528 - protein, 114 aa, Homo sapiens
AGLPVGRVRPLSRPLLGPDTGSVANIFKGLVILPEMSLVIRNLQRVIPIRRAPLRSKIEIVTATHGLCHLLGFTHGTEAEWQQMFQKEKAVLDELGRRTGTRLQPLTRGLFGGS

SEQ ID NO: 904529 - protein, 97 aa, Homo sapiens
TSGRVFSLPSESVAFTRVGLRAPQTPEDPAPNAYLSPLLSLPHSSPFSPQPLPLPAPRRVRAPLSARTPNPPPFLWEPLLPLRPPGVLLAGFRGILP

SEQ ID NO: 904530 - protein, 106 aa, Homo sapiens
MRAARALLPLLLQACWTAAQDEPETPRAVAFQDCPVDLFFVLDTSESVALRLKPYGALVDKVKSFTKRFIDNLRDRYYRCDRNLVWNAGALHYSDEVEAGRGGSRL

SEQ ID NO: 904531 - protein, 1028 aa, Homo sapiens
MRAARALLPLLLQACWTAAQDEPETPRAVAFQDCPVDLFFVLDTSESVALRLKPYGALVDKVKSFTKRFIDNLRDRYYRCDRNLVWNAGALHYSDEVEIIQGLTRMPGGRDALKSSVDAVKYFGKGTYTDCAIKKGLEQLLVGGSHLKENKYLIVVTDGHPLEGYKEPCGGLEDAVNEAKHLGVKVFSVAITPDHLEPRLSIIATDHTYRRNFTAADWGQSRDAEEAISQTIDTIVDMIKNNVEQVCCSFECQPARGPPGLRGDPGFEGERGKPGLPGEKGEAGDPGRPGDLGPVGYQGMKGEKGSRGEKGSRGPKGYKGEKGKRGIDGVDGVKGEMGYPGLPGCKGSPGFDGIQGPPGPKGDPGAFGLKGEKGEPGADGEAGRPGSSGPSGDEGQPGEPGPPGEKGEAGDEGNPGPDGAPGERGGPGERGPRGTPGTRGPRGDPGEAGPQGDQGREGPVGVPGDPGEAGPIGPKGYRGDEGPPGSEGARGAPGPAGPPGDPGLMGERGEDGPAGNGTEGFPGFPGYPGNRGAPGINGTKGYPGLKGDEGEAGDPGDDNNDIAPRGVKGAKGYRGPEGPQGPPGHQGPPGPDECEILDIIMKMCSCCECKCGPIDLLFVLDSSESIGLQNFEIAKDFVVKVIDRLSRDELVKFEPGQSYAGVVQYSHSQMQEHVSLRSPSIRNVQELKEAIKSLQWMAGGTFTGEALQYTRDQLLPPSPNNRIALVITDGRSDTQRDTTPLNVLCSPGIQVVSVGIKDVFDFIPGSDQLNVISCQGLAPSQGRPGLSLVKENYAELLEDAFLKNVTAQICIDKKCPDYTCPITFSSPADITILLDGSASVGSHNFDTTKRFAKRLAERFLTAGRTDPAHDVRVAVVQYSGTGQQRPERASLQFLQNYTALASAVDAMDFINDATDVNDALGYVTRFYREASSGAAKKRLLLFSDGNSQGATPAAIEKAVQEAQRAGIEIFVVVVGRQVNEPHIRVLVTGKTAEYDVAYGESHLFRVPSYQALLRGVFHQTVSRKVALG

SEQ ID NO: 904532 - protein, 969 aa, Homo sapiens
GVIDATPMRFIDNLRDRYYRCDRNLVWNAGALHYSDEVEIIQGLTRMPGGRDALKSSVDAVKYFGKGTYTDCAIKKGLEQLLVGGSHLKENKYLIVVTDGHPLEGYKEPCGGLEDAVNEAKHLGVKVFSVAITPDHLEPRLSIIATDHTYRRNFTAADWGQSRDAEEAISQTIDTIVDMIKNNVEQVCCSFECQPARGPPGLRGDPGFEGERGKPGLPGEKGEAGDPGRPGDLGPVGYQGMKGEKGSRGEKGSRGPKGYKGEKGKRGIDGVDGVKGEMGYPGLPGCKGSPGFDGIQGPPGPKGDPGAFGLKGEKGEPGADGEAGRPGSSGPSGDEGQPGEPGPPGEKGEAGDEGNPGPDGAPGERGGPGERGPRGTPGTRGPRGDPGEAGPQGDQGREGPVGVPGDPGEAGPIGPKGYRGDEGPPGSEGARGAPGPAGPPGDPGLMGERGEDGPAGNGTEGFPGFPGYPGNRGAPGINGTKGYPGLKGDEGEAGDPGDDNNDIAPRGVKGAKGYRGPEGPQGPPGHQGPPGPDECEILDIIMKMCSCCECKCGPIDLLFVLDSSESIGLQNFEIAKDFVVKVIDRLSRDELVKFEPGQSYAGVVQYSHSQMQEHVSLRSPSIRNVQELKEAIKSLQWMAGGTFTGEALQYTRDQLLPPSPNNRIALVITDGRSDTQRDTTPLNVLCSPGIQVVSVGIKDVFDFIPGSDQLNVISCQGLAPSQGRPGLSLVKENYAELLEDAFLKNVTAQICIDKKCPDYTCPITFSSPADITILLDGSASVGSHNFDTTKRFAKRLAERFLTAGRTDPAHDVRVAVVQYSGTGQQRPERASLQFLQNYTALASAVDAMDFINDATDVNDALGYVTRFYREASSGAAKKRLLLFSDGNSQGATPAAIEKAVQEAQRAGIEIFVVVVGRQVNEPHIRVLVTGKTAEYDVAYGESHLFRVPSYQALLRGVFHQTVSRKVALG

SEQ ID NO: 904533 - protein, 1028 aa, Homo sapiens; identical to SEQ ID NO: 904531

SEQ ID NO: 904534 - protein, 937 aa, Homo sapiens
DSERTMELCYNTLSNVLTIMPSLEGPTPPPDSSSVSHDRYSGSRSATFCSAAASLKEDSIKVLLRNSTEARKPQRKALKTRGDAVNEAKHLGVKVFSVAITPDHLEPRLSIIATDHTYRRNFTAADWGQSRDAEEAISQTIDTIVDMIKNNVEQVCCSFECQPARGPPGLRGDPGFEGERGKPGLPGEKGEAGDPGRPGDLGPVGYQGMKGEKGSRGEKGSRGPKGYKGEKGKRGIDGVDGVKGEMGYPGLPGCKGSPGFDGIQGPPGPKGDPGAFGLKGEKGEPGADGEAGRPGSSGPSGDEGQPGEPGPPGEKGEAGDEGNPGPDGAPGERGGPGERGPRGTPGTRGPRGDPGEAGPQGDQGREGPVGVPGDPGEAGPIGPKGYRGDEGPPGSEGARGAPGPAGPPGDPGLMGERGEDGPAGNGTEGFPGFPGYPGNRGAPGINGTKGYPGLKGDEGEAGDPGDDNNDIAPRGVKGAKGYRGPEGPQGPPGHQGPPGPDECEILDIIMKMCSCCECKCGPIDLLFVLDSSESIGLQNFEIAKDFVVKVIDRLSRDELVKFEPGQSYAGVVQYSHSQMQEHVSLRSPSIRNVQELKEAIKSLQWMAGGTFTGEALQYTRDQLLPPSPNNRIALVITDGRSDTQRDTTPLNVLCSPGIQVVSVGIKDVFDFIPGSDQLNVISCQGLAPSQGRPGLSLVKENYAELLEDAFLKNVTAQICIDKKCPDYTCPITFSSPADITILLDGSASVGSHNFDTTKRFAKRLAERFLTAGRTDPAHDVRVAVVQYSGTGQQRPERASLQFLQNYTALASAVDAMDFINDATDVNDALGYVTRFYREASSGAAKKRLLLFSDGNSQGATPAAIEKAVQEAQRAGIEIFVVVVGRQVNEPHIRVLVTGKTAEYDVAYGESHLFRVPSYQALLRGVFHQTVSRKVALG

SEQ ID NO: 904535 - protein, 833 aa, Homo sapiens
MRAARALLPLLLQACWTAAQDEPETPRAVAFQDCPVDLFFVLDTSESVALRLKPYGALVDKVKSFTKRFIDNLRDRYYRCDRNLVWNAGALHYSDEVEIIQGLTRMPGGRDALKSSVDAVKYFGGEKGKRGIDGVDGVKGEMGYPGLPGCKGSPGFDGIQGPPGPKGDPGAFGLKGEKGEPGADGEAGRPGSSGPSGDEGQPGEPGPPGEKGEAGDEGNPGPDGAPGERGGPGERGPRGTPGTRGPRGDPGEAGPQGDQGREGPVGVPGDPGEAGPIGPKGYRGDEGPPGSEGARGAPGPAGPPGDPGLMGERGEDGPAGNGTEGFPGFPGYPGNRGAPGINGTKGYPGLKGDEGEAGDPGDDNNDIAPRGVKGAKGYRGPEGPQGPPGHQGPPGPDECEILDIIMKMCSCCECKCGPIDLLFVLDSSESIGLQNFEIAKDFVVKVIDRLSRDELVKFEPGQSYAGVVQYSHSQMQEHVSLRSPSIRNVQELKEAIKSLQWMAGGTFTGEALQYTRDQLLPPSPNNRIALVITDGRSDTQRDTTPLNVLCSPGIQVVSVGIKDVFDFIPGSDQLNVISCQGLAPSQGRPGLSLVKENYAELLEDAFLKNVTAQICIDKKCPDYTCPITFSSPADITILLDGSASVGSHNFDTTKRFAKRLAERFLTAGRTDPAHDVRVAVVQYSGTGQQRPERASLQFLQNYTALASAVDAMDFINDATDVNDALGYVTRFYREASSGAAKKRLLLFSDGNSQGATPAAIEKAVQEAQRAGIEIFVVVVGRQVNEPHIRVLVTGKTAEYDVAYGESHLFRVPSYQALLRGVFHQTVSRKVALG

SEQ ID NO: 904536 - protein, 652 aa, Homo sapiens
QIADLVRRETGARDHLETGQPGEPGPPGEKGEAGDEGNPGPDGAPGERGGPGERGPRGTPGTRGPRGDPGEAGPQGDQGREGPVGVPGDPGEAGPIGPKGYRGDEGPPGSEGARGAPGPAGPPGDPGLMGERGEDGPAGNGTEGFPGFPGYPGNRGAPGINGTKGYPGLKGDEGEAGDPGDDNNDIAPRGVKGAKGYRGPEGPQGPPGHQGPPGPDECEILDIIMKMCSCCECKCGPIDLLFVLDSSESIGLQNFEIAKDFVVKVIDRLSRDELVKFEPGQSYAGVVQYSHSQMQEHVSLRSPSIRNVQELKEAIKSLQWMAGGTFTGEALQYTRDQLLPPSPNNRIALVITDGRSDTQRDTTPLNVLCSPGIQVVSVGIKDVFDFIPGSDQLNVISCQGLAPSQGRPGLSLVKENYAELLEDAFLKNVTAQICIDKKCPDYTCPITFSSPADITILLDGSASVGSHNFDTTKRFAKRLAERFLTAGRTDPAHDVRVAVVQYSGTGQQRPERASLQFLQNYTALASAVDAMDFINDATDVNDALGYVTRFYREASSGAAKKRLLLFSDGNSQGATPAAIEKAVQEAQRAGIEIFVVVVGRQVNEPHIRVLVTGKTAEYDVAYGESHLFRVPSYQALLRGVFHQTVSRKVALG

SEQ ID NO: 904537 - protein, 1028 aa, Homo sapiens; identical to SEQ ID NO: 904531

SEQ ID NO: 904538 - protein, 1028 aa, Homo sapiens; identical to SEQ ID NO: 904531

SEQ ID NO: 904539 - protein, 1028 aa, Homo sapiens; identical to SEQ ID NO: 904531

SEQ ID NO: 904540 - protein, 1028 aa, Homo sapiens; identical to SEQ ID NO: 904531

SEQ ID NO: 904541 - protein, 446 aa, Homo sapiens
MRAARALLPLLLQACWTAAQDEPETPRAVAFQDCPVDLFFVLDTSESVALRLKPYGALVDKVKSFTKRFIDNLRDRYYRCDRNLVWNAGALHYSDEVEIIQGLTRMPGGRDALKSSVDAVKYFGKGTYTDCAIKKGLEQLLVGGSHLKENKYLIVVTDGHPLEGYKEPCGGLEDAVNEAKHLGVKVFSVAITPDHLEPRLSIIATDHTYRRNFTAADWGQSRDAEEAISQTIDTIVDMIKNNVEQVCCSFECQPARGPPGLRGDPGFEGERGKPGLPGEKGEAGDPGRPGDLGPVGYQGMKGEKGSRGEKGSRGPKGYKGEKGKRGIDGVDGVKGEMGYPGLPGCKGSPGFDGIQGPPGPKGDPGAFGLKGEKGEPGADGEAGRPGSSGPSGDEGQPGEPGPPGEKGEAGDEGNPGPDGAPGERGGPGERGPRGTPGTRGPRGDPP

SEQ ID NO: 904542 - protein, 1028 aa, Homo sapiens; identical to SEQ ID NO: 904531

SEQ ID NO: 904543 - protein, 1028 aa, Homo sapiens; identical to SEQ ID NO: 904531

SEQ ID NO: 904544 - protein, 1078 aa, Homo sapiens
MRAARALLPLLLQACWTAAQDEPETPRAVAFQDCPVDLFFVLDTSESVALRLKPYGALVDKVKSFTKRFIDNLRDRYYRCDRNLVWNAGALHYSDEVEIIQGLTRMPGGRDALKSSVDAVKYFGKGTYTDCAIKKGLEQLLVGGSHLKENKYLIVVTDGHPLEGYKEPCGGLEDAVNEAKHLGVKVFSVAITPDHLEPRLSIIATDHTYRRNFTAADWGQSRDAEEAISQTIDTIVDMIKNNVEQVCCSFECQPARGPPGLRGDPGFEGERGKPGLPGEKGEAGDPGRPGDLGPVGYQGMKGEKGSRGEKGSRGPKGYKGEKGKRGIDGVDGVKGEMGYPGLPGCKGSPGFDGIQGPPGPKGDPGAFGLKGEKGEPGADGEAGRPGSSGPSGDEGQPGEPGPPGEKGEAGDEGNPGPDGAPGERGGPGERGPRGTPGTRGPRGDPGEAGPQGDQGREGPVGVPGDPGEAGPIGPKGYRGDEGPPGSEGARGAPGPAGPPGDPGLMGERGEDGPAGNGTEGFPGFPGYPGNRGAPGINGTKGYPGLKGDEGEAGDPGDDNNDIAPRGVKGAKGYRGPEGPQGPPGHQGPPGPDECEILDIIMKMCSCCECKCGPIDLLFVLDSSESIGLQNFEIAKDFVVKVIDRLSRDELVKFEPGQSYAGVVQYSHSQMQEHVSLRSPSIRNVQELKEAIKSLQWMAGGTFTGEALQYTRDQLLPPSPNNRIALVITDGRSDTQRDTTPLNVLCSPGIQVVSVGIKDVFDFIPGSDQLNVISCQGLAPSQGRPGLSLVKENYAELLEDAFLKKRHHPKQQKQEKIQIDTNPNTLRRPNPRMLKTDSQTKRKAERSRPGGSDQDARSERKSSAVKVTDVPKVLLKMSNVTSRTQVRGNNGYSPSQQTITNKAIERHKTTNTGIPTRHPQEAKARHLNQKPKPRNRTAEPLKPMGGPVRMLRGDLIILPNERAEPRRKEKEQAREGSEGVGPAGRTKRSVEERDWDEMAGEAQGGKNVERKGAELPGNKKLRWPQRRAAEVAGGEGHNIERRIRRRRGKVRECEAEGDVDKTSLGWKGGVGGGEEERGV

SEQ ID NO: 904545 - protein, 250 aa, Homo sapiens
MRAARALLPLLLQACWTAAQDEPETPRAVAFQDCPVDLFFVLDTSESVALRLKPYGALVDKVKSFTKRFIDNLRDRYYRCDRNLVWNAGALHYSDEVEIIQGLTRMPGGRDALKSSVDAVKYFGKGTYTDCAIKKGLEQLLVGGSHLKENKYLIVVTDGHPLEGYKEPCGGLEDAVNEAKHLGVKVFSVAITPDHLEPRLSIIATDHTYRRNFTAADWGQSRDAEEAISQTIDTIVDMIPTALEAAADQH

SEQ ID NO: 904546 - protein, 309 aa, Homo sapiens
MRAARALLPLLLQACWTAAQDEPETPRAVAFQDCPVDLFFVLDTSESVALRLKPYGALVDKVKSFTKRFIDNLRDRYYRCDRNLVWNAGALHYSDEVEIIQGLTRMPGGRDALKSSVDAVKYFGKGTYTDCAIKKGLEQLLVGGSHLKENKYLIVVTDGHPLEGYKEPCGGLEDAVNEAKHLGVKVFSVAITPDHLEPRLSIIATDHTYRRNFTAADWGQSRDAEEAISQTIDTIVDMIKNNVEQVCCSFECQPARGPPGLRGDPGFEGERGKPGLPGEKGEAGDPGRPGDLGPVGTSDDGVHWDPLER

SEQ ID NO: 904547 - protein, 1002 aa, Homo sapiens
PSPNNRIALVITDGRSDTSESVALRLKPYGALVDKVKSFTKRFIDNLRDRYYRCDRNLVWNAGALHYSDEVEIIQGLTRMPGGRDALKSSVDAVKYFGKGTYTDCAIKKGLEQLLVGGSHLKENKYLIVVTDGHPLEGYKEPCGGLEDAVNEAKHLGVKVFSVAITPDHLEPRLSIIATDHTYRRNFTAADWGQSRDAEEAISQTIDTIVDMIKNNVEQVCCSFECQPARGPPGLRGDPGFEGERGKPGLPGEKGEAGDPGRPGDLGPVGYQGMKGEKGSRGEKGSRGPKGYKGEKGKRGIDGVDGVKGEMGYPGLPGCKGSPGFDGIQGPPGPKGDPGAFGLKGEKGEPGADGEAGRPGSSGPSGDEGQPGEPGPPGEKGEAGDEGNPGPDGAPGERGGPGERGPRGTPGTRGPRGDPGEAGPQGDQGREGPVGVPGDPGEAGPIGPKGYRGDEGPPGSEGARGAPGPAGPPGDPGLMGERGEDGPAGNGTEGFPGFPGYPGNRGAPGINGTKGYPGLKGDEGEAGDPGDDNNDIAPRGVKGAKGYRGPEGPQGPPGHQGPPGPDECEILDIIMKMCSCCECKCGPIDLLFVLDSSESIGLQNFEIAKDFVVKVIDRLSRDELVKFEPGQSYAGVVQYSHSQMQEHVSLRSPSIRNVQELKEAIKSLQWMAGGTFTGEALQYTRDQLLPPSPNNRIALVITDGRSDTQRDTTPLNVLCSPGIQVVSVGIKDVFDFIPGSDQLNVISCQGLAPSQGRPGLSLVKENYAELLEDAFLKNVTAQICIDKKCPDYTCPITFSSPADITILLDGSASVGSHNFDTTKRFAKRLAERFLTAGRTDPAHDVRVAVVQYSGTGQQRPERASLQFLQNYTALASAVDAMDFINDATDVNDALGYVTRFYREASSGAAKKRLLLFSDGNSQGATPAAIEKAVQEAQRAGIEIFVVVVGRQVNEPHIRVLVTGKTAEYDVAYGESHLFRVPSYQALLRGVFHQTVSRKVALG

SEQ ID NO: 904548 - protein, 1028 aa, Homo sapiens; identical to SEQ ID NO: 904531

SEQ ID NO: 904549 - protein, 894 aa, Homo sapiens
VSRCPLLSRGSHLKENKYLIVVTDGHPLEGYKEPCGGLEDAVNEAKHLGVKVFSVAITPDHLEPRLSIIATDHTYRRNFTAADWGQSRDAEEAISQTIDTIVDMIKNNVEQVCCSFECQPARGPPGLRGDPGFEGERGKPGLPGEKGEAGDPGRPGDLGPVGYQGMKGEKGSRGEKGSRGPKGYKGEKGKRGIDGVDGVKGEMGYPGLPGCKGSPGFDGIQGPPGPKGDPGAFGLKGEKGEPGADGEAGRPGSSGPSGDEGQPGEPGPPGEKGEAGDEGNPGPDGAPGERGGPGERGPRGTPGTRGPRGDPGEAGPQGDQGREGPVGVPGDPGEAGPIGPKGYRGDEGPPGSEGARGAPGPAGPPGDPGLMGERGEDGPAGNGTEGFPGFPGYPGNRGAPGINGTKGYPGLKGDEGEAGDPGDDNNDIAPRGVKGAKGYRGPEGPQGPPGHQGPPGPDECEILDIIMKMCSCCECKCGPIDLLFVLDSSESIGLQNFEIAKDFVVKVIDRLSRDELVKFEPGQSYAGVVQYSHSQMQEHVSLRSPSIRNVQELKEAIKSLQWMAGGTFTGEALQYTRDQLLPPSPNNRIALVITDGRSDTQRDTTPLNVLCSPGIQVVSVGIKDVFDFIPGSDQLNVISCQGLAPSQGRPGLSLVKENYAELLEDAFLKNVTAQICIDKKCPDYTCPITFSSPADITILLDGSASVGSHNFDTTKRFAKRLAERFLTAGRTDPAHDVRVAVVQYSGTGQQRPERASLQFLQNYTALASAVDAMDFINDATDVNDALGYVTRFYREASSGAAKKRLLLFSDGNSQGATPAAIEKAVQEAQRAGIEIFVVVVGRQVNEPHIRVLVTGKTAEYDVAYGESHLFRVPSYQALLRGVFHQTVSRKVALG

SEQ ID NO: 904550 - protein, 732 aa, Homo sapiens
MRAARALLPLLLQACWTAAQDEPETPRAVAFQDCPVDLFFVLDTSESVALRLKPYGALVDKVKSFTKRFIDNLRDRYYRCDRNLVWNAGALHYSDEVEIIQGLTRMPGGRDALKSSVDAVKYFGKGTYTDCAIKKGLEQLLVGGSHLKENKYLIVVTDGHPLEGYKEPCGGLEDAVNEAKHLGVKVFSVAITPDHLEPRLSIIATDHTYRRNFTAADWGQSRDAEEAISQTIDTIVDMIKNNVEQVCCSFECQPARGPPETDNNDIAPRGVKGAKGYRGPEGPQGPPGHQGPPGPDECEILDIIMKMCSCCECKCGPIDLLFVLDSSESIGLQNFEIAKDFVVKVIDRLSRDELVKFEPGQSYAGVVQYSHSQMQEHVSLRSPSIRNVQELKEAIKSLQWMAGGTFTGEALQYTRDQLLPPSPNNRIALVITDGRSDTQRDTTPLNVLCSPGIQVVSVGIKDVFDFIPGSDQLNVISCQGLAPSQGRPGLSLVKENYAELLEDAFLKNVTAQICIDKKCPDYTCPITFSSPADITILLDGSASVGSHNFDTTKRFAKRLAERFLTAGRTDPAHDVRVAVVQYSGTGQQRPERASLQFLQNYTALASAVDAMDFINDATDVNDALGYVTRFYREASSGAAKKRLLLFSDGNSQGATPAAIEKAVQEAQRAGIEIFVVVVGRQVNEPHIRVLVTGKTAEYDVAYGESHLFRVPSYQALLRGVFHQTVSRKVALG

SEQ ID NO: 904551 - protein, 441 aa, Homo sapiens
GQGTGGEGRALLTPPPPACCECKCGPIDLLFVLDSSESIGLQNFEIAKDFVVKVIDRLSRDELVKFEPGQSYAGVVQYSHSQMQEHVSLRSPSIRNVQELKEAIKSLQWMAGGTFTGEALQYTRDQLLPPSPNNRIALVITDGRSDTQRDTTPLNVLCSPGIQVVSVGIKDVFDFIPGSDQLNVISCQGLAPSQGRPGLSLVKENYAELLEDAFLKNVTAQICIDKKCPDYTCPITFSSPADITILLDGSASVGSHNFDTTKRFAKRLAERFLTAGRTDPAHDVRVAVVQYSGTGQQRPERASLQFLQNYTALASAVDAMDFINDATDVNDALGYVTRFYREASSGAAKKRLLLFSDGNSQGATPAAIEKAVQEAQRAGIEIFVVVVGRQVNEPHIRVLVTGKTAEYDVAYGESHLFRVPSYQALLRGVFHQTVSRKVALG

SEQ ID NO: 904552 - protein, 442 aa, Homo sapiens
MGGGGLFLGLRRGDPNVSACCECKCGPIDLLFVLDSSESIGLQNFEIAKDFVVKVIDRLSRDELVKFEPGQSYAGVVQYSHSQMQEHVSLRSPSIRNVQELKEAIKSLQWMAGGTFTGEALQYTRDQLLPPSPNNRIALVITDGRSDTQRDTTPLNVLCSPGIQVVSVGIKDVFDFIPGSDQLNVISCQGLAPSQGRPGLSLVKENYAELLEDAFLKNVTAQICIDKKCPDYTCPITFSSPADITILLDGSASVGSHNFDTTKRFAKRLAERFLTAGRTDPAHDVRVAVVQYSGTGQQRPERASLQFLQNYTALASAVDAMDFINDATDVNDALGYVTRFYREASSGAAKKRLLLFSDGNSQGATPAAIEKAVQEAQRAGIEIFVVVVGRQVNEPHIRVLVTGKTAEYDVAYGESHLFRVPSYQALLRGVFHQTVSRKVALG

SEQ ID NO: 904553 - protein, 332 aa, Homo sapiens
ARHPGVVLRPALALEVVEGALYEQYRRSVQHCQALRHWEGDQNAQRALKYPLPAVVSVGIKDVFDFIPGSDQLNVISCQGLAPSQGRPGLSLVKENYAELLEDAFLKNVTAQICIDKKCPDYTCPITFSSPADITILLDGSASVGSHNFDTTKRFAKRLAERFLTAGRTDPAHDVRVAVVQYSGTGQQRPERASLQFLQNYTALASAVDAMDFINDATDVNDALGYVTRFYREASSGAAKKRLLLFSDGNSQGATPAAIEKAVQEAQRAGIEIFVVVVGRQVNEPHIRVLVTGKTAEYDVAYGESHLFRVPSYQALLRGVFHQTVSRKVALG

SEQ ID NO: 904554 - protein, 1028 aa, Homo sapiens; identical to SEQ ID NO: 904531

SEQ ID NO: 904555 - protein, 1028 aa, Homo sapiens; identical to SEQ ID NO: 904531

SEQ ID NO: 904556 - protein, 146 aa, Homo sapiens
TSSGLECSQRPCEYSLRSGSVLVSSGLQGCRAKVQAGHQQDPQETVARFFLRKSLESQDTTLLPALCRVLRGSALSWHHLRRALWGLSPELVSPAQGPLGLSPELASPVQGPLGLSPELASPGFPTPGSPALPSCPPSLLPAQLLP

SEQ ID NO: 904557 - protein, 677 aa, Homo sapiens
MRAARALLPLLLQACWTAAQDEPETPRAVAFQDCPVDLFFVLDTSESVALRLKPYGALVDKVKSFTKRFIDNLRDRYYRCDRNLVWNAGALHYSDEVEIIQGLTRMPGGRDALKSSVDAVKYFGKGTYTDCAIKKGLEQLLVGGSHLKENKYLIVVTDGHPLEGYKEPCGGLEDAVNEAKHLGVKVFSVAITPDHLEPRLSIIATDHTYRRNFTAADWGQSRDAEEAISQTIDTIVDMIKNNVEQVCCSFECQPARGPPGLRGDPGFEGERGKPGLPGEKGEAGDPGRPGDLGPVGYQGMKGEKGSRGEKGSRGPKGYKGEKGKRGIDGVDGVKGEMGYPGLPGCKGSPGFDGIQGPPGPKGDPGAFGLKGEKGEPGADGEAGRPGSSGPSGDEGQPGEPGPPGEKGEAGDEGNPGPDGAPGERGGPGERGPRGTPGTRGPRGDPGEAGPQGDQGREGPVGVPGDPGEAGPIGPKGYRGDEGPPGSEGARGAPGPAGPPGDPGLMGERGEDGPAGNGTEGFPGFPGYPGNRGAPGINGTKGYPGLKGDEGEAGDPGDDNNDIAPRGVKGAKGYRGPEGPQGPPGHQGPPGPDECEILDIIMKMCSCCECKCGPIDLLFVLDSSESIGLQNFEIAKDFVVKVIDRLSRDELVKPGMKSNTSLMPTETTWMPGLQSTLS

SEQ ID NO: 904558 - protein, 327 aa, Homo sapiens
MRAARALLPLLLQACWTAAQDEPETPRAVAFQDCPVDLFFVLDTSESVALRLKPYGALVDKVKSFTKRFIDNLRDRYYRCDRNLVWNAGALHYSDEVEIIQGLTRMPGGRDALKSSVDAVKYFGKGTYTDCAIKKGLEQLLVGGSHLKENKYLIVVTDGHPLEGYKEPCGGLEDAVNEAKHLGVKVFSVAITPDHLEPRLSIIATDHTYRRNFTAADWGQSRDAEEAISQTIDTIVDMIKNNVEQVCCSFECQPARGPPGLRGDPGFEGERGKPGLPGEKGEAGDPGRPGDLGPVGYQGMKGEKGSRGEKGSRDRAPFSHFRLSCAE

SEQ ID NO: 904559 - protein, 448 aa, Homo sapiens
MLTFMASDSEEEVCDERTSLMSAESPTPRSCQEGRQGPEDGENTAQWRSQENEEDGEEDPDRYVCSGVPGRPPGLEEELTLKYGAKHVIMLFVPVTLCMIVVVATIKSVRFYTEKNGQLIYTPFTEDTPSVGQRLLNSVLNTLIMISVIVVMTIFLVVLYKYRCYKFIHGWLIMSSLMLLFLFTYIYLGEVLKTYNVAMDYPTLLLTVWNFGAVGMVCIHWKGPLVLQQAYLIMISALMALVFIKYLPEWSAWVILGAISVYDLVAVLCPKGPLRMLVETAQERNEPIFPALIYSSAMVWTVGMAKLDPSSQGALQLPYDPEMEEDSYDSFGEPSYPEVFEPPLTGYPGEELEEEEERGVKLGLGDFIFYSVLVGKAAATGSGDWNTTLACFVAILIGLCLTLLLLAVFKKALPALPISITFGLIFYFSTDNLVRPFMDTLASHQLYI

SEQ ID NO: 904560 - protein, 448 aa, Homo sapiens; identical to SEQ ID NO: 904559

SEQ ID NO: 904561 - protein, 481 aa, Homo sapiens
MLAGTVRFARHCLKFFPAQKPACVDFGASRGRAMLTFMASDSEEEVCDERTSLMSAESPTPRSCQEGRQGPEDGENTAQWRSQENEEDGEEDPDRYVCSGVPGRPPGLEEELTLKYGAKHVIMLFVPVTLCMIVVVATIKSVRFYTEKNGQLIYTPFTEDTPSVGQRLLNSVLNTLIMISVIVVMTIFLVVLYKYRCYKFIHGWLIMSSLMLLFLFTYIYLGEVLKTYNVAMDYPTLLLTVWNFGAVGMVCIHWKGPLVLQQAYLIMISALMALVFIKYLPEWSAWVILGAISVYDLVAVLCPKGPLRMLVETAQERNEPIFPALIYSSAMVWTVGMAKLDPSSQGALQLPYDPEMEEDSYDSFGEPSYPEVFEPPLTGYPGEELEEEEERGVKLGLGDFIFYSVLVGKAAATGSGDWNTTLACFVAILIGLCLTLLLLAVFKKALPALPISITFGLIFYFSTDNLVRPFMDTLASHQLYI

SEQ ID NO: 904562 - protein, 275 aa, Homo sapiens
MSSLMLLFLFTYIYLGEVLKTYNVAMDYPTLLLTVWNFGAVGMVCIHWKGPLVLQQAYLIMISALMALVFIKYLPEWSAWVILGAISVYDLVAVLCPKGPLRMLVETAQERNEPIFPALIYSSAMVWTVGMAKLDPSSQGALQLPYDPEMEEDSYDSFGEPSYPEVFEPPLTGYPGEELEEEEERGVKLGLGDFIFYSVLVGKAAATGSGDWNTTLACFVAILIGLCLTLLLLAVFKKALPALPISITFGLIFYFSTDNLVRPFMDTLASHQLYI

SEQ ID NO: 904563 - protein, 448 aa, Homo sapiens; identical to SEQ ID NO: 904559

SEQ ID NO: 904564 - protein, 441 aa, Homo sapiens
MLTFMASDSEEEVCDERTSLMSAESPTPRSCQEGRQGPEDGENTAQWRSQENEEDGEEDPDRYVCSGVPGRPPGLEEELTLKYGAKHVIMLFVPVTLCMIVVVATIKSVRFYTEKNGQLIYTPFTEDTPSVGQRLLNSVLNTLIMISVIVVMTIFLVVLYKYRCYKFIHGWLIMSSLMLLFLFTYIYLGEVLKTYNVAMDYPTLLLTVWNFGAVGMVCIHWKGPLVLQQAYLIMISALMALVFIKYLPEWSAWVILGAISVYDLVAVLCPKGPLRMLVETAQERNEPIFPALIYSSAMVWTVGMAKLDPSSQGALQLPYDPEMEEDSYDSFGEPSYPEVFEPPLTGYPGEELEEEEERGVKLGLGDFIFYSVLVGKAAATGSGDWNTTLACFVAILIGLCLTLLLLAVFKKALPALPISITFGLIFYFFTDRKHSRFIQMN

SEQ ID NO: 904565 - protein, 109 aa, Homo sapiens
ALNTSRAVAGPGKIMGCLAPLSDWSSNKLLCPGTETMTHSSCPHQGSPRSPSPPCPAGGLCLTLLLLAVFKKALPALPISITFGLIFYFSTDNLVRPFMDTLASHQLYI

SEQ ID NO: 904566 - protein, 881 aa, Homo sapiens [sequence omitted]

SEQ ID NO: 904567 - protein, 881 aa, Homo sapiens [sequence omitted]

SEQ ID NO: 904568 - protein, 881 aa, Homo sapiens [sequence omitted]

SEQ ID NO: 904569 - protein, 881 aa, Homo sapiens [sequence omitted]

SEQ ID NO: 904570 - protein, 881 aa, Homo sapiens [sequence omitted]

SEQ ID NO: 904571 - protein, 714 aa, Homo sapiens
MLSRLFRMHGLFVASHPWEVIVGTVTLTICMMSMNMFTGNNKICGWNYECPKFEEDVLSSDIIILTITRCIAILYIYFQFQNLRQLGSKYILGIAGLFTIFSSFVFSTVVIHFLDKELTGLNEALPFFLLLIDLSRASTLAKFALSSNSQDEVRENIARGMAILGPTFTLDALVECLVIGVGTMSGVRQLEIMCCFGCMSVLANYFVFMTFFPACVSLVLELSRESREGRPIWQLSHFARVLEEEENKPNPVTQRVKMIMSLGLVLVHAHSRWIADPSPQNSTADTSKVSLGLDENVSKRIEPSVSLWQFYLSKMISMDIEQVITLSLALLLAVKYIFFEQTETESTLSLKNPITSPVVTQKKVPDNCCRREPMLVRNNQKCDSVEEETGINRERKVEVIKPLVAETDTPNRATFVVGNSSLLDTSSVLVTQEPEIELPREPRPNEECLQILGNAEKGAKFLSDAEIIQLVNAKHIPAYKLETLMETHERGVSIRRQLLSKKLSEPSSLQYLPYRDYNYSLVMGACCENVIGYMPIPVGVAGPLCLDEKEFQVPMATTEGCLVASTNRGCRAIGLGGGASSRVLADGMTRGPVVRLPRACDSAEVKAWLETSEGFAVIKEAFDSTSRFARLQKLHTSIAGRNLYIRFQSRSGDAMGMNMISKGTEKALSKLHEYFPEMQILAVSGNYCTDKKPAAINWIEGRGKCIKDYHRGYD

SEQ ID NO: 904572 - protein, 673 aa, Homo sapiens
MHGLFVASHPWEVIVGTVTLTICMMSMNMFTGNNKICGWNYECPKFEEDVLSSDIIILTITRCIAILYIYFQFQNLRQLGSKYILGIAGLFTIFSSFVFSTVVIHFLDKELTGLNEALPFFLLLIDLSRASTLAKFALSSNSQDEVRENIARGMAILGPTFTLDALVECLVIGVGTMSGVRQLEIMCCFGCMSVLANYFVFMTFFPACVSLVLELSRESREGRPIWQLSHFARVLEEEENKPNPVTQRVKMIMSLGLVLVHAHSRWIADPSPQNSTADTSKVSLGLDENVSKRIEPSVSLWQFYLSKMISMDIEQVITLSLALLLAVKYIFFEQTETESTLSLKNPITSPVVTQKKVPDNCCRREPMLVRNNQKCDSVEEETGINRERKVEVIKPLVAETDTPNRATFVVGNSSLLDTSSVLVTQEPEIELPREPRPNEECLQILGNAEKGAKFLSDAEIIQLVNAKHIPAYKLETLMETHERGVSIRRQLLSKKLSEPSSLQYLPYRDYNYSLVMGACCENVIGYMPIPVGVAGPLCLDEKEFQVPMATTEGCLVASTNRGCRAIGLGGGASSRVLADGMTRGPVVRLPRACDSAEVKAWLETSEGFAVIKEAFDSTSRFARLQKLHTSIAGRNLYIRFQSRSGDAMGMNMISKVSVGRVSESTFIKMKVLL

SEQ ID NO: 904573 - protein, 107 aa, Homo sapiens
MHGLFVASHPWEVIVGTVTLTICMMSMNMFTGNNKICGWNYECPKFEEDVLSSDIIILTITRCIAILYIYFQFQNLRQLGSKYILGNSFTYLTSGVIRFLICCGNKP

SEQ ID NO: 904574 - protein, 881 aa, Homo sapiens [sequence omitted]

SEQ ID NO: 904575 - protein, 931 aa, Homo sapiens
MHGLFVASHPWEVIVGTVTLTICMMSMNMFTGNNKICGWNYECPKFEEDVLSSDIIILTITRCIAILYIYFQFQNLRQLGSKYILGIAGLFTIFSSFVFSTVVIHFLDKELTGLNEALPFFLLLIDLSRASTLAKFALSSNSQDEVRENIARGMAILGPTFTLDALVECLVIGVGTMSGVRQLEIMCCFGCMSVLANYFVFMTFFPACVSLVLELSRESREGRPIWQLSHFARVLEEEENKPNPVTQRVKMIMSLGLVLVHAHSRWIADPSPQNSTADTSKVSLGLDENVSKRIEPSVSLWQFYLSKMISMDIEQVITLSLALLLAVKYIFFEQTETESTLSLKNPITSPVVTQKKVPDNCCRREPMLVRNNQKCDSVEEETGINRERKVEVIKPLVAETDTPNRATFVVGNSSLLDTSSVLVTQEPEIELPREPRPNEECLQILGNAEKGAKFLSDAEIIQLVNAKHIPAYKLETLMETHERGVSIRRQLLSKKLSEPSSLQYLPYRDYNYSLVMGACCENVIGYMPIPVGVAGPLCLDEKEFQVPMATTEGCLVASTNRGCRAIGVSWHLYICQFEKYIISKAMRRVLRTISDTFWVKHEHFWVTCACFSNIYCVLGGGASSRVLADGMTRGPVVRLPRACDSAEVKAWLETSEGFAVIKEAFDSTSRFARLQKLHTSIAGRNLYIRFQSRSGDAMGMNMISKGTEKALSKLHEYFPEMQILAVSGNYCTDKKPAAINWIEGRGKSVVCEAVIPAKVVREVLKTTTEAMIEVNINKNLVGSAMAGSIGGYNAHAANIVTAIYIACGQDAAQNVGSSNCITLMEASGPTNEDLYISCTMPSIEIGTVGGGTNLLPQQACLQMLGVQGACKDNPGENARQLARIVCGTVMAGELSLMAALAAGHLVKSHMIHNRSKINLQDLQGACTKKTA

SEQ ID NO: 904576 - protein, 881 aa, Homo sapiens [sequence omitted]

SEQ ID NO: 904577 - protein, 581 aa, Homo sapiens
MHGLFVASHPWEVIVGTVTLTICMMSMNMFTGNNKICGWNYECPKFEEDVLSSDIIILTITRCIAILYIYFQFQNLRQLGSKYILGIAGLFTIFSSFVFSTVVIHFLDKELTGLNEALPFFLLLIDLSRASTLAKFALSSNSQDEVRENIARGMAILGPTFTLDALVECLVIGVGTMSGVRQLEIMCCFGCMSVLANYFVFMTFFPACVSLVLELSRESREGRPIWQLSHFARVLEEEENKPNPVTQRVKMIMSLGLVLVHAHSRWIADPSPQNSTADTSKVSLGLDENVSKRIEPSVSLWQFYLSKMISMDIEQVITLSLALLLAVKYIFFEQTETESTLSLKNPITSPVVTQKKVPDNCCRREPMLVRNNQKCDSVEEETGINRERKVEVIKPLVAETDTPNRATFVVGNSSLLDTSSVLVTQEPEIELPREPRPNEECLQILGNAEKGAKFLSDAEIIQLVNAKHIPAYKLETLMETHERGVSIRRQLLSKKLSEPSSLQYLPYRDYNYSLVMGACCENVIGYMPIPVGVAGPLCLDEKEFQVPMATTEGCLVASTNRGCRAIGVSWHLYICQFKNTS

SEQ ID NO: 904578 - protein, 329 aa, Homo sapiens
MGATGDAEQPRGPSGAERGGLELGDAGAAGQLVLTNPWNIMIKHRQVQRRGRRSQMTTSFTDPAISMDLLRAVLQPSINEEIQTVFNKYMKFFQKAALNVRDNVGEEVDAEQLIQEACRSCLEQAKLLFSDGEKVIPRLTHELPGIKRGRQAEEECAHRGSPLPKKRKGRPPGHILSSDRAAAGMVWKPKSCEPIRREGPKWDPARLNESTTFVLGSRANKALGMGGTRGRIYIKHPHLFKYAADPQDKHWLAEQHHMRATGGKMAYLLIEEDIRDLAASDDYRGCLDLKLEELKSFVLPSWMVEKMRKYMETLRTENEHRAVEAPPQT

SEQ ID NO: 904579 - protein, 329 aa, Homo sapiens; identical to SEQ ID NO: 904578

SEQ ID NO: 904580 - protein, 105 aa, Homo sapiens
MGGTRGRIYIKHPHLFKYAADPQDKHWLAEQHHMRATGGKMAYLLIEEDIRDLAASDDYRGCLDLKLEELKSFVLPSWMVEKMRKYMETLRTENEHRAVEAPPQT

SEQ ID NO: 904581 - protein, 248 aa, Homo sapiens
MGATGDAEQPRGPSGAERGGLELGDAGAAGQLVLTNPWNIMIKHRQVQRRGRRSQMTTSFTDPAISMDLLRAVLQPSINEEIQTVFNKYMKFFQKAALNVRDNVGEEVDAEQLIQEACRSCLEQAKLLFSDGEKVIPRLTHELPGIKRGRQAEEECAHRGSPLPKKRKGRPPGHILSSDRAAAGMVWKPKSCEPIRREGPKWDPARLNESTTFVLGSRANKALGMGGTRGRIYIKHPHLFKVGDCWEE

SEQ ID NO: 904582 - protein, 88 aa, Homo sapiens
EEVDAEQLIQEACRSCLEQVRPKGTRDAGTRFSSRASDKKCDLKPDVVAHTCNPSTVGGQGGQITQGQEFETSLGNVAKPHLYKQYEN

SEQ ID NO: 904583 - protein, 155 aa, Homo sapiens
MGATGDAEQPRGPSGAERGGLELGDAGAAGQLVLTNPWNIMIKHRQVQRRGRRSQMTTSFTDPAISMDLLRAVLQPSINEEIQTVFNKYMKFFQKAALNVRDNVGEEVDAEQLIQEACRSCLEQVRGGSSYHGPIWYHGDEHPAASLPLWCGQEA

SEQ ID NO: 904584 - protein, 284 aa, Homo sapiens
MGATGDAEQPRGPSGAERGGLELGDAGAAGQLVLTNPWNIMIKHRQVQRRGRRSQMTTSFTDPAISMDLLRAVLQPSINEEIQTVFNKYMKFFQKAALNVRDNVGEEVDAEQLIQEACRSCLEQAKLLFSDGEKVIPRLTHELPGIKRGRQAEEECAHRGSPLPKKRKGRPPGHILSSDRAAAGMVWKPKSCEPIRREGPKWDPARLNESTTFVLGSRANKALGMGGTRGRIYIKHPHLFKYAADPQDKHWLAEQHHMRATGGKMAYLLIEEDIRDLAASDDYR

SEQ ID NO: 904585 - protein, 124 aa, Homo sapiens
RSSDVHGATFRPVTESSGVVGAGGAMGATGDAEQPRGPSGAERGGLELGDAGAAGQLVLTNPWNIMIKHRQVQRRGRRSQMTTSFTDPAISMDLLRAVLQPSINEEIQTVFNKYMKVRGTQDKK

SEQ ID NO: 904586 - protein, 359 aa, Homo sapiens
MDPLGPAKPQWSWRCCLTTLLFQLLMAVCFFSYLRVSQDDPTVYPNGSRFPDSTGTPAHSIPLILLWTWPFNKPIALPRCSEMVPGTADCNITADRKVYPQADAVIVHHREVMYNPSAQLPRSPRRQGQRWIWFSMESPSHCWQLKAMDGYFNLTMSYRSDSDIFTPYGWLEPWSGQPAHPPLNLSAKTELVAWAVSNWGPNSARVRYYQSLQAHLKVDVYGRSHKPLPQGTMMETLSRYKFYLAFENSLHPDYITEKLWRNALEAWAVPVVLGPSRSNYERFLPPDAFIHVDDFQSPKDLARYLQELDKDHARYLSYFRWRETLRPRSFSWALAFCKACWKLQEESRYQTRGIAAWFT

SEQ ID NO: 904587 - protein, 359 aa, Homo sapiens; identical to SEQ ID NO: 904586

SEQ ID NO: 904588 - protein, 359 aa, Homo sapiens; identical to SEQ ID NO: 904586

SEQ ID NO: 904589 - protein, 286 aa, Homo sapiens
MDPLGPAKPQWSWRCCLTTLLFQLLMAVCFFSYLRVSQDDPTVYPNGSRFPDSTGTPAHSIPLILLWTWPFNKPIALPRCSEMVPGTADCNITADRKVYPQADAVIVHHREVMYNPSAQLPRSPRRQGQRWIWFSMESPSHCWQLKAMDGYFNLTMSYRSDSDIFTPYGWLEPWSGQPAHPPLNLSAKTELVAWAVSNWGPNSARVRYYQSLQAHLKVDVYGRSHKPLPQGTMMETLSRYKFYLAFENSLHPDYITEKLWRNALEAWAVPVVLGPSRRTSFSWGLT

SEQ ID NO: 904590 - protein, 109 aa, Homo sapiens
MTGVVVGKGRVSAPGTLPPSFCCVVWPLPRPQNPAVTRPRPLSSRALCTLAPPVSRASRRDPVHPLLEERPVSRSPSPSSISQKVSRRSSVQGAAAVHSNLGDTVRLSQ

SEQ ID NO: 904591 - protein, 359 aa, Homo sapiens; identical to SEQ ID NO: 904586

SEQ ID NO: 904592 - protein, 364 aa, Homo sapiens
MDPLGPAKPQWSWRCCLTTLLFQLLMAVCFFSYLRVSQDDPTVYPNGSRFPDSTGTPAHSIPLILLWTWPFNKPIALPRCSEMVPGTADCNITADRKVYPQADAVIVHHREVMYNPSAQLPRSPRRQGQRWIWFSMESPSHCWQLKAMDGYFNLTMSYRSDSDIFTPYGWLEPWSGQPAHPPLNLSAKTELVAWAVSNWGPNSARVRYYQSLQAHLKVDVYGRSHKPLPQGTMMETLSRYKFYLAFENSLHPDYITEKLWRNALEAWAVPVVLGPSRSNYERFLPPDAFIHVDDFQSPKDLARYLQELDKDHARYLSYFRWRETLRPRSFSWALAFCKACWKLQEESSGGLIYLRTRLPEASPA

SEQ ID NO: 904593 - protein, 537 aa, Homo sapiens
RALYGRGDGASRRQAPRAGKRGRGARLMPGGGASAASGRLLTAAEQRGSREAAGSASRSGFGGSGGGRGGASGPGSGSGGPGGPAGRMSLTPKELSSLLSIISEEAGGGSTFEGLSTAFHHYFSKADHFRLGSVLVMLLQQPDLLPSAAQRLTALYLLWEMYRTEPLAANPFAASFAHLLNPAPPARGGQEPDRPPLSGFLPPITPPEKFFLSQLMLAPPRELFKKTPRQIALMDVGNMGQSVDISGLQLALAERQSELPTQSKASFPSILSDPDPDSSNSGFDSSVASQITEALVSGPKPPIESHFRPEFIRPPPPLHICEDELAWLNPTEPDHAIQWDKSMCVKNSTGVEIKRIMAKAFKSPLSSPQQTQLLGELEKDPKLVYHIGLTPAKLPDLVENNPLVAIEMLLKLMQSSQITEYFSVLVNMDMSLHSMEVVNRLTTAVDLPPEFIHLYISNCISTCEQIKDKYMQNRLVRLVCVFLQSLIRNKIINVQDLFIEVQAFCIEFSRIREAAGLFRLLKTLDTGETPSETKMSK

SEQ ID NO: 904594 - protein, 329 aa, Homo sapiens
ADSKNLSTTLSEDLLYVQTYTHFLSLSESGPLFFSVTDSLPQLVACLFSLLMMSIILSFPSILSDPDPDSSNSGFDSSVASQITEALVSGPKPPIESHFRPEFIRPPPPLHICEDELAWLNPTEPDHAIQWDKSMCVKNSTGVEIKRIMAKAFKSPLSSPQQTQLLGELEKDPKLVYHIGLTPAKLPDLVENNPLVAIEMLLKLMQSSQITEYFSVLVNMDMSLHSMEVVNRLTTAVDLPPEFIHLYISNCISTCEQIKDKYMQNRLVRLVCVFLQSLIRNKIINVQDLFIEVQAFCIEFSRIREAAGLFRLLKTLDTGETPSETKMSK

SEQ ID NO: 904595 - protein, 537 aa, Homo sapiens; identical to SEQ ID NO: 904593

SEQ ID NO: 904596 - protein, 474 aa, Homo sapiens
RALYGRGDGASRRQAPRAGKRGRGARLMPGGGASAASGRLLTAAEQRGSREAAGSASRSGFGGSGGGRGGASGPGSGSGGPGGPAGRMSLTPKELSSLLSIISEEAGGGSTFEGLSTAFHHYFSKADHFRLGSVLVMLLQQPDLLPSAAQRLTALYLLWEMYRTEPLAANPFAASFAHLLNPAPPARGGQEPDRPPLSGFLPPITPPEKFFLSQLMLAPPRELFKKTPRQIALMDVGNMGQSVDISGLQLALAERQSELPTQSKASFPSILSDPDPDSSNSGFDSSVASQITEALVSGPKPPIESHFRPEFIRPPPPLHICEDELAWLNPTEPDHAIQWDKSMCVKNSTGVEIKRIMAKAFKSPLSSPQQTQLLGELEKDPKLVYHIGLTPAKLPDLVENNPLVAIEMLLKLMQSSQITEYFSVLVNMDMSLHSMEVVNRLTTAVDLPPEFIHLYISNCISTCEQIKDKYMQVI

SEQ ID NO: 904597 - protein, 398 aa, Homo sapiens
RALYGRGDGASRRQAPRAGKRGRGARLMPGGGASAASGRLLTAAEQRGSREAAGSASRSGFGGSGGGRGGASGPGSGSGGPGGPAGRMSLTPKELSSLLSIISEEAGGGSTFEGLSTAFHHYFSKADHFRLGSVLVMLLQQPDLLPSAAQRLTALYLLWEMYRTEPLAANPFAASFAHLLNPAPPARGGQEPDRPPLSGFLPPITPPEKFFLSQLMLAPPRELFKKTPRQIALMDVGNMGQSVDISGLQLALAERQSELPTQSKASFPSILSDPDPDSSNSGFDSSVASQITEALVSGPKPPIESHFRPEFIRPPPPLHICEDELAWLNPTEPDHAIQWDKSMCVKNSTGVEIKRIMAKAFKSPLSSPQQTQLLGELEKDPKLVYHIDQDREILSDLA

SEQ ID NO: 904598 - protein, 255 aa, Homo sapiens
RALYGRGDGASRRQAPRAGKRGRGARLMPGGGASAASGRLLTAAEQRGSREAAGSASRSGFGGSGGGRGGASGPGSGSGGPGGPAGRMSLTPKELSSLLSIISEEAGGGSTFEGLSTAFHHYFSKADHFRLGSVLVMLLQQPDLLPSAAQRLTALYLLWEMYRTEPLAANPFAASFAHLLNPAPPARGGQEPDRPPLSGFLPPITPPEKFFLSQLMLAPPRELFKKTPRQIALMDVGNMGQSVDISGLQLALADW

SEQ ID NO: 904599 - protein, 537 aa, Homo sapiens; identical to SEQ ID NO: 904593

SEQ ID NO: 904600 - protein, 537 aa, Homo sapiens; identical to SEQ ID NO: 904593

SEQ ID NO: 904601 - protein, 519 aa, Homo sapiens
RALYGRGDGASRRQAPRAGKRGRGARLMPGGGASAASGRLLTAAEQRGSREAAGSASRSGFGGSGGGRGGASGPGSGSGGPGGPAGRMSLTPKELSSLLSIISEEAGGGSTFEGLSTAFHHYFSKADHFRLGSVLVMLLQQPDLLPSAAQRLTALYLLWEMYRTEPLAANPFAASFAHLLNPAPPARGGQEPDRPPLSGFLPPITPPEKFFLSQLMLAPPRELFKKTPRQIALMDVGNMGQSVDISGLQLALAERQSELPTQSKASFPSILSDPDPDSSNSGFDSSVASQITEALVSGPKPPIESHFRPEFIRPPPPLHICEDELAWLNPTEPDHAIQWDKSMCVKNSTGVEIKRIMAKAFKSPLSSPQQTQLLGELEKDPKLVYHIGLTPAKLPDLVEITEYFSVLVNMDMSLHSMEVVNRLTTAVDLPPEFIHLYISNCISTCEQIKDKYMQNRLVRLVCVFLQSLIRNKIINVQDLFIEVQAFCIEFSRIREAAGLFRLLKTLDTGETPSETKMSK

SEQ ID NO: 904602 - protein, 549 aa, Homo sapiens
RALYGRGDGASRRQAPRAGKRGRGARLMPGGGASAASGRLLTAAEQRGSREAAGSASRSGFGGSGGGRGGASGPGSGSGGPGGPAGRMSLTPKELSSLLSIISEEAGGGSTFEGLSTAFHHYFSKADHFRLGSVLVMLLQQPDLLPSAAQRLTALYLLWEMYRTEPLAANPFAASFAHLLNPAPPARGGQEPDRPPLSGFLPPITPPEKFFLSQLMLAPPRELFKKTPRQIALMDVGNMGQSVDISGLQLALAERQSELPTQSKASFPSILSDPDPDSSNSGFDSSVASQITEALVSGPKPPIESHFRPEFIRPPPPLHICEDELAWLNPTEPDHAIQWDKSMCVKNSTGVEIKRIMAKAFKSPLSSPQQTQLLGELEKDPKLVYHIGLTPAKLPDLVENNPLVAIEMLLKLMQSSQITEYFSVLVNMDMSLHSMEVVNRLTTAVDLPPEFIHLYISNCISTCEQIKDKYMQNRLVRLVCVFLQSLIRNKIINVQDLFIEVQAFCIEFSRKRPAASRILLNSIREAAGLFRLLKTLDTGETPSETKMSK

SEQ ID NO: 904603 - protein, 104 aa, Homo sapiens [sequence omitted]

SEQ ID NO: 904604 - protein, 259 aa, Homo sapiens
LLGAGRAVATDSRPAPARVQDPVVPSCCPGARTEAPGARQGSRSTRAMARPRLGSALPSAAAFGWLRPRPNFQATVSRRRRAGPSLPPPAARSGAPATPRLWLGCGSGACPDCDAATAWGQFAQSGGWLGRPRGSTIPRVGDVPCPGLTSRVRKTGWTTQPKAEPRQGPSLSPGSGGLTGPGVRACPRAWGGRRDGLAGSAPGPPGGAAAVAADPGPEAAQAASQVRGPTVGRRALSRPHLTRLQNAAENAAVGPLQGP

SEQ ID NO: 904605 - protein, 399 aa, Homo sapiens
AHPAARPRPPPLVVAPRPRARPARPPPAATMSTGLRYKSKLATPEDKQDIDKQYVGFATLPNQVHRKSVKKGFDFTLMVAGESGLGKSTLVHSLFLTDLYKDRKLLSAEERISQTVEILKHTVDIEEKGVKLKLTIVDTPGFGDAVNNTECWKPITDYVDQQFEQYFRDESGLNRKNIQDNRVHCCLYFISPFGHGLRPVDVGFMKALHEKVNIVPLIAKADCLVPSEIRKLKERIREEIDKFGIHVYQFPECDSDEDEDFKQQDRELKESAPFAVIGSNTVVEAKGQRVRGRLYPWGIVEVENQAHCDFVKLRNMLIRTHMHDLKDVTCDVHYENYRAHCIQQMTSKLTQDSRMESPIPILPLPTPDAETEKLIRMKDEELRRMQEMLQRMKQQMQDQ

SEQ ID NO: 904606 - protein, 573 aa, Homo sapiens
LLGAGRAVATDSRPAPARVQDPVVPSCCPGARTEAPGARQGSRSTRAMARPRLGSALPSAAAFGWLRPRPNFQATVSRRRRAGPSLPPPAARSGAPATPRLWLGCGSGACPDCDAATAWGQFAQSGGWLGRPRGSTIPRVGDVPCPGLTSRVRKTGWTTQPKAEPRQGPSLSPGSGGLTGPGVRACPRAWGGRRDGLAGSAPGPPGGAAAVAADPGPEAAQEDIDKQYVGFATLPNQVHRKSVKKGFDFTLMVAGESGLGKSTLVHSLFLTDLYKDRKLLSAEERISQTVEILKHTVDIEEKGVKLKLTIVDTPGFGDAVNNTECWKPITDYVDQQFEQYFRDESGLNRKNIQDNRVHCCLYFISPFGHGLRPVDVGFMKALHEKVNIVPLIAKADCLVPSEIRKLKERIREEIDKFGIHVYQFPECDSDEDEDFKQQDRELKESAPFAVIGSNTVVEAKGQRVRGRLYPWGIVEVENQAHCDFVKLRNMLIRTHMHDLKDVTCDVHYENYRAHCIQQMTSKLTQDSRMESPIPILPLPTPDAETEKLIRMKDEELRRMQEMLQRMKQQMQDQ

SEQ ID NO: 904607 - protein, 407 aa, Homo sapiens
ISRLLPTGPPLIFANEMPHPGNRTLCCLLIPHLVRDRVLGFWRNLCVPTLFHPVPKDIDKQYVGFATLPNQVHRKSVKKGFDFTLMVAGESGLGKSTLVHSLFLTDLYKDRKLLSAEERISQTVEILKHTVDIEEKGVKLKLTIVDTPGFGDAVNNTECWKPITDYVDQQFEQYFRDESGLNRKNIQDNRVHCCLYFISPFGHGLRPVDVGFMKALHEKVNIVPLIAKADCLVPSEIRKLKERIREEIDKFGIHVYQFPECDSDEDEDFKQQDRELKESAPFAVIGSNTVVEAKGQRVRGRLYPWGIVEVENQAHCDFVKLRNMLIRTHMHDLKDVTCDVHYENYRAHCIQQMTSKLTQDSRMESPIPILPLPTPDAETEKLIRMKDEELRRMQEMLQRMKQQMQDQ

SEQ ID NO: 904608 - protein, 314 aa, Homo sapiens
HGHSCLSGRTGVEETGYRRCGCGSALIIDWLPILKHTVDIEEKGVKLKLTIVDTPGFGDAVNNTECWKPITDYVDQQFEQYFRDESGLNRKNIQDNRVHCCLYFISPFGHGLRPVDVGFMKALHEKVNIVPLIAKADCLVPSEIRKLKERIREEIDKFGIHVYQFPECDSDEDEDFKQQDRELKESAPFAVIGSNTVVEAKGQRVRGRLYPWGIVEVENQAHCDFVKLRNMLIRTHMHDLKDVTCDVHYENYRAHCIQQMTSKLTQDSRMESPIPILPLPTPDAETEKLIRMKDEELRRMQEMLQRMKQQMQDQ

SEQ ID NO: 904609 - protein, 113 aa, Homo sapiens
MREMLSDNVGASEDVCGDTEDPVGAVRMLWGCCGDSKDTGGSEDAVDTADAVGTMTLWTVRTLWGRRGHCGVRTLGAVRTLWTVGRCGGGEDAVGAVEDAVDGENAVGTLRML

SEQ ID NO: 904610 - protein, 399 aa, Homo sapiens; identical to SEQ ID NO: 904605

SEQ ID NO: 904611 - protein, 399 aa, Homo sapiens; identical to SEQ ID NO: 904605

SEQ ID NO: 904612 - protein, 377 aa, Homo sapiens
AHPAARPRPPPLVVAPRPRARPARPPPAATMSTGLRYKSKLATPEDKQDIDKQYVGFATLPNQVHRKSVKKGFDFTLMVAGESGLGKSTLVHSLFLTDLYKDRKLLSAEERISQTVEILKHTVDIEEKGVKLKLTIVDTPGFGDAVNNTECWKPITDYVDQQFEQYFRDESGLNRKNIQDNRVHCCLYFISPFGHGLRPVDVGFMKALHEKVNIVPLIAKADCLVPSEIRKLKERIREEIDKFGIHVYQFPECDSDEDEDFKQQDRELKESAPFAVIGSNTVVEAKGQRVRGRLYPWGIVEVENQAHCDFVKLRNMLIRTHMHDLKDVTCDVHYENYRAHCIQQMTRCAPQPRARPRPSGPAHVSITEGRSCQPTQT

SEQ ID NO: 904613 - protein, 491 aa, Homo sapiens
LLGAGRAVATDSRPAPARVQDPVVPSCCPGARTEAPGARQGSRSTRAMARPRLGSALPSAAAFGWLRPRPNFQATVSRRRRAGPSLPPPAARSAGACDAPPLARVRERGLPGLRRRHSLGPVRPVRGMARSASGVDDPPEDIDKQYVGFATLPNQVHRKSVKKGFDFTLMVAGESGLGKSTLVHSLFLTDLYKDRKLLSAEERISQTVEILKHTVDIEEKGVKLKLTIVDTPGFGDAVNNTECWKPITDYVDQQFEQYFRDESGLNRKNIQDNRVHCCLYFISPFGHGLRPVDVGFMKALHEKVNIVPLIAKADCLVPSEIRKLKERIREEIDKFGIHVYQFPECDSDEDEDFKQQDRELKESAPFAVIGSNTVVEAKGQRVRGRLYPWGIVEVENQAHCDFVKLRNMLIRTHMHDLKDVTCDVHYENYRAHCIQQMTSKLTQDSRMESPIPILPLPTPDAETEKLIRMKDEELRRMQEMLQRMKQQMQDQ

SEQ ID NO: 904614 - protein, 399 aa, Homo sapiens; identical to SEQ ID NO: 904605

SEQ ID NO: 904615 - protein, 399 aa, Homo sapiens; identical to SEQ ID NO: 904605

SEQ ID NO: 904616 - protein, 409 aa, Homo sapiens
AHPAARPRPPPLVVAPRPRARPARPPPAATMSTGLRYKSKLATPEDKQDIDKQYVGFATLPNQVHRKSVKKGFDFTLMVAGESGLGKSTLVHSLFLTDLYKDRKLLSAEERISQTVEILKHTVDIEEKGVKLKLTIVDTPGFGDAVNNTECWKPITDYVDQQFEQYFRDESGLNRKNIQDNRVHCCLYFISPFGHGLRPVDVGFMKALHEKVNIVPLIAKADCLVPSEIRKLKERIREEIDKFGIHVYQFPECDSDEDEDFKQQDRELKVLSLSPSFPQESAPFAVIGSNTVVEAKGQRVRGRLYPWGIVEVENQAHCDFVKLRNMLIRTHMHDLKDVTCDVHYENYRAHCIQQMTSKLTQDSRMESPIPILPLPTPDAETEKLIRMKDEELRRMQEMLQRMKQQMQDQ

SEQ ID NO: 904617 - protein, 542 aa, Homo sapiens
LLGAGRAVATDSRPAPARVQDPVVPSCCPGARTEAPGARQGSRSTRAMARPRLGSALPSAAAFGWLRPRPNFQATVSRRRRAGPSLPPPAARSGAPATPRLWLGCGSGACPDCDAATAWGQFAQSGGWLGRPRGSTIPRVGDVPCPGLTSRVRKTGWTTQPKAEPRQGPSLSPGSGGLTGPGVRACPRAWGGRRDGLAGSAPGPPGGAAAVAADPGPEAAQEDIDKQYVGFATLPNQVHRKSVKKGFDFTLMVAGESGLGKSTLVHSLFLTDLYKDRKLLSAEERISQTVEILKHTVDIEEKGVKLKLTIVDTPGFGDAVNNTECWKPITDYVDQQFEQYFRDESGLNRKNIQDNRVHCCLYFISPFGHGEIRKLKERIREEIDKFGIHVYQFPECDSDEDEDFKQQDRELKESAPFAVIGSNTVVEAKGQRVRGRLYPWGIVEVENQAHCDFVKLRNMLIRTHMHDLKDVTCDVHYENYRAHCIQQMTSKLTQDSRMESPIPILPLPTPDAETEKLIRMKDEELRRMQEMLQRMKQQMQDQ

SEQ ID NO: 904618 - protein, 117 aa, Homo sapiens
MLWGCCGDSKDTGGSEDAVDTADAVGTMTLWTVRTLWGRRGHCGVRTLGAVRTLWTVGRCGGGEDAVGAVEDAVDGENAVGTLRCCEDAVGAVRTLWTVRTLWGWRRLCGGGEDSVD

SEQ ID NO: 904619 - protein, 290 aa, Homo sapiens
RREVFGQVCEKTAGPELGGYPRCCAWVPGAASGALWRAEAAQHLLGAGRAVATDSRPAPARVQDPVVPSCCPGARTEAPGARQGSRSTRAMARPRLGSALPSAAAFGWLRPRPNFQATVSRRRRAGPSLPPPAARSGAPATPRLWLGCGSGACPDCDAATAWGQFAQSGGWLGRPRGSTIPRVGDVPCPGLTSRVRKTGWTTQPKAEPRQGPSLSPGSGGLTGPGVRACPRAWGGRRDGLAGSAPGPPGGAAAVAADPGPEAAQGACVERAERGSVTPRAPGLGMGSPSP

SEQ ID NO: 904620 - protein, 457 aa, Homo sapiens
MAQVLHVPAPFPGTPGPASPPAFPAKDPDPPYSVETPYGYRLDLDFLKYVDDIEKGHTLRRVAVQRRPRLSSLPRGPGSWWTSTESLCSNASGDSRHSAYSYCGRGFYPQYGALETRGGFNPRVERTLLDARRRLEDQAATPTGLGSLTPSAAGSTASLVGVGLPPPTPRSSGLSTPVPPSAGHLAHVREQMAGALRKLRQLEEQVKLIPVLQVKLSVLQEEKRQLTVQLKSQKFLGHPTAGRGRSELCLDLPDPPEDPVALETRSVGTWVRERDLGMPDGEAALAAKVAVLETQLKKALQELQAAQARQADPQPQAWPPPDSPVRVDTVRVVEGPREVEVVASTAAGAPAQRAQSLEPYGTGLRALAMPGRPESPPVFRSQEVVETMCPVPAAATSNVHMVKKISITERSCDGAAGKRSQAGRGEWLGGGGASFFPWLILDSQNARVQAGCGGACL

SEQ ID NO: 904621 - protein, 851 aa, Homo sapiens
MAQVLHVPAPFPGTPGPASPPAFPAKDPDPPYSVETPYGYRLDLDFLKYVDDIEKGHTLRRVAVQRRPRLSSLPRGPGSWWTSTESLCSNASGDSRHSAYSYCGRGFYPQYGALETRGGFNPRVERTLLDARRRLEDQAATPTGLGSLTPSAAGSTASLVGVGLPPPTPRSSGLSTPVPPSAGHLAHVREQMAGALRKLRQLEEQVKLIPVLQVKLSVLQEEKRQLTVQLKSQKFLGHPTAGRGRSELCLDLPDPPEDPVALETRSVGTWVRERDLGMPDGEAALAAKVAVLETQLKKALQELQAAQARQADPQPQAWPPPDSPVRVDTVRVVEGPREVEVVASTAAGAPAQRAQSLEPYGTGLRALAMPGRPESPPVFRSQEVVETMCPVPAAATSNVHMVKKISITERSCDGAAGLPEVPAESSSSPPGSEVASLTQPEKSTGRVPTQEPTHREPTRQAASQESEEAGGTGGPPAGVRSIMKRKEEVADPTAHRRSLQFVGVNGGYESSSEDSSTAENISDNDSTENEAPEPRERVPSVAEAPQLRPAGTAAAKTSRQECQLSRESQHIPTAEGASGSNTEEEIRMELSPDLISACLALEKYLDNPNALTERELKVAYTTVLQEWLRLACRSDAHPELVRRHLVTFRAMSARLLDYVVNIADSNGNTALHYSVSHANFPVVQQLLDSGVCKVDKQNRAGYSPIMLTALATLKTQDDIETVLQLFRLGNINAKASQAGQTALMLAVSHGRVDVVKALLACEADVNVQDDDGSTALMCACEHGHKEIAGLLLAVPSCDISLTDRDGSTALMVALDAGQSEIASMLYSRMNIKCSFAPMSDDESPTSSSAEE

SEQ ID NO: 904622 - protein, 851 aa, Homo sapiens; identical to SEQ ID NO: 904621

SEQ ID NO: 904623 - protein, 143 aa, Homo sapiens
AGFITPLVTGGLFEIQEEISKLRVHFTIRAGQTALMLAVSHGRVDVVKALLACEADVNVQDDDGSTALMCACEHGHKEIAGLLLAVPSCDISLTDRDGSTALMVALDAGQSEIASMLYSRMNIKCSFAPMSDDESPTSSSAEE

SEQ ID NO: 904624 - protein, 851 aa, Homo sapiens; identical to SEQ ID NO: 904621

SEQ ID NO: 904625 - protein, 152 aa, Homo sapiens
TLGRRDPGKAAAGARKVLKDREAKTETWKDRERDTERDAEGQRRGERRRETETLTVSFMACFGPLRISTSLSFLCLFLGEQQKGKGSKPLKMCFVIRSALQTKYARCPFEASELSLQGFKATFQQEKALRARRFIKEGKALVSLLRKVGFLA

SEQ ID NO: 904626 - protein, 851 aa, Homo sapiens; identical to SEQ ID NO: 904621

SEQ ID NO: 904627 - protein, 851 aa, Homo sapiens; identical to SEQ ID NO: 904621

SEQ ID NO: 904628 - protein, 851 aa, Homo sapiens; identical to SEQ ID NO: 904621

SEQ ID NO: 904629 - protein, 386 aa, Homo sapiens
PPLSSPPGGPPAGVRSIMKRKEEVADPTAHRRSLQFVGVNGGYESSSEDSSTAENISDNDSTENEAPEPRERVPSVAEAPQLRPAGTAAAKTSRQECQLSRESQHIPTAEGASGSNTEEEIRMELSPDLISACLALEKYLDNPNALTERELKVAYTTVLQEWLRLACRSDAHPELVRRHLVTFRAMSARLLDYVVNIADSNGNTALHYSVSHANFPVVQQLLDSGVCKVDKQNRAGYSPIMLTALATLKTQDDIETVLQLFRLGNINAKASQAGQTALMLAVSHGRVDVVKALLACEADVNVQDDDGSTALMCACEHGHKEIAGLLLAVPSCDISLTDRDGSTALMVALDAGQSEIASMLYSRMNIKCSFAPMSDDESPTSSSAEE

SEQ ID NO: 904630 - protein, 851 aa, Homo sapiens; identical to SEQ ID NO: 904621

SEQ ID NO: 904631 - protein, 841 aa, Homo sapiens
MAQVLHVPAPFPGTPGPASPPAFPAKDPDPPYSVETPYGYRLDLDFLKYVDDIEKGHTLRRVAVQRRPRLSSLPRGPGSWWTSTESLCSNASGDSRHSAYSYCGRGFYPQYGALETRGGFNPRVERTLLDARRRLEDQAATPTGLGSLTPSAAGSTASLVGVGLPPPTPRSSGLSTPVPPSAGHLAHVREQMAGALRKLRQLEEQVKLIPVLQVKLSVLQEEKRQLTVQLKSQKFLGHPTAGRGRSELCLDLPDPPEDPVALETRSVGTWVRERDLGMPDGEAALAAKVAVLETQLKKALQELQAAQARQADPQPQAWPPPDSPVRVDTVRVVEGPREVEVVASTAAGAPAQRAQSLEPYGTGLRALAMPGRPESPPVFRSQEVVETMCPVPAAATSNVHMVKKISITERSCDGAAGLPEVPAESSSSPPGSEVASLTQPEKSTGRVPTQEPTHREPTRQAASQESEEAGGTGGPPAGVRSIMKRKEEVADPTAHRRSLQFVGVNGGYESSSEDSSTAENISDNDSTENEAPEPRERVPSVAEAPQLRPAGTAAAKTSRQECQLSRESQHIPTAEGASGSNTEEEIRMELSPDLISACLALEKYLDNPNALTERELKVAYTTVLQEWLRLACRSDAHPELVRRHLVTFRAMSARLLDYVVNIADSNGNTALHYSVSHANFPVVQQLLDSGVCKVDKQNRAGYSPIMLTALATLKTQDDIETVLQLFRLGNINAKASQAGQTALMLAVSHGRVDVVKALLACEADVNVQDDDGSTALMCACEHGHKEIAGLLLAVPSCDISLTDRDGSTALMVALDAGQSEIASMLYSRMNIKCSVSLNPAG

SEQ ID NO: 904632 - protein, 851 aa, Homo sapiens; identical to SEQ ID NO: 904621

SEQ ID NO: 904633 - protein, 304 aa, Homo sapiens
MSIFPKISLRPEVENYLKEGFMNKEIVTALGKQEAERKFETLLKHLSHPPSFTTVRVNTHLASVQHVKNLLLDELQKQFNGLSVPILQHPDLQDVLLIPVIGPRKNIKKQQCEAIVGAQCGNAVLRGAHVYAPGIVSASQFMKAGDVISVYSDIKGKCKKGAKEFDGTKVFLGNGISELSRKEIFSGLPELKGMGIRMTEPVYLSPSFDSVLPRYLFLQNLPSALVSHVLNPQPGEKILDLCAAPGGKTTHIAALMHDQVCCGLLEVHPRPCLTGYHQWRLQNSKNCCLFLPLEASSERALARC

SEQ ID NO: 904634 - protein, 197 aa, Homo sapiens [sequence omitted]

SEQ ID NO: 904635 - protein, 304 aa, Homo sapiens; identical to SEQ ID NO: 904633

SEQ ID NO: 904636 - protein, 272 aa, Homo sapiens
MSIFPKISLRPEVENYLKEGFMNKEIVTALGKQEAERKFETLLKHLSHPPSFTTVRVNTHLASVQHVKNLLLDELQKQFNGLSVPILQHPDLQDVLLIPVIGPRKNIKKQQCEAIVGAQCGNAVLRGAHVYAPGIVSASQFMKAGDVISVYSDIKGKCKKGAKEFDGTKVFLGNGISELSRKEIFSGLPELKGMGIRMTEPVYLSPSFDSVLPRYLFLQNLPSALVSHVLNPQPGEKILDLCAAPGGKTTHIAALMHDQAVQLLKPEGVPGL

SEQ ID NO: 904637 - protein, 109 aa, Homo sapiens
GIVGPHDPDLQASGDQPREDSSKGVEPTFVGGWHHFGNIHHKRAFGFTADLRSNTGGQAFPQCVFDHWQILPGDPFDNSSRPSQVVAETRKRKGLKEGIPALDNFLDKL

SEQ ID NO: 904638 - protein, 132 aa, Homo sapiens
DAAVILEDPSKLAVGDHCNKAFRQTAADPGPIFKVFDAIMNFKKEETAKLIEKLDIKLDSEDKDKEGKPLLKAVMRRWLPAGDALLQMITIHLPSPVTAQKYRCELLYEGPPDDEAAMGIKSCTSPVAVPHP

SEQ ID NO: 904639 - protein, 346 aa, Homo sapiens
YVGTVMAHRWWRHPMWWSGYLPVNESFGFSADREANTGVQAFPQCVFDHWQILPGDPFDNSSRPSQVVAETRKRKGLKEGIPALDNFLDKLRRPFLQRLPPRGLAAPTGPNILTDITKGVQYLNEIKDSVVAGFQWATKEGALCEENMRGVRFDVHDVTLHADAIHRGGGQIIPTARRCLYASVLTAQPRLMEPIYLVEIQCPEQVVGGIYGVLNRKRGPELHLEICLKDLEEDHACIPIKKSDPVVSYRETVSEESNVLCLSKSPKKAQPAVHEGAAFPDGLAEDIDKGEVSARQELKQRARYLAEKYEWDVAEARKIWCFGPDGTGPTSSPTSPRDVLTMYQHD

SEQ ID NO: 904640 - protein, 255 aa, Homo sapiens
MKARPFPDGLAEDIDKGEVSARQELKQRARYLAEKYEWDVAEARKIWCFGPDGTGPNILTDITKGVQYLNEIKDSVVAGFQWATKEGALCEENMRGVRFDVHDVTLHADAIHRGGGQIIPTARRCLYASVLTAQPRLMEPIYLVEIQCPEQVVGGIYGVLNRKRGHVFEESQVAGTPMFVVKAYLPVNESFGFTADLRSNTGGQAFPQCVFDHWQILPGDPFDNSSRPSQVVAETRKRKGLKEGIPALDNFLDKL

SEQ ID NO: 904641 - protein, 418 aa, Homo sapiens
GRVGRPTRSTILMMGRYVEPIEDVPCGNIVGLVGVDQFLVKTGTITTFEHAHNMRVMKFSVSPVVRVAVEAKNPADLPKLVEGLKRLAKSDPMVQCIIEESGEHIIAGAGELHLEICLKDLEEDHACIPIKKSDPVVSYRETVSEESNVLCLSKSPNKHNRLYMKARPFPDGLAEDIDKGEVSARQELKQRARYLAEKYEWDVAEARKIWCFGPDGTGPNILTDITKGVQYLNEIKDSVVAGFQWATKEGALCEENMRGVRFDVHDVTLHADAIHRGGGQIIPTARRCLYASVLTAQPRLMEPIYLVEIQCPEQVVGGIYGVLNRKRGHVFEESQVAGTPMFVVKAYLPVNESFGFTADLRSNTGGQAFPQCVFDHWQILPGDPFDNSSRPSQVVAETRKRKGLKEGIPALDNFLDKL

SEQ ID NO: 904642 - protein, 418 aa, Homo sapiens; identical to SEQ ID NO: 904641

SEQ ID NO: 904643 - protein, 418 aa, Homo sapiens; identical to SEQ ID NO: 904641

SEQ ID NO: 904644 - protein, 418 aa, Homo sapiens; identical to SEQ ID NO: 904641

SEQ ID NO: 904645 - protein, 418 aa, Homo sapiens; identical to SEQ ID NO: 904641

SEQ ID NO: 904646 - protein, 418 aa, Homo sapiens; identical to SEQ ID NO: 904641

SEQ ID NO: 904647 - protein, 418 aa, Homo sapiens; identical to SEQ ID NO: 904641

SEQ ID NO: 904648 - protein, 418 aa, Homo sapiens; identical to SEQ ID NO: 904641

SEQ ID NO: 904649 - protein, 418 aa, Homo sapiens; identical to SEQ ID NO: 904641

SEQ ID NO: 904650 - protein, 418 aa, Homo sapiens; identical to SEQ ID NO: 904641

SEQ ID NO: 904651 - protein, 418 aa, Homo sapiens; identical to SEQ ID NO: 904641

SEQ ID NO: 904652 - protein, 418 aa, Homo sapiens; identical to SEQ ID NO: 904641

SEQ ID NO: 904653 - protein, 418 aa, Homo sapiens; identical to SEQ ID NO: 904641

SEQ ID NO: 904654 - protein, 418 aa, Homo sapiens; identical to SEQ ID NO: 904641

SEQ ID NO: 904655 - protein, 418 aa, Homo sapiens; identical to SEQ ID NO: 904641

SEQ ID NO: 904656 - protein, 418 aa, Homo sapiens; identical to SEQ ID NO: 904641

SEQ ID NO: 904657 - protein, 259 aa, Homo sapiens
GRVGRPTRSTILMMGRYVEPIEDVPCGNIVGLVGVDQFLVKTGTITTFEHAHNMRVMKFSVSPVVRVAVEAKNPADLPKLVEGLKRLAKSDPMVQCIIEESGEHIIAGAGELHLEICLKDLEEDHACIPIKASVLTAQPRLMEPIYLVEIQCPEQVVGGIYGVLNRKRGHVFEESQVAGTPMFVVKAYLPVNESFGFTADLRSNTGGQAFPQCVFDHWQILPGDPFDNSSRPSQVVAETRKRKGLKEGIPALDNFLDKL

SEQ ID NO: 904658 - protein, 418 aa, Homo sapiens; identical to SEQ ID NO: 904641

SEQ ID NO: 904659 - protein, 418 aa, Homo sapiens; identical to SEQ ID NO: 904641

SEQ ID NO: 904660 - protein, 354 aa, Homo sapiens
GRVGRPTRSTILMMGRYVEPIEDVPCGNIVGLVGVDQFLVKTGTITTFEHAHNMRVMKFSVSPVVRVAVEAKNPADLPKLVEGLKRLAKSDPMVQCIIEESGEHIIAGAGELHLEICLKDLEEDHACIPIKKSDPVVSYRETVSEESNVLCLSKSPNKHNRLYMKARPFPDGLAEDIDKGEVSARQELKQRARYLAEKYEWDVAEARKIWCFGPDGTGPNILTDITKGVQYLNEIKDSVVAGFQWATKEGALCEENMRGVRFDVHDVTLHADAIHRGGGQIIPTARRCLYASVLTAQPRLMEPIYLVEIQCPEQVVGGIYGVLNRKRGPRSTHSTTSSNSQTTPGDCPDTATLP

SEQ ID NO: 904661 - protein, 85 aa, Homo sapiens
GRVGRPTRSTILMMGRYVEPIEDVPCGNIVGLVGVDQFLVKTGTITTFEHAHNMRVMKFTRSTHSTTSSNSQTTPGDCPDTATLP

SEQ ID NO: 904662 - protein, 426 aa, Homo sapiens
GRVGRPTRSTILMMGRYVEPIEDVPCGNIVGLVGVDQFLVKTGTITTFEHAHNMRVMKFSVSPVVRVAVEAKNPADLPKLVEGLKRLAKSDPMVQCIIEESGEHIIAGAGELHLEICLKDLEEDHACIPIKKSDPVVSYRETVSEESNVLCLSKSPNKHNRLYMKARPFPDGLAEDIDKGEVSARQELKQRARYLAEKYEWDVAEARKIWCFGPDGTGPNILTDITKGVQYLNEIKDSVVAGFQWATKEGALCEENMRGVRFDVHDVTLHADAIHRGGGQIIPTARRCLYASVLTAQPRLMEPIYLVEIQCPEQVVGGIYGVLNRKRGHVFEESQVAGTPMFVVKAYLPVNESFGFTADLRSNTGGQAFPQCPPPLCCPDSTEEGTAGEAVVLAHCLSPSVLKEKRQPAVRAVRKASLCCPAVHLL

SEQ ID NO: 904663 - protein, 336 aa, Homo sapiens
GRVGRPTRSTILMMGRYVEPIEDVPCGNIVGLVGVDQFLVKTGTITTFEHAHNMRVMKFSVSPVVRVAVEAKNPADLPKLVEGLKRLAKSDPMVQCIIEESGEHIIAGAGELHLEICLKDLEEDHACIPIKKSDPVVSYRETVSEESNVLCLSKSPNKHNRLYMKARPFPDGLAEDIDKGEVSARQELKQRARYLAEKYEWDVAEARKIWCFGPDGTGPNILTDITKGVQYLNEIKDSVVAGFQWATKEGALCEENMRGVRFDVHDVTLHADAIHRGGGQIIPTARRCLYASVLTAQPRLMEPIYLVEIQCPEQVVGGIYGVLNRKRGRNTRVDDF

SEQ ID NO: 904664 - protein, 135 aa, Homo sapiens
SVPAALIYREPASRSVGTIPLGRRRSSCPEQVVGGIYGVLNRKRGHVFEESQVAGTPMFVVKAYLPVNESFGFTADLRSNTGGQAFPQCVFDHWQILPGDPFDNSSRPSQVVAETRKRKGLKEGIPALDNFLDKL

SEQ ID NO: 904665 - protein, 137 aa, Homo sapiens
GRVGRPTRSTILMMGRYVEPIEDVPCGNIVGLVGVDQFLVKTGTITTFEHAHNMRVMKFSVSPVVRVAVEAKNPADLPKLVEGLKRLAKSDPMVQCIIEESGEHIIAGAGELHLEICLKDLEEDHACIPIKPASPSR

SEQ ID NO: 904666 - protein, 42 aa, Homo sapiens
ALSPVSPGVCVQTETVLRQAIAERIKPVLMMNKMDRALLELQ

SEQ ID NO: 904667 - protein, 138 aa, Homo sapiens
MPTAIENVMKKLWGEYFDPANGKFSKSATSPEGKKLPRTFCQLILDPIFKVFDAIMNFKKEETAKLIEKLDIKTWHEGTGHEFMSRAFMPRKRIPGFSLLCVFVLLLHGAMMPAEVVSTMKPYWRMKALDMKGSSRST

SEQ ID NO: 904668 - protein, 418 aa, Homo sapiens; identical to SEQ ID NO: 904641

SEQ ID NO: 904669 - protein, 348 aa, Homo sapiens
GRVGRPTRSRCGQVRPHGAVHHRGVGRAHHRGRRRAAPGDLPEGPGGGPRLHPHQACIPIKKSDPVVSYRETVSEESNVLCLSKSPNKHNRLYMKARPFPDGLAEDIDKGEVSARQELKQRARYLAEKYEWDVAEARKIWCFGPDGTGPNILTDITKGVQYLNEIKDSVVAGFQWATKEGALCEENMRGVRFDVHDVTLHADAIHRGGGQIIPTARRCLYASVLTAQPRLMEPIYLVEIQCPEQVVGGIYGVLNRKRGHVFEESQVAGTPMFVVKAYLPVNESFGFTADLRSNTGGQAFPQCVFDHWQILPGDPFDNSSRPSQVVAETRKRKGLKEGIPALDNFLDKL

SEQ ID NO: 904670 - protein, 418 aa, Homo sapiens; identical to SEQ ID NO: 904641

SEQ ID NO: 904671 - protein, 418 aa, Homo sapiens; identical to SEQ ID NO: 904641

SEQ ID NO: 904672 - protein, 418 aa, Homo sapiens; identical to SEQ ID NO: 904641

SEQ ID NO: 904673 - protein, 418 aa, Homo sapiens; identical to SEQ ID NO: 904641

SEQ ID NO: 904674 - protein, 418 aa, Homo sapiens; identical to SEQ ID NO: 904641

SEQ ID NO: 904675 - protein, 398 aa, Homo sapiens
GRVGRPTRSTILMMGRYVEPIEDVPCGNIVGLVGVDQFLVKTGTITTFEHAHNMRVMKFSVSPVVRVAVEAKNPADLPKLVEGLKRLAKSDPMVQCIIEESGEHIIAGAGELHLEICLKDLEEDHACIPIKITQPYTLDAVSFNIYFQSSDGLAEDIDKGEVSARQELKQRARYLAEKYEWDVAEARKIWCFGPDGTGPNILTDITKGVQYLNEIKDSVVAGFQWATKEGALCEENMRGVRFDVHDVTLHADAIHRGGGQIIPTARRCLYASVLTAQPRLMEPIYLVEIQCPEQVVGGIYGVLNRKRGHVFEESQVAGTPMFVVKAYLPVNESFGFTADLRSNTGGQAFPQCVFDHWQILPGDPFDNSSRPSQVVAETRKRKGLKEGIPALDNFLDKL

SEQ ID NO: 904676 - protein, 418 aa, Homo sapiens; identical to SEQ ID NO: 904641

SEQ ID NO: 904677 - protein, 465 aa, Homo sapiens
GRVGRPTRSTILMMGRYVEPIEDVPCGNIVGLVGVDQFLVKTGTITTFEHAHNMRVMKFSVSPVVRVAVEAKNPADLPKLVEGLKRLAKSDPMVQCIIEESGEHIIAGAGELHLEICLKDLEEDHACIPIKKSDPVVSYRETVSEESNVLCLSKSPNKHNRLYMKARPFPDGLAEDIDKGEVSARQELKQRARYLAEKYEWDVAEARKIWCFGPDGTGPNILTDITKGVQYLNEIKDSVVAGFQWATKEGALCEENMRGVRFDVHDVTLHADAIHRGGGQIIPTARRCLYASVLTAQPRLMEPIYLVEIQCPEQVVGGIYGVLNRKRGHVFEESQVAGTPMFVVKAYLPVNESFGFTADLRSNTGGQAFPQCVFDHWQILPGDPLTSWTNCRRPFLQRLPPRGLAAPTAPRPRILRRHLETVPTQRRSPERFLGPAACCHHSTITLDAVSFNIYFQSPEAADTPS

SEQ ID NO: 904678 - protein, 418 aa, Homo sapiens; identical to SEQ ID NO: 904641

SEQ ID NO: 904679 - protein, 418 aa, Homo sapiens; identical to SEQ ID NO: 904641

SEQ ID NO: 904680 - protein, 418 aa, Homo sapiens; identical to SEQ ID NO: 904641

SEQ ID NO: 904681 - protein, 418 aa, Homo sapiens; identical to SEQ ID NO: 904641

SEQ ID NO: 904682 - protein, 425 aa, Homo sapiens
GRVGRPTRSTILMMGRYVEPIEDVPCGNIVGLVGVDQFLVKTGTITTFEHAHNMRVMKFSVSPVVRVAVEAKNPADLPKLVEGLKRLAKSDPMVQCIIEESGEHIIAGAGELHLEICLKDLEEDHACIPIKKSDPVVSYRETVSEESNVLCLSKSPNKHNRLYMKARPFPDGLAEDIDKGEVSARQELKQRARYLAEKYEWDVAEARKIWCFGPDGTGPNILTDITKGVQYLNEIKDSVVAGFQWATKEGALCEENMRGVRFDVHDVTLHADAIHRGGGQIIPTARRCLYASVLTAQPRLMEPIYLVEIQCPEQVVGGIYGVLNRKRGHVFEESQVAGTPMFVVKAYLPVNESFGFTADLRSNTGGQAFPQCVFDHWQILPGDPFSQHPQHHVLEFSDDTWRLSRHSDAPLRGFWGPLRAAITQP

SEQ ID NO: 904683 - protein, 418 aa, Homo sapiens; identical to SEQ ID NO: 904641

SEQ ID NO: 904684 - protein, 125 aa, Homo sapiens
EDHDVRMSKNYIVPSSYIPPPELHFSLKEKRKCSSDVFEESQVAGTPMFVVKAYLPVNESFGFTADLRSNTGGQAFPQCVFDHWQILPGDPFDNSSRPSQVVAETRKRKGLKEGIPALDNFLDKL

SEQ ID NO: 904685 - protein, 360 aa, Homo sapiens
GRVGRPTRSTILMMGRYVEPIEDVPCGNIVGLVGVDQFLVKTGTITTFEHAHNMRVMKFSVSPVVRVAVEAKNPADLPKLVEGLKRLAKSDPMVQCIIEESGEHIIAGAGELHLEICLKDLEEDHACIPIKKSDPVVSYRETVSEESNVLCLSKSPNKHNRLYMKARPFPDGLAEDIDKGEVSARQELKQRARYLAEKYEWDVAEARKIWCFGPDGTGPNILTDITKGVQYLNEIKDSVVAGFQWATKEGALCEENMRGVRFDVHDVTLHADAIHRGGGQIIPTARRCLYASVLTAQPRLMEPIYLVEIQGTPNTFSISSEGNSDVQTNFNKRIKRFIWVHGPQWLLPQKGERNTRVDDF

SEQ ID NO: 904686 - protein, 433 aa, Homo sapiens
GRVGRPTRSTILMMGRYVEPIEDVPCGNIVGLVGVDQFLVKTGTITTFEHAHNMRVMKFSVSPVVRVAVEAKNPADLPKLVEGLKRLAKSDPMVQCIIEESGEHIIAGAGELHLEICLKDLEEDHACIPIKKSDPVVSYRETVSEESNVLCLSKSPNKHNRLYMKARPFPDGLAEDIDKGEVSARQELKQRARYLAEKYEWDVAEARKIWCFGPDGTGPNILTDITKGVQYLNEIKDSVVAGFQWATKEGALCEENMRGVRFDVHDVTLHADAIHRGGGQIIPTARRCLYASVLTAQPRLMEPIYLVEIQCPEQVVGGIYGVLNRKRGHVFEESQVAGTPMFVVKFAAKGEGQLGPAERAKKVEDMMKKLWGDRYFDPPNGKFSKSATSPEGKKLPRTFCQLILDPILYFTFLYSVVLLLLVFIFYTLAIPQS

SEQ ID NO: 904687 - protein, 577 aa, Homo sapiens
GRVGRPTRSTILMMGRYVEPIEDVPCGNIVGLVGVDQFLVKTGTITTFEHAHNMRVMKFSVSPVVRVAVEAKNPADLPKLVEGLKRLAKSDPMVQCIIEESGEHIIAGAGELHLEICLKDLEEDHACIPIKFDSSLTVSRYETTGSDFLMGIQAWSSSRYFRQISRCSFPAPAMMCSPDSSMMHCTMGSDLASRFSKSATSPEGKKLPRTFCQLILDPIFKVFDAIMNFKKEETAKLIEILDSQDWTARQGQRRQPLLKSVMPRWLPAGDALLQMITIHLPSPVTAQKYRCELLYEGPPDDEAAMGIKSCDPKGPLMMYISKMVPTSDKGRFYAFGRVFSGLVSTGLKVRIMGPNYTPGKKEDLYLKPIQRTILMMGRYVEPIEDVPCGNIVGLVGVDQFLVKTGTITTFEHAHNMRVMKFSVSPVVRVAVEAKNPADLPKLVEGLKRLAKSDPMVAVHHRGVGRAHHRGAGELHLEICLKDLEEDHACIPIKKSDPVVSYRETVSEESNVLCLSKSPNKHNRLYMKGTPNTFSISSEGNSDVQTNFNKRIKRFIWVHGPQWLLPQKGERNTRVDDF

SEQ ID NO: 904688 - protein, 136 aa, Homo sapiens
RWGRMSGQEGSEDLAMGLVPGVPCHGGGMSRTEAKDKGGLALVGASPGMSHGGRSSLASDSIPDSLGQVCGSCPPDESLPSISAISLFYELSENDLNFIKQSKDGAGFLINLIDSPGHVDFSSEVTAALRVTDGAL

SEQ ID NO: 904689 - protein, 77 aa, Homo sapiens
EPPTITKFAAARPMRAAPASEWEIMQLLRMCPPHLMLICLMVMPRVQDLVTCAVVNTQRLGRSVSLVLPSFKVHGKI

SEQ ID NO: 904690 - protein, 70 aa, Homo sapiens
TLGSRVTHAKYIVQVDGKIGLFRGLSPRLMSNALSTVTRGSMKKVSFSSSCFSWWLTSELTSIEYVASVR

SEQ ID NO: 904691 - protein, 384 aa, Homo sapiens
MSRCPPPSPPGAMGASDPEVAPWARGGAAGMAGAGAGAGARGGAAAGVEARARDPPPAHRAHPRHPRPAAQPSARRMDGGSGGLGSGDNAPTTEALFVALGAGVTALSHPLLYVKLLIQVGHEPMPPTLGTNVLGRKVLYLPSFFTYAKYIVQVDGKIGLFRGLSPRLMSNALSTVTRGSMKKVFPPDEIEQVSNKDDMKTSLKKVVKETSYEMMMQCVSRMLAHPLHVISMRCMVQFVGREAKYSGVLSSIGKIFKEEGLLGFFVGLIPHLLGDVVFLWGCNLLAHFINAYLVDDSFSQALAIRSYTKFVMGIAVSMLTYPFLLVGDLMAVNNCGLQAGLPPYSPVFKSWIHCWKYLSVQGQLFRGSSLLFRRVSSGSCFALE

SEQ ID NO: 904692 - protein, 372 aa, Homo sapiens
MGASDPEVAPWARGGAAGMAGAGAGAGARGGAAAGVEARARDPPPAHRAHPRHPRPAAQPSARRMDGGSGGLGSGDNAPTTEALFVALGAGVTALSHPLLYVKLLIQVGHEPMPPTLGTNVLGRKVLYLPSFFTYAKYIVQVDGKIGLFRGLSPRLMSNALSTVTRGSMKKVFPPDEIEQVSNKDDMKTSLKKVVKETSYEMMMQCVSRMLAHPLHVISMRCMVQFVGREAKYSGVLSSIGKIFKEEGLLGFFVGLIPHLLGDVVFLWGCNLLAHFINAYLVDDSFSQALAIRSYTKFVMGIAVSMLTYPFLLVGDLMAVNNCGLQAGLPPYSPVFKSWIHCWKYLSVQGQLFRGSSLLFRRVSSGSCFALE

SEQ ID NO: 904693 - protein, 368 aa, Homo sapiens
CRLVPAGSDGGAAGMAGAGAGAGARGGAAAGVEARARDPPPAHRAHPRHPRPAAQPSARRMDGGSGGLGSGDNAPTTEALFVALGAGVTALSHPLLYVKLLIQVGHEPMPPTLGTNVLGRKVLYLPSFFTYAKYIVQVDGKIGLFRGLSPRLMSNALSTVTRGSMKKVFPPDEIEQVSNKDDMKTSLKKVVKETSYEMMMQCVSRMLAHPLHVISMRCMVQFVGREAKYSGVLSSIGKIFKEEGLLGFFVGLIPHLLGDVVFLWGCNLLAHFINAYLVDDSFSQALAIRSYTKFVMGIAVSMLTYPFLLVGDLMAVNNCGLQAGLPPYSPVFKSWIHCWKYLSVQGQLFRGSSLLFRRVSSGSCFALE

SEQ ID NO: 904694 - protein, 372 aa, Homo sapiens; identical to SEQ ID NO: 904692

SEQ ID NO: 904695 - protein, 372 aa, Homo sapiens; identical to SEQ ID NO: 904692

SEQ ID NO: 904696 - protein, 427 aa, Homo sapiens
MGASDPEVAPWARGGAAGMAGAGAGAGARGGAAAGVEARARDPPPAHRAHPRHPRPAAQPSARRMDGGSGGLGSGDNAPTTEALFVALGAGVTALSHPLLYVKLLIQVGHEPMPPTLGTNVLGRKVLYLPSFFTYAKYIVQVDGKIGLFRGLSPRLMSNALSTVTRGSMKKVFPPDEIEQVSNKDDMKTSLKKVVKETSYEMMMQCVSRMLAHPLHVISMRCMVQFVGREAKYSGVLSSIGKIFKEEGLLGFFVGLIPHLLGDVVFLWGCNLLAHFINAYLVDDSVSDTPGGLGNDQNPGSQFSQALAIRSYTKFVMGIAVSMLTYPFLLVGDLMAVNNCGLQAGLPPYSPVFKSWIHCWKYLSVQVSKHWTAEAFPVLCYILQLKWFCGCFIACKDKWFHGIQYCEEILGIYKAFKFSSYIISERI

SEQ ID NO: 904697 - protein, 389 aa, Homo sapiens
MGASDPEVAPWARGGAAGMAGAGAGAGARGGAAAGVEARARDPPPAHRAHPRHPRPAAQPSARRMDGGSGGLGSGDNAPTTEALFVALGAGVTALSHPLLYVKLLIQVGHEPMPPTLGTNVLGRKVLYLPSFFTYAKYIVQVDGKIGLFRGLSPRLMSNALSTVTRGSMKKVFPPDEIEQVSNKDDMKTSLKKVVKETSYEMMMQCVSRMLAHPLHVISMRCMVQFVGREAKYSGVLSSIGKIFKEEGLLGFFVGLIPHLLGDVVFLWGCNLLAHFINAYLVDDSVSDTPGGLGNDQNPGSQFSQALAIRSYTKFVMGIAVSMLTYPFLLVGDLMAVNNCGLQAGLPPYSPVFKSWIHCWKYLSVQGQLFRGSSLLFRRVSSGSCFALE

SEQ ID NO: 904698 - protein, 406 aa, Homo sapiens
MGASDPEVAPWARGGAAGMAGAGAGAGARGGAAAGVEARARDPPPAHRAHPRHPRPAAQPSARRMDGGSGGLGSGDNAPTTEALFVALGAGVTALSHPLLYVKLLIQVGHEPMPPTLGTNVLGRKVLYLPSFFTYAKYIVQVDGKIGLFRGLSPRLMSNALSTVTRGSMKKVFPPDEIEQVSNKDDMKTSLKKVVKETSYEMMMQCVSRMLAHPLHVISMRCMVQFVGREAKYSCPAGPPSQEAQLAMVPHFGVINGKLAHSPRLIMSGVLSSIGKIFKEEGLLGFFVGLIPHLLGDVVFLWGCNLLAHFINAYLVDDSFSQALAIRSYTKFVMGIAVSMLTYPFLLVGDLMAVNNCGLQAGLPPYSPVFKSWIHCWKYLSVQGQLFRGSSLLFRRVSSGSCFALE

SEQ ID NO: 904699 - protein, 216 aa, Homo sapiens
MSNALSTVTRGSMKKVFPPDEIEQVSNKDDMKTSLKKVVKETSYEMMMQCVSRMLAHPLHVISMRCMVQFVGREAKYSGVLSSIGKIFKEEGLLGFFVGLIPHLLGDVVFLWGCNLLAHFINAYLVDDSFSQALAIRSYTKFVMGIAVSMLTYPFLLVGDLMAVNNCGLQAGLPPYSPVFKSWIHCWKYLSVQGQLFRGSSLLFRRVSSGSCFALE

SEQ ID NO: 904700 - protein, 231 aa, Homo sapiens
SNSCDDPRSEILGLSQTKVAVIVTRGSMKKVFPPDEIEQVSNKDDMKTSLKKVVKETSYEMMMQCVSRMLAHPLHVISMRCMVQFVGREAKYSGVLSSIGKIFKEEGLLGFFVGLIPHLLGDVVFLWGCNLLAHFINAYLVDDSFSQALAIRSYTKFVMGIAVSMLTYPFLLVGDLMAVNNCGLQAGLPPYSPVFKSWIHCWKYLSVQGQLFRGSSLLFRRVSSGSCFALE

SEQ ID NO: 904701 - protein, 149 aa, Homo sapiens
MVRRPCVSAEAGVLSSIGKIFKEEGLLGFFVGLIPHLLGDVVFLWGCNLLAHFINAYLVDDSFSQALAIRSYTKFVMGIAVSMLTYPFLLVGDLMAVNNCGLQAGLPPYSPVFKSWIHCWKYLSVQGQLFRGSSLLFRRVSSGSCFALE

SEQ ID NO: 904702 - protein, 384 aa, Homo sapiens
MGASDPEVAPWARGGAAGMAGAGAGAGARGGAAAGVEARARDPPPAHRAHPRHPRPAAQPSARRMDGGSGGLGSGDNAPTTEALFVALGAGVTALSHPLLYVKLLIQVGHEPMPPTLGTNVLGRKVLYLPSFFTYAKYIVQVDGKIGLFRGLSPRLMSNALSTVTRGSMKKVFPPDEIEQVSNKDDMKTSLKKVVKETSYEMMMQCVSRMLAHPLHVISMRCMVQFVGREAKYSGVLSSIGKIFKEEGLLGFFVGLIPHLLGDVVFLWGCNLLAHFINAYLVDDSVSDTPGGLGNDQNPGSQFSQALAIRSYTKFVMGIAVSMLTYPFLLVGDLMAVNNCGLQAGLPPYSPVAHPAAQLGASFSCFVHRVWSPGTWPPSCLGLC

SEQ ID NO: 904703 - protein, 116 aa, Homo sapiens
VYIILSLETNPLWYVVNIFFINAYLVDDSFSQALAIRSYTKFVMGIAVSMLTYPFLLVGDLMAVNNCGLQAGLPPYSPVFKSWIHCWKYLSVQGQLFRGSSLLFRRVSSGSCFALE

SEQ ID NO: 904704 - protein, 380 aa, Homo sapiens
MGASDPEVAPWARGGAAGMAGAGAGAGARGGAAAGVEARARDPPPAHRAHPRHPRPAAQPSARRMDGGSGGLGSGDNAPTTEALFVALGAGVTALSHPLLYVKLLIQVGHEPMPPTLGTNVLGRKVLYLPSFFTYAKYIVQVDGKIGLFRGLSPRLMSNALSTVTRGSMKKVFPPDEIEQVSNKDDMKTSLKKVVKETSYEMMMQCVSRMLAHPLHVISMRCMVQFVGREAKYSGVLSSIGKIFKEEGLLGFFVGLIPHLLGDVVFLWGCNLLAHFINAYLVDDSVSDTPGGLGNDQNPGSQFSQALAIRSYTKFVMGIAVSMLTYPFLLVGDLMAVNNCGLQAGLPPYSPVFKSWIHCWKYLSVQGQALPRLQAAFRVS

SEQ ID NO: 904705 - protein, 338 aa, Homo sapiens
MGASDPEVAPWARGGAAGMAGAGAGAGARGGAAAGVEARARDPPPAHRAHPRHPRPAAQPSARRMDGGSGGLGSGDNAPTTEALFVALGAGVTALSHPLLYVKLLIQVGHEPMPPTLGTNVLGRKVLYLPSFFTYAKYIVQVDGKIGLFRGLSPRLMSNALSTVTRGSMKKVFPPDEIEQVSNKDDMKTSLKKVVKETSYEMMMQCVSRMLAHPLHVISMRCMVQFVGREAKYSGVLSSIGKIFKEEGLLGFFVGLIPHLLGDVVFLWGCNLLAHFINAYLVDDSFRPCIRSQSRDGIQYASDPSCSDCCDTAAGSPTPVSIWITLSLISGSLEVTAS

SEQ ID NO: 904706 - protein, 103 aa, Homo sapiens
CEVIYRILTSALLAHCKTTPTQQQPDVLQPSRASVPYLPCVCPDVGLSGGGAAPSGLGHPADLGKVRRGGELAESPYLADLLSLSCAEGQRMAYGGPGWMGKG

SEQ ID NO: 904707 - protein, 266 aa, Homo sapiens
MGASDPEVAPWARGGAAGMAGAGAGAGARGGAAAGVEARARDPPPAHRAHPRHPRPAAQPSARRMDGGSGGLGSGDNAPTTEALFVALGAGVTALSHPLLYVKLLIQVGHEPMPPTLGTNVLGRKVLYLPSFFTYAKYIVQVDGKIGLFRGLSPRLMSNALSTVTRGSMKKVFPPDEIEQVSNKDDMKTSLKKVVKETSYEMMMQCVSRMLAHPLHVISMRCMVQFVGREAKYRWVTLGTGRVALLPFQSRPGQAVLGLVAAPFLP

SEQ ID NO: 904708 - protein, 223 aa, Homo sapiens
MSRCPPPSPPGAMGASDPEVAPWARGGAAGMAGAGAGAGARGGAAAGVEARARDPPPAHRAHPRHPRPAAQPSARRMDGGSGGLGSGDNAPTTEALFVALGAGVTALSHPLLYVKLLIQVGHEPMPPTLGTNVLGRKVLYLPSFFTYAKYIVQVDGKIGLFRGLSPRLMSNALSTVTRGSMKKVFPPDEIEQVYQPVKPGSLSAEVGLEIGDQIARSQCRRLL

SEQ ID NO: 904709 - protein, 100 aa, Homo sapiens
IFAMCLSRCGTEARLGWSTSGCCGLEPSRASVPYLPCVCPDVGLSGGGAAPSGLGHPADLGKVRRGGELAESPYLADLLSLSCAEGQRMAYGGPGWMGKG

SEQ ID NO: 904710 - protein, 372 aa, Homo sapiens; identical to SEQ ID NO: 904692

SEQ ID NO: 904711 - protein, 389 aa, Homo sapiens; identical to SEQ ID NO: 904697

SEQ ID NO: 904712 - protein, 354 aa, Homo sapiens
MAGAGAGAGARGGAAAGVEARARDPPPAHRAHPRHPRPAAQPSARRMDGGSGGLGSGDNAPTTEALFVALGAGVTALSHPLLYVKLLIQVGHEPMPPTLGTNVLGRKVLYLPSFFTYAKYIVQVDGKIGLFRGLSPRLMSNALSTVTRGSMKKVFPPDEIEQVSNKDDMKTSLKKVVKETSYEMMMQCVSRMLAHPLHVISMRCMVQFVGREAKYSGVLSSIGKIFKEEGLLGFFVGLIPHLLGDVVFLWGCNLLAHFINAYLVDDSFSQALAIRSYTKFVMGIAVSMLTYPFLLVGDLMAVNNCGLQAGLPPYSPVFKSWIHCWKYLSVQGQLFRGSSLLFRRVSSGSCFALE

SEQ ID NO: 904713 - protein, 447 aa, Homo sapiens
MGASDPEVAPWARGGAAGMAGAGAGAGARGGAAAGVEARARDPPPAHRAHPRHPRPAAQPSARRMDGGSGGLGSGDNAPTTEALFVALGAGVTALSHPLLYVKLLIQVGHEPMPPTLGTNVLGRKVLYLPSFFTYAKYIVQVDGKIGLFRGLSPRLMSNALSTVTRGSMKKVFPPDEIEQVSNKDDMKTSLKKVVKETSYEMMMQCVSRMLAHPLHVISMRCMVQFVGREAKYSGVLSSIGKIFKEEGLLGFFVGLIPHLLGDVVFLWGCNLLAHFINAYLVDDSVSDTPGGLGNDQNPGSQFSQALAIRSYTKFVMGVSCASCPSFPLPCGPKRGLGGQPWYMAGGRSWYRVLAWCVPAPWAGVGHWHSGLSGFQIAVSMLTYPFLLVGDLMAVNNCGLQAGLPPYSPVFKSWIHCWKYLSVQGQLFRGSSLLFRRVSSGSCFALE

SEQ ID NO: 904714 - protein, 308 aa, Homo sapiens [sequence omitted]

SEQ ID NO: 904715 - protein, 410 aa, Homo sapiens
MGASDPEVAPWARGGAAGMAGAGAGAGARGGAAAGVEARARDPPPAHRAHPRHPRPAAQPSARRMDGGSGGLGSGDNAPTTEALFVALGAGVTALSHPLLYVKLLIQVGHEPMPPTLGTNVLGRKVLYLPSFFTYAKYIVQVDGKIGLFRGLSPRLMSNALSTVTRGSMKKVFPPDEIEQVSNKDDMKTSLKKVVKETSYEMMMQCVSRMLAHPLHVISMRCMVQFVGREAKYSGVLSSIGKIFKEEGLLGFFVGLIPHLLGDVVFLWGCNLLAHFINAYLVDDSFSQALAIRSYTKFVMGIAVSMLTYPFLLVGDLMAVNNCGLQAGLPPYSPVFKSWIHCWKYLSVQVSKHWTAEAFPVLCYILQLKWFCGCFIACKDKWFHGIQYCEEILGIYKAFKFSSYIISERI

SEQ ID NO: 904716 - protein, 261 aa, Homo sapiens
RLGRGWWLIGRGEEGLYLPSFFTYAKYIVQVDGKIGLFRGLSPRLMSNALSTVTRGSMKKVFPPDEIEQVSNKDDMKTSLKKVVKETSYEMMMQCVSRMLAHPLHVISMRCMVQFVGREAKYSGVLSSIGKIFKEEGLLGFFVGLIPHLLGDVVFLWGCNLLAHFINAYLVDDSFSQALAIRSYTKFVMGIAVSMLTYPFLLVGDLMAVNNCGLQAGLPPYSPVFKSWIHCWKYLSVQGQLFRGSSLLFRRVSSGSCFALE

SEQ ID NO: 904717 - protein, 233 aa, Homo sapiens
MSNALSTVTRGSMKKVFPPDEIEQVSNKDDMKTSLKKVVKETSYEMMMQCVSRMLAHPLHVISMRCMVQFVGREAKYSGVLSSIGKIFKEEGLLGFFVGLIPHLLGDVVFLWGCNLLAHFINAYLVDDSVSDTPGGLGNDQNPGSQFSQALAIRSYTKFVMGIAVSMLTYPFLLVGDLMAVNNCGLQAGLPPYSPVFKSWIHCWKYLSVQGQLFRGSSLLFRRVSSGSCFALE

SEQ ID NO: 904718 - protein, 177 aa, Homo sapiens
TGPSQRNHSQGNGPLSTHPLHVISMRCMVQFVGREAKYSGVLSSIGKIFKEEGLLGFFVGLIPHLLGDVVFLWGCNLLAHFINAYLVDDSFSQALAIRSYTKFVMGIAVSMLTYPFLLVGDLMAVNNCGLQAGLPPYSPVFKSWIHCWKYLSVQGQLFRGSSLLFRRVSSGSCFALE

SEQ ID NO: 904719 - protein, 108 aa, Homo sapiens
MCLSRCGVERGWGCTQWIGSPGRPREGEARWGVGRIPIPRRFAESVLCRGPENGLWGPRLDGERLMGSDPTPSTPPVSPAPILQLSWEHHSPALYIGCGPLARGHHHV

SEQ ID NO: 904720 - protein, 87 aa, Homo sapiens
SRGSLNIRVITKFVMGIAVSMLTYPFLLVGDLMAVNNCGLQAGLPPYSPVFKSWIHCWKYLSVQGQLFRGSSLLFRRVSSGSCFALE

SEQ ID NO: 904721 - protein, 80 aa, Homo sapiens
TYSNYYKFVIKTAVCLTYPFLLEGDLISKNSKLQAGLPPYSPVFKSWIHCWKYLSVQGQLFRGSSLLFRRVSSGSCFALE

SEQ ID NO: 904722 - protein, 100 aa, Homo sapiens; identical to SEQ ID NO: 904709

SEQ ID NO: 904723 - protein, 95 aa, Homo sapiens
EPPTITKFAAASTGGKWARLCLCFSQHYFSDMRAAPASEWEIMQLLRMCPPHLMLICLMVMPRVQDLVTCAVVNTQRLGRSVSLVLPSFKVHGKI

SEQ ID NO: 904724 - protein, 109 aa, Homo sapiens
MAATFQLPGHQEMPLTFQDVAVYFSQAEGRQLGPQQRALYRDVMLENYGNVASLGFPVPKPELISQLEQGKELWVLNLLGAEEPDILKSCQKGENGWDANPGSSLPILP

SEQ ID NO: 904725 - protein, 113 aa, Homo sapiens
MAATFQLPGHQEMPLTFQDVAVYFSQAEGRQLGPQQRALYRDVMLENYGNVASLGFPVPKPELISQLEQGKELWVLNLLGAEEPDILKSCQKVILSVAERGVFVGFMYLEAVL

SEQ ID NO: 904726 - protein, 960 aa, Homo sapiens
RRTEAPQGAGKPACAQLGPARPLHPSPPPPRLWTRFCGRVRSGLGATAQLLGASSVASPGRANRWGSVGPGRSAKRAGRRGGRGEGAGRRRPVQEEPVLGAAGATDGLQRPGGGDRGAALEGWTEDHSWLPASPRSLGPSAASPRPPSHVLSLGEAAPSRGSLPQVGQAGRTALHPISRAFSRSGPRELPAFTPEPGVPGSPRALALAVLGFQESLSSRARRPVLHSDLPPATQEATAAISFCLLAILPHPWLNGAEPEFSPLKVSSGRLQARAVSCLLLETTAAHAHRMAATFQLPGHQEMPLTFQDVAVYFSQAEGRQLGPQQRALYRDVMLENYGNVASLGFPVPKPELISQLEQGKELWVLNLLGAEEPDILKSCQKDSEVGTKKELSILNQKFSEEVKTPEFVSRRLLRDNAQAAEFREAWGREGKLKERVGNSAGQSLNKPNIHKRVLTEATVGRERSLGERTQECSAFDRNLNLDQNVVRLQRNKTGERVFKCDICSKTFKYNSDLSRHQRSHTGEKPYECGRCGRAFTHSSNLVLHHHIHTGNKPFKCDECGKTFGLNSHLRLHRRIHTGEKPFGCGECGKAFSRSSTLIQHRIIHTGEKPYKCNECGRGFSQSPQLTQHQRIHTGEKPHECSHCGKAFSRSSSLIQHERIHTGEKPHKCNQCGKAFSQSSSLFLHHRVHTGEKPYVCNECGRAFGFNSHLTEHVRIHTGEKPYVCNECGKAFRRSSTLVQHRRVHTGEKPYQCVECGKAFSQSSQLTLHQRVHTGEKPYDCGDCGKAFSRRSTLIQHQKVHSGETRKCRKHGPAFVHGSSLTADGQIPTGEKHGRAFNHGANLILRWTVHTGEKSFGCNEYGKAFSPTSRPTEDQIMHAGEKPYKCQECGNAFSGKSTLIQHQVTHTGQKPCHCSVYGKAFSQSSQLTPPQQTRVGEKPALNDGSKRYFIHIKKIFQERHF

SEQ ID NO: 904727 - protein, 671 aa, Homo sapiens
MAATFQLPGHQEMPLTFQDVAVYFSQAEGRQLGPQQRALYRDVMLENYGNVASLGFPVPKPELISQLEQGKELWVLNLLGAEEPDILKSCQKDSEVGTKKELSILNQKFSEEVKTPEFVSRRLLRDNAQAAEFREAWGREGKLKERVGNSAGQSLNKPNIHKRVLTEATVGRERSLGERTQECSAFDRNLNLDQNVVRLQRNKTGERVFKCDICSKTFKYNSDLSRHQRSHTGEKPYECGRCGRAFTHSSNLVLHHHIHTGNKPFKCDECGKTFGLNSHLRLHRRIHTGEKPFGCGECGKAFSRSSTLIQHRIIHTGEKPYKCNECGRGFSQSPQLTQHQRIHTGEKPHECSHCGKAFSRSSSLIQHERIHTGEKPHKCNQCGKAFSQSSSLFLHHRVHTGEKPYVCNECGRAFGFNSHLTEHVRIHTGEKPYVCNECGKAFRRSSTLVQHRRVHTGEKPYQCVECGKAFSQSSQLTLHQRVHTGEKPYDCGDCGKAFSRRSTLIQHQKVHSGETRKCRKHGPAFVHGSSLTADGQIPTGEKHGRAFNHGANLILRWTVHTGEKSFGCNEYGKAFSPTSRPTEDQIMHAGEKPYKCQECGNAFSGKSTLIQHQVTHTGQKPCHCSVYGKAFSQSSQLTPPQQTRVGEKPALNDGSKRYFIHIKKIFQERHF

SEQ ID NO: 904728 - protein, 960 aa, Homo sapiens; identical to SEQ ID NO: 904726

SEQ ID NO: 904729 - protein, 398 aa, Homo sapiens
RRTEAPQGAGKPACAQLGPARPLHPSPPPPRLWTRFCGRVRSGLGATAQLLGASSVASPGRANRWGSVGPGRSAKRAGRRGGRGEGAGRRRPVQEEPVLGAAGATDGLQRPGGGDRGAALEGWTEDHSWLPASPRSLGPSAASPRPPSHVLSLGEAAPSRGSLPQVGQAGRTALHPISRAFSRSGPRELPAFTPEPGVPGSPRALALAVLGFQESLSSRARRPVLHSDLPPATQEATAAISFCLLAILPHPWLNGAEPEFSPLKVSSGRLQARAVSCLLLETTAAHAHRMAATFQLPGHQEMPLTFQDVAVYFSQAEGRQLGPQQRALYRDVMLENYGNVASLGFPVPKPELISQLEQGKELWVLNLLGAEEPDILKSCQKGENGWDANPGSSLPILP

SEQ ID NO: 904730 - protein, 671 aa, Homo sapiens; identical to SEQ ID NO: 904727

SEQ ID NO: 904731 - protein, 73 aa, Homo sapiens
PKNSARGMLENYGNVASLGFPVPKPELISQLEQGKELWVLNLLGAEEPDILKSCQKGENGWDANPGSSLPILP

SEQ ID NO: 904732 - protein, 131 aa, Homo sapiens
GVLRPRRGRGSLRVRSSARPALFILARPLPGSGPGSVGGSVPGSVRLRSSSALPRWLPRVEQTGDAADLPGCGRVLLSGGGAAAGPPAAGALPGCDAGELWERGLSGYQVSPLLKIVITDKKFFKGRFIEA

SEQ ID NO: 904733 - protein, 960 aa, Homo sapiens; identical to SEQ ID NO: 904726

SEQ ID NO: 904734 - protein, 762 aa, Homo sapiens
RRTEAPQGAGKPACAQLGPARPLHPSPPPPRLWTRFCGRVRSGLGATAQLLGASSVASPGRANRWGSVGPGRSAKRAGRRGGRGEGAGRRRPVQEEPVLGAAGATDGLQRPGGGDRGAALEGWTEDHSWLPASPRSLGPSAASPRPPSHVLSLGEAAPSRGSLPQVGQAGRTALHPISRAFSRSGPRELPAFTPEPGVPGSPRALALAVLGFQESLSSRARRPVLHSDLPPATQEATAAISFCLLAILPHPWLNGAEPEFSPLKVSSGRLQARAVSCLLLETTAAHAHRMAATFQLPGHQEMPLTFQDVAVYFSQAEGRQLGPQQRALYRDVMLENYGNVASLGFPVPKPELISQLEQGKELWVLNLLGAEEPDILKSCQKDSEVGTKKELSILNQKFSEEVKTPEFVSRRLLRDNAQAAEFREAWGREGKLKERVGNSAGQSLNKPNIHKRVLTEATVGRERSLGERTQECSAFDRNLNLDQNVVRLQRNKTGERVFKCDICSKTFKYNSDLSRHQRSHTGEKPYECGRCGRAFTHSSNLVLHHHIHTGNKPFKCDECGKTFGLNSHLRLHRRIHTGEKPFGCGECGKAFSRSSTLIQHRIIHTGEKPYKCNECGRGFSQSPQLTQHQRIHTGEKPHECSHCGKAFSRSSSLIQHERIHTGEKPHKCNQCGKAFSQSSSLFLHHRVHTGEKPYVCNECGRAFGFNSHLTEHVRIHTGEKPYVCNECVRRSLFRRPFRLLWESWYEALPLKEEPELLPNCQP

SEQ ID NO: 904735 - protein, 170 aa, Homo sapiens
LPAGAARLKIMDPPGARNWAGAATRTPGVPVYKGREQAASLEALFGALDPFPSVLTAARQTPAAKMVKQIESKTAFQEALDAAGDKLVVVDFSATWCGPCKMIKPFFHSLSEKYSNVIFLEVDVDDCQDVASECEVKCMPTFQFFKKGQKVGEFSGANKEKLEATINELV

SEQ ID NO: 904736 - protein, 125 aa, Homo sapiens
APGAGRGRGAATGAEVRPGARAPATRTPGVPVYKGREQAASLEALFGALDPFPSVLTAARQTPAAKMVKQIESKTAFQEALDAAGDKLVVVDFSATWCGPCKMIKPFFHSLSVASECEVCMPIPF

SEQ ID NO: 904737 - protein, 171 aa, Homo sapiens
APGAGRGRGAATGAEVRPGARAPATRTPGVPVYKGREQAASLEALFGALDPFPSVLTAARQTPAAKMVKQIESKTAFQEALDAAGDKLVVVDFSATWCGPCKMIKPFFHSLSEKYSNVIFLEVDVDDCQDVASECEVKCMPTFQFFKKGQKVGEFSGANKEKLEATINELV

SEQ ID NO: 904738 - protein, 171 aa, Homo sapiens; identical to SEQ ID NO: 904737

SEQ ID NO: 904739 - protein, 171 aa, Homo sapiens; identical to SEQ ID NO: 904737

SEQ ID NO: 904740 - protein, 171 aa, Homo sapiens; identical to SEQ ID NO: 904737

SEQ ID NO: 904741 - protein, 171 aa, Homo sapiens; identical to SEQ ID NO: 904737

SEQ ID NO: 904742 - protein, 151 aa, Homo sapiens
APGAGRGRGAATGAEVRPGARAPATRTPGVPVYKGREQAASLEALFGALDPFPSVLTAARQTPAAKMVKQIESKTAFQEALDAAGDKLVVVDFSATWCGPCKMIKPFFHDVASECEVKCMPTFQFFKKGQKVGEFSGANKEKLEATINELV

SEQ ID NO: 904743 - protein, 157 aa, Homo sapiens
APGAGRGRGAATGAEVRPGARAPATRTPGVPVYKGREQAASLEALFGALDPFPSVLTAARQTPAAKMVKQIESKTAFQEALDAAGDKLVVVDFSATWCGPCKMIKPFFHSLSEKYSNVIFLEVDVDDCQDVASECEVKCMPTFQFFKKGQKSFAPTF

SEQ ID NO: 904744 - protein, 201 aa, Homo sapiens
APGAGRGRGAATGAEVRPGARAPATRTPGVPVYKGREQAASLEALFGALDPFPSVLTAARQTPAAKMVKQIESKTAFQEALDAAGDKLVVVDFSATWCGPCKMIKPFFHSLSEKYSNVIFLEVDVDDCQDVASECEVKCMPTFQFFKKGQKVASSFCKAHTTWLRSQLLQVYHLQRPGFLKSSLALDLLTIYGCWSRLASV

SEQ ID NO: 904745 - protein, 87 aa, Homo sapiens
APGAGRGRGAATGAEVRPGARAPATRTPGVPVYKGREQAASLEALFGALDPFPSVLTAARQTPAAKMVKQIESKTAFQEALDAAVPL

SEQ ID NO: 904746 - protein, 142 aa, Homo sapiens
APGAGRGRGAATGAEVRPGARAPATRTPGVPVYKGREQAASLEALFGALDPFPSVLTAARQTPAAKMVKQIESKTAFQEALDAAGDKLVVVDFSATWCGPCKMIKPFFHTFCPFLKNWNVACIWLHTLKHILTVIHIYVQDM

SEQ ID NO: 904747 - protein, 171 aa, Homo sapiens; identical to SEQ ID NO: 904737

SEQ ID NO: 904748 - protein, 171 aa, Homo sapiens; identical to SEQ ID NO: 904737

SEQ ID NO: 904749 - protein, 171 aa, Homo sapiens; identical to SEQ ID NO: 904737

SEQ ID NO: 904750 - protein, 171 aa, Homo sapiens; identical to SEQ ID NO: 904737

SEQ ID NO: 904751 - protein, 171 aa, Homo sapiens; identical to SEQ ID NO: 904737

SEQ ID NO: 904752 - protein, 87 aa, Homo sapiens; identical to SEQ ID NO: 904745

SEQ ID NO: 904753 - protein, 116 aa, Homo sapiens
APGAGRGRGAATGAEVRPGARAPATRTPGVPVYKGREQAASLEALFGALDPFPSVLTAARQTPAAKMVKQIESKDVASECEVKCMPTFQFFKKGQKVGEFSGANKEKLEATINELV

SEQ ID NO: 904754 - protein, 139 aa, Homo sapiens
APGAGRGRGAATGAEVRPGARAPATRTPGVPVYKGREQAASLEALFGALDPFPSVLTAARQTPAAKMVKQIESKTAFQEALDAAGDKLVVVDFSATWCGPCKMIKPFFHSLSEKYSNVIFLEVDVDDCQRYVAGNMRYC

SEQ ID NO: 904755 - protein, 117 aa, Homo sapiens
APGAGRGRGAATGAEVRPGARAPATRTPGVPVYKGREQAASLEALFGALDPFPSVLTAARQTPAAKMVKQIESKTAFQEALDAAGDKLVVVDFSATWCGPCKMIKPFFHRTSSIKFA

SEQ ID NO: 904756 - protein, 137 aa, Homo sapiens
HTSAERMASRKAGTRGKVAATKQAQRGSSNVFSMFEQAQIQEFKEAFSCIDQNRDGIICKADLRETYSQLGKVSVPEEELDAMLQEGKGPINFTVFLTLFGEKLNGQPQEHLVLPMFTQRKGCNRIVSSFYQEKVLP

SEQ ID NO: 904757 - protein, 122 aa, Homo sapiens
SSHTSAERMASRKAGTRGKVAATKQAQRGSSNVFSMFEQAQIQEFKEAFSCIDQNRDGIICKADLRETYSQLGKVSVPEEELDAMLQEGKGPINFTVFLTLFGEKLNGDRPRGSHPECLPHV

SEQ ID NO: 904758 - protein, 122 aa, Homo sapiens; identical to SEQ ID NO: 904757

SEQ ID NO: 904759 - protein, 139 aa, Homo sapiens
SSHTSAERMASRKAGTRGKVAATKQAQRGSSNVFSMFEQAQIQEFKEAFSCIDQNRDGIICKADLRETYSQLGKVSVPEEELDAMLQEGKGPINFTVFLTLFGEKLNGQPQEHLVLPMFTQRKGCNRIVSSFYQEKVLP

SEQ ID NO: 904760 - protein, 209 aa, Homo sapiens
HTSAERMASRKAGTRGKVAATKQAQRGSSNVFSMFEQAQIQEFKEAFSCIDQNRDGIICKADLRETYSQLGCVHPPPTLRTGVPTLSCWAGGSGLGDRTLLPCFPSSPSPHTALPPLSRLASTSPSRPTAASAPPAPVARMEGGRPGPSGGHPGSLCAPHAPPPAGEGECPRGGAGRHAARGQGPHQLHRLPHALWGEAQWGQTPRKPS

SEQ ID NO: 904761 - protein, 133 aa, Homo sapiens
TPLQREWPAGRRGPGARWQPPSRPNVVLPTSFPCLNKPRYRSSKKAGGCSHLKAPIPQAFSCIDQNRDGIICKADLRETYSQLGKVSVPEEELDAMLQEGKGPINFTVFLTLFGEKLNGDRPRGSHPECLPHV

SEQ ID NO: 904762 - protein, 130 aa, Homo sapiens
SSHTSAERMASRKAGTRGKVAATKQAQRGSSNVFSMFEQAQIQEFKEAFSCIDQNRDGIICKADLRETYSQLGKVSVPEEELDAMLQEGKNPIFTKNTKISQAWWLVTVVPATLEAEAKESLEPRRRRLQ

SEQ ID NO: 904763 - protein, 100 aa, Homo sapiens
HTSAERMASRKAGTRGKVAATKQAQRGSSNVFSMFEQAQIQEFKEAFSCIDQNRDGIICKADLRETYSQLEGSFPGGVDAISKGRPIITFLVLGSYGNPE

SEQ ID NO: 904764 - protein, 68 aa, Homo sapiens
MLQEGKGPINFTVFLTLFGEKLNGGQPPGGILVLPHFSPRKGCNKISEELSTRESFPKVRDLPNHDLR

SEQ ID NO: 904765 - protein, 88 aa, Homo sapiens
HTSAERMASRKAGTRGKVAATKQAQRGSSNVFSMFEQAQIQEFKELFSTSTFLELGVASLKAPFKGFSLLTRLYGYLKEALGNYSVGK

SEQ ID NO: 904766 - protein, 122 aa, Homo sapiens; identical to SEQ ID NO: 904757

SEQ ID NO: 904767 - protein, 122 aa, Homo sapiens; identical to SEQ ID NO: 904757

SEQ ID NO: 904768 - protein, 120 aa, Homo sapiens
HTSAERMASRKAGTRGKVAATKQAQRGSSNVFSMFEQAQIQEFKEAFSCIDQNRDGIICKADLRETYSQLGKVSVPEEELDAMLQEGKGPINFTVFLTLFGEKLNGDRPRGSHPECLPHV

SEQ ID NO: 904769 - protein, 143 aa, Homo sapiens
HTSAERMASRKAGTRGKVAATKQAQRGSSNVFSMFEQAQIQEFKEVSPPPPTFPRAGGCSHLKAPIPQAFSCIDQNRDGIICKADLRETYSQLGKVSVPEEELDAMLQEGKGPINFTVFLTLFGEKLNGDRPRGSHPECLPHV

SEQ ID NO: 904770 - protein, 98 aa, Homo sapiens
SSHTSAERMASRKAGTRGKVAATKQAQRGSSNVFSMFEQAQIQEFKEAFSCIDQNRDGIICKADLRETYSQLGKVSVPEEELDAMLQEGKGQTPRKPS

SEQ ID NO: 904771 - protein, 90 aa, Homo sapiens
HTSAERMASRKAGTRGKVAATKQAQRGSSNVFSMFEQAQIQEFKEAFSCIDQNRDGIICKADLRETYSQLGEAAQPLQYSSPAPSLGLHP

SEQ ID NO: 904772 - protein, 143 aa, Homo sapiens; identical to SEQ ID NO: 904769

SEQ ID NO: 904773 - protein, 209 aa, Homo sapiens
MRIPTSTPRGLVIQDYDADKMFPAFGFGAQIPPQWQVSHEFPMNFNPSNPYCNGIQGIVEAYRSCLPQIKLYGPTNFSPIINHVARFAAAATQQQTASQYFVLLIITDGVITDLDETRQAIVNASRLPMSIIIVGVGGADFSAMEFLDGDGGSLRSPLGEVAIRDIVQFVPFRQFQNAPKEALAQCACPVVSCPRCYRGCAKRVEISDE

SEQ ID NO: 904774 - protein, 537 aa, Homo sapiens
MAAQCVTKVALNVSCANLLDKDIGSKSDPLCVLFLNTSGQQWYEVERTERIKNCLNPQFSKTFIIDYYFEVVQKLKFGVYDIDNKTIELSDDDFLGECECTLGQIVSSKKLTRPLVMKTGRPAGKGSITISAEEIKDNRVVLFEMEARKLDNKDLFGKSDPYLEFHKQTSDGNWLMVHRTEVVKNNLNPVWRPFKISLNSLCYGDMDKTIKVECYDYDNDGSHDLIGTFQTTMTKLKEASRSSPVEFECINEKKRQKKKSYKNSGVISVKQCEITVECTFLDYIMGGCQLNFTVGVDFTGSNGDPRSPDSLHYISPNGVNEYLTALWSVGLVIQDYDADKMFPAFGFGAQIPPQWQVSHEFPMNFNPSNPYCNGIQGIVEAYRSCLPQIKLYGPTNFSPIINHVARFAAAATQQQTASQYFVLLIITDGVITDLDETRQAIVNASRLPMSIIIVGVGGADFSAMEFLDGDGGSLRSPLGEVAIRDIVQFVPFRQFQNAPKEALAQCVLAEIPQQVVGYFNTYKLLPPKNPATKQQKQ

SEQ ID NO: 904775 - protein, 429 aa, Homo sapiens
LYDSRASRHLKRKTAGKGSITISAEEIKDNRVVLFEMEARKLDNKDLFGKSDPYLEFHKQTSDGNWLMVHRTEVVKNNLNPVWRPFKISLNSLCYGDMDKTIKVECYDYDNDGSHDLIGTFQTTMTKLKEASRSSPVEFECINEKKRQKKKSYKNSGVISVKQCEITVECTFLDYIMGGCQLNFTVGVDFTGSNGDPRSPDSLHYISPNGVNEYLTALWSVGLVIQDYDADKMFPAFGFGAQIPPQWQVSHEFPMNFNPSNPYCNGIQGIVEAYRSCLPQIKLYGPTNFSPIINHVARFAAAATQQQTASQYFVLLIITDGVITDLDETRQAIVNASRLPMSIIIVGVGGADFSAMEFLDGDGGSLRSPLGEVAIRDIVQFVPFRQFQNAPKEALAQCVLAEIPQQVVGYFNTYKLLPPKNPATKQQKQ

SEQ ID NO: 904776 - protein, 537 aa, Homo sapiens; identical to SEQ ID NO: 904774

SEQ ID NO: 904777 - protein, 537 aa, Homo sapiens; identical to SEQ ID NO: 904774

SEQ ID NO: 904778 - protein, 537 aa, Homo sapiens; identical to SEQ ID NO: 904774

SEQ ID NO: 904779 - protein, 217 aa, Homo sapiens
MRIPTSTPRGLVIQDYDADKMFPAFGFGAQIPPQWQVSHEFPMNFNPSNPYCNGIQGIVEAYRSCLPQIKLYGPTNFSPIINHVARFAAAATQQQTASQYFVLLIITDGVITDLDETRQAIVNASRLPMSIIIVGVGGADFSAMEFLDGDGGSLRSPLGEVAIRDIVQFVPFRQFQNAPKEALAQCVLAEIPQQVVGYFNTYKLLPPKNPATKQQKQ

SEQ ID NO: 904780 - protein, 95 aa, Homo sapiens
NQLERCRTALFLGFKKPCPTQWCRYLSSALLARRRWELTLLNLPNIRRRQESCEPRLSQCLSALRLQQGGSTGSIRNPGCSLPCGLQQPPRTQAR

SEQ ID NO: 904781 - protein, 872 aa, Homo sapiens
MRTREEELKSLGADFTFGFIQVMDGEKDPRNLLVAFRIVHDLISRDYSLGPFVEELFEVTSCYFPIDFTPPPNDPHGIQREDLILSLRAVLASTPRFAEFLLPLLIEKVDSEVLSAKLDSLQTLNACCAVYGQKELKDFLPSLWASIRREVFQTASERVEAEGLAALHSLTACLSRSVLRADAEDLLDSFLSNILQDCRHHLCEPDMKLVWPSAKLLQAAAGASARACDSVTSNVLPLLLEQFHKHSQSSQRRTILEMLLGFLKLQQKWSYEDKDQRPLNGFKDQLCSLVFMALTDPSTQLQLVGIRTLTVLGAQPDLLSYEDLELAVGHLYRLSFLKEDSQSCRVAALEASGTLAALYPVAFSSHLVPKLAEELRVGESNLTNGDEPTQCSRHLCCLQALSAVSTHPSIVKETLPLLLQHLWQVNRGNMVAQSSDVIAVCQSLRQMAEKCQQDPESCWYFHQTAIPCLLALAVQASMPEKEPSVLRKVLLEDEVLAAMVSVIGTATTHLSPELAAQSVTHIVPLFLDGNVSFLPENSFPSRFQPFQDGSSGQRRLIALLMAFVCSLPRNVEIPQLNQLMRELLELSCCHSCPFSSTAAAKCFAGLLNKHPAGQQLDEFLQLAVDKVEAGLGSGPCRSQAFTLLLWVTKALVLRYHPLSSCLTARLMGLLSDPELGPAAADGFSLLMSDCTDVLTRAGHAEVRIMFRQRFFTDNVPALVQGFHAAPQDVKPNYLKGLSHVLNRLPKPVLLPELPTLLSLLLEALSCPDCVVQLSTLSCLQPLLLEAPQVMSLHVDTLVTKFLNLSSSPSMAVRIAALQCMHALTRLPTPVLLPYKPQVIRALAKPLDDKKRLVRKEAVSARGEWFLLGSPGS

SEQ ID NO: 904782 - protein, 666 aa, Homo sapiens
MKLVWPSAKLLQAAAGASARACDSVTSNVLPLLLEQFHKHSQSSQRRTILEMLLGFLKLQQKWSYEDKDQRPLNGFKDQLCSLVFMALTDPSTQLQLVGIRTLTVLGAQPDLLSYEDLELAVGHLYRLSFLKEDSQSCRVAALEASGTLAALYPVAFSSHLVPKLAEELRVGESNLTNGDEPTQCSRHLCCLQALSAVSTHPSIVKETLPLLLQHLWQVNRGNMVAQSSDVIAVCQSLRQMAEKCQQDPESCWYFHQTAIPCLLALAVQASMPEKEPSVLRKVLLEDEVLAAMVSVIGTATTHLSPELAAQSVTHIVPLFLDGNVSFLPENSFPSRFQPFQDGSSGQRRLIALLMAFVCSLPRNVEIPQLNQLMRELLELSCCHSCPFSSTAAAKCFAGLLNKHPAGQQLDEFLQLAVDKVEAGLGSGPCRSQAFTLLLWVTKALVLRYHPLSSCLTARLMGLLSDPELGPAAADGFSLLMSDCTDVLTRAGHAEVRIMFRQRFFTDNVPALVQGFHAAPQDVKPNYLKGLSHVLNRLPKPVLLPELPTLLSLLLEALSCPDCVVQLSTLSCLQPLLLEAPQVMSLHVDTLVTKFLNLSSSPSMAVRIAALQCMHALTRLPTPVLLPYKPQVIRALAKPLDDKKRLVRKEAVSARGEWFLLGSPGS

SEQ ID NO: 904783 - protein, 811 aa, Homo sapiens
SEYEAGVNWPPNDPHGIQREDLILSLRAVLASTPRFAEFLLPLLIEKVDSEVLSAKLDSLQTLNACCAVYGQKELKDFLPSLWASIRREVFQTASERVEAEGLAALHSLTACLSRSVLRADAEDLLDSFLSNILQDCRHHLCEPDMKLVWPSAKLLQAAAGASARACDSVTSNVLPLLLEQFHKHSQSSQRRTILEMLLGFLKLQQKWSYEDKDQRPLNGFKDQLCSLVFMALTDPSTQLQLVGIRTLTVLGAQPDLLSYEDLELAVGHLYRLSFLKEDSQSCRVAALEASGTLAALYPVAFSSHLVPKLAEELRVGESNLTNGDEPTQCSRHLCCLQALSAVSTHPSIVKETLPLLLQHLWQVNRGNMVAQSSDVIAVCQSLRQMAEKCQQDPESCWYFHQTAIPCLLALAVQASMPEKEPSVLRKVLLEDEVLAAMVSVIGTATTHLSPELAAQSVTHIVPLFLDGNVSFLPENSFPSRFQPFQDGSSGQRRLIALLMAFVCSLPRNVEIPQLNQLMRELLELSCCHSCPFSSTAAAKCFAGLLNKHPAGQQLDEFLQLAVDKVEAGLGSGPCRSQAFTLLLWVTKALVLRYHPLSSCLTARLMGLLSDPELGPAAADGFSLLMSDCTDVLTRAGHAEVRIMFRQRFFTDNVPALVQGFHAAPQDVKPNYLKGLSHVLNRLPKPVLLPELPTLLSLLLEALSCPDCVVQLSTLSCLQPLLLEAPQVMSLHVDTLVTKFLNLSSSPSMAVRIAALQCMHALTRLPTPVLLPYKPQVIRALAKPLDDKKRLVRKEAVSARGEWFLLGSPGS

SEQ ID NO: 904784 - protein, 666 aa, Homo sapiens; identical to SEQ ID NO: 904782

SEQ ID NO: 904785 - protein, 865 aa, Homo sapiens
MRTREEELKSLGADFTFGFIQVMDGEKDPRNLLVAFRIVHDLISRDYSLGPFVEELFEVTSCYFPIDFTPPPNDPHGIQREDLILSLRAVLASTPRFAEFLLPLLIEKVDSEVLSAKLDSLQTLNACCAVYGQKELKDFLPSLWASIRREVFQTASERVEAEGLAALHSLTACLSRSVLRADAEDLLDSFLSNILQDCRHHLCEPDMKLVWPSAKLLQAAAGASARACDSVTSNVLPLLLEQFHKHSQSSQRRTILEMLLGFLKLQQKWSYEDKDQRPLNGFKDQLCSLVFMALTDPSTQLQLVGIRTLTVLGAQPDLLSYEDLELAVGHLYRLSFLKEDSQSCRVAALEASGTLAALYPVAFSSHLVPKLAEELRVGESNLTNGDEPTQCSRHLCCLQALSAVSTHPSIVKETLPLLLQHLWQVNRGNMVAQSSDVIAVCQSLRQMAEKCQQDPESCWYFHQTAIPCLLALAVQASMPEKEPSVLRKVLLEDEVLAAMVSVIGTATTHLSPELAAQSVTHIVPLFLDGNVSFLPENSFPSRFQPFQDGSSGQRRLIALLMAFVCSLPRNVEIPQLNQLMRELLELSCCHSCPFSSTAAAKCFAGLLNKHPAGQQLDEFLQLAVDKVEAGLGSGPCRSQAFTLLLWVTKALVLRYHPLSSCLTARLMGLLSDPELGPAAADGFSLLMSDCTDVLTRAGHAEVRIMFRQRFFTDNVPALVQGFHAAPQDVKPNYLKGLSHVLNRLPKPVLLPELPTALSCPDCVVQLSTLSCLQPLLLEAPQVMSLHVDTLVTKFLNLSSSPSMAVRIAALQCMHALTRLPTPVLLPYKPQVIRALAKPLDDKKRLVRKEAVSARGEWFLLGSPGS

SEQ ID NO: 904786 - protein, 589 aa, Homo sapiens
MRTREEELKSLGADFTFGFIQVMDGEKDPRNLLVAFRIVHDLISRDYSLGPFVEELFEVTSCYFPIDFTPPPNDPHGIQREDLILSLRAVLASTPRFAEFLLPLLIEKVDSEVLSAKLDSLQTLNACCAVYGQKELKDFLPSLWASIRREVFQTASERVEAEGLAALHSLTACLSRSVLRADAEDLLDSFLSNILQDCRHHLCEPDMKLVWPSAKLLQAAAGASARACDSVTSNVLPLLLEQFHKHSQSSQRRTILEMLLGFLKLQQKWSYEDKDQRPLNGFKDQLCSLVFMALTDPSTQLQLVGIRTLTVLGAQPDLLSYEDLELAVGHLYRLSFLKEDSQSCRVAALEASGTLAALYPVAFSSHLVPKLAEELRVGESNLTNGDEPTQCSRHLCCLQALSAVSTHPSIVKETLPLLLQHLWQVNRGNMVAQSSDVIAVCQSLRQMAEKCQQDPESCWYFHQTAIPCLLALAVQASMPEKEPSVLRKVLLEDEVLAAMVSVIGTATTHLSPELAAQSVTHIVPLFLDGNVSFLPENSFPSRFQPFQDGSSGQRRLIALLMAFVCSLPRNVSEHIWEVLLFNLDKVTPG

SEQ ID NO: 904787 - protein, 879 aa, Homo sapiens
MRTREEELKSLGADFTFGFIQVMDGEKDPRNLLVAFRIVHDLISRDYSLGPFVEELFEVTSCYFPIDFTPPPNDPHGIQREDLILSLRAVLASTPRFAEFLLPLLIEKVDSEVLSAKLDSLQTLNACCAVYGQKELKDFLPSLWASIRREVFQTASERVEAEGLAALHSLTACLSRSVLRADAEDLLDSFLSNILQDCRHHLCEPDMKLVWPSAKLLQAAAGASARACDSVTSNVLPLLLEQFHKHSQYPLKRYQSSQRRTILEMLLGFLKLQQKWSYEDKDQRPLNGFKDQLCSLVFMALTDPSTQLQLVGIRTLTVLGAQPDLLSYEDLELAVGHLYRLSFLKEDSQSCRVAALEASGTLAALYPVAFSSHLVPKLAEELRVGESNLTNGDEPTQCSRHLCCLQALSAVSTHPSIVKETLPLLLQHLWQVNRGNMVAQSSDVIAVCQSLRQMAEKCQQDPESCWYFHQTAIPCLLALAVQASMPEKEPSVLRKVLLEDEVLAAMVSVIGTATTHLSPELAAQSVTHIVPLFLDGNVSFLPENSFPSRFQPFQDGSSGQRRLIALLMAFVCSLPRNVEIPQLNQLMRELLELSCCHSCPFSSTAAAKCFAGLLNKHPAGQQLDEFLQLAVDKVEAGLGSGPCRSQAFTLLLWVTKALVLRYHPLSSCLTARLMGLLSDPELGPAAADGFSLLMSDCTDVLTRAGHAEVRIMFRQRFFTDNVPALVQGFHAAPQDVKPNYLKGLSHVLNRLPKPVLLPELPTLLSLLLEALSCPDCVVQLSTLSCLQPLLLEAPQVMSLHVDTLVTKFLNLSSSPSMAVRIAALQCMHALTRLPTPVLLPYKPQVIRALAKPLDDKKRLVRKEAVSARGEWFLLGSPGS

SEQ ID NO: 904788 - protein, 872 aa, Homo sapiens; identical to SEQ ID NO: 904781

SEQ ID NO: 904789 - protein, 784 aa, Homo sapiens
MRTREEELKSLGADFTFGFIQVMDGEKDPRNLLVAFRIVHDLISRDYSLGPFVEELFEVTSCYFPIDFTPPPNDPHGIQREDLILSLRAVLASTPRFAEFLLPLLIEKVDSEVLSAKLDSLQTLNACCAVYGQKELKDFLPSLWASIRREVFQTASERVEAEGLAALHSLTACLSRSVLRADAEDLLDSFLSNILQDCRHHLCEPDMKLVWPSAKLLQAAAGASARACDSVTSNVLPLLLEQFHKHSQSSQRRTILEMLLGFLKLQQKWSYEDKDQRPLNGFKDQLCSLVFMALTDPSTQLQLVGIRTLTVLGAQPDLLSYEDLELAVGHLYRLSFLKEDSQSCRVAALEASGTLAALYPVAFSSHLVPKLAEELRVGESNLTNGDEPTQCSRHLCCLQALSAVSTHPSIVKETLPLLLQHLWQVNRGNMVAQSSDVIAVCQSLRQMAEKCQQDPESCWYFHQTAIPCLLALAVQASMPEKEPSVLRKVLLEDEVLAAMVSVIGTATTHLSPELAAQSVTHIVPLFLDGNVSFLPENSFPSRFQPFQDGSSGQRRLIALLMAFVCSLPRNVEIPQLNQLMRELLELSCCHSCPFSSTAAAKCFAGLLNKHPAGQQLDEFLQLAVDKVEAGLGSGPCRSQAFTLLLWVTKALVLRYHPLSSCLTARLMGLLSDPELGPAAADGFSLLMSDCTDVLTRAGHAEVRIMFRQRFFTDNVPALVQGFHAAPQDVKPNYLKGLSHVLNRLPKPVLLPELPTLLSLLLEALSCPDCVVQLSTLCCMAVQRT

SEQ ID NO: 904790 - protein, 443 aa, Homo sapiens
MVAQSSDVIAVCQSLRQMAEKCQQDPESCWYFHQTAIPCLLALAVQASMPEKEPSVLRKVLLEDEVLAAMVSVIGTATTHLSPELAAQSVTHIVPLFLDGNVSFLPENSFPSRFQPFQDGSSGQRRLIALLMAFVCSLPRNVEIPQLNQLMRELLELSCCHSCPFSSTAAAKCFAGLLNKHPAGQQLDEFLQLAVDKVEAGLGSGPCRSQAFTLLLWVTKALVLRYHPLSSCLTARLMGLLSDPELGPAAADGFSLLMSDCTDVLTRAGHAEVRIMFRQRFFTDNVPALVQGFHAAPQDVKPNYLKGLSHVLNRLPKPVLLPELPTLLSLLLEALSCPDCVVQLSTLSCLQPLLLEAPQVMSLHVDTLVTKFLNLSSSPSMAVRIAALQCMHALTRLPTPVLLPYKPQVIRALAKPLDDKKRLVRKEAVSARGEWFLLGSPGS

SEQ ID NO: 904791 - protein, 92 aa, Homo sapiens
LLRLGPRGLSAFALWPLPRLWRRRRLWVPYGASCTTSSWVSKRAPLTRWLQVLSRESRTPNSGTRNPAFVTGATPLSHLAPGEGSGTPDTVL

SEQ ID NO: 904792 - protein, 535 aa, Homo sapiens
MRTREEELKSLGADFTFGFIQVMDGEKDPRNLLVAFRIVHDLISRDYSLGPFVEELFEVTSCYFPIDFTPPPNDPHGIQREDLILSLRAVLASTPRFAEFLLPLLIEKVDSEVLSAKLDSLQTLNACCAVYGQKELKDFLPSLWASIRREVFQTASERVEAEGLAALHSLTACLSRSVLRADAEDLLDSFLSNILQDCRHHLCEPDMKLVWPSAKLLQAAAGASARACDSVTSNVLPLLLEQFHKHSQSSQRRTILEMLLGFLKLQQKWSYEDKDQRPLNGFKDQLCSLVFMALTDPSTQLQLVGIRTLTVLGAQPDLLSYEDLELAVGHLYRLSFLKEDSQSCRVAALEASGTLAALYPVAFSSHLVPKLAEELRVGESNLTNGDEPTQCSRHLCCLQALSAVSTHPSIVKETLPLLLQHLWQVNRGNMVAQSSDVIAVCQSLRQMAEKCQQDPESCWYFHQTAIPCLLALAVQASMPEKEAQSEETTMHEEVSKHGRRQGQEKQANYIGPTVTVARIEDGARNRPDRKHRTQH

SEQ ID NO: 904793 - protein, 126 aa, Homo sapiens
SRFILPERTLLSLLLEALSCPDCVVQLSTLSCLQPLLLEAPQVMSLHVDTLVTKFLNLSSSPSMAVRIAALQCMHALTRLPTPVLLPYKPQVIRALAKPLDDKKRLVRKEAVSARGEWFLLGSPGS

SEQ ID NO: 904794 - protein, 257 aa, Homo sapiens
MRTREEELKSLGADFTFGFIQVMDGEKDPRNLLVAFRIVHDLISRDYSLGPFVEELFEVTSCYFPIDFTPPPNDPHGIQREDLILSLRAVLASTPRFAEFLLPLLIEKVDSEVLSAKLDSLQTLNACCAVYGQKELKDFLPSLWASIRREVFQTASERVEAEGLAALHSLTACLSRSVLRADAEDLLDSFLSNILQDCRHHLCEPDMKLVWPSAKLLQAAAGASARACDSVTSNVLPLLLEQFHKHSQVREQNLWGK

SEQ ID NO: 904795 - protein, 237 aa, Homo sapiens
MRTREEELKSLGADFTFGFIQVMDGEKDPRNLLVAFRIVHDLISRDYSLGPFVEELFEVTSCYFPIDFTPPPNDPHGIQREDLILSLRAVLASTPRFAEFLLPLLIEKVDSEVLSAKLDSLQTLNACCAVYGQKELKDFLPSLWASIRREVFQTASERVEAEGLAALHSLTACLSRSVLRADAEDLLDSFLSNILQGNGAVAARKGSEHNRNDIPCLGAVAHACNPCTLGGRGGWIT

SEQ ID NO: 904796 - protein, 279 aa, Homo sapiens
MAAAAAVEAAAPMGALWGLVHDFVVGQQEGPADQVAADVKSGNYTVLQVVEALGSSLENPEPRTRARGIQLLSQVLLHCHTLLLEKEEGTGVTNRNVFLDVLSPVVHLILFYENRLKDHHLVIPSVLQGLKALSLCVALPPGLAVSVLKAIFQEVHVQSLPQVDRHTVYNIITNFMRTREEELKSLGADFTFGFIQVMDGEKDPRNLLVAFRIVHDLISRDYSLGLCGGVLKVNPVISYDLTLQLMIHGSREKTHLNFSDVLVLTEWSRCPRCNGPGTA

SEQ ID NO: 904797 - protein, 1030 aa, Homo sapiens [sequence omitted]

SEQ ID NO: 904798 - protein, 194 aa, Homo sapiens
MAAAAAVEAAAPMGALWGLVHDFVVGQQEGPADQVAADVKSGNYTVLQVVEALGSSLENPEPRTRARGIQLLSQVLLHCHTLLLEKEVVHLILFYENRLKDHHLVIPSVLQGLKALSLCVALPPGLAVSVLKAIFQEVHVQSLPQVDRHTVYNIITNFMRTREEGKRQSFLGNVKSKHILLFPLLVGLILPGVI

SEQ ID NO: 904799 - protein, 1047 aa, Homo sapiens
MAAAAAVEAAAPMGALWGLVHDFVVGQQEGPADQVAADVKSGNYTVLQVVEALGSSLENPEPRTRARGIQLLSQVLLHCHTLLLEKEEGTGVTNRNVFLDVLSPVVHLILFYENRLKDHHLVIPSVLQGLKALSLCVALPPGLAVSVLKAIFQEVHVQSLPQVDRHTVYNIITNFMRTREEELKSLGADFTFGFIQVMDGEKDPRNLLVAFRIVHDLISRDYSLGPFVEELFEVTSCYFPIDFTPPPNDPHGIQREDLILSLRAVLASTPRFAEFLLPLLIEKVDSEVLSAKLDSLQTLNACCAVYGQKELKDFLPSLWASIRREVFQTASERVEAEGLAALHSLTACLSRSVLRADAEDLLDSFLSNILQDCRHHLCEPDMKLVWPSAKLLQAAAGASARACDSVTSNVLPLLLEQFHKHSQSSQRRTILEMLLGFLKLQQKWSYEDKDQRPLNGFKDQLCSLVFMALTDPSTQLQLVGIRTLTVLGAQPDLLSYEDLELAVGHLYRLSFLKEDSQSCRVAALEASGTLAALYPVAFSSHLVPKLAEELRVGESNLTNGDEPTQCSRHLCCLQALSAVSTHPSIVKETLPLLLQHLWQVNRGNMVAQSSDVIAVCQSLRQMAEKCQQDPESCWYFHQTAIPCLLALAVQASMPEKEPSVLRKVLLEDEVLAAMVSVIGTATTHLSPELAAQSVTHIVPLFLDGNVSFLPENSFPSRFQPFQDGSSGQRRLIALLMAFVCSLPRNVEIPQLNQLMRELLELSCCHSCPFSSTAAAKCFAGLLNKHPAGQQLDEFLQLAVDKVEAGLGSGPCRSQAFTLLLWVTKALVLRYHPLSSCLTARLMGLLSDPELGPAAADGFSLLMSDCTDVLTRAGHAEVRIMFRQRFFTDNVPALVQGFHAAPQDVKPNYLKGLSHVLNRLPKPVLLPELPTLLSLLLEALSCPDCVVQLSTLSCLQPLLLEAPQVMSLHVDTLVTKFLNLSSSPSMAVRIAALQCMHALTRLPTPVLLPYKPQVIRALAKPLDDKKRLVRKEAVSARGEWFLLGSPGS

SEQ ID NO: 904800 - protein, 800 aa, Homo sapiens
MALSYTILALLPYNYSAVLASTPRFAEFLLPLLIEKVDSEVLSAKLDSLQTLNACCAVYGQKELKDFLPSLWASIRREVFQTASERVEAEGLAALHSLTACLSRSVLRADAEDLLDSFLSNILQDCRHHLCEPDMKLVWPSAKLLQAAAGASARACDSVTSNVLPLLLEQFHKHSQSSQRRTILEMLLGFLKLQQKWSYEDKDQRPLNGFKDQLCSLVFMALTDPSTQLQLVGIRTLTVLGAQPDLLSYEDLELAVGHLYRLSFLKEDSQSCRVAALEASGTLAALYPVAFSSHLVPKLAEELRVGESNLTNGDEPTQCSRHLCCLQALSAVSTHPSIVKETLPLLLQHLWQVNRGNMVAQSSDVIAVCQSLRQMAEKCQQDPESCWYFHQTAIPCLLALAVQASMPEKEPSVLRKVLLEDEVLAAMVSVIGTATTHLSPELAAQSVTHIVPLFLDGNVSFLPENSFPSRFQPFQDGSSGQRRLIALLMAFVCSLPRNVEIPQLNQLMRELLELSCCHSCPFSSTAAAKCFAGLLNKHPAGQQLDEFLQLAVDKVEAGLGSGPCRSQAFTLLLWVTKALVLRYHPLSSCLTARLMGLLSDPELGPAAADGFSLLMSDCTDVLTRAGHAEVRIMFRQRFFTDNVPALVQGFHAAPQDVKPNYLKGLSHVLNRLPKPVLLPELPTLLSLLLEALSCPDCVVQLSTLSCLQPLLLEAPQVMSLHVDTLVTKFLNLSSSPSMAVRIAALQCMHALTRLPTPVLLPYKPQVIRALAKPLDDKKRLVRKEAVSARGEWFLLGSPGS

SEQ ID NO: 904801 - protein, 703 aa, Homo sapiens
DRRLGTRPGWWADAEDLLDSFLSNILQDCRHHLCEPDMKLVWPSAKLLQAAAGASARACDSVTSNVLPLLLEQFHKHSQSSQRRTILEMLLGFLKLQQKWSYEDKDQRPLNGFKDQLCSLVFMALTDPSTQLQLVGIRTLTVLGAQPDLLSYEDLELAVGHLYRLSFLKEDSQSCRVAALEASGTLAALYPVAFSSHLVPKLAEELRVGESNLTNGDEPTQCSRHLCCLQALSAVSTHPSIVKETLPLLLQHLWQVNRGNMVAQSSDVIAVCQSLRQMAEKCQQDPESCWYFHQTAIPCLLALAVQASMPEKEPSVLRKVLLEDEVLAAMVSVIGTATTHLSPELAAQSVTHIVPLFLDGNVSFLPENSFPSRFQPFQDGSSGQRRLIALLMAFVCSLPRNVEIPQLNQLMRELLELSCCHSCPFSSTAAAKCFAGLLNKHPAGQQLDEFLQLAVDKVEAGLGSGPCRSQAFTLLLWVTKALVLRYHPLSSCLTARLMGLLSDPELGPAAADGFSLLMSDCTDVLTRAGHAEVRIMFRQRFFTDNVPALVQGFHAAPQDVKPNYLKGLSHVLNRLPKPVLLPELPTLLSLLLEALSCPDCVVQLSTLSCLQPLLLEAPQVMSLHVDTLVTKFLNLSSSPSMAVRIAALQCMHALTRLPTPVLLPYKPQVIRALAKPLDDKKRLVRKEAVSARGEWFLLGSPGS

SEQ ID NO: 904802 - protein, 932 aa, Homo sapiens [sequence omitted]

SEQ ID NO: 904803 - protein, 666 aa, Homo sapiens; identical to SEQ ID NO: 904782

SEQ ID NO: 904804 - protein, 872 aa, Homo sapiens; identical to SEQ ID NO: 904781

SEQ ID NO: 904805 - protein, 564 aa, Homo sapiens
QAVGAGCPDLLSYEDLELAVGHLYRLSFLKEDSQSCRVAALEASGTLAALYPVAFSSHLVPKLAEELRVGESNLTNGDEPTQCSRHLCCLQALSAVSTHPSIVKETLPLLLQHLWQVNRGNMVAQSSDVIAVCQSLRQMAEKCQQDPESCWYFHQTAIPCLLALAVQASMPEKEPSVLRKVLLEDEVLAAMVSVIGTATTHLSPELAAQSVTHIVPLFLDGNVSFLPENSFPSRFQPFQDGSSGQRRLIALLMAFVCSLPRNVEIPQLNQLMRELLELSCCHSCPFSSTAAAKCFAGLLNKHPAGQQLDEFLQLAVDKVEAGLGSGPCRSQAFTLLLWVTKALVLRYHPLSSCLTARLMGLLSDPELGPAAADGFSLLMSDCTDVLTRAGHAEVRIMFRQRFFTDNVPALVQGFHAAPQDVKPNYLKGLSHVLNRLPKPVLLPELPTLLSLLLEALSCPDCVVQLSTLSCLQPLLLEAPQVMSLHVDTLVTKFLNLSSSPSMAVRIAALQCMHALTRLPTPVLLPYKPQVIRALAKPLDDKKRLVRKEAVSARGEWFLLGSPGS

SEQ ID NO: 904806 - protein, 719 aa, Homo sapiens
MRTREEELKSLGADFTFGFIQVMDGEKDPRNLLVAFRIVHDLISRDYSLGPFVEELFEVTSCYFPIDFTPPPNDPHGIQREDLILSLRAVLASTPRFAEFLLPLLIEKVDSEVLSAKLDSLQTLNACCAVYGQKELKDFLPSLWASIRREVFQTASERVEAEGLAALHSLTACLSRSVLRADAEDLLDSFLSNILQDCRHHLCEPDMKLVWPSAKLLQAAAGASARACDSVTSNVLPLLLEQFHKHSQSSQRRTILEMLLGFLKLQQKWSYEDKDQRPLNGFKDQLCSLVFMALTDPSTQLQLVGIRTLTVLGAQPDLLSYEDLELAVGHLYRLSFLKEDSQSCRVAALEASGTLAALYPVAFSSHLVPKLAEELRVGESNLTNGDEPTQCSRHLCCLQALSAVSTHPSIVKETLPLLLQHLWQVNRGNMVAQSSDVIAVCQSLRQMAEKCQQDPESCWYFHQTAIPCLLALAVQASMPEKEPSVLRKVLLEDEVLAAMVSVIGTATTHLSPELAAQSVTHIVPLFLDGNVSFLPENSFPSRFQPFQDGSSGQRRLIALLMAFVCSLPRNVEIPQLNQLMRELLELSCCHSCPFSSTAAAKCFAGLLNKHPAGQQLDEFLQLAVDKVEAGLGSGPCRSQAFTLLLWVTKALVLRYHPLSSCLTARVRPFWRQKNPGPKQTFWLLLFLPRTSILPCVFFVFFSFFFLETGSYSVTQAGVQ

SEQ ID NO: 904807 - protein, 293 aa, Homo sapiens [sequence omitted]

SEQ ID NO: 904808 - protein, 381 aa, Homo sapiens
MRTREEELKSLGADFTFGFIQVMDGEKDPRNLLVAFRIVHDLISRDYSLGPFVEELFEVTSCYFPIDFTPPPNDPHGIQREDLILSLRAVLASTPRFAEFLLPLLIEKVDSEVLSAKLDSLQTLNACCAVYGQKELKDFLPSLWASIRREVFQTASERVEAEGLAALHSLTACLSRSVLRADAEDLLDSFLSNILQDCRHHLCEPDMKLVWPSAKLLQAAAGASARACDSVTSNVLPLLLEQFHKHSQSSQRRTILEMLLGFLKLQQKWSYEDKDQRPLNGFKDQLCSLVFMALTDPSTQLQLVGIRTLTVLGAQPDLLSYEDLELAVGHLYRLSFLKEDSQSCRVAALEASGTLAALYPVAFSSHLVPKLAEELRVGMCL

SEQ ID NO: 904809 - protein, 137 aa, Homo sapiens
MRTREEELKSLGADFTFGFIQVMDGEKDPRNLLVAFRIVHDLISRDYSLGPFVEELFEVTSCYFPIDFTPPPNDPHGIQREDLILSLRAVLASTPRFAEFLLPLLIEKVDSEVLSAKLDSLQTLVSDFSSLQDPATF

SEQ ID NO: 904810 - protein, 108 aa, Homo sapiens [sequence omitted]

SEQ ID NO: 904811 - protein, 215 aa, Homo sapiens
QVVMRFNNSLLPTEPSQQLQAYVAWVNAQLKKRPAVKPVQDLRQDLRDGVILAYLIEIVAGEKLSGVQLSPGNQQEMKNNVEKVLQFVASKKIRMHQTSAKDIVDGNLKSIMRLVLALAAHFKPGSSRTVNQGRDSRAPLQSHRPHCATAVAQGAAAALADVCHDMSRSGRDVFRYRQRNSSMDEEIENPYWSVRALVQQYEGQQRSPSESSCSR

SEQ ID NO: 904812 - protein, 683 aa, Homo sapiens
MLACLTRGNLLDVLQEGFNEQQLQAYVAWVNAQLKKRPAVKPVQDLRQDLRDGVILAYLIEIVAGEKLSGVQLSPGNQQEMKNNVEKVLQFVASKKIRMHQTSAKDIVDGNLKSIMRLVLALAAHFKPGSSRTVNQGRDSRAPLQSHRPHCATAVAQGAAAALADVCHDMSRSGRDVFRYRQRNSSMDEEIENPYWSVRALVQQYEGQQRSPSESSCSSLTSPSPIHSAKSESIITQSEEKADFVIIPAEGIENRTEGTDSPLSRDWRPGSPGTYLETSWEEQLLEQQEYLEKEMEEAKKMISGLQALLLNGSLPEDEQERPLALCEPGVNPEEQLIIIQSRLDQSMEENQDLKKELLKCKQEARNLQGIKDALQQRLTQQDTSVLQLKQELLRANMDKDELHNQNVDLQRKLDERNRLLGEYKKELGQKDRLLQQHQAKLEEALRKLSDVSYHQVDLERELEHKDVLLAHCMKREADEATNYNSHNSQSNGFLLPTAGKGATSVSNRGTSDLQLVRDALRSLRNSFSGHDPQHHTIDSLEQGISSLMERLHVMETQKKQERKVRVKSPRTQVGSEYRESWPPNSKLPHSQSSPTVSSTCTKVLYFTDRSLTPFMVNIPKRLEEVTLKDFKAAIDREGNHRYHFKALDPEFGTVKEEIFHDDDAIPGWEGKIVAWVEEDHGEN

SEQ ID NO: 904813 - protein, 472 aa, Homo sapiens
MGGTQVKCLTSPSPIHSAKSESIITQSEEKADFVIIPAEGIENRTEGTDSPLSRDWRPGSPGTYLETSWEEQLLEQQEYLEKEMEEAKKMISGLQALLLNGSLPEDEQERPLALCEPGVNPEEQLIIIQSRLDQSMEENQDLKKELLKCKQEARNLQGIKDALQQRLTQQDTSVLQLKQELLRANMDKDELHNQNVDLQRKLDERNRLLGEYKKELGQKDRLLQQHQAKLEEALRKLSDVSYHQVDLERELEHKDVLLAHCMKREADEATNYNSHNSQSNGFLLPTAGKGATSVSNRGTSDLQLVRDALRSLRNSFSGHDPQHHTIDSLEQGISSLMERLHVMETQKKQERKVRVKSPRTQVGSEYRESWPPNSKLPHSQSSPTVSSTCTKVLYFTDRSLTPFMVNIPKRLEEVTLKDFKAAIDREGNHRYHFKALDPEFGTVKEEIFHDDDAIPGWEGKIVAWVEEDHGEN

SEQ ID NO: 904814 - protein, 596 aa, Homo sapiens
MLACLTRGNLLDVLQEGFNEQQLQAYVAWVNAQLKKRPAVKPVQDLRQDLRDGVILAYLIEIVAGEKLSGVQLSPGNQQEMKNNVEKVLQFVASKKIRMHQTSAKDIVDGNLKSIMRLVLALAAHFKPGSSRTVNQGRDSRAPLQSHRPHCATAVAQGAAAALADVCHDMSRSGRDVFRYRQRNSSMDEEIENPYWSVRALVQQYEGQQRSPSESSCSSLTSPSPIHSAKSESIITQSEEKADFVIIPAEGIENRTEGTDSPLSRDWRPGSPGTYLETSWEEQLLEQQEYLEKEMEEAKKMISGLQALLLNGSLPEDEQERPLALCEPGVNPEEQLIIIQSRLDQSMEENQDLKKELLKCKQEARNLQGIKDALQQRLTQQDTSVLQLKQELLRANMDKDELHNQNVDLQRKLDERNRLLGEYKKELGQKDRLLQQHQAKLEEALRKLSDVSYHQVDLERELEHKDVLLAHCMKREADEATNYNSHNSQSNGFLLPTAGKGATSVSNRGTSDLQLVRDALRSLRNSFSGHDPQHHTIDSLEQGISSLMERLHVMETQKKQERKVRVKSPRTQVGSEYRESWPPNSSKYPFLLSRDS

SEQ ID NO: 904815 - protein, 316 aa, Homo sapiens [sequence omitted]

SEQ ID NO: 904816 - protein, 132 aa, Homo sapiens
MELNLSHSAAPGFITDSAASSAGKKRARAEGGGGARVEIGKKRSPATSAWVITPAVGPRRRGRVGDTLTFYLGGRHPNLTVYILSFSRESCSIAGPSVSWLPCPPLHLPPKRRSVTSHMFHSGGGEREATIS

SEQ ID NO: 904817 - protein, 338 aa, Homo sapiens
MTTTLVSATIFDLSEVLCKGNKMLNYSAPSAGGCLLDRKAVGTPAGGGFPRRHSVTLPSSKFHQNQLLSSLKGEPAPALSSRDSRFRDRSFSEGGERLLPTQKQPGGGQVNSSRYKTELCRPFEENGACKYGDKCQFAHGIHELRSLTRHPKYKTELCRTFHTIGFCPYGPRCHFIHNAEERRALAGARDLSADRPRLQHSFSFAGFPSAAATAAATGLLDSPTSITPPPILSADDLLGSPTLPDGTNNPFAFSSQELASLFAPSMGLPGGGSPTTFLFRPMSESPHMFDSPPSPQDSLSDQEGYLSSSSSSHSGSDSPTLDNSRRLPIFSRLSISDD

SEQ ID NO: 904818 - protein, 338 aa, Homo sapiens; identical to SEQ ID NO: 904817

SEQ ID NO: 904819 - protein, 338 aa, Homo sapiens; identical to SEQ ID NO: 904817

SEQ ID NO: 904820 - protein, 338 aa, Homo sapiens; identical to SEQ ID NO: 904817

SEQ ID NO: 904821 - protein, 338 aa, Homo sapiens; identical to SEQ ID NO: 904817

SEQ ID NO: 904822 - protein, 338 aa, Homo sapiens; identical to SEQ ID NO: 904817

SEQ ID NO: 904823 - protein, 338 aa, Homo sapiens; identical to SEQ ID NO: 904817

SEQ ID NO: 904824 - protein, 140 aa, Homo sapiens
MTTTLVSATIFDLSEVLCKGNKMLNYSAPSAGGCLLDRKAVGTPAGGGFPRRHSVTLPSSKFHQNQLLSSLKGEPAPALSSRDSRFRDRSFSEGGERLLPTQKQPGGGQVNSSRYKTELCRPFEENGASLRILSRTRRAT

SEQ ID NO: 904825 - protein, 338 aa, Homo sapiens; identical to SEQ ID NO: 904817

SEQ ID NO: 904826 - protein, 338 aa, Homo sapiens; identical to SEQ ID NO: 904817

SEQ ID NO: 904827 - protein, 338 aa, Homo sapiens; identical to SEQ ID NO: 904817

SEQ ID NO: 904828 - protein, 132 aa, Homo sapiens; identical to SEQ ID NO: 904816

SEQ ID NO: 904829 - protein, 338 aa, Homo sapiens; identical to SEQ ID NO: 904817

SEQ ID NO: 904830 - protein, 397 aa, Homo sapiens
MNWHLPLFLLASVTLPSICSHFNPLSLEELGSNTGIQVFNQIVKSRPHDNIVISPHGIASVLGMLQLGADGRTKKQLAMVMRYGVNGVGKILKKINKAIVSKKNKDIVTVANAVFVKNASEIEVPFVTRNKDVFQCEVRNVNFEDPASACDSINAWVKNETRDMIDNLLSPDLIDGVLTRLVLVNAVYFKGLWKSRFQPENTKKRTFVAADGKSYQVPMLAQLSVFRCGSTSAPNDLWYNFIELPYHGESISMLIALPTESSTPLSAIIPHISTKTIDSWMSIMVPKRVQVILPKFTAVAQTDLKEPLKVLGITDMFDSSKANFAKITRSENLHVSHILQKAKIEVSEDGTKASAATTAILIARSSPPWFIVDRPFLFFIRHNPTGAVLFMGQINKP

SEQ ID NO: 904831 - protein, 397 aa, Homo sapiens; identical to SEQ ID NO: 904830

SEQ ID NO: 904832 - protein, 397 aa, Homo sapiens; identical to SEQ ID NO: 904830

SEQ ID NO: 904833 - protein, 397 aa, Homo sapiens; identical to SEQ ID NO: 904830

SEQ ID NO: 904834 - protein, 487 aa, Homo sapiens
GTSPGIPPATSHTPIRETHVQLGPGWRRTSGSARLPGAFRAQPHDTDPWRGGIREVAGGEGASWRPGAGTLRPAATQRRRREGGARRAGGGGGRRGGGPRGAADKAPAAAAASLRCGAARAARRLQAPPLPLSGCDPPRRRRFAASSDSPRRRDQAPAPVAAAPPSAAAPWGSSERGVGKILKKINKAIVSKKNKDIVTVANAVFVKNASEIEVPFVTRNKDVFQCEVRNVNFEDPASACDSINAWVKNETRDMIDNLLSPDLIDGVLTRLVLVNAVYFKGLWKSRFQPENTKKRTFVAADGKSYQVPMLAQLSVFRCGSTSAPNDLWYNFIELPYHGESISMLIALPTESSTPLSAIIPHISTKTIDSWMSIMVPKRVQVILPKFTAVAQTDLKEPLKVLGITDMFDSSKANFAKITRSENLHVSHILQKAKIEVSEDGTKASAATTAILIARSSPPWFIVDRPFLFFIRHNPTGAVLFMGQINKP

SEQ ID NO: 904835 - protein, 152 aa, Homo sapiens
MNWHLPLFLLASVTLPSICSHFNPLSLEELGSNTGIQVFNQIVKSRPHDNIVISPHGIASVLGMLQLGADGRTKKQLAMVMRYGVNGVGKILKKINKAIVSKKNKDIVTVANAVFVKNASEIEVPFVTYGNTYFKSKSQCVLNGCENILIYI

SEQ ID NO: 904836 - protein, 173 aa, Homo sapiens
VGLEDPMRDASINAWVKNETKDMIDNLLSPDLIDGVLTRLVLVNAVYFKGLWKSRFQPENTKKRTFVAADGKSYQVPMLAQLSVFRCGSTSAPNDLWYNFIELPYHGESISMLIALPTESSTPLSAIIPHISTKTIDSWMSIMVPKRVQVILPKFTAVAQTDLMEASRMGTEL

SEQ ID NO: 904837 - protein, 397 aa, Homo sapiens; identical to SEQ ID NO: 904830

SEQ ID NO: 904838 - protein, 345 aa, Homo sapiens
ARAERGSGGPADAAQPGDGRTKKQLAMVMRYGVNGVGKILKKINKAIVSKKNKDIVTVANAVFVKNASEIEVPFVTRNKDVFQCEVRNVNFEDPASACDSINAWVKNETRDMIDNLLSPDLIDGVLTRLVLVNAVYFKGLWKSRFQPENTKKRTFVAADGKSYQVPMLAQLSVFRCGSTSAPNDLWYNFIELPYHGESISMLIALPTESSTPLSAIIPHISTKTIDSWMSIMVPKRVQVILPKFTAVAQTDLKEPLKVLGITDMFDSSKANFAKITRSENLHVSHILQKAKIEVSEDGTKASAATTAILIARSSPPWFIVDRPFLFFIRHNPTGAVLFMGQINKP

SEQ ID NO: 904839 - protein, 111 aa, Homo sapiens
FLHFCFHARFTAVAQTDLKEPLKVLGITDMFDSSKANFAKITRSENLHVSHILQKAKIEVSEDGTKASAATTAILIARSSPPWFIVDRPFLFFIRHNPTGAVLFMGQINKP

SEQ ID NO: 904840 - protein, 232 aa, Homo sapiens
RYEPWYSPRHLTHPHPGDPRAAGPGLAPHLGVCASPRRVPGAAPRHGPLAGRHPRSRRRRGGVLEAGRGDAAARGHTKEAAGRRGKAGRGRGRQEGAGARAAPPIKPPPPRQPACAVGLPGLRGVCRRHRCLFPAVTLLAAAASLRPPTPRAAETRLPLRLRPHRPPRPPPGDPASAVVLGGRNHELASPPLPLGLCDAAFHLLPLQSSVSRGTRLQHGDPGFQSDCEVEAS

SEQ ID NO: 904841 - protein, 38 aa, Homo sapiens
MRERFFLALGFVERYNWNRRFHFFCSMSCRAWVPPEEL

SEQ ID NO: 904842 - protein, 85 aa, Homo sapiens
MRERFFLALGFVERYNWNRRLRSKGMRERFFLALGFMEWPNWNQRLRSNLKGKVRGSLELESEAAVSYDHTTAPQLWVTAQDPNA

SEQ ID NO: 904843 - protein, 202 aa, Homo sapiens
MEESMEEEEGGSYEAMMDDQNHNNWEAAVDGFRQPLPPPPPPSSIPAPAREPPGGQLLAVPAVSVDRKGPKEGLPMGPQPPPEANGVIMMLKSCDAAAAVAKAAPAPTASSTININTSTSKFLMNVITIEDYKSTYWPKLDGAIDQLLTQSPGDYIPISYEQIYSCVYKCVCQQHSEQMYSDLIKKITNHLERVSKELQVKN

SEQ ID NO: 904844 - protein, 176 aa, Homo sapiens
MEESMEEEEGGSYEAMMDDQNHNNWEAAVDGFRQPLPPPPPPSSIPAPAREPPGGQLLAVPAVSVDRKGPKEGLPMGPQPPPEANGVIMMLKSCDAAAAVAKAAPAPTASSTININTSTSKFLMNVITIEDYKSTYWPKLDGAIDQLLTQSPGDYIPISYEQIYRYKTVHAGWLSG

SEQ ID NO: 904845 - protein, 325 aa, Homo sapiens
MEESMEEEEGGSYEAMMDDQNHNNWEAAVDGFRQPLPPPPPPSSIPAPAREPPGGQLLAVPAVSVDRKGPKEGLPMGPQPPPEANGVIMMLKSCDAAAAVAKAAPAPTASSTININTSTSKFLMNVITIEDYKSTYWPKLDGAIDQLLTQSPGDYIPISYEQIYSCVYKCVCQQHSEQMYSDLIKKITNHLERVSKELQASPPDLYIERFNIALGQYMGALQSIVPLFIYMNKFYIETKLNRDLKDDLIKLFTEHVAEKHIYSLMPLLLEAQSTPFQVTPSTMANIVKGLYTLRPGKHFSFLLGLELFVTAFSKRAVVLYVFCEA

SEQ ID NO: 904846 - protein, 215 aa, Homo sapiens
MSACCIRLFYRVGGGEGGEQHSEQMYSDLIKKITNHLERVSKELQASPPDLYIERFNIALGQYMGALQSIVPLFIYMNKFYIETKLNRDLKDDLIKLFTEHVAEKHIYSLMPLLLEAQSTPFQVTPSTMANIVKGLYTLRPEWVQMAPTLFSKFIPNILPPAVESELSEYAAQDQKFQRELIQNGFTRGDQSRKRAGDELAYNSSSACASSRGYR

SEQ ID NO: 904847 - protein, 176 aa, Homo sapiens; identical to SEQ ID NO: 904844

SEQ ID NO: 904848 - protein, 103 aa, Homo sapiens
AAAAVAKAAPAPTASSTININTSTSKFCESSLSLQPWLFSTSLGRRIHPLLEKAPLPLFQASVFPLLPVRLRLPASFPLTVPSPSFGVCGQRLSGPGFLYYLA

SEQ ID NO: 904849 - protein, 369 aa, Homo sapiens
MEESMEEEEGGSYEAMMDDQNHNNWEAAVDGFRQPLPPPPPPSSIPAPAREPPGGQLLAVPAVSVDRKGPKEGLPMGPQPPPEANGVIMMLKSCDAAAAVAKAAPAPTASSTININTSTSKFLMNVITIEDYKSTYWPKLDGAIDQLLTQSPGDYIPISYEQIYSCVYKCVCQQHSEQMYSDLIKKITNHLERVSKELQASPPDLYIERFNIALGQYMGALQSIVPLFIYMNKFYIETKLNRDLKDDLIKLFTEHVAEKHIYSLMPLLLEAQSTPFQVTPSTMANIVKGLYTLRPEWVQMAPTLFSKFIPNILPPAVESELSEYAAQDQKFQRELIQNGFTRGDQSRKRAGDELAYNSSSACASSRGYR

SEQ ID NO: 904850 - protein, 176 aa, Homo sapiens; identical to SEQ ID NO: 904844

SEQ ID NO: 904851 - protein, 130 aa, Homo sapiens
MEESMEEEEGGSYEAMMDDQNHNNWEAAVDGFRQPLPPPPPPSSIPAPAREPPGGQLLAVPAVSVDRKGPKEGLPMGPQPPPEANGVIMMLKSCDAAAAVAKAAPAPTASSTININTSTSKFCQPSRSLY

SEQ ID NO: 904852 - protein, 255 aa, Homo sapiens
MEESMEEEEGGSYEAMMDDQNHNNWEAAVDGFRQPLPPPPPPSSIPAPAREPPGGQLLAVPAVSVDRKGPKEGLPMGPQPPPEANGVIMMLKSCDAAAAVAKAAPAPTASSTININTSTSKFLMNVITIEDYKSTYWPKLDGAIDQLLTQSPGDYIPISYEQIYSCVYKCVCQQHSEQMYSDLIKKITNHLERVSKELQASPPDLYIERFNIALGQYMGALQSIVPLFIYMVSKSSFLLPKYLGVLLRAQIDAES

SEQ ID NO: 904853 - protein, 420 aa, Homo sapiens
MAGPAFGATHFLPLHPSQVMAQLIKAHMTPKKNKKNPRLVLSVEIARPLGRAGAPVGGRGAPGSLLDWRHEPPTGVVGLGSPFGGLGLCAHRLVWPCVTRAAQAATLVKLLVAKILCMVGVFFFMLLGSLLPVKIIETDFEKAHRSKKILSLCNTFGGGVFLATCFNALLPAVREKLQKVLSLGHISTDYPLAETILLLGFFMTVFLEQLILTFRKEKPSFIDLETFNAGSDVGSDSEYESPFMGGARGHALYVEPHGHGPSLSVQGLSRASPVRLLSLAFALSAHSVFEGLALGLQEEGEKVVSLFVGVAVHETLVAVALGISMARSAMPLRDAAKLAVTVSAMIPLGIGLGLGIESAQGVPGSVASVLLQGLAGGTFLFITFLEILAKELEEKSDRLLKVLFLVLGYTVLAGMVFLKW

SEQ ID NO: 904854 - protein, 75 aa, Homo sapiens
TRPPTRRGTRGSTHASGKMAEVEQKKKRTFRKFTYRGVDLDQLLDMSYEQLMQLYSARQRRRLEPGPAAEAALPC

SEQ ID NO: 904855 - protein, 70 aa, Homo sapiens
NVRLYWSESLDVKMAEVEQKKKRTFRKFTYRGVDLDQLLDMSYEQLMQLYSARQRRRLEPGPAAEAALPC

SEQ ID NO: 904856 - protein, 70 aa, Homo sapiens
EASRGWGESDEGKMAEVEQKKKRTFRKFTYRGVDLDQLLDMSYEQLMQLYSARQRRRLEPGPAAEAALPC

SEQ ID NO: 904857 - protein, 43 aa, Homo sapiens
MWRWFYNVRELALVLPSLFALRTSPFADGVIPRGPTVGFPSCP

SEQ ID NO: 904858 - protein, 351 aa, Homo sapiens
MSLQLVWWGSVAHSGDLGCAPTDWFGPAVTRAAQAATLVKLLVAKILCMVGVFFFMLLGSLLPVKIIETDFEKAHRSKKILSLCNTFGGGVFLATCFNALLPAVREKLQKVLSLGHISTDYPLAETILLLGFFMTVFLEQLILTFRKEKPSFIDLETFNAGSDVGSDSEYESPFMGGARGHALYVEPHGHGPSLSVQGLSRASPVRLLSLAFALSAHSVFEGLALGLQEEGEKVVSLFVGVAVHETLVAVALGISMARSAMPLRDAAKLAVTVSAMIPLGIGLGLGIESAQGVPGSVASVLLQGLAGGTFLFITFLEILAKELEEKSDRLLKVLFLVLGYTVLAGMVFLKW

SEQ ID NO: 904859 - protein, 47 aa, Homo sapiens
MGNAPTTGAGQHWRTTLHEYTLGASQFQCIVANPGIFAENCPRTVEI

SEQ ID NO: 904860 - protein, 76 aa, Homo sapiens
RRHHFRLLHGRRSFLALLQALQPEVVKTHLRDMIILPEMVGSMVGVYNGKTFNQVEIKPEMIGHYLGRVLHHLTSP

SEQ ID NO: 904861 - protein, 72 aa, Homo sapiens
FKTPFYYYYYYYYAAKTTEGALLRIRQDGRSRAEEEADLPQVHLPRRGPRPAAGHVLRAADAAVQCAPAAAA

SEQ ID NO: 904862 - protein, 103 aa, Homo sapiens
MLCKVFFVRNSRFFEEMTTNFGFLLLCENIRPQQHVIVEGKIKVRKMAEVEQKKKRTFRKFTYRGVDLDQLLDMSYEQLMQLYSARQRRRLEPGPAAEAALPC

SEQ ID NO: 904863 - protein, 47 aa, Homo sapiens; identical to SEQ ID NO: 904859

SEQ ID NO: 904864 - protein, 71 aa, Homo sapiens
RKRGNQARNEAGCEMAEVEQKKKRTFRKFTYRGVDLDQLLDMSYEQLMQLYSARQRRRLEPGPAAEAALPC

SEQ ID NO: 904865 - protein, 47 aa, Homo sapiens; identical to SEQ ID NO: 904859

SEQ ID NO: 904866 - protein, 82 aa, Homo sapiens
RSNIRMVSSTPLLKRLRKAKKEAPPMEKPEVVKTHLRDMIILPEMVGSMVGVYNGKTFNQVEIKPEMIGHYLGRVLHHLTSP

SEQ ID NO: 904867 - protein, 109 aa, Homo sapiens
MEKPEVVKTHLRDMIILPEMVGSMVGVYNGKTFNQVEIKVCAAVPAGWGGLGSLMQAGSADTQLCSWSPAARDDRPLPGASSPSPYKPVKQWPARHSGPPTSSRFIPLK

SEQ ID NO: 904868 - protein, 176 aa, Homo sapiens
MEKPEVVKTHLRDMIILPEMVGSMVGVYNGKTITLQARKAMAGPAFGATHFLPLHPSQVMAQLIKAHMTPVLCAACSSWRPELWEGPGPASGSWCEEVQVGRSGVCGSVVWMVSWCRRLTAVRALPQLGCPCSCLQGQLWSWVPKPRCVAPSLLAPSAFLTSGQLPGLTLSSGYLT

SEQ ID NO: 904869 - protein, 138 aa, Homo sapiens
AGLIGRGDGRSRAEEEADLPQVHLPRRGPRPAAGHVLVGLELLGSSDPPASTSRSAGITGGSHCALPAFPCVFRGLWPELYAAAPCLRLWSPGRLFSLNLCSHTVALACEGEQLMQLYSARQRRRLEPGPAAEAALPC

SEQ ID NO: 904870 - protein, 66 aa, Homo sapiens
TLGKVRGWVWAEVEQKKKRTFRKFTYRGVDLDQLLDMSYEQLMQLYSARQRRRLEPGPAAEAALPC

SEQ ID NO: 904871 - protein, 73 aa, Homo sapiens
SHLKQLTPLVRIRHEEMAEVEQKKKRTFRKFTYRGVDLDQLLDMSYEQLMQLYSARQRRRLEPGPAAEAALPC

SEQ ID NO: 904872 - protein, 67 aa, Homo sapiens
GWYGRKFWIKMAEVEQKKKRTFRKFTYRGVDLDQLLDMSYEQLMQLYSARQRRRLEPGPAAEAALPC

SEQ ID NO: 904873 - protein, 73 aa, Homo sapiens; identical to SEQ ID NO: 904871

SEQ ID NO: 904874 - protein, 77 aa, Homo sapiens
DMSYEQLMQLYSVPAAEAPPMEKPEVVKTHLRDMIILPEMVGSMVGVYNGKTFNQVEIKPEMIGHYLGRVLHHLTSP

SEQ ID NO: 904875 - protein, 108 aa, Homo sapiens
DLGLSLFTLPCISRVNLLKKRLIGHGSAGLYRKHSSICFWGGPQGASSHTLRAEVEQKKKRTFRKFTYRGVDLDQLLDMSYEQLMQLYSARQRRRLEPGPAAEAALPC

SEQ ID NO: 904876 - protein, 108 aa, Homo sapiens; identical to SEQ ID NO: 904875

SEQ ID NO: 904877 - protein, 136 aa, Homo sapiens
MAGPAFGATHFLPLHPSQVMAQLIKAHMTPVLCAACSSWRPELWEGPGPASGSWCEEVQVGRSGVCGSVVWMVSWCRRLTAVRALPQLGCPCSCLQGQLWSWVPKPRCVAPSLLAPSAFLTSGQLPGLTLSSGYLT

SEQ ID NO: 904878 - protein, 47 aa, Homo sapiens; identical to SEQ ID NO: 904859

SEQ ID NO: 904879 - protein, 109 aa, Homo sapiens; identical to SEQ ID NO: 904867

SEQ ID NO: 904880 - protein, 152 aa, Homo sapiens
MEKPEVVKTHLRDMIILPEMVGSMVGVYNGKTFNQVEIKPEIDSATTLGEFSNSTLTKRPPGVKKKANLGPGPPGNRGPTPTSFPRFIPLLPKRVLKLGGGVSQGAFALQEGAGDLIEPSPKRRHNTKKNKICPKGRHLYHVVAGRWTGERQ

SEQ ID NO: 904881 - protein, 72 aa, Homo sapiens; identical to SEQ ID NO: 904861

SEQ ID NO: 904882 - protein, 70 aa, Homo sapiens
WCGSGYGEGSGGEGVSDRVGEALGKAGPRGAAARGDRSHSSRRRRQQSAHCLQQINIKIGSLCLLLDIGN

SEQ ID NO: 904883 - protein, 490 aa, Homo sapiens
MATEFIKSCCGGCFYGETEKHNFSVERDFKAAVPNSQNATISVPPLTSVSVKPQLGCTEDYLLSKLPSDGKEVPFVVPKFKLSYIQPRTQETPSHLEELEGSARASFGDRKVELSSSSQHGPSYDVYNPFYMYQHISPDLSRRFPPRSEVTRLYGSVCDLRTNKLPGSPGLSKSMFDLTNSSQRFIQRHDSLSSVPSSSSSRKNSQGSNRSLDTITLSGDERDFGRLNVKLFYNSSVEQIWITVLQCRDLSWPSSYGDTPTVSIKGILTLPKPVHFKSSAKEGSNAIEFMETFVFAIKLQNLQTVRLVFKIQTQTPRKKTIGECSMSLRTLSTQEMDYSLDITPPSKISVCHAELELGTCFQAVNSRIQLQILEARYLPSSSTPLTLSFFVKVGMFSSGELIYKKKTRLLKASNGRVKWGETMIFPLIQSEKEIVFLIKLYSRSSVRRKHFVGQIWISEDSNNIEAVNQWKETVINPEKVVIRWHKLNPS

SEQ ID NO: 904884 - protein, 484 aa, Homo sapiens
MATEFIKSCCGGCFYGETEKHNFSVERDFKAAVPNSQNATISVPPLTSVSVKPQLGCTEDYLLSKLPSDGKEVPFVVPKFKLSYIQPRTQETPSHLEELEGSARASFGDRKVELSSSSQHGPSYDVYNPFYMYQHISPDLSRRFPPRSEVTRLYGSVCDLRTNKLPGSPGLSKSMFDLTNSSQRFIQRHDSLSSVPSSSSSRKNSQGSNRSLGDERDFGRLNVKLFYNSSVEQIWITVLQCRDLSWPSSYGDTPTVSIKGILTLPKPVHFKSSAKEGSNAIEFMETFVFAIKLQNLQTVRLVFKIQTQTPRKKTIGECSMSLRTLSTQEMDYSLDITPPSKISVCHAELELGTCFQAVNSRIQLQILEARYLPSSSTPLTLSFFVKVGMFSSGELIYKKKTRLLKASNGRVKWGETMIFPLIQSEKEIVFLIKLYSRSSVRRKHFVGQIWISEDSNNIEAVNQWKETVINPEKVVIRWHKLNPS

SEQ ID NO: 904885 - protein, 490 aa, Homo sapiens; identical to SEQ ID NO: 904883

SEQ ID NO: 904886 - protein, 103 aa, Homo sapiens [sequence omitted]

SEQ ID NO: 904887 - protein, 138 aa, Homo sapiens
MESPLIYVSVLLLNIFEFSSGIVYNKDDTEKRFACSNKGFPQENEIIKLYLFLENLKIQCFFQTENEIASKAMLSVFTSGGLAPSLGIMNSTYNGIFHFNLTLFSDRILWLVDIPRENITQSTDIAAVEEWLVRITLH

SEQ ID NO: 904888 - protein, 490 aa, Homo sapiens; identical to SEQ ID NO: 904883

SEQ ID NO: 904889 - protein, 276 aa, Homo sapiens
LVLEVSIAPSLEVSIVLVLEVSIAQIWITVLQCRDLSWPSSYGDTPTVSIKGILTLPKPVHFKSSAKEGSNAIEFMETFVFAIKLQNLQTVRLVFKIQTQTPRKKTIGECSMSLRTLSTQEMDYSLDITPPSKISVCHAELELGTCFQAVNSRIQLQILEARYLPSSSTPLTLSFFVKVGMFSSGELIYKKKTRLLKASNGRVKWGETMIFPLIQSEKEIVFLIKLYSRSSVRRKHFVGQIWISEDSNNIEAVNQWKETVINPEKVVIRWHKLNPS

SEQ ID NO: 904890 - protein, 70 aa, Homo sapiens; identical to SEQ ID NO: 904882

SEQ ID NO: 904891 - protein, 701 aa, Homo sapiens
VKVMVDSGDRKRAISSVCTYIVYQCSRPAPLHSRDLHSMIVAAFQCLCVWLTEHPDMLDEKDCLKEVLEIVELGISGSKSKNNEQEVKYKGDKEPNPASMRVKDAAEATLTCIMQLLGAFPSPSGPASPCSLVNETTLIKYSRLPTINKHSFRYFVLDNSVILAMLEQPLGNEQNDFFPSVTVLVRGMSGRLAWAQQLCLLPRGAKANQKLFVPEPRPVPKNDVGFKYSVKHRPFPEEVDKIPFVKADLSIPDLHEIVTEELEERHEKLRSGMAQQIAYEIHLEQQSEEELQKRSFPDPVTDCKPPPPAQEFQTARLFLSHFGFLSLEALKEPANSRLPPHLIALDSTIPGFFDDIGYLDLLPCRPFDTVFIFYMKPGQKTNQEILKNVESSRTVQPHFLEFLLSLGWSVDVGRHPGWTGHVSTSWSINCCDDGEGSQQEVISSEDIGASIFNGQKKVLYYADALTEIAFVVPSPVESLTDSLESNISDQDSDSNMDLMPGILKQPSLTLELFPNHTDNLNSSQRLSPSSRMRKLPQGRPVPPLGPETRVSVVWVERYDDIENFPLSELMTEISTGVETTANSSTSLRSTTLEKEVPVIFIHPLNTGLFRIKIQGATGKFNMVIPLVDGMIVSRRALGFLVRQTVINICRRKRLESDSYSPPHVRRKQKITDIVNKYRNKQLEPEFYTSLFQEVGLKNCSS

SEQ ID NO: 904892 - protein, 215 aa, Homo sapiens
ENRCPLLAAASVVEFILKQPSLTLELFPNHTDNLNSSQRLSPSSRMRKLPQGRPVPPLGPETRVSVVWVERYDDIENFPLSELMTEISTGVETTANSSTSLRSTTLEKEVPVIFIHPLNTGLFRIKIQGATGKFNMVIPLVDGMIVSRRALGFLVRQTVINICRRKRLESDSYSPPHVRRKQKITDIVNKYRNKQLEPEFYTSLFQEVGLKNCSS

SEQ ID NO: 904893 - protein, 701 aa, Homo sapiens; identical to SEQ ID NO: 904891

SEQ ID NO: 904894 - protein, 701 aa, Homo sapiens; identical to SEQ ID NO: 904891

SEQ ID NO: 904895 - protein, 701 aa, Homo sapiens; identical to SEQ ID NO: 904891

SEQ ID NO: 904896 - protein, 261 aa, Homo sapiens
VKVMVDSGDRKRAISSVCTYIVYQCSRPAPLHSRDLHSMIVAAFQCLCVWLTEHPDMLDEKDCLKEVLEIVELGISGSKSKNNEQEVKYKGDKEPNPASMRVKDAAEATLTCIMQLLGAFPSPSGPASPCSLVNETTLIKYSRLPTINKHSFRYFVLDNSVILAMLEQPLGNEQNDFFPSVTVLVRGMSGRLAWAQQLCLLPRGAKANQKLFVPEPRPVPKNDVGFKYSVKHRPFPEEVDKIPFVKADLSIPDLHEIVTEE

SEQ ID NO: 904897 - protein, 701 aa, Homo sapiens; identical to SEQ ID NO: 904891

SEQ ID NO: 904898 - protein, 261 aa, Homo sapiens; identical to SEQ ID NO: 904896

SEQ ID NO: 904899 - protein, 701 aa, Homo sapiens; identical to SEQ ID NO: 904891

SEQ ID NO: 904900 - protein, 701 aa, Homo sapiens; identical to SEQ ID NO: 904891

SEQ ID NO: 904901 - protein, 91 aa, Homo sapiens
MAANATTNPSQLLPLELVDKCIGSRIHIVMKSDKEIVGTLLGFDDFVNMVLEDVTEFEITPEGRRITKLDQILLNGNNITMLVPGGEGPEV

SEQ ID NO: 904902 - protein, 91 aa, Homo sapiens; identical to SEQ ID NO: 904901

SEQ ID NO: 904903 - protein, 78 aa, Homo sapiens
LLVLFGYVLCLLVWFSFRACVLFCASFSVSRSGMVALLVLSVFSVSLVCCSSVHTAVLVVASFVLFLSLLAPLVVWVL

SEQ ID NO: 904904 - protein, 91 aa, Homo sapiens; identical to SEQ ID NO: 904901

SEQ ID NO: 904905 - protein, 94 aa, Homo sapiens
YVTRAAGLAEPVVSAGPGELVDKCIGSRIHIVMKSDKEIVGTLLGFDDFVNMVLEDVTEFEITPEGRRITKLDQILLNGNNITMLVPGGEGPEV

SEQ ID NO: 904906 - protein, 94 aa, Homo sapiens; identical to SEQ ID NO: 904905

SEQ ID NO: 904907 - protein, 78 aa, Homo sapiens; identical to SEQ ID NO: 904903

SEQ ID NO: 904908 - protein, 91 aa, Homo sapiens; identical to SEQ ID NO: 904901

SEQ ID NO: 904909 - protein, 78 aa, Homo sapiens; identical to SEQ ID NO: 904903

SEQ ID NO: 904910 - protein, 94 aa, Homo sapiens; identical to SEQ ID NO: 904905

SEQ ID NO: 904911 - protein, 101 aa, Homo sapiens
TVSLFLLLILFLFAATTNPSQLLPLELVDKCIGSRIHIVMKSDKEIVGTLLGFDDFVNMVLEDVTEFEITPEGRRITKLDQILLNGNNITMLVPGGEGPEV

SEQ ID NO: 904912 - protein, 101 aa, Homo sapiens; identical to SEQ ID NO: 904911

SEQ ID NO: 904913 - protein, 91 aa, Homo sapiens; identical to SEQ ID NO: 904901

SEQ ID NO: 904914 - protein, 91 aa, Homo sapiens; identical to SEQ ID NO: 904901

SEQ ID NO: 904915 - protein, 102 aa, Homo sapiens
SGKRVEEEREEEEGGGGAVAEEQEQEGDGEEKVLGGMALLLLQALPSPLSARAEPPQDKEACVGTNNQSYICDTGHCCGQSQCQHPATWQSNQGRGEPREKH

SEQ ID NO: 904916 - protein, 390 aa, Homo sapiens
SGKRVEEEREEEEGGGGAVAEEQEQEGDGEEKVLGGMALLLLQALPSPLSARAEPPQDKEACVGTNNQSYICDTGHCCGQSQCCNYYYELWWFWLVWTIIIILSCCCVCHHRRAKHRLQAQQRQHEINLIAYREAHNYSALPFYFRFLPNYLLPPYEEVVNRPPTPPPPYSAFQLQQQQLLPPQCGPAGGSPPGIDPTRGSQGAQSSPLSEPSRSSTRPPSIADPDPSDLPVDRAATKAPGMEPSGSVAGLGELDPGAFLDKDAECREELLKDDSSEHGAPDSKEKTPGRHRRFTGDSGIEVCVCNRGHHDDDLKEFNTLIDDALDGPLDFCDSCHVRPPGDEEEGLCQPSEEQAREPGHPHLPRPPACLLLNTINEQDSPNSQSSSSPS

SEQ ID NO: 904917 - protein, 390 aa, Homo sapiens; identical to SEQ ID NO: 904916

SEQ ID NO: 904918 - protein, 390 aa, Homo sapiens; identical to SEQ ID NO: 904916

SEQ ID NO: 904919 - protein, 115 aa, Homo sapiens
LVGAGSGGRGGAWGLGPGARAWGAGGRPLPTPGAPRPAARLTEGQGALFCAAGGLLGGGPLEEAKTARGVRPLKSPASPARPACGGCGGYTAGRAGAFRLPVFKVETSRTSLLDV

SEQ ID NO: 904920 - protein, 386 aa, Homo sapiens
MADHSFSDGVPSDSVEAAKNASNTEKLTDQVMQNPRVLAALQERLDNVPHTPSSYIETLPKAVKRRINALKQLQVRCAHIEAKFYEEVHDLERKYAALYQPLFDKRREFITGDVEPTDAESEWHSENEEEEKLAGDMKSKVVVTEKAAATAEEPDPKGIPEFWFTIFRNVDMLSELVQEYDEPILKHLQDIKVKFSDPGQPMSFVLEFHFEPNDYFTNSVLTKTYKMKSEPDKADPFSFEGPEIVDCDGCTIDWKKGKNVTVKTIKKKQKHKGRGTVRTITKQVPNESFFNFFNPLKASGDGESLDEDSEFTLASDFEIGHFFRERIVPRAVLYFTGEAIEDDDNFEEGEEGEEEELEGDEEGEDEDDAEINPKKEPSQPAECKQQ

SEQ ID NO: 904921 - protein, 386 aa, Homo sapiens; identical to SEQ ID NO: 904920

SEQ ID NO: 904922 - protein, 386 aa, Homo sapiens; identical to SEQ ID NO: 904920

SEQ ID NO: 904923 - protein, 386 aa, Homo sapiens; identical to SEQ ID NO: 904920

SEQ ID NO: 904924 - protein, 362 aa, Homo sapiens
MADHSFSDGVPSDSVEAAKNASNTEKLTDQVMQNPRVLAALQERLDNVPHTPSSYIETLPKAVKRRINALKQLQVRCAHIEAKFYEEVHDLERKYAALYQPLFDKRREFITGDVEPTDAESEWHSENEEEEKLAGDMKSKVVVTEKAAATAEEPDPKGIPEFWFTIFRNVDMLSELVQSFVLEFHFEPNDYFTNSVLTKTYKMKSEPDKADPFSFEGPEIVDCDGCTIDWKKGKNVTVKTIKKKQKHKGRGTVRTITKQVPNESFFNFFNPLKASGDGESLDEDSEFTLASDFEIGHFFRERIVPRAVLYFTGEAIEDDDNFEEGEEGEEEELEGDEEGEDEDDAEINPKKEPSQPAECKQQ

SEQ ID NO: 904925 - protein, 362 aa, Homo sapiens; identical to SEQ ID NO: 904924

SEQ ID NO: 904926 - protein, 386 aa, Homo sapiens; identical to SEQ ID NO: 904920

SEQ ID NO: 904927 - protein, 107 aa, Homo sapiens [sequence omitted]

SEQ ID NO: 904928 - protein, 346 aa, Homo sapiens [sequence omitted]

SEQ ID NO: 904929 - protein, 429 aa, Homo sapiens
MADHSFSDGVPSDSVEAAKNASNTEKLTDQVMQNPRVLAALQERLDNVPHTPSSYIETLPKAVKRRINALKQLQVRCAHIEAKFYEEVHDLERKYAALYQPLFDKRREFITGDVEPTDAESEWHSENEEEEKLAGDMKSKVVVTEKAAATAEEPDPKGIPEFWFTIFRNVDMLSELVQEYDEPILKHLQDIKVKFSDPGQPMSFVLEFHFEPNDYFTNSVLTKTYKMKSEPDKADPFSFEGPEIVDCDGCTIDWKKGKNVTVKTIKKKQKHKGRGTVRTITKQVPNESFFNFFNPLKASGDGESLFPKAVKRRINALKQLQVRCAHIEAKFYEEVHDLERKYAVPFRFRICWFNIAGDKFSSRAEFGTRGSGTGHGQVATPDPWLFTAGCLRTFLTLAVCFVCTLFFSLGLVFFFHLEIAFPDRRTQVV

SEQ ID NO: 904930 - protein, 306 aa, Homo sapiens
MADHSFSDGVPSDSVEAAKNASNTEKLTDQVMQNPRVLAALQERLDNVPHTPSSYIETLPKAVKRRINALKQLQVRCAHIEAKFYEEVHDLERKYAALYQPLFDKRREFITGDVEPTDAESEWHSENEEEEKLAGDMKSKVVVTEKAAATAEEPDPKGIPEFWFTIFRNVDMLSELVQEYDEPILKHLQDIKVKFSDPGQPMSFVLEFHFEPNDYFTNSVLTKTYKMKSEPDKADPFSFEGPEIVDCDGCTIDWKKGKNVTVKTIKKKQKHKGRGTVRTITKQVPNESFFNFFNPLKASGDGESLG

SEQ ID NO: 904931 - protein, 344 aa, Homo sapiens
MADHSFSDGVPSDSVEAAKNASNTEKLTDQVMQNPRVLAALQERLDNVPHTPSSYIETLPKAVKRRINALKQLQVRCAHIEAKFYEEVHDLERKYAALYQPLFDKRREFITGDVEPTDAESEWHSENEEEEKLAGDMKSKVVVTEKAAATAEEPDPKGIPEFWFTIFRNVDMLSELVQEYDEPILKHLQDIKVKFSDPGQPMSFVLEFHFEPNDYFTNSVLTKTYKMKSEPDKADPFSFEGPEIVDCDGCTIDWKKGKNVTVKTIKKKQKHKGRGTVRTITKQVPNESFFNFFNPLKASGDGESLVRFVVNSLIFLLKSLLSECLLVYLLKKVQSWLCVDWVCQ

SEQ ID NO: 904932 - protein, 375 aa, Homo sapiens
MADHSFSDGVPSDSVEAAKNASNTEKLTDQVMQNPRVLAALQERLDNVPHTPSSYIETLPKAVKRRINALKQLQVRCAHIEAKFYEEVHDLERKYAALYQPLFDKRREFITGDVEPTDAESEWHSENEEEEKLAGDMKSKVVVTEKAAATAEEPDPKGIPEFWFTIFRNVDMLSELVQEYDEPILKHLQDIKVKFSDPGQPMSFVLEFHFEPNDYFTNSVLTKTYKMKSEPDKADPFSFEGPEIVDCDGCTIDWKKGKNVTVKTIKKKQKHKGRGTVRTITKQVPNESFFNFFNPLKASGDGESLDEDSEFTLASDFEIGHFFRERIVPRAVLYFTGEAIEDDDNFEEGEEGEEEELEGDEEGEDEDDAEINPKV

SEQ ID NO: 904933 - protein, 76 aa, Homo sapiens
LIEDSQVTTQRNERSEWSFFNFFNPLKASGDGESLDEDSEFTLASDFEIGHFFRERIVPRAVLYFTGEAIEDDDNV

SEQ ID NO: 904934 - protein, 386 aa, Homo sapiens; identical to SEQ ID NO: 904920

SEQ ID NO: 904935 - protein, 386 aa, Homo sapiens; identical to SEQ ID NO: 904920

SEQ ID NO: 904936 - protein, 377 aa, Homo sapiens
MADHSFSDGVPSDSVEAAKNASNTEKLTDQVMQNPRVLAALQERLDNVPHTPSSYIETLPKAVKRRINALKQLQVRCAHIEAKFYEEVHDLERKYAALYQPLFDKRREFITGDVEPTDAESEWHSENEEEEKLAGDMKSKVVVTEKAAATAEEPDPKGIPEFWFTIFRNVDMLSELVQEYDEPILKHLQDIKVKFSDPGQPMSFVLEFHFEPNDYFTNSVLTKTYKMKSEPDKADPFSFEGPEIVDCDGCTIDWKKGKNVTVKTIKKKQKHKGRGTVRTITKQVPNESFFNFFNPLKASGDGESLDEDSEFTLASDFEIGHFFRERIVPRAVLYFTGEAIEDDDNFEEGEEGEEEELEGDEEGEDEDDAEINPKTPQ

SEQ ID NO: 904937 - protein, 398 aa, Homo sapiens
MADHSFSDGVPSDSVEAAKNASNTEKLTDQVMQNPRVLAALQERLDNVPHTPSSYIETHEDVVFLTPFFSLPKAVKRRINALKQLQVRCAHIEAKFYEEVHDLERKYAALYQPLFDKRREFITGDVEPTDAESEWHSENEEEEKLAGDMKSKVVVTEKAAATAEEPDPKGIPEFWFTIFRNVDMLSELVQEYDEPILKHLQDIKVKFSDPGQPMSFVLEFHFEPNDYFTNSVLTKTYKMKSEPDKADPFSFEGPEIVDCDGCTIDWKKGKNVTVKTIKKKQKHKGRGTVRTITKQVPNESFFNFFNPLKASGDGESLDEDSEFTLASDFEIGHFFRERIVPRAVLYFTGEAIEDDDNFEEGEEGEEEELEGDEEGEDEDDAEINPKKEPSQPAECKQQ

SEQ ID NO: 904938 - protein, 116 aa, Homo sapiens
LIEDSQVTTQRNERSEWSFFNFFNPLKASGDGESLDEDSEFTLASDFEIGHFFRERIVPRAVLYFTGEAIEDDDNFEEGEEGEEEELEGDEEGEDEDDAEINPKKEPSQPAECKQQ

SEQ ID NO: 904939 - protein, 107 aa, Homo sapiens [sequence omitted]

SEQ ID NO: 904940 - protein, 360 aa, Homo sapiens
MADHSFSDGVPSDSVEAAKNASNTEKLTDQVMQNPRVLAALQERLDNVPHTPSSYIETLPKAVKRRINALKQLQVRCAHIEAKFYEEVHDLERKYAALYQPLFDKRREFITGDVEPTDAESEWHSENEEEEKLAGDMKSKVVVTEKAAATAEEPDPKGIPEFWFTIFRNVDMLSELVQEYDEPILKHLQDIKVKFSDPGQPMSFVLEFHFEPNDYFTNSVLTKTYKMKSEPDKADPFSFEGPEIVDCDGCTIDWKKGKNVTVKTIKKKQKHKGRGTVRTITKQVPNESFFNFFNPLKASGDGESLDEDSEFTLASDFEIGHFFRERIVPRAVLYFTGEAIEDDDNFEEGDSVQSKPEPPG

SEQ ID NO: 904941 - protein, 303 aa, Homo sapiens
MADHSFSDGVPSDSVEAAKNASNTEKLTDQVMQNPRVLAALQERLDNVPHTPSSYIETLPKAVKRRINALKQLQVRCAHIEAKFYEEVHDLERKYAALYQPLFDKRREFITGDVEPTDAESEWHSENEEEEKLAGDMKSKVVVTEKAAATAEEPDPKGIPEFWFTIFRNVDMLSELVQEYDEPILKHLQDIKVKFSDPGQPMSFVLEFHFEPNDYFTNSVLTKTYKMKSEPDKADPFSFEGPEIVDCDGCTIDWKKGKNVTVKTIKKKQKHKGRGTVRTITKQVPNESFFNFFNPLKGKSVGC

SEQ ID NO: 904942 - protein, 604 aa, Homo sapiens
MADHSFSDGVPSDSVEAAKNASNTEKLTDQVMQNPRVLAALQERLDNVPHTPSSYIETLPKAVKRRINALKQLQVRCAHIEAKFYEEVHDLERKYAALYQPLFDKRREFITGDVEPTDAESEWHSENEEEEKLAGDMKSKVVVTEKAAATAEEPDPKGIPEFWFTIFRNVDMLSELVQEYDEPILKHLQDIKVKFSDPGQPMSFVLEFHFEPNDYFTNSVLTKTYKMKSEPDKADPFSFEGPEIVDCDGVYYGLEKRTNVPVQPSEKPNLWSSLVTLATVPRSLHLNLKRGKHGEIILPLKKPHRNPDACGRTKKKEHTKCENPKCDGVKLYSMTKAKNTTDTTTSHRSHDSNNPPTHNTTNNNKQMLTTTPPHTPHNQTTRRTKGRAQGTRSRQPARRTAAAHEEEKKTRADDRHSNSEQKERRRREEGSTGKKKRGRTEDREEEKRGRTRGGKGRPGRRRTHRTRRRSPTSKETPADERAGAPTTPRRTTTQSHNRRPSETTQDKHNQGEAAATKQRGKEEKRRERGERRARRNRQAKRARRTKKRRGTDTRTHGREAREQTRERHERAKKTTRGTEESRNENKAGRGKTTRPGQTKEQRGQ

SEQ ID NO: 904943 - protein, 296 aa, Homo sapiens [sequence omitted]

SEQ ID NO: 904944 - protein, 296 aa, Homo sapiens [sequence omitted]

SEQ ID NO: 904945 - protein, 230 aa, Homo sapiens
VLTGSYLYPDPNLKYGFNEGHSFRRQYKPLSLNRLQYLIDLGRVDPSQPIDLTQLVNGRGVTIQPLKRDYGVQLVEEGADTFTAKVNIEVQLASELAIAAIEKNGGVVTTAFYDPRSLDIVCKPVPFFLRGQPIPKRMLPPEELVPYYTDAKNRGYLADPAKFPEARLELARKYGYILPDITKDELFKMLCTRKDPRQIFFGLAPGWVVNMADKKILKPTDENLLKYYTS

SEQ ID NO: 904946 - protein, 296 aa, Homo sapiens [sequence omitted]

SEQ ID NO: 904947 - protein, 511 aa, Homo sapiens
GRVGRPRVRRNKNLAEIGKRRSFIAAPCQIITNTSTLLKNYQDNNKMLVLALENEKSKVKEAQDIILQLRKECYYLTCQLYALKGKLTSQQTVEPAQNQEICSSGMDPNSDDSSRNLFVKDLPQIPLEETELPGQGESFQIEDQIPTIPQDTLGVDFDSGEAKSTDNVLPRTVSVRSSLKKHCNSICQFDSLDDFETSHLAGKSFEFERVGFLDPLVNMHIPENVQHNACQWSKDQVNLSPKLIQPGTFTKTKEDILESKSEQTKSKQRDTQERKREEKRKANRRKSKRMSKYKENKSENKKTVPQKKMHKSVSSNDAYNFNLEEGVHLTPFRQKVSNDSNREENNESEVSLCESSGSGDDSDDLYLPTCKYIQNPTSNSDRPVTRPLAKRALKYTDEKETEGSKPTKTPTTTPPETQQSPHLSLKDITNVSLYPVVKIRRLSLSPKKNKASPAVALPKRRCTASVNYKEPTLASKLRRGDPFTDLCFLNSPIFKQKKDLRRSKKSMKQIQ

SEQ ID NO: 904948 - protein, 527 aa, Homo sapiens
MAKERCLKKSFQDSLEDIKKRMKEKRNKNLAEIGKRRSFIAAPCQIITNTSTLLKNYQDNNKMLVLALENEKSKVKEAQDIILQLRKECYYLTCQLYALKGKLTSQQTVEPAQNQEICSSGMDPNSDDSSRNLFVKDLPQIPLEETELPGQGESFQIEDQIPTIPQDTLGVDFDSGEAKSTDNVLPRTVSVRSSLKKHCNSICQFDSLDDFETSHLAGKSFEFERVGFLDPLVNMHIPENVQHNACQWSKDQVNLSPKLIQPGTFTKTKEDILESKSEQTKSKQRDTQERKREEKRKANRRKSKRMSKYKENKSENKKTVPQKKMHKSVSSNDAYNFNLEEGVHLTPFRQKVSNDSNREENNESEVSLCESSGSGDDSDDLYLPTCKYIQNPTSNSDRPVTRPLAKRALKYTDEKETEGSKPTKTPTTTPPETQQSPHLSLKDITNVSLYPVVKIRRLSLSPKKNKASPAVALPKRRCTASVNYKEPTLASKLRRGDPFTDLCFLNSPIFKQKKDLRRSKKSMKQIQ

SEQ ID NO: 904949 - protein, 527 aa, Homo sapiens; identical to SEQ ID NO: 904948

SEQ ID NO: 904950 - protein, 527 aa, Homo sapiens; identical to SEQ ID NO: 904948

SEQ ID NO: 904951 - protein, 577 aa, Homo sapiens
MSHQPLSCLTEKEDSPSESTGNGPPHLAHPNLDTFTPEELLQQMKELLTENHQLKEAMKLNNQAMKGRFEELSAWTEKQKEERQFFEIQSKEAKERLMALSHENEKLKEELGKLKGKSERSSEDPTDDSRLPRAEAEQEKDQLRTQVVRLQAEKADLLGIVSELQLKLNSSGSSEDSFVEIRMAEGEAEGSVKEIKHSPGPTRTVSTGTALSKYRSRSADGAKNYFEHEELTVSQLLLCLREGNQKVERLEVALKEAKERVSDFEKKTSNRSEIETQTEGSTEKENDEEKGPETVGSEVEALNLQVTSLFKELQEAHTKLSEAELMKKRLQEKCQALERKNSAIPSELNEKQELVYTNKKLELQVESMLSEIKMEQAKTEDEKSKLTVLQMTHNKLLQEHNNALKTIEELTRKESEKVDRAVLKELSEKLELAEKALASKQLQMDEMKQTIAKQEEDLETMTILRAQMEVYCSDFHAERAAREKIHEEKEQLALQLAVLLKENDAFEDGGRQSLMEMQSRHGARTSDSDQQAYLVQRGAEDRDWRQQRNIPIHSCPKCGEVLPDIDTLQIHVMDCII

SEQ ID NO: 904952 - protein, 577 aa, Homo sapiens; identical to SEQ ID NO: 904951

SEQ ID NO: 904953 - protein, 577 aa, Homo sapiens; identical to SEQ ID NO: 904951

SEQ ID NO: 904954 - protein, 571 aa, Homo sapiens
MSHQPLSCLTEKEDSPSESTGNGPPHLAHPNLDTFTPEELLQQMKELLTENHQLKEAMKLNNQAMKGRFEELSAWTEKQKEERQFFEIQSKEAKERLMALSHENEKLKEELGKLKGKSERSSEDPTDDSRLPRAEAEQEKDQLRTQVVRLQAEKADLLGIVSELQLKLNSSGSSEDSFVEIRMAEGEAEGSVKEIKHSPGPTRTVSTGTSRSADGAKNYFEHEELTVSQLLLCLREGNQKVERLEVALKEAKERVSDFEKKTSNRSEIETQTEGSTEKENDEEKGPETVGSEVEALNLQVTSLFKELQEAHTKLSEAELMKKRLQEKCQALERKNSAIPSELNEKQELVYTNKKLELQVESMLSEIKMEQAKTEDEKSKLTVLQMTHNKLLQEHNNALKTIEELTRKESEKVDRAVLKELSEKLELAEKALASKQLQMDEMKQTIAKQEEDLETMTILRAQMEVYCSDFHAERAAREKIHEEKEQLALQLAVLLKENDAFEDGGRQSLMEMQSRHGARTSDSDQQAYLVQRGAEDRDWRQQRNIPIHSCPKCGEVLPDIDTLQIHVMDCII

SEQ ID NO: 904955 - protein, 577 aa, Homo sapiens; identical to SEQ ID NO: 904951

SEQ ID NO: 904956 - protein, 549 aa, Homo sapiens
MSHQPLSCLTEKEDSPSESTGNGPPHLAHPNLDTFTPEELLQQMKELLTENHQLKEAMKLNNQAMKGRFEELSAWTEKQKEERQFFEIQSKEAKERLMALSHENEKLKEELGKLKGKSERSSEDPTDDSRLPRAEAEQEKDQLRTQVVRLQAEKADLLGIVSELQLKLNSSGSSEDSFVEIRMAEGEAEGSVKEIKHSPGPTRTVSTGTSRSADGAKNYFEHEELTVSQLLLCLREGNQKVERLEVALKEAKEREKENDEEKGPETVGSEVEALNLQVTSLFKELQEAHTKLSEAELMKKRLQEKCQALERKNSAIPSELNEKQELVYTNKKLELQVESMLSEIKMEQAKTEDEKSKLTVLQMTHNKLLQEHNNALKTIEELTRKESEKVDRAVLKELSEKLELAEKALASKQLQMDEMKQTIAKQEEDLETMTILRAQMEVYCSDFHAERAAREKIHEEKEQLALQLAVLLKENDAFEDGGRQSLMEMQSRHGARTSDSDQQAYLVQRGAEDRDWRQQRNIPIHSCPKCGEVLPDIDTLQIHVMDCII

SEQ ID NO: 904957 - protein, 403 aa, Homo sapiens
MESSSFKLVPVILGYSLLSLWNFSDENLLTFILNRALSKYRSRSADGAKNYFEHEELTVSQLLLCLREGNQKVERLEVALKEAKERVSDFEKKTSNRSEIETQTEGSTEKENDEEKGPETVGSEVEALNLQVTSLFKELQEAHTKLSEAELMKKRLQEKCQALERKNSAIPSELNEKQELVYTNKKLELQVESMLSEIKMEQAKTEDEKSKLTVLQMTHNKLLQEHNNALKTIEELTRKESEKVDRAVLKELSEKLELAEKALASKQLQMDEMKQTIAKQEEDLETMTILRAQMEVYCSDFHAERAAREKIHEEKEQLALQLAVLLKENDAFEDGGRQSLMEMQSRHGARTSDSDQQAYLVQRGAEDRDWRQQRNIPIHSCPKCGEVLPDIDTLQIHVMDCII

SEQ ID NO: 904958 - protein, 487 aa, Homo sapiens
MSHQPLSCLTEKEDSPSESTGNGPPHLAHPNLDTFTPEELLQQMKELLTENHQLKEAMKLNNQAMKGRFEELSAWTEKQKEERQFFEIQSKEAKERLMALSHENEKLKEELGKLKGKSERSSEDPTDDSRLPRAEAEQEKDQLRTQVVRLQAEKADLLGIVSELQLKLNSSGSSEDSFVEIRMAEGEAEGSVKEIKHSPGPTRTVSTGTALSKYRSRSADGAKNYFEHEELTVSQLLLCLREGNQKVERLEVALKEAKERVSDFEKKTSNRSEIETQTEGSTEKENDEEKGPETVGSEVEALNLQVTSLFKELQEAHTKLSEAELMKKRLQEKCQALERKNSAIPSELNEKQELVYTNKKLELQVESMLSEIKMEQAKTEDEKSKLTVLQMTHNKLLQEHNNALKTIEELTRKESEKVDRAVLKELSEKLELAEKALASKQLQMDEMKQTIAKQEEDLETMTILRAQMEVYILILPGFGIISHIVTY

SEQ ID NO: 904959 - protein, 262 aa, Homo sapiens
MSHQPLSCLTEKEDSPSESTGNGPPHLAHPNLDTFTPEELLQQMKELLTENHQLKEAMKLNNQAMKGRFEELSAWTEKQKEERQFFEIQSKEAKERLMALSHENEKLKEELGKLKGKSERSSEDPTDDSRLPRAEAEQEKDQLRTQVVRLQAEKADLLGIVSELQLKLNSSGSSEDSFVEIRMAEGEAEGSVKEIKHSPGPTRTVSTGTALSKYRSRSADGAKNYFEHEELTVSQLLLCLREGNQKVERLEVALKEAKESMK

SEQ ID NO: 904960 - protein, 241 aa, Homo sapiens [sequence omitted]

SEQ ID NO: 904961 - protein, 241 aa, Homo sapiens [sequence omitted]

SEQ ID NO: 904962 - protein, 577 aa, Homo sapiens; identical to SEQ ID NO: 904951

SEQ ID NO: 904963 - protein, 577 aa, Homo sapiens; identical to SEQ ID NO: 904951

SEQ ID NO: 904964 - protein, 577 aa, Homo sapiens; identical to SEQ ID NO: 904951

SEQ ID NO: 904965 - protein, 535 aa, Homo sapiens
NCSSRLNSSGSSEDSFVEIRMAEGDADGLGKRNQAESWAHVEQSPLARADLQMGPRALSHENEKLKEELGKLKGKSERSSEDPTDDSRLPRAEAEQEKDQLRTQVVRLQAEKADLLGIVSELQLKLNSSGSSEDSFVEIRMAEGEAEGSVKEIKHSPGPTRTVSTGTALSKYRSRSADGAKNYFEHEELTVSQLLLCLREGNQKVERLEVALKEAKERVSDFEKKTSNRSEIETQTEGSTEKENDEEKGPETVGSEVEALNLQVTSLFKELQEAHTKLSEAELMKKRLQEKCQALERKNSAIPSELNEKQELVYTNKKLELQVESMLSEIKMEQAKTEDEKSKLTVLQMTHNKLLQEHNNALKTIEELTRKESEKVDRAVLKELSEKLELAEKALASKQLQMDEMKQTIAKQEEDLETMTILRAQMEVYCSDFHAERAAREKIHEEKEQLALQLAVLLKENDAFEDGGRQSLMEMQSRHGARTSDSDQQAYLVQRGAEDRDWRQQRNIPIHSCPKCGEVLPDIDTLQIHVMDCII

SEQ ID NO: 904966 - protein, 115 aa, Homo sapiens
QGSLILLIPPPLFHAERAAREKIHEEKEQLALQLAVLLKENDAFEDGGRQSLMEMQSRHGARTSDSDQQAYLVQRGAEDRDWRQQRNIPIHSCPKCGEVLPDIDTLQIHVMDCII

SEQ ID NO: 904967 - protein, 333 aa, Homo sapiens [sequence omitted]

SEQ ID NO: 904968 - protein, 75 aa, Homo sapiens
EYEVELMLKLAICSSSETNTTACKMELMELSYLFPGAEDRDWRQQRNIPIHSCPKCGEVLPDIDTLQIHVMDCII

SEQ ID NO: 904969 - protein, 388 aa, Homo sapiens
MKETRGYGGDAPFCTRLNHSYTGMWAPERSAEARGNLTRPPGSGEDCGSVSVAFPITMLLTGFVGNALAMLLVSRSYRRRESKRKKSFLLCIGWLALTDLVGQLLTTPVVIVVYLSKQRWEHIDPSGRLCTFFGLTMTVFGLSSLFIASAMAVERALAIRAPHWYASHMKTRATRAVLLGVWLAVLAFALLPVLGVGQYTVQWPGTWCFISTGRGGNGTSSSHNWGNLFFASAFAFLGLLALTVTFSCNLATIKALVSRCRAKATASQSSAQWGRITTETAIQLMGIMCVLSVCWSPLLIMMLKMIFNQTSVEHCKTHTEKQKECNFFLIAVRLASLNQILDPWVYLLLRKILLRKFCQVANAVSSCSNDGQKGQPISLSNEIIQTEA

SEQ ID NO: 904970 - protein, 365 aa, Homo sapiens
MKETRGYGGDAPFCTRLNHSYTGMWAPERSAEARGNLTRPPGSGEDCGSVSVAFPITMLLTGFVGNALAMLLVSRSYRRRESKRKKSFLLCIGWLALTDLVGQLLTTPVVIVVYLSKQRWEHIDPSGRLCTFFGLTMTVFGLSSLFIASAMAVERALAIRAPHWYASHMKTRATRAVLLGVWLAVLAFALLPVLGVGQYTVQWPGTWCFISTGRGGNGTSSSHNWGNLFFASAFAFLGLLALTVTFSCNLATIKALVSRCRAKATASQSSAQWGRITTETAIQLMGIMCVLSVCWSPLLIMMLKMIFNQTSVEHCKTHTEKQKECNFFLIAVRLASLNQILDPWVYLLLRKILLRKFCQEEFWGN

SEQ ID NO: 904971 - protein, 374 aa, Homo sapiens
MKETRGYGGDAPFCTRLNHSYTGMWAPERSAEARGNLTRPPGSGEDCGSVSVAFPITMLLTGFVGNALAMLLVSRSYRRRESKRKKSFLLCIGWLALTDLVGQLLTTPVVIVVYLSKQRWEHIDPSGRLCTFFGLTMTVFGLSSLFIASAMAVERALAIRAPHWYASHMKTRATRAVLLGVWLAVLAFALLPVLGVGQYTVQWPGTWCFISTGRGGNGTSSSHNWGNLFFASAFAFLGLLALTVTFSCNLATIKALVSRCRAKATASQSSAQWGRITTETAIQLMGIMCVLSVCWSPLLIMMLKMIFNQTSVEHCKTHTEKQKECNFFLIAVRLASLNQILDPWVYLLLRKILLRKFCQMRKRRLREQEEFWGN

SEQ ID NO: 904972 - protein, 402 aa, Homo sapiens
MKETRGYGGDAPFCTRLNHSYTGMWAPERSAEARGNLTRPPGSGEDCGSVSVAFPITMLLTGFVGNALAMLLVSRSYRRRESKRKKSFLLCIGWLALTDLVGQLLTTPVVIVVYLSKQRWEHIDPSGRLCTFFGLTMTVFGLSSLFIASAMAVERALAIRAPHWYASHMKTRATRAVLLGVWLAVLAFALLPVLGVGQYTVQWPGTWCFISTGRGGNGTSSSHNWGNLFFASAFAFLGLLALTVTFSCNLATIKALVSRCRAKATASQSSAQWGRITTETAIQLMGIMCVLSVCWSPLLIMMLKMIFNQTSVEHCKTHTEKQKECNFFLIAVRLASLNQILDPWVYLLLRKILLRKFCQMRKRRLREQEMGPDGRCFCHAWRQVPRTWCSSHDREPCSVQLS

SEQ ID NO: 904973 - protein, 393 aa, Homo sapiens
MKETRGYGGDAPFCTRLNHSYTGMWAPERSAEARGNLTRPPGSGEDCGSVSVAFPITMLLTGFVGNALAMLLVSRSYRRRESKRKKSFLLCIGWLALTDLVGQLLTTPVVIVVYLSKQRWEHIDPSGRLCTFFGLTMTVFGLSSLFIASAMAVERALAIRAPHWYASHMKTRATRAVLLGVWLAVLAFALLPVLGVGQYTVQWPGTWCFISTGRGGNGTSSSHNWGNLFFASAFAFLGLLALTVTFSCNLATIKALVSRCRAKATASQSSAQWGRITTETAIQLMGIMCVLSVCWSPLLIMMLKMIFNQTSVEHCKTHTEKQKECNFFLIAVRLASLNQILDPWVYLLLRKILLRKFCQEMGPDGRCFCHAWRQVPRTWCSSHDREPCSVQLS

SEQ ID NO: 904974 - protein, 390 aa, Homo sapiens
MKETRGYGGDAPFCTRLNHSYTGMWAPERSAEARGNLTRPPGSGEDCGSVSVAFPITMLLTGFVGNALAMLLVSRSYRRRESKRKKSFLLCIGWLALTDLVGQLLTTPVVIVVYLSKQRWEHIDPSGRLCTFFGLTMTVFGLSSLFIASAMAVERALAIRAPHWYASHMKTRATRAVLLGVWLAVLAFALLPVLGVGQYTVQWPGTWCFISTGRGGNGTSSSHNWGNLFFASAFAFLGLLALTVTFSCNLATIKALVSRCRAKATASQSSAQWGRITTETAIQLMGIMCVLSVCWSPLLIMMLKMIFNQTSVEHCKTHTEKQKECNFFLIAVRLASLNQILDPWVYLLLRKILLRKFCQIRYHTNNYASSSTSLPCQCSSTLMWSDHLER

SEQ ID NO: 904975 - protein, 445 aa, Homo sapiens
MKETRGYGGDAPFCTRLNHSYTGMWAPERSAEARGNLTRPPGSGEDCGSVSVAFPITMLLTGFVGNALAMLLVSRSYRRRESKRKKSFLLCIGWLALTDLVGQLLTTPVVIVVYLSKQRWEHIDPSGRLCTFFGLTMTVFGLSSLFIASAMAVERALAIRAPHWYASHMKTRATRAVLLGVWLAVLAFALLPVLGVGQYTVQWPGTWCFISTGRGGNGTSSSHNWGNLFFASAFAFLGLLALTVTFSCNLATIKALVSRCRAKATASQSSAQWGRITTETAIQLMGIMCVLSVCWSPLLIMMLKMIFNQTSVEHCKTHTEKQKECNFFLIAVRLASLNQILDPWVYLLLRKILLRKFCQMRKRRLREQEMGPDGRCFCHAWRQVPRTWCSSHDRGILGKLKPAFLPGSHHWKLHDSLFVKEKKITETPTSQTILFYFFPQAHPQI

SEQ ID NO: 904976 - protein, 391 aa, Homo sapiens
MKETRGYGGDAPFCTRLNHSYTGMWAPERSAEARGNLTRPPGSGEDCGSVSVAFPITMLLTGFVGNALAMLLVSRSYRRRESKRKKSFLLCIGWLALTDLVGQLLTTPVVIVVYLSKQRWEHIDPSGRLCTFFGLTMTVFGLSSLFIASAMAVERALAIRAPHWYASHMKTRATRAVLLGVWLAVLAFALLPVLGVGQYTVQWPGTWCFISTGRGGNGTSSSHNWGNLFFASAFAFLGLLALTVTFSCNLATIKALVSRCRAKATASQSSAQWGRITTETAIQLMGIMCVLSVCWSPLLIMMLKMIFNQTSVEHCKTHTEKQKECNFFLIAVRLASLNQILDPWVYLLLRKILLRKFCQMRKRRLREQFWRPASSGSGCQQIRCLEEFWGN

SEQ ID NO: 904977 - protein, 217 aa, Homo sapiens
WEHIDPSGRLCTFFGLTMTVFGLSSLFIASAMAVERALAIRAPHWYASHMKTRATRAVLLGVWLAVLAFALLPVLGVGQYTVQWPGTWCFISTGRGGNGTSSSHNWGNLFFASAFAFLGLLALTVTFSCNLATIKALVSRCRAKATASQSSAQWGRITTETAIQLMGIMCVLSVCWSPLLVGSSRVGGSQDACASKREPKTLLSGSTRRGVFATAER

SEQ ID NO: 904978 - protein, 390 aa, Homo sapiens; identical to SEQ ID NO: 904974

SEQ ID NO: 904979 - protein, 390 aa, Homo sapiens; identical to SEQ ID NO: 904974

SEQ ID NO: 904980 - protein, 425 aa, Homo sapiens
MKETRGYGGDAPFCTRLNHSYTGMWAPERSAEARGNLTRPPGSGEDCGSVSVAFPITMLLTGFVGNALAMLLVSRSYRRRESKRKKSFLLCIGWLALTDLVGQLLTTPVVIVVYLSKQRWEHIDPSGRLCTFFGLTMTVFGLSSLFIASAMAVERALAIRAPHWYASHMKTRATRAVLLGVWLAVLAFALLPVLGVGQYTVQWPGTWCFISTGRGGNGTSSSHNWGNLFFASAFAFLGLLALTVTFSCNLATIKALVSRCRAKATASQSSAQWGRITTETAIQLMGIMCVLSVCWSPLLIMMLKMIFNQTSVEHCKTHTEKQKECNFFLIAVRLASLNQILDPWVYLLLRKILLRKFCQMRKRRLREQAPLLPTSTVIDPSRFCAQPFRWFLDLSFPAMSSSHPQLPLTLASFKLLREPCSVQLS

SEQ ID NO: 904981 - protein, 418 aa, Homo sapiens
MKETRGYGGDAPFCTRLNHSYTGMWAPERSAEARGNLTRPPGSGEDCGSVSVAFPITMLLTGFVGNALAMLLVSRSYRRRESKRKKSFLLCIGWLALTDLVGQLLTTPVVIVVYLSKQRWEHIDPSGRLCTFFGLTMTVFGLSSLFIASAMAVERALAIRAPHWYASHMKTRATRAVLLGVWLAVLAFALLPVLGVGQYTVQWPGTWCFISTGRGGNGTSSSHNWGNLFFASAFAFLGLLALTVTFSCNLATIKALVSRCRAKATASQSSAQWGRITTETAIQLMGIMCVLSVCWSPLLIMMLKMIFNQTSVEHCKTHTEKQKECNFFLIAVRLASLNQILDPWVYLLLRKILLRKFCQMRKRRLREQLICSLQNSQIQRATAHCGQVQTYRVLNREEMEVLVSSINVYTRISTVKTE

SEQ ID NO: 904982 - protein, 390 aa, Homo sapiens; identical to SEQ ID NO: 904974

SEQ ID NO: 904983 - protein, 278 aa, Homo sapiens
MPPSAPASTTPTQACGRPSVPPRRGATSRALQGLARIADRCPWPSRSPCCSLVSWATHWPCCSCRAATGAGRASARSPSCCASAGWRSPTWSGSFSPPRSSSSCTCPSSSHNWGNLFFASAFAFLGLLALTVTFSCNLATIKALVSRCRAKATASQSSAQWGRITTETAIQLMGIMCVLSVCWSPLLIMMLKMIFNQTSVEHCKTHTEKQKECNFFLIAVRLASLNQILDPWVYLLLRKILLRKFCQIRYHTNNYASSSTSLPCQCSSTLMWSDHLER

SEQ ID NO: 904984 - protein, 427 aa, Homo sapiens
QHLTACEALSVPLSFATNMRFTFPLMAIVLEIAMIVLFGLFVEYETDQTVLEQLNITKPTDMGIFFELYPLFQDVHVMIFVGFGFLMTFLKKYGFSSVGINLLVAALGLQWGTIVQGILQSQGQKFNIGIKNMINADFSAATVLISFGAVLGKTSPTQMLIMTILEIVFFAHNEYLVSEIFKASDIGASMTIHAFGAYFGLAVAGILYRSGLRKGHENEESAYYSDLFAMIGTLFLWMFWPSFNSAIAEPGDKQCRAIVNTYFSLAACVLTAFAFSSLVEHRGKLNMVHIQNATLAGGVAVGTCADMAIHPFGSMIIGSIAGMVSVLGYKFLTPLFTTKLRIHDTCGVHNLHGLPGVVGGLAGIVAVAMGASNTSMAMQAAALGSSIGTAVVGGLMTGLILKLPLWGQPSDQNCYDDSVYWKVPKTR

SEQ ID NO: 904985 - protein, 411 aa, Homo sapiens
QHLTACEALSVPLSFATNMRFTFPLMAIVLEIAMIVLFGLFVEYETDQTVLEQLNITKPTDMGIFFELYPLFQDVHVMIFVGFGFLMTFLKKYGFSSVGINLLVAALGLQWGTIVQGILQSQGQKFNIGIKNMINADFSAATVLISFGAVLGKTSPTQMLIMTILEIVFFAHNEYLVSEIFKASDIGASMTIHAFGAYFGLAVAGILYRSGLRKGHENEESAYYSDLFAMIGTLFLWMFWPSFNSAIAEPGDKQCRAIVNTYFSLAACVLTAFAFSSLVEHRGKLNMVHIQNATLAGGVAVGTCADMAIHPFGSMIIGSIAGMVSVLGYKFLTPLFTTKLRIHDTCGVHNLHGLPGVVGGLAGIVAVAMGASNTSMAMQAAALGSSIGTAVVGGLMTGQHKKMNTSLYLML

SEQ ID NO: 904986 - protein, 103 aa, Homo sapiens
MFWPSFNSAIAEPGDKQCRAIVNTYFSLAACVLTAFAFSSLVEHRGKLNMVHIQNATLAGGVAVGTCADMAIHPFGSMIIGSIAGMVSVLGYKFLTVKVQQMF

SEQ ID NO: 904987 - protein, 190 aa, Homo sapiens
MFWPSFNSAIAEPGDKQCRAIVNTYFSLAACVLTAFAFSSLVEHRGKLNMVHIQNATLAGGVAVGTCADMAIHPFGSMIIGSIAGMVSVLGYKFLTPLFTTKLRIHDTCGVHNLHGLPGVVGGLAGIVAVAMGASNTSMAMQAAALGSSIGTAVVGGLMTGLILKLPLWGQPSDQNCYDDSVYWKVPKTR

SEQ ID NO: 904988 - protein, 427 aa, Homo sapiens; identical to SEQ ID NO: 904984

SEQ ID NO: 904989 - protein, 369 aa, Homo sapiens
QHLTACEALSVPLSFATNMRFTFPLMAIVLEIAMIVLFGLFVEYETDQTVLEQLNITKPTDMGIFFELYPLFQDVHVMIFVGFGFLMTFLKKYGFSSVGINLLVAALGLQWGTIVQGILQSQGQKFNIGIKNMINADFSAATVLISFGAVLGKTSPTQMLIMTILEIVFFAHNEYLVSEIFKASDIGASMTIHAFGAYFGLAVAGILYRSGLRKGHENEESAYYSDLFAMIGTLFLWMFWPSFNSAIAEPGDKQCRAIVNTYFSLAACVLTAFAFSSLVEHRGKLNMVHIQNATLAGGVAVGTCADMAIHPFGSMIIGSIAGMVSVLGYKFLTVYGHAGSCTGFLYRNSSCWRSDDRFNSKVASLGTAI

SEQ ID NO: 904990 - protein, 284 aa, Homo sapiens
SWTAVVPLVSVNMEAEESEKAATEQEPLEGTEQTLDAEEEQEESEEAACGSKKRVVPGIVYLGHIPPRFRPLHVRNLLSAYGEVGRVFFQAEDRFVRRKKKAAAAAGGKKRSYTKDYTEGWVEFRDKRIAKRVAASLHNTPMGARRRSPFRYDLWNLKYLHRFTWSHLSEHLAFERQVRRQRLRAEVAQAKRETDFYLQSVERGQRFLAADGDPARPDGSWTFAQRPTEQELRARKAARPGGRERARLATAQDKARSNKGLLARIFGAPPPSESMEGPSLVRDS

SEQ ID NO: 904991 - protein, 284 aa, Homo sapiens; identical to SEQ ID NO: 904990

SEQ ID NO: 904992 - protein, 280 aa, Homo sapiens
GPEFPGFNMEAEESEKAATEQEPLEGTEQTLDAEEEQEESEEAACGSKKRVVPGIVYLGHIPPRFRPLHVRNLLSAYGEVGRVFFQAEDRFVRRKKKAAAAAGGKKRSYTKDYTEGWVEFRDKRIAKRVAASLHNTPMGARRRSPFRYDLWNLKYLHRFTWSHLSEHLAFERQVRRQRLRAEVAQAKRETDFYLQSVERGQRFLAADGDPARPDGSWTFAQRPTEQELRARKAARPGGRERARLATAQDKARSNKGLLARIFGAPPPSESMEGPSLVRDS

SEQ ID NO: 904993 - protein, 143 aa, Homo sapiens
MGARRRSPFRYDLWNLKYLHRFTWSHLSEHLAFERQVRRQRLRAEVAQAKRETDFYLQSVERGQRFLAADGDPARPDGSWTFAQRPTEQELRARKAARPGGRERARLATAQDKARSNKGLLARIFGAPPPSESMEGPSLVRDS

SEQ ID NO: 904994 - protein, 138 aa, Homo sapiens
MARSDASSFRLRYLHRFTWSHLSEHLAFERQVRRQRLRAEVAQAKRETDFYLQSVERGQRFLAADGDPARPDGSWTFAQRPTEQELRARKAARPGGRERARLATAQDKARSNKGLLARIFGAPPPSESMEGPSLVRDS

SEQ ID NO: 904995 - protein, 284 aa, Homo sapiens; identical to SEQ ID NO: 904990

SEQ ID NO: 904996 - protein, 284 aa, Homo sapiens; identical to SEQ ID NO: 904990

SEQ ID NO: 904997 - protein, 284 aa, Homo sapiens; identical to SEQ ID NO: 904990

SEQ ID NO: 904998 - protein, 262 aa, Homo sapiens
GPEFPGFNMEAEESEKAATEQEPLEGTEQTLDAEEEQEESEEAACGSKKRVVPGIVYLGHIPPRFRPLHVRNLLSAYGEVGRVFFQAEDRFVRRKKKAAAAAGGKRIAKRVAASLHNTPMGARRRSPFRYDLWNLKYLHRFTWSHLSEHLAFERQVRRQRLRAEVAQAKRETDFYLQSVERGQRFLAADGDPARPDGSWTFAQRPTEQELRARKAARPGGRERARLATAQDKARSNKGLLARIFGAPPPSESMEGPSLVRDS

SEQ ID NO: 904999 - protein, 110 aa, Homo sapiens
MSKNGSSASLCASSAPIAGQLRYVAESIGFRKCKNQGEHKIRKDHALHGHIHNESPGTCNLFNVPLETSRSLLRRNTCKQARHSILDSTHARCDSATGPFSHPRLRTAEE

SEQ ID NO: 905000 - protein, 1148 aa, Homo sapiens
MTTPTRRSTRNTRAETASQSQRSPISDNSGCDAPGNSNPSLSVPSSAESEKQTRQAPKRKSVRRGRKPPLLKKKLRSSVAAPEKSSSNDSVDEETAESDTSPVLEKEHQPDVDSSNICTVQTHVENQSANCLKSCNEQIEESEKHTANYDTEERVGSSSSESCAQDLPVLVGEEGEVKKLENTGIEANVLCLESEISENILEKGGDPLEKQDQISGLSQSEVKTDVCTVHLPNDFPTCLTSESKVYQPVSCPLSDLSENVESVVNEEKITESSLVEITEHKDFTLKTEELIESPKLESSEGEIIQTVDRQSVKSPEVQLLGHVETEDVEIIATCDTFGNEDFNNIQDSENNLLKNNLLNTKLEKSLEEKNESLTEHPRSTELPKTHIEQIQKHFSEDNNEMIPMECDSFCSDQNESEVEPSVNADLKQMNENSVTHCSENNMPSSDLADEKVETVSQPSESPKDTIDKTKKPRTRRSRFHSPSTTWSPNKDTPQEKKRPQSPSPRRETGKESRKSQSPSPKNESARGRKKSRSQSPKKDIARERRQSQSRSPKRDTTRESRRSESLSPRRETSRENKRSQPRVKDSSPGEKSRSQSRERESDRDGQRRERERRTRKWSRSRSHSRSPSRCRTKSKSSSFGRIDRDSYSPRWKGRWANDGWRCPRGNDRYRKNDPEKQNENTRKEKNDIHLDADDPNSADKHRNDCPNWITEKINSGPDPRTRNPEKLKESHWEENRNENSGNSWNKNFGSGWVSNRGRGRGNRGRGTYRSSFAYKDQNENRWQNRKPLSGNSNSSGSESFKFVEQQSYKRKSEQEFSFDTPADRSGWTSASSWAVRKTLPADVQNYYSRRGRNSSGPQSGWMKQEEETSGQDSSLKDQTNQQVDGSQLPINMMQPQMNVMQQQMNAQHQPMNIFPYPVGVHAPLMNIQRNPFNIHPQLPLHLHTGVPLMQVATPTSVSQGLPPPPPPPPPSQQVNYIASQPDGKQLQGIPSSSHVSNNMSTPVLPAPTAAPGNTGMVQGPSSGNTSSSSHSKASNAAVKLAESKVSVAVEASADSSKTDKKLQIQEKAAQEVKLAIKPFYQNKDITKEEYKEIVRKAVDKVCHSKSGEVNSTKVANLVKAYVDKYKYSRKGSQKKTLEEPVSTEKNIG

SEQ ID NO: 905001 - protein, 1148 aa, Homo sapiens; identical to SEQ ID NO: 905000

SEQ ID NO: 905002 - protein, 1474 aa, Homo sapiens
MQEGGSEAVGRRGRGKVGRKLIPGRRQGGWRAQHARTERGQATGKRVSARLKATGTWETLFQREMKKKTVCTLNMGDKKYEDMEGEENGDNTISTGLLYSEADRCPICLNCLLEKEVGFPESCNHVFCMTCILKWAEELFIPIKTLETLASCPIDRKPFQAVFKFSALEGYVKVQVKKQLRETKDKKNENSFEKQVSCHENSKSCIRRKAIVREDLLSAKVCDLKWIHRNSLYSETGGKKNAAIKINKPQRSNWSTNQCFRNFFSNMFSSVSHSGESSFTYRAYCTEFIEASEISALIRQKRHELELSWFPDTLPGIGRIGFIPWNVETEVLPLISSVLPRTIFPTSTISFEHFGTSCKGYALAHTQEGEEKKQTSGTSNTRGSRRKPAMTTPTRRSTRNTRAETASQSQRSPISDNSGCDAPGNSNPSLSVPSSAESEKQTRQAPKRKSVRRGRKPPLLKKKLRSSVAAPEKSSSNDSVDEETAESDTSPVLEKEHQPDVDSSNICTVQTHVENQSANCLKSCNEQIEESEKHTANYDTEERVGSSSSESCAQDLPVLVGEEGEVKKLENTGIEANVLCLESEISENILEKGGDPLEKQDQISGLSQSEVKTDVCTVHLPNDFPTCLTSESKVYQPVSCPLSDLSENVESVVNEEKITESSLVEITEHKDFTLKTEELIESPKLESSEGEIIQTVDRQSVKSPEVQLLGHVETEDVEIIATCDTFGNEDFNNIQDSENNLLKNNLLNTKLEKSLEEKNESLTEHPRSTELPKTHIEQIQKHFSEDNNEMIPMECDSFCSDQNESEVEPSVNADLKQMNENSVTHCSENNMPSSDLADEKVETVSQPSESPKDTIDKTKKPRTRRSRFHSPSTTWSPNKDTPQEKKRPQSPSPRRETGKESRKSQSPSPKNESARGRKKSRSQSPKKDIARERRQSQSRSPKRDTTRESRRSESLSPRRETSRENKRSQPRVKDSSPGEKSRSQSRERESDRDGQRRERERRTRKWSRSRSHSRSPSRCRTKSKSSSFGRIDRDSYSPRWKGRWANDGWRCPRGNDRYRKNDPEKQNENTRKEKNDIHLDADDPNSADKHRNDCPNWITEKINSGPDPRTRNPEKLKESHWEENRNENSGNSWNKNFGSGWVSNRGRGRGNRGRGTYRSSFAYKDQNENRWQNRKPLSGNSNSSGSESFKFVEQQSYKRKSEQEFSFDTPADRSGWTSASSWAVRKTLPADVQNYYSRRGRNSSGPQSGWMKQEEETSGQDSSLKDQTNQQVDGSQLPINMMQPQMNVMQQQMNAQHQPMNIFPYPVGVHAPLMNIQRNPFNIHPQLPLHLHTGVPLMQVATPTSVSQGLPPPPPPPPPSQQVNYIASQPDGKQLQGIPSSSHVSNNMSTPVLPAPTAAPGNTGMVQGPSSGNTSSSSHSKASNAAVKLAESKVSVAVEASADSSKTDKASSRLRATFIILYMIKEKKYQLFIV

SEQ ID NO: 905003 - protein, 1473 aa, Homo sapiens
MKKKTVCTLNMGDKKYEDMEGEENGDNTISTGLLYSEADRCPICLNCLLEKEVGFPESCNHVFCMTCILKWAEELFIPIKTLETLASCPIDRKPFQAVFKFSALEGYVKVQVKKQLRETKDKKNENSFEKQVSCHENSKSCIRRKAIVREDLLSAKVCDLKWIHRNSLYSETGGKKNAAIKINKPQRSNWSTNQCFRNFFSNMFSSVSHSGESSFTYRAYCTEFIEASEISALIRQKRHELELSWFPDTLPGIGRIGFIPWNVETEVLPLISSVLPRTIFPTSTISFEHFGTSCKGYALAHTQEGEEKKQTSGTSNTRGSRRKPAMTTPTRRSTRNTRAETASQSQRSPISDNSGCDAPGNSNPSLSVPSSAESEKQTRQAPKRKSVRRGRKPPLLKKKLRSSVAAPEKSSSNDSVDEETAESDTSPVLEKEHQPDVDSSNICTVQTHVENQSANCLKSCNEQIEESEKHTANYDTEERVGSSSSESCAQDLPVLVGEEGEVKKLENTGIEANVLCLESEISENILEKGGDPLEKQDQISGLSQSEVKTDVCTVHLPNDFPTCLTSESKVYQPVSCPLSDLSENVESVVNEEKITESSLVEITEHKDFTLKTEELIESPKLESSEGEIIQTVDRQSVKSPEVQLLGHVETEDVEIIATCDTFGNEDFNNIQDSENNLLKNNLLNTKLEKSLEEKNESLTEHPRSTELPKTHIEQIQKHFSEDNNEMIPMECDSFCSDQNESEVEPSVNADLKQMNENSVTHCSENNMPSSDLADEKVETVSQPSESPKDTIDKTKKPRTRRSRFHSPSTTWSPNKDTPQEKKRPQSPSPRRETGKESRKSQSPSPKNESARGRKKSRSQSPKKDIARERRQSQSRSPKRDTTRESRRSESLSPRRETSRENKRSQPRVKDSSPGEKSRSQSRERESDRDGQRRERERRTRKWSRSRSHSRSPSRCRTKSKSSSFGRIDRDSYSPRWKGRWANDGWRCPRGNDRYRKNDPEKQNENTRKEKNDIHLDADDPNSADKHRNDCPNWITEKINSGPDPRTRNPEKLKESHWEENRNENSGNSWNKNFGSGWVSNRGRGRGNRGRGTYRSSFAYKDQNENRWQNRKPLSGNSNSSGSESFKFVEQQSYKRKSEQEFSFDTPADRSGWTSASSWAVRKTLPADVQNYYSRRGRNSSGPQSGWMKQEEETSGQDSSLKDQTNQQVDGSQLPINMMQPQMNVMQQQMNAQHQPMNIFPYPVGVHAPLMNIQRNPFNIHPQLPLHLHTGVPLMQVATPTSVSQGLPPPPPPPPPSQQVNYIASQPDGKQLQGIPSSSHVSNNMSTPVLPAPTAAPGNTGMVQGPSSGNTSSSSHSKASNAAVKLAESKVSVAVEASADSSKTDKKLQIQEKAAQEVKLAIKPFYQNKDITKEEYKEIVRKAVDKVCHSKSGEVNSTKVANLVKAYVDKYKYSRKGSQKKTLEEPVSTEKNIG

SEQ ID NO: 905004 - protein, 686 aa, Homo sapiens
MKKKTVCTLNMGDKKYEDMEGEENGDNTISTGLLYSEADRCPICLNCLLEKEVGFPESCNHVFCMTCILKWAEELFIPIKTLETLASCPIDRKPFQAVFKFSALEGYVKVQVKKQLRETKDKKNENSFEKQVSCHENSKSCIRRKAIVREDLLSAKVCDLKWIHRNSLYSETGGKKNAAIKINKPQRSNWSTNQCFRNFFSNMFSSVSHSGESSFTYRAYCTEFIEASEISALIRQKRHELELSWFPDTLPGIGRIGFIPWNVETEVLPLISSVLPRTIFPTSTISFEHFGTSCKGYALAHTQEGEEKKQTSGTSNTRGSRRKPAMTTPTRRSTRNTRAETASQSQRSPISDNSGCDAPADRSGWTSASSWAVRKTLPADVQNYYSRRGRNSSGPQSGWMKQEEETSGQDSSLKDQTNQQVDGSQLPINMMQPQMNVMQQQMNAQHQPMNIFPYPVGVHAPLMNIQRNPFNIHPQLPLHLHTGVPLMQVATPTSVSQGLPPPPPPPPPSQQVNYIASQPDGKQLQGIPSSSHVSNNMSTPVLPAPTAAPGNTGMVQGPSSGNTSSSSHSKASNAAVKLAESKVSVAVEASADSSKTDKKLQIQEKAAQEVKLAIKPFYQNKDITKEEYKEIVRKAVDKVCHSKSGEVNSTKVANLVKAYVDKYKYSRKGSQKKTLEEPVSTEKNIG

SEQ ID NO: 905005 - protein, 150 aa, Homo sapiens [sequence omitted]

SEQ ID NO: 905006 - protein, 1500 aa, Homo sapiens
MQEGGSEAVGRRGRGKVGRKLIPGRRQGGWRAQHARTERGQATGKRVSARLKATGTWETLFQREMKKKTVCTLNMGDKKYEDMEGEENGDNTISTGLLYSEADRCPICLNCLLEKEVGFPESCNHVFCMTCILKWAEELFIPIKTLETLASCPIDRKPFQAVFKFSALEGYVKVQVKKQLRETKDKKNENSFEKQVSCHENSKSCIRRKAIVREDLLSAKVCDLKWIHRNSLYSETGGKKNAAIKINKPQRSNWSTNQCFRNFFSNMFSSVSHSGESSFTYRAYCTEFIEASEISALIRQKRHELELSWFPDTLPGIGRIGFIPWNVETEVLPLISSVLPRTIFPTSTISFEHFGTSCKGYALAHTQEGEEKKQTSGTSNTRGSRRKPAMTTPTRRSTRNTRAETASQSQRSPISDNSGCDAPGNSNPSLSVPSSAESEKQTRQAPKRKSVRRGRKPPLLKKKLRSSVAAPEKSSSNDSVDEETAESDTSPVLEKEHQPDVDSSNICTVQTHVENQSANCLKSCNEQIEESEKHTANYDTEERVGSSSSESCAQDLPVLVGEEGEVKKLENTGIEANVLCLESEISENILEKGGDPLEKQDQISGLSQSEVKTDVCTVHLPNDFPTCLTSESKVYQPVSCPLSDLSENVESVVNEEKITESSLVEITEHKDFTLKTEELIESPKLESSEGEIIQTVDRQSVKSPEVQLLGHVETEDVEIIATCDTFGNEDFNNIQDSENNLLKNNLLNTKLEKSLEEKNESLTEHPRSTELPKTHIEQIQKHFSEDNNEMIPMECDSFCSDQNESEVEPSVNADLKQMNENSVTHCSENNMPSSDLADEKVETVSQPSESPKDTIDKTKKPRTRRSRFHSPSTTWSPNKDTPQEKKRPQSPSPRRETGKESRKSQSPSPKNESARGRKKSRSQSPKKDIARERRQSQSRSPKRDTTRESRRSESLSPRRETSRENKRSQPRVKDSSPGEKSRSQSRERESDRDGQRRERERRTRKWSRSRSHSRSPSRCRTKSKSSSFGRIDRDSYSPRWKGRWANDGWRCPRGNDRYRKNDPEKQNENTRKEKNDIHLDADDPNSADKHRNDCPNWITEKINSGPDPRTRNPEKLKESHWEENRNENSGNSWNKNFGSGWVSNRGRGRGNRGRGTYRSSFAYKDQNENRWQNRKPLSGNSNSSGSESFKFVEQQSYKRKSEQEFSFDTPADRSGWTSASSWAVRKTLPADVQNYYSRRGRNSSGPQSGWMKQEEETSGQDSSLKDQTNQQVDGSQLPINMMQPQMNVMQQQMNAQHQPMNIFPYPVGVHAPLMNIQRNPFNIHPQLPLHLHTGVPLMQVATPTSVSQGLPPPPPPPPPSQQVNYIASQPDGKQLQGIPSSSHVSNNMSTPVLPAPTAAPGNTGMVQGPSSGNTSSSSHSKASNAAVKLAESKVSVAVEASADSSKTDKKLQIQEKAAQEVKLAIKPFYQNKDITKEEYKEIVRKAVDKCVLLECSIQKM

SEQ ID NO: 905007 - protein, 1474 aa, Homo sapiens; identical to SEQ ID NO: 905002

SEQ ID NO: 905008 - protein, 305 aa, Homo sapiens
MKKKTVCTLNMGDKKYEDMEGEENGDNTISTGLLYSEADRCPICLNCLLEKEVGFPESCNHVFCMTCILKWAEELFIPIKTLETLASCPIDRKPFQAVFKFSALEGYVKVQVKKQLRETKDKKNENSFEKQVSCHENSKSCIRRKAIVREDLLSAKVCDLKWIHRNSLYSETGGKKNAAIKINKPQRSNWSTNQCFRNFFSNMFSSVSHSGESSFTYRAYCTEFIEASEISALIRQKRHELELSWFPDTLPGIGRIGFIPWNVETEVLPLISSVLPRTIFPTSTISFEHFGKVCEIIFYFKNYYY

SEQ ID NO: 905009 - protein, 305 aa, Homo sapiens; identical to SEQ ID NO: 905008

SEQ ID NO: 905010 - protein, 182 aa, Homo sapiens
MKKKTVCTLNMGDKKYEDMEGEENGDNTISTGLLYSEADRCPICLNCLLEKEVGFPESCNHVFCMTCILKWAEELFIPIKTLETLASCPIDRKPFQAVFKFSALEGYVKVQVKKQLRETKDKKNENSFEKQVSCHENSKSCIRRKAIVREDLLSAKVCDLKWIHSKLLFACGFYLFFCCFLI

SEQ ID NO: 905011 - protein, 1463 aa, Homo sapiens
MKKKTVCTLNMGDKKYEDMEGEENGDNTISTGLLYSEADRCPICLNCLLEKEVGFPESCNHVFCMTCILKWAETLASCPIDRKPFQAVFKFSALEGYVKVQVKKQLRETKDKKNENSFEKQVSCHENSKSCIRRKAIVREDLLSAKVCDLKWIHRNSLYSETGGKKNAAIKINKPQRSNWSTNQCFRNFFSNMFSSVSHSGESSFTYRAYCTEFIEASEISALIRQKRHELELSWFPDTLPGIGRIGFIPWNVETEVLPLISSVLPRTIFPTSTISFEHFGTSCKGYALAHTQEGEEKKQTSGTSNTRGSRRKPAMTTPTRRSTRNTRAETASQSQRSPISDNSGCDAPGNSNPSLSVPSSAESEKQTRQAPKRKSVRRGRKPPLLKKKLRSSVAAPEKSSSNDSVDEETAESDTSPVLEKEHQPDVDSSNICTVQTHVENQSANCLKSCNEQIEESEKHTANYDTEERVGSSSSESCAQDLPVLVGEEGEVKKLENTGIEANVLCLESEISENILEKGGDPLEKQDQISGLSQSEVKTDVCTVHLPNDFPTCLTSESKVYQPVSCPLSDLSENVESVVNEEKITESSLVEITEHKDFTLKTEELIESPKLESSEGEIIQTVDRQSVKSPEVQLLGHVETEDVEIIATCDTFGNEDFNNIQDSENNLLKNNLLNTKLEKSLEEKNESLTEHPRSTELPKTHIEQIQKHFSEDNNEMIPMECDSFCSDQNESEVEPSVNADLKQMNENSVTHCSENNMPSSDLADEKVETVSQPSESPKDTIDKTKKPRTRRSRFHSPSTTWSPNKDTPQEKKRPQSPSPRRETGKESRKSQSPSPKNESARGRKKSRSQSPKKDIARERRQSQSRSPKRDTTRESRRSESLSPRRETSRENKRSQPRVKDSSPGEKSRSQSRERESDRDGQRRERERRTRKWSRSRSHSRSPSRCRTKSKSSSFGRIDRDSYSPRWKGRWANDGWRCPRGNDRYRKNDPEKQNENTRKEKNDIHLDADDPNSADKHRNDCPNWITEKINSGPDPRTRNPEKLKESHWEENRNENSGNSWNKNFGSGWVSNRGRGRGNRGRGTYRSSFAYKDQNENRWQNRKPLSGNSNSSGSESFKFVEQQSYKRKSEQEFSFDTPADRSGWTSASSWAVRKTLPADVQNYYSRRGRNSSGPQSGWMKQEEETSGQDSSLKDQTNQQVDGSQLPINMMQPQMNVMQQQMNAQHQPMNIFPYPVGVHAPLMNIQRNPFNIHPQLPLHLHTGVPLMQVATPTSVSQGLPPPPPPPPPSQQVNYIASQPDGKQLQGIPSSSHVSNNMSTPVLPAPTAAPGNTGMVQGPSSGNTSSSSHSKASNAAVKLAESKVSVAVEASADSSKTDKKLQIQEKAAQEVKLAIKPFYQNKDITKEEYKEIVRKAVDKVCHSKSGEVNSTKVANLVKAYVDKYKYSRKGSQKKTLEEPVSTEKNIG

SEQ ID NO: 905012 - protein, 1148 aa, Homo sapiens; identical to SEQ ID NO: 905000

SEQ ID NO: 905013 - protein, 1537 aa, Homo sapiens
MQEGGSEAVGRRGRGKVGRKLIPGRRQGGWRAQHARTERGQATGKRVSARLKATGTWETLFQREMKKKTVCTLNMGDKKYEDMEGEENGDNTISTGLLYSEADRCPICLNCLLEKEVGFPESCNHVFCMTCILKWAEELFIPIKTLETLASCPIDRKPFQAVFKFSALEGYVKVQVKKQLRETKDKKNENSFEKQVSCHENSKSCIRRKAIVREDLLSAKVCDLKWIHRNSLYSETGGKKNAAIKINKPQRSNWSTNQCFRNFFSNMFSSVSHSGESSFTYRAYCTEFIEASEISALIRQKRHELELSWFPDTLPGIGRIGFIPWNVETEVLPLISSVLPRTIFPTSTISFEHFGTSCKGYALAHTQEGEEKKQTSGTSNTRGSRRKPAMTTPTRRSTRNTRAETASQSQRSPISDNSGCDAPGNSNPSLSVPSSAESEKQTRQAPKRKSVRRGRKPPLLKKKLRSSVAAPEKSSSNDSVDEETAESDTSPVLEKEHQPDVDSSNICTVQTHVENQSANCLKSCNEQIEESEKHTANYDTEERVGSSSSESCAQDLPVLVGEEGEVKKLENTGIEANVLCLESEISENILEKGGDPLEKQDQISGLSQSEVKTDVCTVHLPNDFPTCLTSESKVYQPVSCPLSDLSENVESVVNEEKITESSLVEITEHKDFTLKTEELIESPKLESSEGEIIQTVDRQSVKSPEVQLLGHVETEDVEIIATCDTFGNEDFNNIQDSENNLLKNNLLNTKLEKSLEEKNESLTEHPRSTELPKTHIEQIQKHFSEDNNEMIPMECDSFCSDQNESEVEPSVNADLKQMNENSVTHCSENNMPSSDLADEKVETVSQPSESPKDTIDKTKKPRTRRSRFHSPSTTWSPNKDTPQEKKRPQSPSPRRETGKESRKSQSPSPKNESARGRKKSRSQSPKKDIARERRQSQSRSPKRDTTRESRRSESLSPRRETSRENKRSQPRVKDSSPGEKSRSQSRERESDRDGQRRERERRTRKWSRSRSHSRSPSRCRTKSKSSSFGRIDRDSYSPRWKGRWANDGWRCPRGNDRYRKNDPEKQNENTRKEKNDIHLDADDPNSADKHRNDCPNWITEKINSGPDPRTRNPEKLKESHWEENRNENSGNSWNKNFGSGWVSNRGRGRGNRGRGTYRSSFAYKDQNENRWQNRKPLSGNSNSSGSESFKFVEQQSYKRKSEQEFSFDTPADRSGWTSASSWAVRKTLPADVQNYYSRRGRNSSGPQSGWMKQEEETSGQDSSLKDQTNQQVDGSQLPINMMQPQMNVMQQQMNAQHQPMNIFPYPVGVHAPLMNIQRNPFNIHPQLPLHLHTGVPLMQVATPTSVSQGLPPPPPPPPPSQQVNYIASQPDGKQLQGIPSSSHVSNNMSTPVLPAPTAAPGNTGMVQGPSSGNTSSSSHSKASNAAVKLAESKVSVAVEASADSSKTDKKLQIQEKAAQEVKLAIKPFYQNKDITKEEYKEIVRKAVDKVCHSKSGEVNSTKVANLVKAYVDKYKYSRKGSQKKTLEEPVSTEKNIG

SEQ ID NO: 905014 - protein, 1464 aa, Homo sapiens
MQEGGSEAVGRRGRGKVGRKLIPGRRQGGWRAQHARTERGQATGKRVSARLKATGTWETLFQREMKKKTVCTLNMGDKKYEDMEGEENGDNTISTGLLYSEADRCPICLNCLLEKEVGFPESCNHVFCMTCILKWAEELFIPIKTLETLASCPIDRKPFQAVFKFSALEGYVKVQVKKQLRETKDKKNENSFEKQVSCHENSKSCIRRKAIVREDLLSAKVCDLKWIHRNSLYSETGGKKNAAIKINKPQRSNWSTNQCFRNFFSNMFSSVSHSGESSFTYRAYCTEFIEASEISALIRQKRHELELSWFPDTLPGIGRIGFIPWNVETEVLPLISSVLPRTIFPTSTISFEHFGTSCKGYALAHTQEGEEKKQTSGTSNTRGSRRKPAMTTPTRRSTRNTRAETASQSQRSPISDNSGCDAPGNSNPSLSVPSSAESEKQTRQAPKRKSVRRGRKPPLLKKKLRSSVAAPEKSSSNDSVDEETAESDTSPVLEKEHQPDVDSSNICTVQTHVENQSANCLKSCNEQIEESEKHTANYDTEERVGSSSSESCAQDLPVLVGEEGEVKKLENTGIEANVLCLESEISENILEKGGDPLEKQDQISGLSQSEVKTDVCTVHLPNDFPTCLTSESKVYQPVSCPLSDLSENVESVVNEEKITESSLVEITEHKDFTLKTEELIESPKLESSEGEIIQTVDRQSVKSPEVQLLGHVETEDVEIIATCDTFGNEDFNNIQDSENNLLKNNLLNTKLEKSLEEKNESLTEHPRSTELPKTHIEQIQKHFSEDNNEMIPMECDSFCSDQNESEVEPSVNADLKQMNENSVTHCSENNMPSSDLADEKVETVSQPSESPKDTIDKTKKPRTRRSRFHSPSTTWSPNKDTPQEKKRPQSPSPRRETGKESRKSQSPSPKNESARGRKKSRSQSPKKDIARERRQSQSRSPKRDTTRESRRSESLSPRRETSRENKRSQPRVKDSSPGEKSRSQSRERESDRDGQRRERERRTRKWSRSRSHSRSPSRCRTKSKSSSFGRIDRDSYSPRWKGRWANDGWRCPRGNDRYRKNDPEKQNENTRKEKNDIHLDADDPNSADKHRNDCPNWITEKINSGPDPRTRNPEKLKESHWEENRNENSGNSWNKNFGSGWVSNRGRGRGNRGRGTYRSSFAYKDQNENRWQNRKPLSGNSNSSGSESFKFVEQQSYKRKSEQEFSFDTPADRSGWTSASSWAVRKTLPADVQNYYSRRGRNSSGPQSGWMKQEEETSGQDSSLKDQTNQQVDGSQLPINMMQPQMNVMQQQMNAQHQPMNIFPYPVGVHAPLMNIQRNPFNIHPQLPLHLHTGVPLMQVATPTSVSQGLPPPPPPPPPSQQVNYIASQPDGKQLQKLQIQEKAAQEVKLAIKPFYQNKDITKEEYKEIVRKAVDKVCHSKSGEVNSTKVANLVKAYVDKYKYSRKGSQKKTLEEPVSTEKNIG

SEQ ID NO: 905015 - protein, 1463 aa, Homo sapiens; identical to SEQ ID NO: 905011

SEQ ID NO: 905016 - protein, 1537 aa, Homo sapiens; identical to SEQ ID NO: 905013

SEQ ID NO: 905017 - protein, 1507 aa, Homo sapiens
MQEGGSEAVGRRGRGKVGRKLIPGRRQGGWRAQHARTERGQATGKRVSARLKATGTWETLFQREMKKKTVCTLNMGDKKYEDMEGEENGDNTISTGLLYSEADRCPICLNCLLEKEVGFPESCNHVFCMTCILKWAEELFIPIKTLETLASCPIDRKPFQAVFKFSALEGYVKVQVKKQLRETKDKKNENSFEKQVSCHENSKSCIRRKAIVREDLLSAKVCDLKWIHRNSLYSETGGKKNAAIKINKPQRSNWSTNQCFRNFFSNMFSSVSHSGESSFTYRAYCTEFIEASEISALIRQKRHELELSWFPDTLPGIGRIGFIPWNVETEVLPLISSVLPRTIFPTSTISFEHFGTSCKGYALAHTQEGEEKKQTSGTSNTRGSRRKPAMTTPTRRSTRNTRAETASQSQRSPISDNSGCDAPGNSNPSLSVPSSAESEKQTRQAPKRKSVRRGRKPPLLKKKLRSSVAAPEKSSSNDSVDEETAESDTSPVLEKEHQPDVDSSNICTVQTHVENQSANCLKSCNEQIEESEKHTANYDTEERVGSSSSESCAQDLPVLVGEEGEVKKLENTGIEANVLCLESEISENILEKGGDPLEKQDQISGLSQSEVKTDVCTVHLPNDFPTCLTSESKVYQPVSCPLSDLSENVESVVNEEKITESSLVEITEHKDFTLKTEELIESPKLESSEGEIIQTVDRQSVKSPEVQLLGHVETEDVEIIATCDTFGNEDFNNIQDSENNLLKNNLLNTKLEKSLEEKNESLTEHPRSTELPKTHIEQIQKHFSEDNNEMIPMECDSFCSDQNESEVEPSVNADLKQMNENSVTHCSENNMPSSDLADEKVETVSQPSESPKDTIDKTKKPRTRRSRFHSPSTTWSPNKDTPQEKKRPQSPSPRRETGKESRKSQSPSPKNESARGRKKSRSQSPKKDIARERRQSQSRSPKRDTTRESRRSESLSPRRETSRENKRSQPRVKDSSPGEKSRSQSRERESDRDGQRRERERRTRKWSRSRSHSRSPSRCRTKSKSSSFGRIDRDSYSPRWKGRWANDGWRCPRGNDRYRKNDPEKQNENTRKEKNDIHLDADDPNSADKHRNDCPNWITEKINSGPDPRTRNPEKLKESHWEENRNENSGNSWNKNFGSGWVSNRGRGRGNRGRGTYRSSFAYKDQNENRWQNRKPLSGNSNSSGSESFKFVEQQSYKRKSEQEFSFDTPADRSGWTSASSWAVRKTLPADVQNYYSRRGRNSSGPQSGWMKQEEETSGQDSSLKDQTNQQVDGSQLPINMMQPQMNVMQQQMNAQHQPMNIFPYPVGVHAPLMNIQRNPFNIHPQLPLHLHTGVPLMQVATPTSVSQGLPPPPPPPPPSQQVNYIASQPDGKQLQGIPSSSHVSNNMSTPVLPAPTAAPGNTGMVQGPSSGNTSSSSHSKASNAAVKLAESKVSVAVEASADSSKTDKKLQIQEKAAQEVKLAIKPFYQNKDITKEEYKEIVRKAVDKVSYGFSGVCARCFEPPLF

SEQ ID NO: 905018 - protein, 1484 aa, Homo sapiens
MQEGGSEAVGRRGRGKVGRKLIPGRRQGGWRAQHARTERGQATGKRVSARLKATGTWETLFQREMKKKTVCTLNMGDKKYEDMEGEENGDNTISTGLLYSEADRCPICLNCLLEKEVGFPESCNHVFCMTCILKWAEELFIPIKTLETLASCPIDRKPFQAVFKFSALEGYVKVQVKKQLRETKDKKNENSFEKQVSCHENSKSCIRRKAIVREDLLSAKVCDLKWIHRNSLYSETGGKKNAAIKINKPQRSNWSTNQCFRNFFSNMFSSVSHSGESSFTYRAYCTEFIEASEISALIRQKRHELELSWFPDTLPGIGRIGFIPWNVETEVLPLISSVLPRTIFPTSTISFEHFGTSCKGYALAHTQEGEEKKQTSGTSNTRGSRRKPAMTTPTRRSTRNTRAETASQSQRSPISDNSGCDAPGNSNPSLSVPSSAESEKQTRQAPKRKSVRRGRKPPLLKKKLRSSVAAPEKSSSNDSVDEETAESDTSPVLEKEHQPDVDSSNICTVQTHVENQSANCLKSCNEQIEESEKHTANYDTEERVGSSSSESCAQDLPVLVGEEGEVKKLENTGIEANVLCLESEISENILEKGGDPLEKQDQISGLSQSEVKTDVCTVHLPNDFPTCLTSESKVYQPVSCPLSDLSENVESVVNEEKITESSLVEITEHKDFTLKTEELIESPKLESSEGEIIQTVDRQSVKSPEVQLLGHVETEDVEIIATCDTFGNEDFNNIQDSENNLLKNNLLNTKLEKSLEEKNESLTEHPRSTELPKTHIEQIQKHFSEDNNEMIPMECDSFCSDQNESEVEPSVNADLKQMNENSVTHCSENNMPSSDLADEKVETVSQPSESPKDTIDKTKKPRTRRSRFHSPSTTWSPNKDTPQEKKRPQSPSPRRETGKESRKSQSPSPKNESARGRKKSRSQSPKKDIARERRQSQSRSPKRDTTRESRRSESLSPRRETSRENKRSQPRVKDSSPGEKSRSQSRERESDRDGQRRERERRTRKWSRSRSHSRSPSRCRTKSKSSSFGRIDRDSYSPRWKGRWANDGWRCPRGNDRYRKNDPEKQNENTRKEKNDIHLDADDPNSADKHRNDCPNWITEKINSGPDPRTRNPEKLKESHWEENRNENSGNSWNKNFGSGWVSNRGRGRGNRGRGTYRSSFAYKDQNENRWQNRKPLSGNSNSSGSESFKFVEQQSYKRKSEQEFSFDTPADRSGWTSASSWAVRKTLPADVQNYYSRRGRNSSGPQSGWMKQEEETSGQDSSLKDQTNQQVDGSQLPINMMQPQMNVMQQQMNAQHQPMNIFPYPVGVHAPLMNIQRNPFNIHPQLPLHLHTGVPLMQVATPTSVSQGLPPPPPPPPPSQQVNYIASQPDGKQLQGIPSSSHVSNNMSTPVLPAPTAAPGNTGMVQGPSSGNTSSSSHSKASNAAVKLAESKKLQIQEKAAQEVKLAIKPFYQNKDITKEEYKEIVRKAVDKCVLLECSIQKM

SEQ ID NO: 905019 - protein, 160 aa, Homo sapiens
MKKKTVCTLNMGDKKYEDMEGEENGDNTISTGLLYSEADRCPICLNCLLEKEVGFPESCNHVFCMTCILKWAEELFIPIKTLETLASCPIDRKPFQAVFKFSALEGYVKVQVKKQLRETKDKKNENSFEKQVSCHENSKSCIRLVINFRSGMQMSGTEVN

SEQ ID NO: 905020 - protein, 221 aa, Homo sapiens
QFQAKTSKVESDQPQNSNDASMDATDQVVYKHCTVSGQTDAAKNAAAPAASSGSGTSTPLIPSPKPEPEKTSPKPEYPAEKPKQSDPSPPSQGTKPALPLASTSSDPPQASTAQPQPQPQPPKQPQLIGRPPSASQTPVPSSPLQISMTSLQNSLPPQLLQYQCDQCTVAFPTLELWQEHQHMHFLAAQNQFLHSPFLERPMDMPYMIFDPNNPLMTGQLL

SEQ ID NO: 905021 - protein, 269 aa, Homo sapiens
SYENQAETKDNEKRELTNERYIRTSNMQYQCKKCNVVFPRIFDLITHQKKQCYKDEDDDAQDESQTEDSMDATDQVVYKHCTVSGQTDAAKNAAAPAASSGSGTSTPLIPSPKPEPEKTSPKPEYPAEKPKQSDPSPPSQGTKPALPLASTSSDPPQASTAQPQPQPQPPKQPQLIGRPPSASQTPVPSSPLQISMTSLQNSLPPQLLQYQCDQCTVAFPTLELWQEHQHMHFLAAQNQFLHSPFLERPMDMPYMIFDPNNPLMTGQLL

SEQ ID NO: 905022 - protein, 469 aa, Homo sapiens
MSIHFSSPVFTSRSAAFSGRGAQVRLSSARPGGLGSSSLYGLGASRPRVAVRSAYGGPVGAGIREVTINQSLLAPLRLDADPSLQRVRQEESEQIKTLNNKFASFIDKVRFLEQQNKLLETKWTLLQEQKSAKSSRLPDIFEAQIAGLRGQLEALQVDGGRLEAELRSMQDVVEDFKNKYEDEINRRTAAENEFVVLKKDVDAAYMSKVELEAKVDALNDEINFLRTLNETELTELQSQISDTSVVLSMDNSRSLDLDGIIAEVKAQYEEMAKCSRAEAEAWYQTKFETLQAQAGKHGDDLRNTRNEISEMNRAIQRLQAEIDNIKNQRAKLEAAIAEAEERGELALKDARAKQEELEAALQRAKQDMARQLREYQELMSVKLALDIEIATYRKLLEGEESRLAGDGVGAVNISVMNSTGGSSSGGGIGLTLGGTMGSNALSFSSSAGPGLLKAYSIRTASASRRSARD

SEQ ID NO: 905023 - protein, 469 aa, Homo sapiens; identical to SEQ ID NO: 905022

SEQ ID NO: 905024 - protein, 469 aa, Homo sapiens; identical to SEQ ID NO: 905022

SEQ ID NO: 905025 - protein, 469 aa, Homo sapiens; identical to SEQ ID NO: 905022

SEQ ID NO: 905026 - protein, 469 aa, Homo sapiens; identical to SEQ ID NO: 905022

SEQ ID NO: 905027 - protein, 436 aa, Homo sapiens
KIRLVRGRVLIGRARVAVRSAYGGPVGAGIREVTINQSLLAPLRLDADPSLQRVRQEESEQIKTLNNKFASFIDKVRFLEQQNKLLETKWTLLQEQKSAKSSRLPDIFEAQIAGLRGQLEALQVDGGRLEAELRSMQDVVEDFKNKYEDEINRRTAAENEFVVLKKDVDAAYMSKVELEAKVDALNDEINFLRTLNETELTELQSQISDTSVVLSMDNSRSLDLDGIIAEVKAQYEEMAKCSRAEAEAWYQTKFETLQAQAGKHGDDLRNTRNEISEMNRAIQRLQAEIDNIKNQRAKLEAAIAEAEERGELALKDARAKQEELEAALQRAKQDMARQLREYQELMSVKLALDIEIATYRKLLEGEESRLAGDGVGAVNISVMNSTGGSSSGGGIGLTLGGTMGSNALSFSSSAGPGLLKAYSIRTASASRRSARD

SEQ ID NO: 905028 - protein, 486 aa, Homo sapiens
MSIHFSSPVFTSRSAAFSGRGAQVRLSSARPGGLGSSSLYGLGASRPRVAVRSAYGGPVGAGIREVTINQSLLAPLRLDADPSLQRVRQEESEQIKTLNNKFASFIDKVRFLEQQNKLLETKWTLLQEQKSAKSSRLPDIFEAQIAGLRGQLEALQVDGGRLEAELRSMQDVVEDFKNKYEDEINRRTAAENEFVVLKKDVDAAYMSKVELEAKVDALNDEINFLRTLNETELTELQSQISDTSVVLSMDNSRSLDLDGIIAEVKAQYEEMAKCSRAEAEAWYQTKFETLQAQAGKHGDDLRNTRNEISEMNRAIQRLQAEIDNIKNQVLAWADGRKVLDVHRACGGRLRLAGQKKATTGSTLILSTLLAPGSGCRALSLGAHHSLQGQRTAEDLIMTHMALSHPLQPHFPRFPSLCSGHANLLPASCICQEWSCFRAFALGVASPWNVVLPALSMVVVFSSLGFRKRPLLRDGTLKHQPLYRQPV

SEQ ID NO: 905029 - protein, 434 aa, Homo sapiens
MSIHFSSPVFTSRSAAFSGRGAQVRLSSARPGGLGSSSLYGLGASRPRVAVRSAYGGPVGAGIREVTINQSLLAPLRLDADPSLQRVRQEESEQIKTLNNKFASFIDKVRFLEQQNKLLETKWTLLQEQKSAKSSRLPDIFEAQIAGLRGQLEALQVDGGRLEAELRSMQDVVEDFKNKYEDEINRRTAAENEFVVLKKDVDAAYMSKVELEAKVDALNDEINFLRTLNETELTELQSQISDTSVVLSMDNSRSLDLDGIIAEVKAQYEEMAKCSRAEAEAWYQTKFETLQAQAGKHGDDLRNTRNEISEMNRAIQRLQAEIDNIKNQRAKLEAAIAEAEERGELALKDARAKQEELEAALQRAKQDMARQLREYQELMSVKLALDIEIATYRKLLEGEESRKEPSSLSVLCPQVGWRWSGSREYLCDEFHWWQ

SEQ ID NO: 905030 - protein, 424 aa, Homo sapiens
MSIHFSSPVFTSRSAAFSGRGAQVRLSSARPGGLGSSSLYGLGASRPRVAVRSAYGGPVGAGIREVTINQSLLAPLRLDADPSLQRVRQEESEQIKTLNNKFASFIDKVRFLEQQNKLLETKWTLLQEQKSAKSSRLPDIFEAQIAGLRGQLEALQVDGGRLEAELRSMQDVVEDFKNKYEDEINRRTAAENEFVVLKKDVDAAYMSKVELEAKVDALNDEINFLRTLNETELTELQSQISDTSVVLSMDNSRSLDLDGIIAEVMSVKLALDIEIAEIDNIKTRAKLEAAIAEAEERGELALKDARAKQEELEAALQRAKQDMARQLREYQELMSVKLALDIEIATYRKLLEGEESRLAGDGVGAVNISVMNSTGGSSSGGGIGLTLGGTMGSNALSFSSSAGPGLLKAYSIRTASASRRSARD

SEQ ID NO: 905031 - protein, 381 aa, Homo sapiens
LGRIIHLTLRVEIALGNKATLRFQKKKKKKREFHHIAQAGLKQSARLRLPDIFEAQIAGLRGQLEALQVDGGRLEAELRSMQDVVEDFKNKYEDEINRRTAAENEFVVLKKDVDAAYMSKVELEAKVDALNDEINFLRTLNETELTELQSQISDTSVVLSMDNSRSLDLDGIIAEVKAQYEEMAKCSRAEAEAWYQTKFETLQAQAGKHGDDLRNTRNEISEMNRAIQRLQAEIDNIKNQRAKLEAAIAEAEERGELALKDARAKQEELEAALQRAKQDMARQLREYQELMSVKLALDIEIATYRKLLEGEESRLAGDGVGAVNISVMNSTGGSSSGGGIGLTLGGTMGSNALSFSSSAGPGLLKAYSIRTASASRRSARD

SEQ ID NO: 905032 - protein, 296 aa, Homo sapiens
ALLYCRYEDEINRRTAAENEFVVLKKDVDAAYMSKVELEAKVDALNDEINFLRTLNETELTELQSQISDTSVVLSMDNSRSLDLDGIIAEVKAQYEEMAKCSRAEAEAWYQTKFETLQAQAGKHGDDLRNTRNEISEMNRAIQRLQAEIDNIKNQRAKLEAAIAEAEERGELALKDARAKQEELEAALQRAKQDMARQLREYQELMSVKLALDIEIATYRKLLEGEESRLAGDGVGAVNISVMNSTGGSSSGGGIGLTLGGTMGSNALSFSSSAGPGLLKAYSIRTASASRRSARD

SEQ ID NO: 905033 - protein, 432 aa, Homo sapiens
MSIHFSSPVFTSRSAAFSGRGAQVRLSSARPGGLGSSSLYGLGASRPRVAVRSAYGGPVGAGIREVTINQSLLAPLRLDADPSLQRVRQEESEQIKTLNNKFASFIDKVRFLEQQNKLLETKWTLLQEQKSAKSSRLPDIFEAQIAGLRGQLEALQVDGGRLEAELRSMQDVVEDFKNKYEDEINRRTAAENEFVVLKKDVDAAYMSKVELEAKVDALNDEINFLRTLNETELTELQSQISDTSVVLSMDNSRSLDLDGIIAEVKAQYEEMAKCSRAEAEAWYQTKFETLQAQAGKHGDDLRNTRNEISEMNRAIQRLQAEIDNIKNQAIAEAEECGELALKDARAKQEELEAALQRAKQDMARQLREYQELMSVKLALDIEIATYRKLLEGEESRLAGDGVGAVNISVMNSTGGSSSGGGIGLALGGTMGS

SEQ ID NO: 905034 - protein, 221 aa, Homo sapiens
MDNSRSLDLDGIIAEVKAQYEEMAKCSRAEAEAWYQTKFETLQAQAGKHGDDLRNTRNEISEMNRAIQRLQAEIDNIKNQRAKLEAAIAEAEERGELALKDARAKQEELEAALQRAKQDMARQLREYQELMSVKLALDIEIATYRKLLEGEESRLAGDGVGAVNISVMNSTGGSSSGGGIGLTLGGTMGSNALSFSSSAGPGLLKAYSIRTASASRRSARD

SEQ ID NO: 905035 - protein, 242 aa, Homo sapiens
MKGGHLNCSTHNYQYTSVVLSMDNSRSLDLDGIIAEVKAQYEEMAKCSRAEAEAWYQTKFETLQAQAGKHGDDLRNTRNEISEMNRAIQRLQAEIDNIKNQRAKLEAAIAEAEERGELALKDARAKQEELEAALQRAKQDMARQLREYQELMSVKLALDIEIATYRKLLEGEESRLAGDGVGAVNISVMNSTGGSSSGGGIGLTLGGTMGSNALSFSSSAGPGLLKAYSIRTASASRRSARD

SEQ ID NO: 905036 - protein, 184 aa, Homo sapiens
MLSLAERQTASTEGRGSEDREWPDGQAGRQTGEPQLTAALLPTRAKLEAAIAEAEERGELALKDARAKQEELEAALQRAKQDMARQLREYQELMSVKLALDIEIATYRKLLEGEESRLAGDGVGAVNISVMNSTGGSSSGGGIGLTLGGTMGSNALSFSSSAGPGLLKAYSIRTASASRRSARD

SEQ ID NO: 905037 - protein, 71 aa, Homo sapiens
YEALGPGMGVRAGNISVMNSTGGSSSGGGIGLTLGGTMGSNALSFSSSAGPGLLKAYSIRTASASRRSARD

SEQ ID NO: 905038 - protein, 69 aa, Homo sapiens
MGSLVGSLTLKRALLFSLPAVMNSTGGSSSGGGIGLTLGGTMGSNALSFSSSAGPGLLKAYSIRTASAS

SEQ ID NO: 905039 - protein, 116 aa, Homo sapiens
MDSLVLGGVGGANEATLSKLPGCSLQDGQAGRQTGEPQLTAALLPTRAKLEAAIAEAEERGELALKDARAKQEELEAALQRAKQDMARQLREYQELMSVKLALDIEIATYRKLLEG

SEQ ID NO: 905040 - protein, 469 aa, Homo sapiens; identical to SEQ ID NO: 905022

SEQ ID NO: 905041 - protein, 469 aa, Homo sapiens; identical to SEQ ID NO: 905022

SEQ ID NO: 905042 - protein, 469 aa, Homo sapiens; identical to SEQ ID NO: 905022

SEQ ID NO: 905043 - protein, 469 aa, Homo sapiens; identical to SEQ ID NO: 905022

SEQ ID NO: 905044 - protein, 486 aa, Homo sapiens; identical to SEQ ID NO: 905028

SEQ ID NO: 905045 - protein, 388 aa, Homo sapiens
MSIHFSSPVFTSRSAAFSGRGAQVRLSSARPGGLGSSSLYGLGASRPRVAVRSAYGGPVGAGIREVTINQSLLAPLRLDADPSLQRVRQEESEQIKTLNNKFASFIDKVRFLEQQNKLLETKWTLLQEQKSAKSSRLPDIFEAQIAGLRGQLEALQVDGGRLEAELRSMQDVVEDFKNKYEDEINRRTAAENEFVVLKKDVDAAYMSKVELEAKVDALNDEINFLRTLNETELTELQSQISDTSVVLSMDNSRSLDLDGIIAEVKAQYEEMAKCSRAEAEAWYQTKFETLQAQAGKHGDDLRNTRNEISEMNRAIQRLQAEIDNIKNQVGQVLLASPATWGMQGWPAEAKLRMWSRRFPSPGQSWCHCLRPPCEISSTECSWPGPGMG

SEQ ID NO: 905046 - protein, 355 aa, Homo sapiens
MNKLLETKWTLLQEQKSAKSSRLPDIFEAQIAGLRGQLEALQVDGGRLEAELRSMQDVVEDFKNKYEDEINRRTAAENEFVVLKKDVDAAYMSKVELEAKVDALNDEINFLRTLNETELTELQSQISDTSVVLSMDNSRSLDLDGIIAEVKAQYEEMAKCSRAEAEAWYQTKFETLQAQAGKHGDDLRNTRNEISEMNRAIQRLQAEIDNIKNQRAKLEAAIAEAEERGELALKDARAKQEELEAALQRAKQDMARQLREYQELMSVKLALDIEIATYRKLLEGEESRLAGDGVGAVNISVMNSTGGSSSGGGIGLTLGGTMGSNALSFSSSAGPGLLKAYSIRTASASRRSARD

SEQ ID NO: 905047 - protein, 486 aa, Homo sapiens; identical to SEQ ID NO: 905028

SEQ ID NO: 905048 - protein, 398 aa, Homo sapiens
MSIHFSSPVFTSRSAAFSGRGAQVRLSSARPGGLGSSSLYGLGASRPRVAVRSAYGGPVGAGIREVTINQSLLAPLRLDADPSLQRVRQEESEQIKTLNNKFASFIDKVRFLEQQNKLLETKWTLLQEQKSAKSSRLPDIFEAQIAGLRGQLEALQVDGGRLEAELRSMQDVVEDFKNKYEDEINRRTAAENEFVVLKKDVDAAYMSKVELEAKVDALNDEINFLRTLNETELTELQSQISDTSVVLSMDNSRSLDLDGIIAEVKAQYEEMAKCSRAEAEAWYQTKFETLQAQAGKHGDDLRNTRNEISEMNRAIQRLQAEIDNIKNQRASGRRMPSGESGNRGPACRPREDVGTAVRANDMSRLANSDIGKGAKTKTTQGGRDQRAKEGNKTTVKRR

SEQ ID NO: 905049 - protein, 286 aa, Homo sapiens
EPATFHTGQVIATPAWSNQSYSSLGNKREAKVDALNDEINFLRTLNETELTELQSQISDTSVVLSMDNSRSLDLDGIIAEVKAQYEEMAKCSRAEAEAWYQTKFETLQAQAGKHGDDLRNTRNEISEMNRAIQRLQAEIDNIKNQRAKLEAAIAEAEERGELALKDARAKQEELEAALQRAKQDMARQLREYQELMSVKLALDIEIATYRKLLEGEESRLAGDGVGAVNISVMNSTGGSSSGGGIGLTLGGTMGSNALSFSSSAGPGLLKAYSIRTASASRRSARD

SEQ ID NO: 905050 - protein, 207 aa, Homo sapiens
GQALKHWSGTEAWSGTEAWYQRHKFETLQAQAGKHGDDLRNTRNEISEMNRAIQRLQAEIDNIKNQRAKLEAAIAEAEERGELALKDARAKQEELEAALQRAKQDMARQLREYQELMSVKLALDIEIATYRKLLEGEESRLAGDGVGAVNISVMNSTGGSSSGGGIGLTLGGTMGSNALSFSSSAGPGLLKAYSIRTASASRRSARD

SEQ ID NO: 905051 - protein, 99 aa, Homo sapiens
LLEVVALGCSLLLALDIEIATYRKLLEGEESRLAGDGVGAVNISVMNSTGGSSSGGGIGLTLGGTMGSNALSFSSSAGPGLLKAYSIRTASASRRSARD

SEQ ID NO: 905052 - protein, 78 aa, Homo sapiens
LFAWLFVRLMVWLMGGVGAVNISVMNSTGGSSSGGGIGLTLGGTMGSNALSFSSSAGPGLLKAYSIRTASASRRSARD

SEQ ID NO: 905053 - protein, 617 aa, Homo sapiens
FTVEDHTMQRDFRWLWVYEIGYAADNSRTLNVDSTAMTLPMSDPTAWATAMNNLGMAPLGIAGQPILPDFDPALGMMTGIPPITPMMPGLGIVPPPIPPDMPVVKEIIHCKSCTLFPPNPNLPPPATRERPPGCKTVFVGGLPENGTEQIIVEVFEQCGEIIAIRKSKKNFCHIRFAEEYMVDKALYLSGYRIRLGSSTDKKDTGRLHVDFAQARDDLYEWECKQRMLAREERHRRRMEEERLRPPSPPPVVHYSDHECSIVAEKLKDDSKFSEAVQTLLTWIERGEVNRRSANNFYSMIQSANSHVRRLVNEKAAHEKDMEEAKEKFKQALSGILIQFEQIVAVYHSASKQKAWDHFTKAQRKNISVWCKQAEEIRNIHNDELMGIRREEEMEMSDDEIEEMTETKETEESALVSQAEALKEENDSLRWQLDAYRNEVELLKQEQGKVHREDDPNKEQQLKLLQQALQGMQQHLLKVQEEYKKKEAELEKLKDDKLQVEKMLENLKEKESCASRLCASNQDSEYPLEKTMNSSPIKSEREALLVGIISTFLHVHPFGASIEYICSYLHRLDNKICTSDVECLMGRLQHTFKQEMTGVGASLEKRWKFCGFEGLKLT

SEQ ID NO: 905054 - protein, 581 aa, Homo sapiens
MTLPMSDPTAWATAMNNLGMAPLGIAGQPILPDFDPALGMMTGIPPITPMMPGLGIVPPPIPPDMPVVKEIIHCKSCTLFPPNPNLPPPATRERPPGCKTVFVGGLPENGTEQIIVEVFEQCGEIIAIRKSKKNFCHIRFAEEYMVDKALYLSGYRIRLGSSTDKKDTGRLHVDFAQARDDLYEWECKQRMLAREERHRRRMEEERLRPPSPPPVVHYSDHECSIVAEKLKDDSKFSEAVQTLLTWIERGEVNRRSANNFYSMIQSANSHVRRLVNEKAAHEKDMEEAKEKFKQALSGILIQFEQIVAVYHSASKQKAWDHFTKAQRKNISVWCKQAEEIRNIHNDELMGIRREEEMEMSDDEIEEMTETKETEESALVSQAEALKEENDSLRWQLDAYRNEVELLKQEQGKVHREDDPNKEQQLKLLQQALQGMQQHLLKVQEEYKKKEAELEKLKDDKLQVEKMLENLKEKESCASRLCASNQDSEYPLEKTMNSSPIKSEREALLVGIISTFLHVHPFGASIEYICSYLHRLDNKICTSDVECLMGRLQHTFKQEMTGVGASLEKRWKFCGFEGLKLT

SEQ ID NO: 905055 - protein, 113 aa, Homo sapiens
MLCPQESCASRLCASNQDSEYPLEKTMNSSPIKSEREALLVGIISTFLHVHPFGASIEYICSYLHRLDNKICTSDVECLMGRLQHTFKQEMTGVGASLEKRWKFCGFEGLKLT

SEQ ID NO: 905056 - protein, 581 aa, Homo sapiens; identical to SEQ ID NO: 905054

SEQ ID NO: 905057 - protein, 78 aa, Homo sapiens
VCESPALGQSAGSRPGSARRAFRKRVARRGAPRGHYEPRNCRAGPIFRGCIRTSASVAGELEVREAESPGGRGWGLWD

SEQ ID NO: 905058 - protein, 617 aa, Homo sapiens; identical to SEQ ID NO: 905053

SEQ ID NO: 905059 - protein, 172 aa, Homo sapiens
MASDEGKLFVGGLSFDTNEQSLEQVFSKYGQISEVVVVKDRETQRSRGFGFVTFENIDDAKDAMMAMNGKSVDGRQIRVDQAGKSSDNRSRGYRGGSAGGRGFFRGGRGRGRGFSRGGGDRGYGGNRFESRSGGYGGSRDYYSSRSQSGGYSDRSSGGSYRDSYDSYATHNE

SEQ ID NO: 905060 - protein, 168 aa, Homo sapiens
MASDEGKLFVGGLSFDTNEQSLEQVFSKYGQISEVVVVKDRETQRSRGFGFVTFENIDDAKDAMMAMNGKSVDGRQIRVDQAGKSSDNRSRGYRGGSAGGRGFFRGGRGRGRGFSRGGGDRGYGGNRFESRSGGYGGSRDYYSSRSQSGGYSDRSSGGSYRDSYDSYG

SEQ ID NO: 905061 - protein, 180 aa, Homo sapiens
TEPAPRNPLVAAMASDEGKLFVGGLSFDTNEQSLEQVFSKYGQISEVVVVKDRETQRSRGFGFVTFENIDDAKDAMMAMNGKSVDGRQIRVDQAGKSSDNRSRGYRGGSAGGRGFFRGGRGRGRGFSRGGGDRGYGGNRFESRSGGYGGSRDYYSSRSQSGGYSDRSSGGSYRDSYDSYG

SEQ ID NO: 905062 - protein, 172 aa, Homo sapiens; identical to SEQ ID NO: 905059

SEQ ID NO: 905063 - protein, 172 aa, Homo sapiens; identical to SEQ ID NO: 905059

SEQ ID NO: 905064 - protein, 172 aa, Homo sapiens; identical to SEQ ID NO: 905059

SEQ ID NO: 905065 - protein, 172 aa, Homo sapiens; identical to SEQ ID NO: 905059

SEQ ID NO: 905066 - protein, 172 aa, Homo sapiens; identical to SEQ ID NO: 905059

SEQ ID NO: 905067 - protein, 172 aa, Homo sapiens; identical to SEQ ID NO: 905059

SEQ ID NO: 905068 - protein, 172 aa, Homo sapiens; identical to SEQ ID NO: 905059

SEQ ID NO: 905069 - protein, 172 aa, Homo sapiens; identical to SEQ ID NO: 905059

SEQ ID NO: 905070 - protein, 299 aa, Homo sapiens
MASDEGKLFVGGLSFDTNEQSLEQVFSKYGQISEVVVVKDRETQRSRGFGFVTFENIDDAKDAMMAMNGKSVDGRQIRVDQAGKSSDNRSRGYRGGSAGGRGFFRGGRGRGRGFSRGGGDRGYGGNRFESRSGGYGGSRDYYSSRSQSGGYSDRSSGGSYRDSYDSYGKSHSEGATLLWPAVGARFTLVPSPSTLGWTLRPCHCACPEEAHLSSQSHFYRRTQKPNETDQKGKGERGPAGQSARCMCGLWGEAASCCFGAFTLCLLLVLSYTQRVKTLPAQDRPSNGCVFKDCGSFAER

SEQ ID NO: 905071 - protein, 199 aa, Homo sapiens
MASDEGKLFVGGLSFDTNEQSLEQVFSKYGQISEVVVVKDRETQRSRGFGFVTFENIDDAKDAMMAMNGKVRIRVLSRSPSRGWGTHLLTRPALCLQSVDGRQIRVDQAGKSSDNRSRGYRGGSAGGRGFFRGGRGRGRGFSRGGGDRGYGGNRFESRSGGYGGSRDYYSSRSQSGGYSDRSSGGSYRDSYDSYATHNE

SEQ ID NO: 905072 - protein, 97 aa, Homo sapiens
SHGQRIVQEQNAEIRRWYRGGSAGGRGFFRGGRGRGRGFSRGGGDRGYGGNRFESRSGGYGGSRDYYSSRSQSGGYSDRSSGGSYRDSYDSYATHNE

SEQ ID NO: 905073 - protein, 297 aa, Homo sapiens
MASDEGKLFVGGLSFDTNEQSLEQVFSKYGQISEVVVVKDRETQRSRGFGFVTFENIDDAKDAMMAMNGKSVDGRQIRVDQAGKSSDNRSRGYRGGSAGGRGFFRGGRGRGRGFSRGGGDRGYGGNRFESRSGGYGGSRDYYSSRSQSGGYSDRSSGGSYRDSYDSYGKSHSEGATLLWPAVGARFTLVPSPSTLGWTLRPCHCACPEEAHLSSQSHFYRRTQKPNETDQKGKGERGPAGQSARCMCGRRPASLGCGGWLLPGRRPRPGLASGVKLPLVASVPLHCACFLSSATHNE

SEQ ID NO: 905074 - protein, 244 aa, Homo sapiens
MSSRWSRSSQSTDRSLKSVDGRQIRVDQAGKSSDNRSRGYRGGSAGGRGFFRGGRGRGRGFSRGGGDRGYGGNRFESRSGGYGGSRDYYSSRSQSGGYSDRSSGGSYRDSYDSYGKSHSEGATLLWPAVGARFTLVPSPSTLGWTLRPCHCACPEEAHLSSQSHFYRRTQKPNETDQKGKGERGPAGQSARCMCGRRPASLGCGGWLLPGRRPRPGLASGVKLPLVASVPLHCACFLSSATHNE

SEQ ID NO: 905075 - protein, 135 aa, Homo sapiens [sequence omitted]

SEQ ID NO: 905076 - protein, 172 aa, Homo sapiens
MASDEGKLFVGGLSFDTNEQSLEQVFSKYGQISEVVVVKDRETQRSRGFGFVTFENIDDAKDAMMAMNGKSVDGRQIRVDQAGKSSDNRSRGYRGGSAGGRGFFRGGRGRGRGFSRGGGDRGYGGNRFESRSGGYGGSRDYYSSRSQSGGYSDRSSGGSYRDSYDSYATHNL

SEQ ID NO: 905077 - protein, 172 aa, Homo sapiens; identical to SEQ ID NO: 905059

SEQ ID NO: 905078 - protein, 135 aa, Homo sapiens [sequence omitted]

SEQ ID NO: 905079 - protein, 274 aa, Homo sapiens
MASDEGKLFVGGLSFDTNEQSLEQVFSKYGQISEVVVVKDRETQRSRGFGFVTFENIDDAKDAMMAMNGKSVDGRQIRVDQAGKSSDNRSRGYRGGSAGGRGFFRGGRGRGRGFSRGGGDRGYGGNRFESRSGGYGGSRDYYSSRSQSGGYSDRSSGGSYRDSYDSYGKSHSEGATLLWPAVGARFTLVPSPSTLGWTLRPCHCACPEEAHLSSQSHFYRRTQKPNETDQKGKGERGPAGQSARCMCGRRPASLGWSPRLFSLPSSSFQEALRQ

SEQ ID NO: 905080 - protein, 202 aa, Homo sapiens
MASDEGKLFVGGLSFDTNEQSLEQVFSKYGQISEVVVVKDRETQRSRGFGFVTFENIDDAKDAMMAMNGKSVDGRQIRVDQAGKSSDNRSRGYRGGSAGGRGFFRGGRGRGRGFSRGGGDRGYGGNRFESRSGGYGGSRDYYSSRSQSGGYSDRSSGGSYRDSYDSYEAGQRAEARGIPGRPQTASRLASSAVASRVLSILC

SEQ ID NO: 905081 - protein, 168 aa, Homo sapiens; identical to SEQ ID NO: 905060

SEQ ID NO: 905082 - protein, 168 aa, Homo sapiens; identical to SEQ ID NO: 905060

SEQ ID NO: 905083 - protein, 85 aa, Homo sapiens
GDLEDPIRRVSECSVVGPRRVWQQLPWSPSPCVHLCCAPHSRRADVPERFLKMFIYIVLFYWKTYAYSIDVVFAVAEEFLYAERA

SEQ ID NO: 905084 - protein, 55 aa, Homo sapiens
YSLFPVCAGGGDRGYGGNRFESRSGGYGGSRDYYSSRSQSVATVSLSLRSPQRRY

SEQ ID NO: 905085 - protein, 172 aa, Homo sapiens; identical to SEQ ID NO: 905059

SEQ ID NO: 905086 - protein, 172 aa, Homo sapiens; identical to SEQ ID NO: 905059

SEQ ID NO: 905087 - protein, 172 aa, Homo sapiens; identical to SEQ ID NO: 905059

SEQ ID NO: 905088 - protein, 297 aa, Homo sapiens; identical to SEQ ID NO: 905073

SEQ ID NO: 905089 - protein, 190 aa, Homo sapiens
TPRRGGGPGGVSGCSEAAMASDEGKLFVGGLSFDTNEQSLEQVFSKYGQISEVVVVKDRETQRSRGFGFVTFENIDDAKDAMMAMNGKSVDGRQIRVDQAGKSSDNRSRGYRGGSAGGRGFFRGGRGRGRGFSRGGGDRGYGGNRFESRSGGYGGSRDYYSSRSQSGGYSDRSSGGSYRDSYDSYATHNE

SEQ ID NO: 905090 - protein, 172 aa, Homo sapiens; identical to SEQ ID NO: 905059

SEQ ID NO: 905091 - protein, 119 aa, Homo sapiens
MSSRWSRSSQSTDRSLKSVDGRQIRVDQAGKSSDNRSRGYRGGSAGGRGFFRGGRGRGRGFSRGGGDRGYGGNRFESRSGGYGGSRDYYSSRSQSGGYSDRSSGGSYRDSYDSYATHNE

SEQ ID NO: 905092 - protein, 135 aa, Homo sapiens [sequence omitted]

SEQ ID NO: 905093 - protein, 286 aa, Homo sapiens
MSSRWSRSSQSTDRSLKTSLPCTVVVVKDRETQRSRGFGFVTFENIDDAKDAMMAMNGKSVDGRQIRVDQAGKSSDNRSRGYRGGSAGGRGFFRGGRGRGRGFSRGGGDRGYGGNRFESRSGGYGGSRDYYSSRSQSGGYSDRSSGGSYRDSYDSYGKSHSEGATLLWPAVGARFTLVPSPSTLGWTLRPCHCACPEEAHLSSQSHFYRRTQKPNETDQKGKGERGPAGQSARCMCGRRPASLGCGGWLLPGRRPRPGLASGVKLPLVASVPLHCACFLSSATHNE

SEQ ID NO: 905094 - protein, 135 aa, Homo sapiens [sequence omitted]

SEQ ID NO: 905095 - protein, 135 aa, Homo sapiens [sequence omitted]

SEQ ID NO: 905096 - protein, 284 aa, Homo sapiens
MASDEGKLFVGGLSFDTNEQSLEQVFSKYGQISEVVVVKDRETQRSRGFGFVTFENIDDAKDAMMAMNGKSVDGRQIRVDQAGKSSDNRSRGYRGGSAGGRGFFRGGRGRGRGFSRGGGDRGYGGNRFDVHLCCAPHSRRADVPERFLKMFIYIVLFYWKTYAYSIDVVFAVAEEFLYAVFFGFTKPIKRPCEMNLALTIPLHCTTHSLLRAPAARPEQREKVEKQRVCKPSLGPAELEREAQQTGAGQGRGARRGTGAGSSGLRAALGGFWQWWPEGWTVRAA

SEQ ID NO: 905097 - protein, 148 aa, Homo sapiens
SFDTNEQSLEQVFSKYGQISEVVVVKDRETQRSRGFGFVTFENIDDAKDAMMAMNGKSVDGRQIRVTAAMASDEGKLFVGGLSFDTNEQSLEQVFSKYGQISEVVVVKDRETQRSRGFGFVTFENIDDAKDAMMAMNGKRPSVLCAPQ

SEQ ID NO: 905098 - protein, 172 aa, Homo sapiens; identical to SEQ ID NO: 905059

SEQ ID NO: 905099 - protein, 168 aa, Homo sapiens; identical to SEQ ID NO: 905060

SEQ ID NO: 905100 - protein, 102 aa, Homo sapiens
GGRGRSQPPFRAGLLPAPSLTKWGRRRRGPAGPAGRTWRPRAWEPGRVLSPRPRGHRRSSRGGGLAPRRSHPNFHGSKKYFPIRGRSLPRQLRTTIKVFQGS

SEQ ID NO: 905101 - protein, 107 aa, Homo sapiens
MGKGDPKKPRGKMSSYAFFVQTCREEHKKKHPDASVNFSEFSKKCSERWKTMSAKEKGKFEDMAKADKARYEQRNENLYPSQRGDKKEVQGSQCTQEASFGLLPLLL

SEQ ID NO: 905102 - protein, 107 aa, Homo sapiens; identical to SEQ ID NO: 905101

SEQ ID NO: 905103 - protein, 107 aa, Homo sapiens; identical to SEQ ID NO: 905101

SEQ ID NO: 905104 - protein, 107 aa, Homo sapiens; identical to SEQ ID NO: 905101

SEQ ID NO: 905105 - protein, 107 aa, Homo sapiens; identical to SEQ ID NO: 905101

SEQ ID NO: 905106 - protein, 107 aa, Homo sapiens; identical to SEQ ID NO: 905101

SEQ ID NO: 905107 - protein, 107 aa, Homo sapiens; identical to SEQ ID NO: 905101

SEQ ID NO: 905108 - protein, 107 aa, Homo sapiens; identical to SEQ ID NO: 905101

SEQ ID NO: 905109 - protein, 107 aa, Homo sapiens; identical to SEQ ID NO: 905101

SEQ ID NO: 905110 - protein, 107 aa, Homo sapiens; identical to SEQ ID NO: 905101

SEQ ID NO: 905111 - protein, 138 aa, Homo sapiens
MGKGDPKKPRGKMSSYAFFVQTCREEHKKKHPDASVNFSEFSKKCSERWKTMSAKEKGKFEDMAKADKARYEQRNENLYPSQRGDNSAFFLFCSEYRPKIKGEHPGLSIGDVAKKLGEMWNNTAADDKQPYEQEGCEG

SEQ ID NO: 905112 - protein, 107 aa, Homo sapiens; identical to SEQ ID NO: 905101

SEQ ID NO: 905113 - protein, 107 aa, Homo sapiens; identical to SEQ ID NO: 905101

SEQ ID NO: 905114 - protein, 107 aa, Homo sapiens; identical to SEQ ID NO: 905101

SEQ ID NO: 905115 - protein, 107 aa, Homo sapiens; identical to SEQ ID NO: 905101

SEQ ID NO: 905116 - protein, 107 aa, Homo sapiens; identical to SEQ ID NO: 905101

SEQ ID NO: 905117 - protein, 132 aa, Homo sapiens
QLFILPHALYFRIEFKYNIKYAWTKYKALSSTLYTSSFRPSSSSALSIAQKSKENILACPLVMLRRNWERCGITLLQMTSSLMNKKAAKAERKNTNKDIAAYRAKGKGLMQQNNKGVVKAEKSKKKEGRGGR

SEQ ID NO: 905118 - protein, 158 aa, Homo sapiens
TLTKETCLRVAVPWSARAWSGAAGSWGDPRRWEREGLPKPAGVPWTLSAGAAFTAGPRRASVVRSPKASVELKLPQSACSQRVITHGAAPPCLPRAHLRGQGLFYQDSGVFLLLSSLPDLLTVRGAAKAQGLCIPRPVLTSQQPICPCCSNSSCPALF

SEQ ID NO: 905119 - protein, 107 aa, Homo sapiens; identical to SEQ ID NO: 905101

SEQ ID NO: 905120 - protein, 107 aa, Homo sapiens; identical to SEQ ID NO: 905101

SEQ ID NO: 905121 - protein, 107 aa, Homo sapiens; identical to SEQ ID NO: 905101

SEQ ID NO: 905122 - protein, 107 aa, Homo sapiens; identical to SEQ ID NO: 905101

SEQ ID NO: 905123 - protein, 107 aa, Homo sapiens; identical to SEQ ID NO: 905101

SEQ ID NO: 905124 - protein, 107 aa, Homo sapiens; identical to SEQ ID NO: 905101

SEQ ID NO: 905125 - protein, 107 aa, Homo sapiens; identical to SEQ ID NO: 905101

SEQ ID NO: 905126 - protein, 107 aa, Homo sapiens; identical to SEQ ID NO: 905101

SEQ ID NO: 905127 - protein, 107 aa, Homo sapiens; identical to SEQ ID NO: 905101

SEQ ID NO: 905128 - protein, 132 aa, Homo sapiens; identical to SEQ ID NO: 905117

SEQ ID NO: 905129 - protein, 103 aa, Homo sapiens
LDRYILLYLSSISAVVYRPSGSGRENSGLVQRGGIKATLERCGITLLQMTSSLMNKKAAKAERKNTNKDIAAYRAKGKGLMQQNNKGVVKAEKSKKKEGRGGR

SEQ ID NO: 905130 - protein, 107 aa, Homo sapiens; identical to SEQ ID NO: 905101

SEQ ID NO: 905131 - protein, 256 aa, Homo sapiens
MPGPATDAGKIPFCDAKEEIRAGLESSEGGGGPERPGARGQRQNIVWRNVVLMSLLHLGAVYSLVLIPKAKPLTLLWAYFCFLLAALGVTAGAHRLWSHRSYRAKLPLRIFLAVANSMAFQNDIFEWSRDHRAHHKYSETDADPHNARRGFFFSHIGWLFVRKHRDVIEKGRKLDVTDLLADPVVRIQRNTQHIQKEGRALNQEAACEMLREWHQGHILKVTLPGLHILALLHTHCNHSEKCCLMLRALSVSLEVF

SEQ ID NO: 905132 - protein, 330 aa, Homo sapiens
MPGPATDAGKIPFCDAKEEIRAGLESSEGGGGPERPGARGQRQNIVWRNVVLMSLLHLGAVYSLVLIPKAKPLTLLWAYFCFLLAALGVTAGAHRLWSHRSYRAKLPLRIFLAVANSMAFQNDIFEWSRDHRAHHKYSETDADPHNARRGFFFSHIGWLFVRKHRDVIEKGRKLDVTDLLADPVVRIQRKYYKISVVLMCFVVPTLVPWYIWGESLWNSYFLASILRYTISLNISWLVNSAAHMYGNRPYDKHISPRQNPLVALGAIGEGFHNYHHTFPFDYSASEFGLNFNPTTWFIDFMCWLGLATDRKRATKPMIEARKARTGDSSA

SEQ ID NO: 905133 - protein, 190 aa, Homo sapiens
MPGPATDAGKIPFCDAKEEIRAGLESSEGGGGPERPGARGQRQNIVWRNVVLMSLLHLGAVYSLVLIPKAKPLTLLWAYFCFLLAALGVTAGAHRLWSHRSYRAKLPLRIFLAVANSMAFQNDIFEWSRDHRAHHKYSETDADPHNARRGFFFSHIGWLFVRKHRDVIEKGRKLDVTDLLADPVVRIQRK

SEQ ID NO: 905134 - protein, 371 aa, Homo sapiens
MAAVCYINPLEWQKPPPPPSSSARAERLPACRCCGRPPRPAMPGPATDAGKIPFCDAKEEIRAGLESSEGGGGPERPGARGQRQNIVWRNVVLMSLLHLGAVYSLVLIPKAKPLTLLWAYFCFLLAALGVTAGAHRLWSHRSYRAKLPLRIFLAVANSMAFQNDIFEWSRDHRAHHKYSETDADPHNARRGFFFSHIGWLFVRKHRDVIEKGRKLDVTDLLADPVVRIQRKYYKISVVLMCFVVPTLVPWYIWGESLWNSYFLASILRYTISLNISWLVNSAAHMYGNRPYDKHISPRQNPLVALGAIGEGFHNYHHTFPFDYSASEFGLNFNPTTWFIDFMCWLGLATDRKRATKPMIEARKARTGDSSA

SEQ ID NO: 905135 - protein, 132 aa, Homo sapiens
MCFVVPTLVPWYIWGESLWNSYFLASILRYTISLNISWLVNSAAHMYGNRPYDKHISPRQNPLVALGAIGEGFHNYHHTFPFDYSASEFGLNFNPTTWFIDFMCWLGLATDRKRATKPMIEARKARTGDSSA

SEQ ID NO: 905136 - protein, 362 aa, Homo sapiens
RAGCRRGLAVREIPPKGKARATLISIGNACCLRVGPTATCAARANPFCTEEIRAGLESSEGGGGPERPGARGQRQNIVWRNVVLMSLLHLGAVYSLVLIPKAKPLTLLWAYFCFLLAALGVTAGAHRLWSHRSYRAKLPLRIFLAVANSMAFQNDIFEWSRDHRAHHKYSETDADPHNARRGFFFSHIGWLFVRKHRDVIEKGRKLDVTDLLADPVVRIQRKYYKISVVLMCFVVPTLVPWYIWGESLWNSYFLASILRYTISLNISWLVNSAAHMYGNRPYDKHISPRQNPLVALGAIGEGFHNYHHTFPFDYSASEFGLNFNPTTWFIDFMCWLGLATDRKRATKPMIEARKARTGDSSA

SEQ ID NO: 905137 - protein, 228 aa, Homo sapiens
THAYDHASAGMSPNPWTFQNDIFEWSRDHRAHHKYSETDADPHNARRGFFFSHIGWLFVRKHRDVIEKGRKLDVTDLLADPVVRIQRKYYKISVVLMCFVVPTLVPWYIWGESLWNSYFLASILRYTISLNISWLVNSAAHMYGNRPYDKHISPRQNPLVALGAIGEGFHNYHHTFPFDYSASEFGLNFNPTTWFIDFMCWLGLATDRKRATKPMIEARKARTGDSSA

SEQ ID NO: 905138 - protein, 199 aa, Homo sapiens
MPGPATDAGKIPFCDAKEEIRAGLESSEGGGGPERPGARGQRQNIVWRNVVLMSLLHLGAVYSLVLIPKAKPLTLLWAYFCFLLAALGVTAGAHRLWSHRSYRAKLPLRIFLAVANSMAFQNDIFEWSRDHRAHHKYSETDADPHNARRGFFFSQPKKLFKSILLRFNIRVWTCDLIAIAKIRQIYVVMCLNMMLTLTG

SEQ ID NO: 905139 - protein, 330 aa, Homo sapiens; identical to SEQ ID NO: 905132

SEQ ID NO: 905140 - protein, 330 aa, Homo sapiens; identical to SEQ ID NO: 905132

SEQ ID NO: 905141 - protein, 252 aa, Homo sapiens
MPGPATDAGKIPFCDAKEEIRAGLESSEGGGGPERPGARGQRQNIVWRNVVLMSLLHLGAVYSLVLIPKAKPLTLLWAYFCFLLAALGVTAGAHRLWSHSTQRRMLTPTMPAGASSSPILGGCLFASIEMLLRRGESLTSLTCLLILWSGSRESTIRSPWCSCALWSPRWCPGTSGERVCGIPTSWPLFSAIPSHSTSAGWSTAPPTCMETGPMTSTSALGRTHSSLWVPLVKASIITITPFPLTTLRVNLA

SEQ ID NO: 905142 - protein, 561 aa, Homo sapiens
MCALFILFLVFGACLALPVLLCVTGMLHSHVLVLVPIPPVFPVYWVMRFSVPSLGCLCRSWFLAGLLSLFLGPRCQILWVRRFVPCRLIMRDMVYSDVEDAQAVGVPRSLSADVPGTSVGTTKHMSTTEIFSTFSESGTTGSSKQGQLTFKHFSQFLNNYPQMLAERTATHMGEEEAPAGIVGVSHPSLEYFVWARWSLDHSKMSFWKAMDLADSQKYPQRQLGPVGPVAPQAMGTICHTSERPGGSRSEAQSRVSGLALGMSTREPGARGQRQNIVWRNVVLMSLLHLGAVYSLVLIPKAKPLTLLWAYFCFLLAALGVTAGAHRLWSHRSYRAKLPLRIFLAVANSMAFQNDIFEWSRDHRAHHKYSETDADPHNARRGFFFSHIGWLFVRKHRDVIEKGRKLDVTDLLADPVVRIQRKYYKISVVLMCFVVPTLVPWYIWGESLWNSYFLASILRYTISLNISWLVNSAAHMYGNRPYDKHISPRQNPLVALGAIGEGFHNYHHTFPFDYSASEFGLNFNPTTWFIDFMCWLGLATDRKRATKPMIEARKARTGDSSA

SEQ ID NO: 905143 - protein, 330 aa, Homo sapiens; identical to SEQ ID NO: 905132

SEQ ID NO: 905144 - protein, 132 aa, Homo sapiens
MPGPATDAGKIPFCDAKEEIRAGLESSEGGGGPERPGARGQRQNIVWRNVVLMSLLHLGAVYSLVLIPKAKPLTLLWAYFCFLLAALGVTAGAHRLWSHRSYRAKLPLRIFLAVANSMAFQAAAEVVLTQMP

SEQ ID NO: 905145 - protein, 119 aa, Homo sapiens
MLRAPRAILGFVNKQQAHDLLINKPDGTFLLRFSDSEIGGITIAWKFDSPERNLWNLKPFTTRDFSIRSLADRLGDLSYLIYVFPDRPKDEVFSKYYTPVLAKAVDGYVKPQIKQVVPE

SEQ ID NO: 905146 - protein, 208 aa, Homo sapiens [sequence omitted]

SEQ ID NO: 905147 - protein, 72 aa, Homo sapiens
RIKRADRRGAESVTEEKFTVLFESQFSVGSNELVFQVKVRPPALLPPLLQVTQEVEGPASGLLAAMPSDSLL

SEQ ID NO: 905148 - protein, 48 aa, Homo sapiens
MLRAPRAILGFVNKQQAHDLLINKPDGTFLLRFSDSEIGGITIAWKFD

SEQ ID NO: 905149 - protein, 76 aa, Homo sapiens
IRHEGIQECAESLSVCNLVDKEVEKIGSRIWWVDRGPGTWRVGPLASWKKQKQKTAVKDKLQISHVLRACGIWSEG

SEQ ID NO: 905150 - protein, 542 aa, Homo sapiens
IQWKRRQQLAGNGGPPEGSLDVLQSWCEKLAEIIWQNRQQIRRAEHLCQQLPIPGPVEEMLAEVNATITDIISALVTSTFIIEKQPPQVLKTQTKFAATVRLLVGGKLNVHMNPPQVKATIISEQQAKSLLKNENTRNECSGEILNNCCVMEYHQATGTLSAHFRNMSLKRIKRADRRGAESVTEEKFTVLFESQFSVGSNELVFQVKTLSLPVVVIVHGSQDHNATATVLWDNAFAEPGRVPFAVPDKVLWPQLCEALNMKFKAEVQSNRGLTKENLVFLAQKLFNNSSSHLEDYSGLSVSWSQFNRENLPGWNYTFWQWFDGVMEVLKKHHKPHWNDGAILGFVNKQQAHDLLINKPDGTFLLRFSDSEIGGITIAWKFDSPERNLWNLKPFTTRDFSIRSLADRLGDLSYLIYVFPDRPKDEVFSKYYTPVLAKAVDGYVKPQIKQVVPEFVNASADAGGSSATYMDQAPSPAVCPQAPYNMYPQNPDHVLDQDGEFDLDETMDVARHVEELLRRPMDSLDSRLSPPAGLFTSARGSLS

SEQ ID NO: 905151 - protein, 542 aa, Homo sapiens; identical to SEQ ID NO: 905150

SEQ ID NO: 905152 - protein, 237 aa, Homo sapiens
NSARAARVGFGAQVPPDWQVSHEFALNFNPSNPYCAGIQGIVDAYRQALPQVRLYGPTNFAPIINHVARFAAQAAHQGTASQYFMLLLLTDGAVTDVEATREAVVRASNLPMSVIIVGVGGADFEAMEQLDADGGPLHTRSGQAAARDIVQFVPYRRFQNAPREALAQTVLAEVPTQLVSYFRAQGWAPLKPLPPSAKDPATGPPGLGSLGGCGKSSILCPRGPSGPQPNPSHSPQC

SEQ ID NO: 905153 - protein, 573 aa, Homo sapiens
MKMMHMAHCVTLVQLSISCDHLIDKDIGSKSDPLCVLLQDVGGGSWAELGRTERVRNCSSPEFSKTLQLEYRFETVQKLRFGIYDIDNKTPELRDDDFLGGAECSLGQIVSSQVLTLPLMLKPGKPAGRGTITVSAQELKDNRVVTMEVEARNLDKKDFLGKSDPFLEFFRQGDGKWHLVYRSEVIKNNLNPTWKRFSVPVQHFCGGNPSTPIQVQCSDYDSDGSHDLIGTFHTSLAQLQAVPAEFECIHPEKQQKKKSYKNSGTIRVKICRVETEYSFLDYVMGGCQINFTVGVDFTGSNGDPSSPDSLHYLSPTGVNEYLMALWSVGSVVQDYDSDKLFPAFGFGAQVPPDWQVSHEFALNFNPSNPYCAGIQGIVDAYRQALPQVRLYGPTNFAPIINHVARFAAQAAHQGTASQYFMLLLLTDGAVTDVEATREAVVRASNLPMSVIIVGVGGADFEAMEQLDADGGPLHTRSGQAAARDIVQFVPYRRFQNAPREALAQTVLAEVPTQLVSYFRAQGWAPLKPLPPSAKDPATGPPGLGSLGGCGKSSILCPRGPSGPQPNPSHSPQC

SEQ ID NO: 905154 - protein, 573 aa, Homo sapiens; identical to SEQ ID NO: 905153

SEQ ID NO: 905155 - protein, 645 aa, Homo sapiens
RRAGLSVTTCDTDGWLACARGIQATADIADMRGPRRRWWLRWAPGSRSGWGCRPRGGGTRAGGVIRGLGSGAAQLSPMAHCVTLVQLSISCDHLIDKDIGSKSDPLCVLLQDVGGGSWAELGRTERVRNCSSPEFSKTLQLEYRFETVQKLRFGIYDIDNKTPELRDDDFLGGAECSLGQIVSSQVLTLPLMLKPGKPAGRGTITVSAQELKDNRVVTMEVEARNLDKKDFLGKSDPFLEFFRQGDGKWHLVYRSEVIKNNLNPTWKRFSVPVQHFCGGNPSTPIQVQCSDYDSDGSHDLIGTFHTSLAQLQAVPAEFECIHPEKQQKKKSYKNSGTIRVKICRVETEYSFLDYVMGGCQINFTVGVDFTGSNGDPSSPDSLHYLSPTGVNEYLMALWSVGSVVQDYDSDKLFPAFGFGAQVPPDWQVSHEFALNFNPSNPYCAGIQGIVDAYRQALPQVRLYGPTNFAPIINHVARFAAQAAHQGTASQYFMLLLLTDGAVTDVEATREAVVRASNLPMSVIIVGVGGADFEAMEQLDADGGPLHTRSGQAAARDIVQFVPYRRFQNAPREALAQTVLAEVPTQLVSYFRAQGWAPLKPLPPSAKDPATGPPGLGSLGGCGKSSILCPRGPSGPQPNPSHSPQC

SEQ ID NO: 905156 - protein, 568 aa, Homo sapiens
MAHCVTLVQLSISCDHLIDKDIGSKSDPLCVLLQDVGGGSWAELGRTERVRNCSSPEFSKTLQLEYRFETVQKLRFGIYDIDNKTPELRDDDFLGGAECSLGQIVSSQVLTLPLMLKPGKPAGRGTITVSAQELKDNRVVTMEVEARNLDKKDFLGKSDPFLEFFRQGDGKWHLVYRSEVIKNNLNPTWKRFSVPVQHFCGGNPSTPIQVQCSDYDSDGSHDLIGTFHTSLAQLQAVPAEFECIHPEKQQKKKSYKNSGTIRVKICRVETEYSFLDYVMGGCQINFTVGVDFTGSNGDPSSPDSLHYLSPTGVNEYLMALWSVGSVVQDYDSDKLFPAFGFGAQVPPDWQVSHEFALNFNPSNPYCAGIQGIVDAYRQALPQVRLYGPTNFAPIINHVARFAAQAAHQGTASQYFMLLLLTDGAVTDVEATREAVVRASNLPMSVIIVGVGGADFEAMEQLDADGGPLHTRSGQAAARDIVQFVPYRRFQNAPREALAQTVLAEVPTQLVSYFRAQGWAPLKPLPPSAKDPATGPPGLGSLGGCGKSSILCPRGPSGPQPNPSHSPQC

SEQ ID NO: 905157 - protein, 549 aa, Homo sapiens
MKMMHMAHCVTLVQLSISCDHLIDKDIGSKSDPLCVLLQDVGGGSWAELGRTERVRNCSSPEFSKTLQLEYRFETVQKLRFGIYDIDNKTPELRDDDFLGGAECSLGQIVSSQVLTLPLMLKPGKPAGRGTITDFLGKSDPFLEFFRQGDGKWHLVYRSEVIKNNLNPTWKRFSVPVQHFCGGNPSTPIQVQCSDYDSDGSHDLIGTFHTSLAQLQAVPAEFECIHPEKQQKKKSYKNSGTIRVKICRVETEYSFLDYVMGGCQINFTVGVDFTGSNGDPSSPDSLHYLSPTGVNEYLMALWSVGSVVQDYDSDKLFPAFGFGAQVPPDWQVSHEFALNFNPSNPYCAGIQGIVDAYRQALPQVRLYGPTNFAPIINHVARFAAQAAHQGTASQYFMLLLLTDGAVTDVEATREAVVRASNLPMSVIIVGVGGADFEAMEQLDADGGPLHTRSGQAAARDIVQFVPYRRFQNAPREALAQTVLAEVPTQLVSYFRAQGWAPLKPLPPSAKDPATGPPGLGSLGGCGKSSILCPRGPSGPQPNPSHSPQC

SEQ ID NO: 905158 - protein, 605 aa, Homo sapiens
MKMMHMAHCVTLVQLSISCDHLIDKDIGSKSDPLCVLLQDVGGGSWAELGRTERVRNCSSPEFSKTLQLEYRFETVQKLRFGIYDIDNKTPELRDDDFLGGAECSLGQIVSSQVLTLPLMLKPGKPAGRGTITVSAQELKDNRVVTMEVEARNLDKKDFLGKSDPFLEFFRQGDGKWHLVYRSEVIKNNLNPTWKRFSVPVQHFCGGNPSTPIQVQCSDYDSDGSHDLIGTFHTSLAQLQAVPAEFECIHPEKQQKKKSYKNSGTIRVKICRVRQKPMYTKALIPELHDTNCYHPRHDPGFIVQVETEYSFLDYVMGGCQINFTVGVDFTGSNGDPSSPDSLHYLSPTGVNEYLMALWSVGSVVQDYDSDKLFPAFGFGAQVPPDWQVSHEFALNFNPSNPYCAGIQGIVDAYRQALPQVRLYGPTNFAPIINHVARFAAQAAHQGTASQYFMLLLLTDGAVTDVEATREAVVRASNLPMSVIIVGVGGADFEAMEQLDADGGPLHTRSGQAAARDIVQFVPYRRFQNAPREALAQTVLAEVPTQLVSYFRAQGWAPLKPLPPSAKDPATGPPGLGSLGGCGKSSILCPRGPSGPQPNPSHSPQC

SEQ ID NO: 905159 - protein, 612 aa, Homo sapiens [sequence omitted]

SEQ ID NO: 905160 - protein, 612 aa, Homo sapiens [sequence omitted]

SEQ ID NO: 905161 - protein, 612 aa, Homo sapiens [sequence omitted]

SEQ ID NO: 905162 - protein, 612 aa, Homo sapiens [sequence omitted]

SEQ ID NO: 905163 - protein, 573 aa, Homo sapiens; identical to SEQ ID NO: 905153

SEQ ID NO: 905164 - protein, 671 aa, Homo sapiens
RRAGLSVTTCDTDGWLACARGIQATARYRGHERPAKEVVAALGSGKPFGLGLSAAGRRHSRGGGNSGSGFWCRAAFPGLTWPLLLVKEIHLLFYQMAHCVTLVQLSISCDHLIDKDIGSKSDPLCVLLQDVGGGSWAELGRTERVRNCSSPEFSKTLQLEYRFETVQKLRFGIYDIDNKTPELRDDDFLGGAECSLGQIVSSQVLTLPLMLKPGKPAGRGTITDFLGKSDPFLEFFRQGDGKWHLVYRSEVIKNNLNPTWKRFSVPVQHFCGGNPSTPIQVQCSDYDSDGSHDLIGTFHTSLAQLQAVPAEFECIHPEKQQKKKSYKNSGTIRVKICRVRQKPMYTKALIPELHDTNCYHPRHDPGFIVQVETEYSFLDYVMGGCQINFTVGVDFTGSNGDPSSPDSLHYLSPTGVNEYLMALWSVGSVVQDYDSDKLFPAFGFGAQVPPDWQVSHEFALNFNPSNPYCAGIQGIVDAYRQALPQVRLYGPTNFAPIINHVARFAAQAAHQGTASQYFMLLLLTDGAVTDVEATREAVVRASNLPMSVIIVGVGGADFEAMEQLDADGGPLHTRSGQAAARDIVQFVPYRRFQNAPREALAQTVLAEVPTQLVSYFRAQGWAPLKPLPPSAKDPATGPPGLGSLGGCGKSSILCPRGPSGPQPNPSHSPQC

SEQ ID NO: 905165 - protein, 932 aa, Homo sapiens
MAVVIRLQGLPIVAGTMDIRHFFSGLTIPDGGVHIVGGELGEAFIVFATDEDARLGMMRTGGTIKGSKVTLLLSSKTEMQNMIELSRRRFETANLDIPPANASRSGPPPSSGMSSRVNLPTTVSNFNNPSPSVVTATTSVHESNKNIQTFSTASVGTAPPNMGASFGSPTFSSTVPSTASPMNTVPPPPIPPIPAMPSLPPMPSIPPIPVPPPVPTLPPVPPVPPIPPVPSVPPMTPLPPMSGMPPLNPPPVAPLPAGMNGSGAPMNLNNNLNPMFLGPLNPVNPIQMNSQSSVKPLPINPDDLYVSVHGMPFSAMENDVRDFFHGLRVDAVHLLKDHVGRNNGNGLVKFLSPQDTFEALKRNRMLMIQRYVEVSPATERQWVAAGGHITFKQNMGPSGQTHPPPQTLPRSKSPSGQKRSRSRSPHEAGFCVYLKGLPFEAENKHVIDFFKKLDIVEDSIYIAYGPNGKATGEGFVEFRNEADYKAALCRHKQYMGNRFIQVHPITKKGMLEKIDMIRKRLQNFSYDQREMILNPEGDVNSAKVCAHITNIPFSITKMDVLQFLEGIPVDENAVHVLVDNNGQGLGQALVQFKNEDDARKSERLHRKKLNGREAFVHVVTLEDMREIEKNPPAQGKKGLKMPVPGNPAVPGMPNAGLPGVGLPSAGLPGAGLPSTGLPGSAITSAGLPGAGMPSAGIPSAGGEEHAFLTVGSKEANNGPPFNFPGNFGGSNAFGPPIPPPGLGGGAFGDARPGMPSVGNSGLPGLGLDVPGFGGGPNNLSGPSGFGGGPQNFGNGPGSLGGPPGFGSGPPGLGSAPGHLGGPPAFGPGPGPGPGPGPIHIGGPPGFASSSGKPGPTVIKVQNMPFTVSIDEILDFFYGYQVIPGSVCLKYNEKGMPTGEAMVAFESRDEATAAVIDLNDRPIGSRKVKLVLG

SEQ ID NO: 905166 - protein, 512 aa, Homo sapiens
MKMMHMAHCVTLVQLSISCDHLIDKDIGSKSDPLCVLLQDVGGGSWAELGRTERVRNCSSPEFSKTLQLEYRFETVQKLRFGIYDIDNKTPELRDDDFLGGAECSLGQIVSSQVLTLPLMLKPGKPAGRGTITVSAQELKDNRVVTMEVEARNLDKKDFLGKSDPFLEFFRQGDGKWHLVYRSEVIKNNLNPTWKRFSVPVQHFCGGNPSTPIQVQCSDYDSDGSHDLIGTFHTSLAQLQAVPAEFECIHPEKQQKKKSYKNSGTIRVKICRVETEYSFLDYVMGGCQINFTVGVDFTGSNGDPSSPDSLHYLSPTGVNEYLMALWSVGSVVQDYDSDKLFPAFGFGAQVPPDWQVSHEFALNFNPSNPYCAGIQGIVDAYRQALPQVRLYGPTNFAPIINHVARFAAQAAHQGTASQYFMLLLLTDGAVTDVEATREAVVRASNLPMSVIIVGVGGADFEAMEQLDADGGPLHTRSGQAAARDIVQFVPYRRFQNVSRCKFDLGVYPFTFP

SEQ ID NO: 905167 - protein, 932 aa, Homo sapiens; identical to SEQ ID NO: 905165

SEQ ID NO: 905168 - protein, 518 aa, Homo sapiens
MKMMHMAHCVTLVQLSISCDHLIDKDIGSKSDPLCVLLQDVGGGSWAELGRTERVRNCSSPEFSKTLQLEYRFETVQKLRFGIYDIDNKTPELRDDDFLGGAECSLGQIVSSQVLTLPLMLKPGKPAGRGTITVSAQELKDNRVVTMEVEARNLDKKDFLGKSDPFLEFFRQGDGKWHLVYRSEVIKNNLNPTWKRFSVPVQHFCGGNPSTPIQVQCSDYDSDGSHDLIGTFHTSLAQLQAVPAEFECIHPEKQQKKKSYKNSGTIRVKICRVETEYSFLDYVMGGCQINFTVGVDFTGSNGDPSSPDSLHYLSPTGVNEYLMALWSVGSVVQDYDSDKLFPAFGFGAQVPPDWQVSHEFALNFNPSNPYCAGIQGIVDAYRQALPQVRLYGPTNFAPIINHVARFAAQAAHQGTASQYFMLLLLTDGAVTDVEATREAVVAPREALAQTVLAEVPTQLVSYFRAQGWAPLKPLPPSAKDPATGPPGLGSLGGCGKSSILCPRGPSGPQPNPSHSPQC

SEQ ID NO: 905169 - protein, 932 aa, Homo sapiens; identical to SEQ ID NO: 905165

SEQ ID NO: 905170 - protein, 612 aa, Homo sapiens [sequence omitted]

SEQ ID NO: 905171 - protein, 612 aa, Homo sapiens [sequence omitted]

SEQ ID NO: 905172 - protein, 612 aa, Homo sapiens [sequence omitted]

SEQ ID NO: 905173 - protein, 612 aa, Homo sapiens [sequence omitted]

SEQ ID NO: 905174 - protein, 612 aa, Homo sapiens [sequence omitted]

SEQ ID NO: 905175 - protein, 151 aa, Homo sapiens
MAHCVTLVQLSISCDHLIDKDIGSKSDPLCVLLQDVGGGSWAELGRTERVRNCSSPEFSKTLQLEYRFETVQKLRFGIYDIDNKTPELRDDDFLGGAECSLGQIVVPSQGNWTLPPLMLERPGKNWLGPGGEQSKGLQLQEIKGTNPCNNP

SEQ ID NO: 905176 - protein, 353 aa, Homo sapiens
ERGAAERAERPFCEAAKEVVGEGGGGCVGLREAVRAGAVGRGAEALARGMAHCVTLVQLSISCDHLIDKDIGSKSDPLCVLLQDVGGGSWAELGRTERVRNCSSPEFSKTLQLEYRFETVQKLRFGIYDIDNKTPELRDDDFLGGAECSLGQIVSSQVLTLPLMLKPGKPAGRGTITVSAQELKDNRVVTMEVEARNLDKKDFLGKSDPFLEFFRQGDGKWHLVYRSEVIKNNLNPTWKRFSVPVQHFCGGNPSTPIQVQCFRIMTSGRGHTCSSNREHFQTTGWAPTGQRKPRHEYGSGSTPVKSTATTDKPPRHLGHIRGERIVAVKPQNTNSGQQPRHVETISVTGDTSP

SEQ ID NO: 905177 - protein, 573 aa, Homo sapiens; identical to SEQ ID NO: 905153

SEQ ID NO: 905178 - protein, 568 aa, Homo sapiens; identical to SEQ ID NO: 905156

SEQ ID NO: 905179 - protein, 663 aa, Homo sapiens
RRAGLSVTTCDTDGWLACARGIQATARYRGHERPAKEVVAALGSGKPFGLGLSAAGRRHSRGGGNSGSGFWCRAAFPGLTWPLLLVKEIHLLFYQMAHCVTLVQLSISCDHLIDKDIGSKSDPLCVLLQDVGGGSWAELGRTERVRNCSSPEFSKTLQLEYRFETVQKLRFGIYDIDNKTPELRDDDFLGGAECSLGQIVSSQVLTLPLMLKPGKPAGRGTITVSAQELKDNRVVTMEVEARNLDKKDFLGKSDPFLEFFRQGDGKWHLVYRSEVIKNNLNPTWKRFSVPVQHFCGGNPSTPIQVQCSDYDSDGSHDLIGTFHTSLAQLQAVPAEFECIHPEKQQKKKSYKNSGTIRVKICRVETEYSFLDYVMGGCQINFTVGVDFTGSNGDPSSPDSLHYLSPTGVNEYLMALWSVGSVVQDYDSDKLFPAFGFGAQVPPDWQVSHEFALNFNPSNPYCAGIQGIVDAYRQALPQVRLYGPTNFAPIINHVARFAAQAAHQGTASQYFMLLLLTDGAVTDVEATREAVVRASNLPMSVIIVGVGGADFEAMEQLDADGGPLHTRSGQAAARDIVQFVPYRRFQNAPREALAQTVLAEVPTQLVSYFRAQGWAPLKPLPPSAKDPATGPPGLGSLGGCGKSSILCPRGPSGPQPNPSHSPQC

SEQ ID NO: 905180 - protein, 621 aa, Homo sapiens
RRAGLSVTTCDTDGWLACARGIQATADIADMRGPRRRWWLRWAPGSRSGWGCRPRGGGTRAGGVIRGLGSGAAQLSPMAHCVTLVQLSISCDHLIDKDIGSKSDPLCVLLQDVGGGSWAELGRTERVRNCSSPEFSKTLQLEYRFETVQKLRFGIYDIDNKTPELRDDDFLGGAECSLGQIVSSQVLTLPLMLKPGKPAGRGTITDFLGKSDPFLEFFRQGDGKWHLVYRSEVIKNNLNPTWKRFSVPVQHFCGGNPSTPIQVQCSDYDSDGSHDLIGTFHTSLAQLQAVPAEFECIHPEKQQKKKSYKNSGTIRVKICRVETEYSFLDYVMGGCQINFTVGVDFTGSNGDPSSPDSLHYLSPTGVNEYLMALWSVGSVVQDYDSDKLFPAFGFGAQVPPDWQVSHEFALNFNPSNPYCAGIQGIVDAYRQALPQVRLYGPTNFAPIINHVARFAAQAAHQGTASQYFMLLLLTDGAVTDVEATREAVVRASNLPMSVIIVGVGGADFEAMEQLDADGGPLHTRSGQAAARDIVQFVPYRRFQNAPREALAQTVLAEVPTQLVSYFRAQGWAPLKPLPPSAKDPATGPPGLGSLGGCGKSSILCPRGPSGPQPNPSHSPQC

SEQ ID NO: 905181 - protein, 612 aa, Homo sapiens [sequence omitted]

SEQ ID NO: 905182 - protein, 612 aa, Homo sapiens [sequence omitted]

SEQ ID NO: 905183 - protein, 573 aa, Homo sapiens; identical to SEQ ID NO: 905153

SEQ ID NO: 905184 - protein, 932 aa, Homo sapiens; identical to SEQ ID NO: 905165

SEQ ID NO: 905185 - protein, 932 aa, Homo sapiens; identical to SEQ ID NO: 905165

SEQ ID NO: 905186 - protein, 932 aa, Homo sapiens; identical to SEQ ID NO: 905165

SEQ ID NO: 905187 - protein, 508 aa, Homo sapiens
MKMMHMAHCVTLVQLSISCDHLIDKDIGSKSDPLCVLLQDVGGGSWAELGRTERVRNCSSPEFSKTLQLEYRFETVQKLRFGIYDIDNKTPELRDDDFLGGAECSLGQIVSSQVLTLPLMLKPGKPAGRGTITVSAQELKDNRVVTMEVEARNLDKKDFLGKSDPFLEFFRQGDGKWHLVYRSEVIKNNLNPTWKRFSVPVQHFCGGNPSTPIQVQCSDYDSDGSHDLIGTFHTSLAQLQAVPAEFECIHPEKQQKKKSYKNSGTIRVKICRVETEYSFLDYVMGGCQINFTVGVDFTGSNGDPSSPDSLHYLSPTGVNEYLMALWSVGSVVQDYDSDKLFPAFGFGAQVPPDWQVSHEFALNFNPSNPYCAGIQGIVDAYRQALPQVRLYGPTNFAPIINHVARFAAQAAHQGTASQYFMLLLLTDGAVTDVEATREAVVRASNLPMSVIIVGVGGADFEAMEQLDADGGPLHTRSGQAAARDIVQFVPTAGRMPGGLGPGSQCHRV

SEQ ID NO: 905188 - protein, 612 aa, Homo sapiens [sequence omitted]

SEQ ID NO: 905189 - protein, 638 aa, Homo sapiens
MAVVIRLQGLPIVAGTMDIRHFFSGLTIPDGGVHIVGGELGEAFIVFATDEDARLGMMRTGGTIKGSKVTLLLSSKTEMQNMIELSRRRFETANLDIPPANASRSGPPPSSGMSSRVNLPTTVSNFNNPSPSVVTATTSVHESNKNIQTFSTASVGTAPPNMGASFGSPTFSSTVPSTASPMNTVPPPPIPPIPAMPSLPPMPSIPPIPVPPPVPTLPPVPPVPPIPPVPSVPPMTPLPPMSGMPPLNPPPVAPLPAGMNGSGAPMNLNNNLNPMFLGPLNPVNPIQMNSQSSVKPLPINPDDLYVSVHGMPFSAMENDVRDFFHGLRVDAVHLLKDHVGRNNGNGLVKFLSPQDTFEALKRNRMLMIQRYVEVSPATERQWVAAGGHITFKQNMGPSGQTHPPPQTLPRSKSPSGQKRSRSRSPHEAGFCVYLKGLPFEAENKHVIDFFKKLDIVEDSIYIAYGPNGKATGEGFVEFRNEADYKAALCRHKQYMGNRFIQVHPITKKGMLEKIDMIRKRLQNFSYDQREMILNPEGDVNSAKVCAHITNIPFSITKMDVLQFLEGIPVDENAVHVLVDNNGQGLGQALVQNAQCGTARCGTAQCRTSRCRPAQHRTAWFSNNQCRTAWCGNAQCRNT

SEQ ID NO: 905190 - protein, 612 aa, Homo sapiens [sequence omitted]

SEQ ID NO: 905191 - protein, 612 aa, Homo sapiens [sequence omitted]

SEQ ID NO: 905192 - protein, 767 aa, Homo sapiens
MAVVIRLQGLPIVAGTMDIRHFFSGLTIPDGGVHIVGGELGEAFIVFATDEDARLGMMRTGGTIKGSKVTLLLSSKTEMQNMIELSRRRFETANLDIPPANASRSGPPPSSGMSSRVNLPTTVSNFNNPSPSVVTATTSVHESNKNIQTFSTASVGTAPPNMGASFGSPTFSSTVPSTASPMNTVPPPPIPPIPAMPSLPPMPSIPPIPVPPPVPTLPPVPPVPPIPPVPSVPPMTPLPPMSGMPPLNPPPVAPLPAGMNGSGAPMNLNNNLNPMFLGPLNPVNPIQMNSQSSVKPLPINPDDLYVSVHGMPFSAMENDVRDFFHGLRVDAVHLLKDHVGRNNGNGLVKFLSPQDTFEALKRNRMLMIQRYVEVSPATERQWVAAGGHITFKQNMGPSGQTHPPPQTLPRSKSPSGQKRSRSRSPHEAGFCVYLKGLPFEAENKHVIDFFKKLDIVEDSIYIAYGPNGKATGEGFVEFRNEADYKAALCRHKQYMGNRFIQVHPITKKGMLEKIDMIRKRLQNFSYDQREMILNPEGDVNSAKVCAHITNIPFSITKMDVLQFLEGIPVDENAVHVLVDNNGQGLGQALVQFKNEDDARKSERLHRKKLNGREAFVHVVTLEDMREIEKNPPAQGKKGLKMPVPGNPAVPGMPNAGLPGVGLPSAGLPGAGLPSTGLPGSAITSAGLPGAGMPSAGIPSAGGEEHAFLTVGSKEANNGPPFNFPGNFGGSNAFGPPIPPPGLGGGAFGDARPGMPSVGNSGLPVYDE

SEQ ID NO: 905193 - protein, 357 aa, Homo sapiens
FGAGCRLSPQRPGTPAVHAFGPPWLTHRPRRRTMDAPRQVVNFGPGPAKLPHSVLLEIQKELLDYKGVGISVLEMSHRSSDFAKIINNTENLVRELLAVPDNYKVIFLQGGGCGQFSAVPLNLIGLKAGRCADYVVTGAWSAKAAEEAKKFGTINIVHPKLGSYTKIPDPSTWNLNPDASYVYYCANETVHGVEFDFIPDVKGAVLVCDMSSNFLSKPVDVSKFGVIFAGAQKNVGSAGVTVVIVRDDLLGFALRECPSVLEYKVQAGNSSLYNTPPCFSIYVMGLVLEWIKNNGGAAAMEKLSSIKSQTIYEIIDNSQGFYVSVGGIRASLYNAVTIEDVQKLAAFMKKFLEMHQL

SEQ ID NO: 905194 - protein, 370 aa, Homo sapiens
MDAPRQVVNFGPGPAKLPHSVLLEIQKELLDYKGVGISVLEMSHRSSDFAKIINNTENLVRELLAVPDNYKVIFLQGGGCGQFSAVPLNLIGLKAGRCADYVVTGAWSAKAAEEAKKFGTINIVHPKLGSYTKIPDPSTWNLNPDASYVYYCANETVHGVEFDFIPDVKGAVLVCDMSSNFLSKPVDVSKFGVIFAGAQKNVGSAGVTVVIVRDDLLGFALRECPSVLEYKVQAGNSSLYNTPPCFSIYVMGLVLEWIKNNGGAAAMEKLSSIKSQTIYEIIDNSQGFYVCPVEPQNRSKMNIPFRIGNAKGDDALEKRFLDKALELNMLSLKGHRSVGGIRASLYNAVTIEDVQKLAAFMKKFLEMHQL

SEQ ID NO: 905195 - protein, 323 aa, Homo sapiens
FGAGCRLSPQRPGTPAVHAFGPPWLTHRPRRRTMDAPRQVVNFGPGPAKLPHSVLLEIQKELLDYKGVGISVLEMSHRSSDFAKIINNTENLVRELLAVPDNYKVIFLQGGGCGQFSAVPLNLIGLKAGRCADYVVTGAWSAKAAEEAKKFGTINIVHPKLGSYTKIPDPSTWNLNPDASYVYYCANETVHGVEFDFIPDVKGAVLVCDMSSNFLSKPVDVSKFGVIFAGAQKNVGSAGVTVVIVRDDLLGFALRECPSVLEYKVQAGNSSLYNTPPCFSIYVMGLVLEWIKNNGGAAAMEKLSSIKSQTIYEIIDNSQGFYV

SEQ ID NO: 905196 - protein, 425 aa, Homo sapiens
GTRTDKLTKAVPNAYSDGSVRLVTLSVTDGASITDDICVHSLCDLKLYPGNLRATMDAPRQVVNFGPGPAKLPHSVLLEIQKELLDYKGVGISVLEMSHRSSDFAKIINNTENLVRELLAVPDNYKVIFLQGGGCGQFSAVPLNLIGLKAGRCADYVVTGAWSAKAAEEAKKFGTINIVHPKLGSYTKIPDPSTWNLNPDASYVYYCANETVHGVEFDFIPDVKGAVLVCDMSSNFLSKPVDVSKFGVIFAGAQKNVGSAGVTVVIVRDDLLGFALRECPSVLEYKVQAGNSSLYNTPPCFSIYVMGLVLEWIKNNGGAAAMEKLSSIKSQTIYEIIDNSQGFYVCPVEPQNRSKMNIPFRIGNAKGDDALEKRFLDKALELNMLSLKGHRSVGGIRASLYNAVTIEDVQKLAAFMKKFLEMHQL

SEQ ID NO: 905197 - protein, 322 aa, Homo sapiens
MFEKIIKNKENVGELVAVPDNYKVIFLQGGGCGQFSAVPLNLIGLKAGRCADYVVTGAWSAKAAEEAKKFGTINIVHPKLGSYTKIPDPSTWNLNPDASYVYYCANETVHGVEFDFIPDVKGAVLVCDMSSNFLSKPVDVSKFGVIFAGAQKNVGSAGVTVVIVRDDLLGFALRECPSVLEYKVQAGNSSLYNTPPCFSIYVMGLVLEWIKNNGGAAAMEKLSSIKSQTIYEIIDNSQGFYVCPVEPQNRSKMNIPFRIGNAKGDDALEKRFLDKALELNMLSLKGHRSVGGIRASLYNAVTIEDVQKLAAFMKKFLEMHQL

SEQ ID NO: 905198 - protein, 220 aa, Homo sapiens
FGAGCRLSPQRPGTPAVHAFGPPWLTHRPRRRTMDAPRQVVNFGPGPAKLPHSVLLEIQKELLDYKGVGISVLEMSHRSSDFAKIINNTENLVRELLIYVMGLVLEWIKNNGGAAAMEKLSSIKSQTIYEIIDNSQGFYVCPVEPQNRSKMNIPFRIGNAKGDDALEKRFLDKALELNMLSLKGHRSVGGIRASLYNAVTIEDVQKLAAFMKKFLEMHQL

SEQ ID NO: 905199 - protein, 403 aa, Homo sapiens
FGAGCRLSPQRPGTPAVHAFGPPWLTHRPRRRTMDAPRQVVNFGPGPAKLPHSVLLEIQKELLDYKGVGISVLEMSHRSSDFAKIINNTENLVRELLAVPDNYKVIFLQGGGCGQFSAVPLNLIGLKAGRCADYVVTGAWSAKAAEEAKKFGTINIVHPKLGSYTKIPDPSTWNLNPDASYVYYCANETVHGVEFDFIPDVKGAVLVCDMSSNFLSKPVDVSKFGVIFAGAQKNVGSAGVTVVIVRDDLLGFALRECPSVLEYKVQAGNSSLYNTPPCFSIYVMGLVLEWIKNNGGAAAMEKLSSIKSQTIYEIIDNSQGFYVCPVEPQNRSKMNIPFRIGNAKGDDALEKRFLDKALELNMLSLKGHRSVGGIRASLYNAVTIEDVQKLAAFMKKFLEMHQL

SEQ ID NO: 905200 - protein, 403 aa, Homo sapiens; identical to SEQ ID NO: 905199

SEQ ID NO: 905201 - protein, 398 aa, Homo sapiens
VTRGRPTRRGRVGAFGPPWLTHRPRRRTMDAPRQVVNFGPGPAKLPHSVLLEIQKELLDYKGVGISVLEMSHRSSDFAKIINNTENLVRELLAVPDNYKVIFLQGGGCGQFSAVPLNLIGLKAGRCADYVVTGAWSAKAAEEAKKFGTINIVHPKLGSYTKIPDPSTWNLNPDASYVYYCANETVHGVEFDFIPDVKGAVLVCDMSSNFLSKPVDVSKFGVIFAGAQKNVGSAGVTVVIVRDDLLGFALRECPSVLEYKVQAGNSSLYNTPPCFSIYVMGLVLEWIKNNGGAAAMEKLSSIKSQTIYEIIDNSQGFYVCPVEPQNRSKMNIPFRIGNAKGDDALEKRFLDKALELNMLSLKGHRSVGGIRASLYNAVTIEDVQKLAAFMKKFLEMHQL

SEQ ID NO: 905202 - protein, 329 aa, Homo sapiens [sequence omitted]

SEQ ID NO: 905203 - protein, 199 aa, Homo sapiens
RERERERPNFLSKPVDVSKFGVIFAGAQKNVGSAGVTVVIVRDDLLGFALRECPSVLEYKVQAGNSSLYNTPPCFSIYVMGLVLEWIKNNGGAAAMEKLSSIKSQTIYEIIDNSQGFYVCPVEPQNRSKMNIPFRIGNAKGDDALEKRFLDKALELNMLSLKGHRSVGGIRASLYNAVTIEDVQKLAAFMKKFLEMHQL

SEQ ID NO: 905204 - protein, 67 aa, Homo sapiens
RAEDHLIVQKTTFVQKITTVQKITSRAEDHLIVQKTTFVQKITYRAEDHLIVQKITYLIYVDTFRIY

SEQ ID NO: 905205 - protein, 123 aa, Homo sapiens
MLRIDNDRVVCAVATALRNMALDVRNKELIGKYAMRDLVHRLPGGNNSNNTASKAMSDDTVTAVCCTLHEVITKNMENAKAWADSGGIEKLVNITKGRGDRSSLKVVKAAAQVLNTLWQYRDL

SEQ ID NO: 905206 - protein, 1250 aa, Homo sapiens
MFARKPPGAAPLGAMPVPDQPSSASEKTSSLSPGLNTSNGDGSETETTSAILASVKEQELQFERLTRELEAERQIVASQLERCKLGSETGSMSSMSSAEEQFQWQSQDGQKDIEDELTTGLELVDSCIRSLQESGILDPQDYSTGERPSLLSQSALQLNSKPEGSFQYPASYHSNQTLALGETTPSQLPARGTQARATGQSFSQGTTSRAGHLAGPEPAPPPPPPPREPFAPSLGSAFHLPDAPPAAAAAALYYSSSTLPAPPRGGSPLAAPQGGSPTKLQRGGSAPEGATYAAPRGSSPKQSPSRLAKSYSTSSPINIVVSSAGLSPIRVTSPPTVQSTISSSPIHQLSSTIGTYATLSPTKRLVHASEQYSKHSQELYATATLQRPGSLAAGSRASYSSQHGHLGPELRALQSPEHHIDPIYEDRVYQKPPMRSLSQSQGDPLPPAHTGTYRTSTAPSSPGVDSVPLQRTGSQHGPQNAAAATFQRASYAAGPASNYADPYRQLQYCPSVESPYSKSGPALPPEGTLARSPSIDSIQKDPREFGWRDPELPEVIQMLQHQFPSVQSNAAAYLQHLCFGDNKIKAEIRRQGGIQLLVDLLDHRMTEVHRSACGALRNLVYGKANDDNKIALKNCGGIPALVRLLRKTTDLEIRELVTGVLWNLSSCDALKMPIIQDALAVLTNAVIIPHSGWENSPLQDDRKIQLHSSQVLRNATGCLRNVSSAGEEARRRMRECDGLTDALLYVIQSALGSSEIDSKTVENCVCILRNLSYRLAAETSQGQHMGTDELDGLLCGEANGKDAESSGCWGKKKKKKKSQDQWDGVGPLPDCAEPPKGIQMLWHPSIVKPYLTLLSECSNPDTLEGAAGALQNLAAGSWKGWAEDVAGMAYALRSLPEGAPCLPQWSVYIRAAVRKEKGLPILVELLRIDNDRVVCAVATALRNMALDVRNKELIGKYAMRDLVHRLPGGNNSNNTASKAMSDDTVTAVCCTLHEVITKNMENAKALRDAGGIEKLVGISKSKGDKHSPKVVKAASQVLNSMWQYRDLRSLYKKDGWSQYHFVASSSTIERDRQRPYSSSRTPSISPVRVSPNNRSASAPASPREMISLKERKTDYECTGSNATYHGAKGEHTSRKDAMTAQNTGISTLYRNSYGAPAEDIKHNQVSAQPVPQEPSRKDYETYQPFQNSTRNYDESFFEDQVHHRPPASEYTMHLGLKSTGNYVDFYSAARPYSELNYETSHYPASPDSWV

SEQ ID NO: 905207 - protein, 1225 aa, Homo sapiens
MFARKPPGAAPLGAMPVPDQPSSASEKTSSLSPGLNTSNGDGSETETTSAILASVKEQELQFERLTRELEAERQIVASQLERCKLGSETGSMSSMSSAEEQFQWQSQDGQKDIEDELTTGLELVDSCIRSLQESGILDPQDYSTGERPSLLSQSALQLNSKPEGSFQYPASYHSNQTLALGETTPSQLPARGTQARATGQSFSQGTTSRAGHLAGPEPAPPPPPPPREPFAPSLGSAFHLPDAPPAAAAAALYYSSSTLPAPPRGGSPLAAPQGGSPTKLQRGGSAPEGATYAAPRGSSPKQSPSRLAKSYSTSSPINIVVSSAGLSPIRVTSPPTVQSTISSSPIHQLSSTIGTYATLSPTKRLVHASEQYSKHSQELYATATLQRPGSLAAGSRASYSSQHGHLGPELRALQSPEHHIDPIYEDRVYQKPPMRSLSQSQGDPLPPAHTGTYRTSTAPSSPGVDSVPLQRTGSQHGPQNAAAATFQRASYAAGPASNYADPYRQLQYCPSVESPYSKSGPALPPEGTLARSPSIDSIQKDPREFGWRDPELPEVIQMLQHQFPSVQSNAAAYLQHLCFGDNKIKAEIRRQGGIQLLVDLLDHRMTEVHRSACGALRNLVYGKANDDNKIALKNCGGIPALVRLLRKTTDLEIRELVTGVLWNLSSCDALKMPIIQDALAVLTNAVIIPHSGWENSPLQDDRKIQLHSSQVLRNATGCLRNVSSAGEEARRRMRECDGLTDALLYVIQSALGSSEIDSKTVENCVCILRNLSYRLAAETSQGQHMGTDELDGLLCGEANGKDAESSGCWGKKKKKKKSQDQWDGVGPLPDCAEPPKGIQMLWHPSIVKPYLTLLSECSNPDTLEGAAGALQNLAAGSWKWSVYIRAAVRKEKGLPILVELLRIDNDRVVCAVATALRNMALDVRNKELIGKYAMRDLVHRLPGGNNSNNTASKAMSDDTVTAVCCTLHEVITKNMENAKALRDAGGIEKLVGISKSKGDKHSPKVVKAASQVLNSMWQYRDLRSLYKKDGWSQYHFVASSSTIERDRQRPYSSSRTPSISPVRVSPNNRSASAPASPREMISLKERKTDYECTGSNATYHGAKGEHTSRKDAMTAQNTGISTLYRNSYGAPAEDIKHNQVSAQPVPQEPSRKDYETYQPFQNSTRNYDESFFEDQVHHRPPASEYTMHLGLKSTGNYVDFYSAARPYSELNYETSHYPASPDSWV

SEQ ID NO: 905208 - protein, 326 aa, Homo sapiens
MLRIDNDRVVCAVATALRNMALDVRNKELIGKYAMRDLVHRLPGGNNSNNTASKAMSDDTVTAVCCTLHEVITKNMENAKALRDAGGIEKLVGISKSKGDKHSPKVVKAASQVLNSMWQYRDLRSLYKKDGWSQYHFVASSSTIERDRQRPYSSSRTPSISPVRVSPNNRSASAPASPREMISLKERKTDYECTGSNATYHGAKGEHTSRKDAMTAQNTGISTLYRNSYGAPAEDIKHNQVSAQPVPQEPSRKDYETYQPFQNSTRNYDESFFEDQVHHRPPASEYTMHLGLKSTGNYVDFYSAARPYSELNYETSHYPASPDSWV

SEQ ID NO: 905209 - protein, 367 aa, Homo sapiens
VHSMTLLLGISSSGCRTADIGEPQMLLPDRSSGSFVSEEYLAVEVSVHPYWGVPPSYGYSGVRDPLEEAVCPFSDLKLHAEENPGGNNSNNTASKAMSDDTVTAVCCTLHEVITKNMENAKALRDAGGIEKLVGISKSKGDKHSPKVVKAASQVLNSMWQYRDLRSLYKKDGWSQYHFVASSSTIERDRQRPYSSSRTPSISPVRVSPNNRSASAPASPREMISLKERKTDYECTGSNATYHGAKGEHTSRKDAMTAQNTGISTLYRNSYGAPAEDIKHNQVSAQPVPQEPSRKDYETYQPFQNSTRNYDESFFEDQVHHRPPASEYTMHLGLKSTGNYVDFYSAARPYSELNYETSHYPASPDSWV

SEQ ID NO: 905210 - protein, 103 aa, Homo sapiens
AVKETNEERERTRCEFRVSAQPVPQEPSRKDYETYQPFQNSTRNYDESFFEDQVHHRPPASEYTMHLGLKSTGNYVDFYSAARPYSELNYETSHYPASPDSWV

SEQ ID NO: 905211 - protein, 102 aa, Homo sapiens
TTTPNAPHCDTLKKPCVSAQPVPQEPSRKDYETYQPFQNSTRNYDESFFEDQVHHRPPASEYTMHLGLKSTGNYVDFYSAARPYSELNYETSHYPASPDSWV

SEQ ID NO: 905212 - protein, 1225 aa, Homo sapiens; identical to SEQ ID NO: 905207

SEQ ID NO: 905213 - protein, 113 aa, Homo sapiens
MFARKPPGAAPLGAMPVPDQPSSASEKTSSLSPGLNTSNGDGSETETTSAILASVKEQELQFERLTRELEAERQIVASQLERCKLGSETGSMSSMRSRRKTLHLPTSTSVVST

SEQ ID NO: 905214 - protein, 326 aa, Homo sapiens; identical to SEQ ID NO: 905208

SEQ ID NO: 905215 - protein, 1145 aa, Homo sapiens
MFARKPPGAAPLGAMPVPDQPSSASEKTSSLSPGLNTSNGDGSETETTSAILASVKEQELQFERLTRELEAERQIVASQLERCKLGSETGSMSSMSSAEEQFQWQSQDGQKDIEDELTTGLELVDSCIRSLQESGILDPQDYSTGERPSLLSQSALQLNSKPEGSFQYPASYHSNQTLALGETTPSQLPARGTQARATGQSFSQGTTSRAGHLAGPEPAPPPPPPPREPFAPSLGSAFHLPDAPPAAAAAALYYSSSTLPAPPRGGSPLAAPQGGSPTKLQRGGSAPEGATYAAPRGSSPKQSPSRLAKSYSTSSPINIVVSSAGLSPIRVTSPPTVQSTISSSPIHQLSSTIGTYATLSPTKRLVHASEQYSKHSQELYATATLQRPGSLAAGSRASYSSQHGHLGPELRALQSPEHHIDPIYEDRVYQKPPMRSLSQSQGDPLPPAHTGTYRTSTAPSSPGVDSVPLQRTGSQHGPQNAAAATFQRASYAAGPASNYADPYRQLQYCPSVESPYSKSGPALPPEGTLARSPSIDSIQKDPREFGWRDPELPEVIQMLQHQFPSVQSNAAAYLQHLCFGDNKIKAEIRRQGGIQLLVDLLDHRMTEVHRSACGALRNLVYGKANDDNKIALKNCGGIPALVRLLRKTTDLEIRELVTGVLWNLSSCDALKMPIIQDALAVLTNAVIIPHSGWENSPLQDDRKIQLHSSQVLRNATGCLRNVSSAGEEARRRMRECDGLTDALLYVIQSALGSSEIDSKTVENCVCILRNLSYRLAAETSQGQHMGTDELDGLLCGEANGKDAESSGCWGKKKKKKKSQDQWDGVGPLPDCAEPPKGIQMLWHPSIVKPYLTLLSECSNPDTLEGAAGALQNLAAGSWKGWAEDVAGMAYALRSLPEGAPCLPQWSVYIRAAVRKEKGLPILVELLRIDNDRVVCAVATALRNMALDVRNKELIGKYAMRDLVHRLPGGNNSNNTASKAMSDDTVTAVCCTLHEVITKNMENAKALRDAGGIEKLVGISKSKGDKHSPKVVKAASQVLNSMWQYRDLRSLYKKDGWSQYHFVASSSTIERDRQRPYSSSRTPSISPVRVSPNNRSASAPASPREMISLKERKTDYECTGSNATYHGSPLRRVRVNSIMASVCIKA

SEQ ID NO: 905216 - protein, 219 aa, Homo sapiens
MPREDTDEFIYLPEQFRSLYKKDGWSQYHFVASSSTIERDRQRPYSSSRTPSISPVRVSPNNRSASAPASPREMISLKERKTDYECTGSNATYHGAKGEHTSRKDAMTAQNTGISTLYRNSYGAPAEDIKHNQVSAQPVPQEPSRKDYETYQPFQNSTRNYDESFFEDQVHHRPPASEYTMHLGLKSTGNYVDFYSAARPYSELNYETSHYPASPDSWV

SEQ ID NO: 905217 - protein, 100 aa, Homo sapiens
YQRKSYKEQNKAHLVSAQPVPQEPSRKDYETYQPFQNSTRNYDESFFEDQVHHRPPASEYTMHLGLKSTGNYVDFYSAARPYSELNYETSHYPASPDSWV

SEQ ID NO: 905218 - protein, 1429 aa, Homo sapiens
PLHEQLELYHTVMYRNYQRKNDMDEPPPFDYGSGDEDGKSEKRKNKDPLYAKMEERFYRYGIKPEWMMIHRILNHSFDKKGDVHYLIKWKDLPYDQCTWEIDDIDIPYYDNLKQAYWGHRELMLGEDTRLPKRLLKKGKKLRDDKQEKPPDTPIVDPTVKFDKQPWYIDSTGGTLHPYQLEGLNWLRFSWAQGTDTILADEMGLGKTVQTIVFLYSLYKEGHSKGPYLVSAPLSTIINWEREFEMWAPDFYVVTYTGDKESRSVIRENEFSFEDNAIRSGKKVFRMKKEVQIKFHVLLTSYELITIDQAILGSIEWACLVVDEAHRLKNNQSKFFRVLNSYKIDYKLLLTGTPLQNNLEELFHLLNFLTPERFNNLEGFLEEFADISKEDQIKKLHDLLGPHMLRRLKADVFKNMPAKTELIVRVELSQMQKKYYKFILTRNFEALNSKGGGNQVSLLNIMMDLKKCCNHPYLFPVAAVEAPVLPNGSYDGSSLVKSSGKLMLLQKMLKKLRDEGHRVLIFSQMTKMLDLLEDFLEYEGYKYERIDGGITGGLRQEAIDRFNAPGAQQFCFLLSTRAGGLGINLATADTVIIYDSDWNPHNDIQAFSRAHRIGQNKKVMIYRFVTRASVEERITQVAKRKMMLTHLVVRPGLGSKSGSMTKQELDDILKFGTEELFKDDVEGMMSQGQRPVTPIPDVQSSKGGNLAASAKKKHGSTPPGDNKDVEDSSVIHYDDAAISKLLDRNQDATDDTELQNMNEYLSSFKVAQYVVREEDGVEEVEREIIKQEENVDPDYWEKLLRHHYEQQQEDLARNLGKGKRIRKQVNYNDASQEDQEWQDELSDNQSEYSIGSEDEDEDFEERPEGQSGRRQSRRQLKSDRDKPLPPLLARVGGNIEVLGFNARQRKAFLNAIMRWGMPPQDAFNSHWLVRDLRGKSEKEFRAYVSLFMRHLCEPGADGAETFADGVPREGLSRQHVLTRIGVMSLVRKKVQEFEHVNGKYSTPDLIPEGPEGKKPGEVISSDPNTPVPASPAHLLPAPLGLPDKMEAQLGYMDEKDPGAQKPRQPLEVQALPAALDRVESEDKHESPASKERAREERPEETEKAPPSPEQLPREEVLPEKEKILDKLELSLIHSRGDSSELRPDDTKAEEKEPIETQQNGDKEEDDEGKKEDKKGKFKFMFNIADGGFTELHTLWQNEERAAVSSGKIYDIWHRRHDYWLLAGIVTHGYARWQDIQNDPRYMILNEPFKSEVHKGNYLEMKNKFLARRFKLLEQALVIEEQLRRAAYLNMTQDPNHPAMALNARLAEVECLAESHQHLSKESLAGNKPANAVLHKVLNQLEELLSDMKADVTRLPSMLSRIPPVAARLQMSERSILSRLTNRAGDPTIQQGAFGSSQMYSNNFGPNFRGPGPGGIVNYNQMPLGPYVTDI

SEQ ID NO: 905219 - protein, 1461 aa, Homo sapiens
PLHEQLELYHTVMYRNYQRKNDMDEPPPFDYGSGDEDGKSEKRKNKDPLYAKMEERFYRYGIKPEWMMIHRILNHSFDKKGDVHYLIKWKDLPYDQCTWEIDDIDIPYYDNLKQAYWGHRELMLGEDTRLPKRLLKKGKKLRDDKQEKPPDTPIVDPTVKFDKQPWYIDSTGGTLHPYQLEGLNWLRFSWAQGTDTILADEMGLGKTVQTIVFLYSLYKEGHSKGPYLVSAPLSTIINWEREFEMWAPDFYVVTYTGDKESRSVIRENEFSFEDNAIRSGKKVFRMKKEVQIKFHVLLTSYELITIDQAILGSIEWACLVVDEAHRLKNNQSKFFRVLNSYKIDYKLLLTGTPLQNNLEELFHLLNFLTPERFNNLEGFLEEFADISKEDQIKKLHDLLGPHMLRRLKADVFKNMPAKTELIVRVELSQMQKKYYKFILTRNFEALNSKGGGNQVSLLNIMMDLKKCCNHPYLFPVAAVEAPVLPNGSYDGSSLVKSSGKLMLLQKMLKKLRDEGHRVLIFSQMTKMLDLLEDFLEYEGYKYERIDGGITGGLRQEAIDRFNAPGAQQFCFLLSTRAGGLGINLATADTVIIYDSDWNPHNDIQAFSRAHRIGQNKKVMIYRFVTRASVEERITQVAKRKMMLTHLVVRPGLGSKSGSMTKQELDDILKFGTEELFKDDVEGMMSQGQRPVTPIPDVQSSKGGNLAASAKKKHGSTPPGDNKDVEDSSVIHYDDAAISKLLDRNQDATDDTELQNMNEYLSSFKVAQYVVREEDGVEEVEREIIKQEENVDPDYWEKLLRHHYEQQQEDLARNLGKGKRIRKQVNYNDASQEDQEWQDELSDNQSEYSIGSEDEDEDFEERPEGQSGRRQSRRQLKSDRDKPLPPLLARVGGNIEVLGFNARQRKAFLNAIMRWGMPPQDAFNSHWLVRDLRGKSEKEFRAYVSLFMRHLCEPGADGAETFADGVPREGLSRQHVLTRIGVMSLVRKKVQEFEHVNGKYSTPDLIPEGPEGKKPGEVISSDPNTPVPASPAHLLPAPLGLPDKMEAQLGYMDEKDPGAQKPRQPLEVQALPAALDRVESEDKHESPASKERAREERPEETEKAPPSPEQLPRASCSVTQAGVQWRHLGSWEPLSPRLKRPSHLSFLKEEVLPEKEKILDKLELSLIHSRGDSSELRPDDTKAEEKEPIETQQNGDKEEDDEGKKEDKKGKFKFMFNIADGGFTELHTLWQNEERAAVSSGKIYDIWHRRHDYWLLAGIVTHGYARWQDIQNDPRYMILNEPFKSEVHKGNYLEMKNKFLARRFKLLEQALVIEEQLRRAAYLNMTQDPNHPAMALNARLAEVECLAESHQHLSKESLAGNKPANAVLHKVLNQLEELLSDMKADVTRLPSMLSRIPPVAARLQMSERSILSRLTNRAGDPTIQQISSRPRDFPVLQRSFPAEPRLPGHLPDPHGREKLPPF

SEQ ID NO: 905220 - protein, 1456 aa, Homo sapiens
PLHEQLELYHTVMYRNYQRKNDMDEPPPFDYGSGDEDGKSEKRKNKDPLYAKMEERFYRYGIKPEWMMIHRILNHSFDKKGDVHYLIKWKDLPYDQCTWEIDDIDIPYYDNLKQAYWGHRELMLGEDTRLPKRLLKKGKKLRDDKQEKPPDTPIVDPTVKFDKQPWYIDSTGGTLHPYQLEGLNWLRFSWAQGTDTILADEMGLGKTVQTIVFLYSLYKEGHSKGPYLVSAPLSTIINWEREFEMWAPDFYVVTYTGDKESRSVIRENEFSFEDNAIRSGKKVFRMKKEVQIKFHVLLTSYELITIDQAILGSIEWACLVVDEAHRLKNNQSKFFRVLNSYKIDYKLLLTGTPLQNNLEELFHLLNFLTPERFNNLEGFLEEFADISKEDQIKKLHDLLGPHMLRRLKADVFKNMPAKTELIVRVELSQMQKKYYKFILTRNFEALNSKGGGNQVSLLNIMMDLKKCCNHPYLFPVAAVEAPVLPNGSYDGSSLVKSSGKLMLLQKMLKKLRDEGHRVLIFSQMTKMLDLLEDFLEYEGYKYERIDGGITGGLRQEAIDRFNAPGAQQFCFLLSTRAGGLGINLATADTVIIYDSDWNPHNDIQAFSRAHRIGQNKKVMIYRFVTRASVEERITQVAKRKMMLTHLVVRPGLGSKSGSMTKQELDDILKFGTEELFKDDVEGMMSQGQRPVTPIPDVQSSKGGNLAASAKKKHGSTPPGDNKDVEDSSVIHYDDAAISKLLDRNQDATDDTELQNMNEYLSSFKVAQYVVREEDGVLSPKSSLWVSPGGLSFPPLLPTLRADLEEVEREIIKQEENVDPDYWEKLLRHHYEQQQEDLARNLGKGKRIRKQVNYNDASQEDQEWQDELSDNQSEYSIGSEDEDEDFEERPEGQSGRRQSRRQLKSDRDKPLPPLLARVGGNIEVLGFNARQRKAFLNAIMRWGMPPQDAFNSHWLVRDLRGKSEKEFRAYVSLFMRHLCEPGADGAETFADGVPREGLSRQHVLTRIGVMSLVRKKVQEFEHVNGKYSTPDLIPEGPEGKKPGEVISSDPNTPVPASPAHLLPAPLGLPDKMEAQLGYMDEKDPGAQKPRQPLEVQALPAALDRVESEDKHESPASKERAREERPEETEKAPPSPEQLPREEVLPEKEKILDKLELSLIHSRGDSSELRPDDTKAEEKEPIETQQNGDKEEDDEGKKEDKKGKFKFMFNIADGGFTELHTLWQNEERAAVSSGKIYDIWHRRHDYWLLAGIVTHGYARWQDIQNDPRYMILNEPFKSEVHKGNYLEMKNKFLARRFKLLEQALVIEEQLRRAAYLNMTQDPNHPAMALNARLAEVECLAESHQHLSKESLAGNKPANAVLHKVLNQLEELLSDMKADVTRLPSMLSRIPPVAARLQMSERSILSRLTNRAGDPTIQQGAFGSSQMYSNNFGPNFRGPGPGGIVNYNQMPLGPYVTDI

SEQ ID NO: 905221 - protein, 876 aa, Homo sapiens
PLHEQLELYHTVMYRNYQRKNDMDEPPPFDYGSGDEDGKSEKRKNKDPLYAKMEERFYRYGIKPEWMMIHRILNHSFDKKGDVHYLIKWKDLPYDQCTWEIDDIDIPYYDNLKQAYWGHRELMLGEDTRLPKRLLKKGKKLRDDKQEKPPDTPIVDPTVKFDKQPWYIDSTGGTLHPYQLEGLNWLRFSWAQGTDTILADEMGLGKTVQTIVFLYSLYKEGHSKGPYLVSAPLSTIINWEREFEMWAPDFYVVTYTGDKESRSVIRENEFSFEDNAIRSGKKVFRMKKEVQIKFHVLLTSYELITIDQAILGSIEWACLVVDEAHRLKNNQSKFFRVLNSYKIDYKLLLTGTPLQNNLEELFHLLNFLTPERFNNLEGFLEEFADISKEDQIKKLHDLLGPHMLRRLKADVFKNMPAKTELIVRVELSQMQKKYYKFILTRNFEALNSKGGGNQVSLLNIMMDLKKCCNHPYLFPVAAVEAPVLPNGSYDGSSLVKSSGKLMLLQKMLKKLRDEGHRVLIFSQMTKMLDLLEDFLEYEGYKYERIDGGITGGLRQEAIDRFNAPGAQQFCFLLSTRAGGLGINLATADTVIIYDSDWNPHNDIQAFSRAHRIGQNKKVMIYRFVTRASVEERITQVAKRKMMLTHLVVRPGLGSKSGSMTKQELDDILKFGTEELFKDDVEGMMSQGQRPVTPIPDVQSSKGGNLAASAKKKHGSTPPGDNKDVEDSSVIHYDDAAISKLLDRNQDATDDTELQNMNEYLSSFKVAQYVVREEDGVEEVEREIIKQEENVDPDYWEKLLRHHYEQQQEDLARNLGKGKRIRKQVNYNDASQEDQEWQDELSDNQSEYSIGSEDEDEDFEERPEGQWTNQFPEGLKN

SEQ ID NO: 905222 - protein, 1429 aa, Homo sapiens; identical to SEQ ID NO: 905218

SEQ ID NO: 905223 - protein, 1456 aa, Homo sapiens; identical to SEQ ID NO: 905220

SEQ ID NO: 905224 - protein, 604 aa, Homo sapiens
PLFHSRGIGVALESPTPSPPASGVHGACASFLTSSPGGSESKATPWRAVSASQELQHPQGGQRSPLPGDLTPARPNPAYPLTVECQRSCSRPVPAPLPPHTHPPGSSCFYSSFSFITKATAPGAQRRAVTQAERGRMGFLGTGTWILVLVLPIQAFPKPGGSQDKSLHNRELSAERPLNEQIAEAEEDKIKKTYPPENKPGQSNYSFVDNLNLLKAITEKEKIEKERQSIRSSPLDNKLNVEDVDSTKNRKLIDDYDSTKSGLDHKFQDDPDGLHQLDGTPLTAEDIVHKIAARIYEENDRAVFDKIVSKLLNLGLITESQAHTLEDEVAEVLQKLISKEANNYEEDPNKPTSWTENQAGKIPEKVTPMAAIQDGLAKGENDETVSNTLTLTNGLERRTKTYSEDNFEELQYFPNFYALLKSIDSEKEAKEKETLITIMKTLIDFVKMMVKYGTISPEEGVSYLENLDEMIALQTKNKLEKNATDNISKLFPAPSEKSHEETDSTKEEAAKMEKEYGSLKDSTKDDNSNPGGKTDEPKGKTEAYLEAIRKNIEWLKKHDKKGNKEDYDLSKMRDFINKQADAYVEKGILDKEEAEAIKRIYSSL

SEQ ID NO: 905225 - protein, 604 aa, Homo sapiens; identical to SEQ ID NO: 905224

SEQ ID NO: 905226 - protein, 468 aa, Homo sapiens
MGFLGTGTWILVLVLPIQAFPKPGGSQDKSLHNRELSAERPLNEQIAEAEEDKIKKTYPPENKPGQSNYSFVDNLNLLKAITEKEKIEKERQSIRSSPLDNKLNVEDVDSTKNRKLIDDYDSTKSGLDHKFQDDPDGLHQLDGTPLTAEDIVHKIAARIYEENDRAVFDKIVSKLLNLGLITESQAHTLEDEVAEVLQKLISKEANNYEEDPNKPTSWTENQAGKIPEKVTPMAAIQDGLAKGENDETVSNTLTLTNGLERRTKTYSEDNFEELQYFPNFYALLKSIDSEKEAKEKETLITIMKTLIDFVKMMVKYGTISPEEGVSYLENLDEMIALQTKNKLEKNATDNISKLFPAPSEKSHEETDSTKEEAAKMEKEYGSLKDSTKDDNSNPGGKTDEPKGKTEAYLEAIRKNIEWLKKHDKKGNKEDYDLSKMRDFINKQADAYVEKGILDKEEAEAIKRIYSSL

SEQ ID NO: 905227 - protein, 604 aa, Homo sapiens; identical to SEQ ID NO: 905224

SEQ ID NO: 905228 - protein, 604 aa, Homo sapiens; identical to SEQ ID NO: 905224

SEQ ID NO: 905229 - protein, 87 aa, Homo sapiens
PVYITTVKTAWLECKHVVFGKVLEGMEMVRTVESTKTDSRDNFGVFATGEKGFGYKNSKFHRVIKDFMIQGGDFTRGDGTGRKEHLR

SEQ ID NO: 905230 - protein, 169 aa, Homo sapiens
GGKRARRPPGAREQPQSPPPARGGAGSLATAAPPSSGLSCPGCFRLRLWMLRLSERNMKVLLAAALIAGSVFFLLLPGPSAADEKKKGPKVTVKVYFDLRIGDEDVGRVIFGLFGKTVPKTVDNFVALATGEKGFGYKNSKFHRVIKDFMIQGGDFTRGDGTGRKEHLR

SEQ ID NO: 905231 - protein, 139 aa, Homo sapiens
TRRSIYGEERFPCFRLRLWMLRLSERNMKVLLAAALIAGSVFFLLLPGPSAADEKKKGPKVTVKVYFDLRIGDEDVGRVIFGLFGKTVPKTVDNFVALATGEKGFGYKNSKFHRVIKDFMIQGGDFTRGDGTGRKEHLR

SEQ ID NO: 905232 - protein, 134 aa, Homo sapiens
HASGCPGCFRLRLWMLRLSERNMKVLLAAALIAGSVFFLLLPGPSAADEKKKGPKVTVKVYFDLRIGDEDVGRVIFGLFGKTVPKTVDNFVALATGEKGFGYKNSKFHRVIKDFMIQGGDFTRGDGTGRKEHLR

SEQ ID NO: 905233 - protein, 134 aa, Homo sapiens; identical to SEQ ID NO: 905232

SEQ ID NO: 905234 - protein, 134 aa, Homo sapiens; identical to SEQ ID NO: 905232

SEQ ID NO: 905235 - protein, 134 aa, Homo sapiens; identical to SEQ ID NO: 905232

SEQ ID NO: 905236 - protein, 134 aa, Homo sapiens; identical to SEQ ID NO: 905232

SEQ ID NO: 905237 - protein, 134 aa, Homo sapiens; identical to SEQ ID NO: 905232

SEQ ID NO: 905238 - protein, 134 aa, Homo sapiens; identical to SEQ ID NO: 905232

SEQ ID NO: 905239 - protein, 134 aa, Homo sapiens; identical to SEQ ID NO: 905232

SEQ ID NO: 905240 - protein, 134 aa, Homo sapiens; identical to SEQ ID NO: 905232

SEQ ID NO: 905241 - protein, 134 aa, Homo sapiens; identical to SEQ ID NO: 905232

SEQ ID NO: 905242 - protein, 134 aa, Homo sapiens; identical to SEQ ID NO: 905232

SEQ ID NO: 905243 - protein, 134 aa, Homo sapiens; identical to SEQ ID NO: 905232

SEQ ID NO: 905244 - protein, 139 aa, Homo sapiens; identical to SEQ ID NO: 905231

SEQ ID NO: 905245 - protein, 114 aa, Homo sapiens
MAQGGKSIYGERFPDENFKLKHYGPGWVSMANAGKDTNGSQFFITTVKTAWLDGKHVVFGKVLEGMEVVRKVESTKTDSRDKPLKDVIIADCGKIEGGEALCHRQGVGHRDIFL

SEQ ID NO: 905246 - protein, 114 aa, Homo sapiens; identical to SEQ ID NO: 905245

SEQ ID NO: 905247 - protein, 220 aa, Homo sapiens
TRRSIYGEGSFPCFRLRLWMLRLSERNMKVLLAAALIAGSVFFLLLPGPSAADEKKKGPKVTVKVYFDLRIGDEDVGRVIFGLFGKTVPKTVDNFVALATGESPGEMAQGGKSIYGERFPDENFKLKHYGPGWVSMANAGKDTNGSQFFITTVKTAWLDGKHVVFGKVLEGMEVVRKVESTKTDSRDKPLKDVIIADCGKIEGGEALCHRQGVGHRDIFL

SEQ ID NO: 905248 - protein, 403 aa, Homo sapiens
SARLLPLPSAFLPLLLASSSFVFLSLVVFSHFSSFFSSSFSLSPPLPLRLLSLLISSLFPPFSSSSLSLLVASVLSSLSFFALVSSVLLSCLSLFFCGRLVGALLLAFGFGSVSPVVFVGCLASPVSLSISFFFFLFVSSLFFSVFMSPHVSFVFWRRAAVLLILAPRFCFVHPPLFVSPPLRQCSFVYVFFPLSSEALVVCLSRYLGYAVCCCPFLCVAPPSPASFFVVFPSLLPMLLSLVRCGSHSVFPPPCVCYLFVVVLRAPSRSASTVFIILSCPPLFGGSPVVSYKISLVATPLISFGLPPFSGVGDPFCARPPPFFVFFFVVFLFFFHSQLSFIPVHSLLRGFDSPESKGQPLFSAPPHTSLAAFSSAAMPVSFVLIGKQAGQPQQSSFSGEFRPC

SEQ ID NO: 905249 - protein, 139 aa, Homo sapiens; identical to SEQ ID NO: 905231

SEQ ID NO: 905250 - protein, 139 aa, Homo sapiens; identical to SEQ ID NO: 905231

SEQ ID NO: 905251 - protein, 139 aa, Homo sapiens; identical to SEQ ID NO: 905231

SEQ ID NO: 905252 - protein, 403 aa, Homo sapiens; identical to SEQ ID NO: 905248

SEQ ID NO: 905253 - protein, 139 aa, Homo sapiens; identical to SEQ ID NO: 905231

SEQ ID NO: 905254 - protein, 139 aa, Homo sapiens; identical to SEQ ID NO: 905231

SEQ ID NO: 905255 - protein, 152 aa, Homo sapiens
TRRSIYGEERFPCFRLRLWMLRLSERNMKVLLAAALIAGSVFFLLLPGPSAADEKKKGPKVTVKRGKQRGGAGGAPPKKHVTFKVYFDLRIGDEDVGRVIFGLFGKTVPKVVPVKAKNVAEDGDEDEEAESATAKRAAEDDEDDDVDTKKQE

SEQ ID NO: 905256 - protein, 92 aa, Homo sapiens
RVDNGSRVDNGSRVDNGSQFFITTVKTAWLDGKHVVFGKVLEGMEVVRKVESTKTDSRDKPLKDVIIADCGKIEGGEALCHRQGVGHRDIFL

SEQ ID NO: 905257 - protein, 95 aa, Homo sapiens
AYYYYIRGRVDANAGKDTNGSQFFITTVKTAWLDGKHVVFGKVLEGMEVVRKVESTKTDSRDKPLKDVIIADCGKIEGGEALCHRQGVGHRDIFL

SEQ ID NO: 905258 - protein, 134 aa, Homo sapiens; identical to SEQ ID NO: 905232

SEQ ID NO: 905259 - protein, 134 aa, Homo sapiens; identical to SEQ ID NO: 905232

SEQ ID NO: 905260 - protein, 134 aa, Homo sapiens; identical to SEQ ID NO: 905232

SEQ ID NO: 905261 - protein, 134 aa, Homo sapiens; identical to SEQ ID NO: 905232

SEQ ID NO: 905262 - protein, 134 aa, Homo sapiens; identical to SEQ ID NO: 905232

SEQ ID NO: 905263 - protein, 134 aa, Homo sapiens; identical to SEQ ID NO: 905232

SEQ ID NO: 905264 - protein, 134 aa, Homo sapiens; identical to SEQ ID NO: 905232

SEQ ID NO: 905265 - protein, 134 aa, Homo sapiens; identical to SEQ ID NO: 905232

SEQ ID NO: 905266 - protein, 134 aa, Homo sapiens; identical to SEQ ID NO: 905232

SEQ ID NO: 905267 - protein, 134 aa, Homo sapiens; identical to SEQ ID NO: 905232

SEQ ID NO: 905268 - protein, 139 aa, Homo sapiens; identical to SEQ ID NO: 905231

SEQ ID NO: 905269 - protein, 159 aa, Homo sapiens
TRRSIYGEERFPCFRLRLWMLRLSERNMKVLLAAALIAGSVFFLLLPGPSAADEKKKGPKVTVKRGKQRGGAGGAPPKKHVTFKVYFDLRIGDEDVGRVIFGLFGKTVPKTVDNFVALATGEKGFGYKNSKFHRVIKDFMIQGGDFTRGDGTGRKEHLR

SEQ ID NO: 905270 - protein, 114 aa, Homo sapiens; identical to SEQ ID NO: 905245

SEQ ID NO: 905271 - protein, 114 aa, Homo sapiens; identical to SEQ ID NO: 905245

SEQ ID NO: 905272 - protein, 139 aa, Homo sapiens; identical to SEQ ID NO: 905231

SEQ ID NO: 905273 - protein, 139 aa, Homo sapiens; identical to SEQ ID NO: 905231

SEQ ID NO: 905274 - protein, 139 aa, Homo sapiens; identical to SEQ ID NO: 905231

SEQ ID NO: 905275 - protein, 139 aa, Homo sapiens; identical to SEQ ID NO: 905231

SEQ ID NO: 905276 - protein, 80 aa, Homo sapiens
TRRSIYGEERFPCFRLRLWMLRLSERNMKVLLAAALIAGSVFFLLLPGPSAADEKKKGPKVTVKVYFDLRIGEHQDRQPG

SEQ ID NO: 905277 - protein, 398 aa, Homo sapiens
MWLLLTMASLISVLGTTHGLFGKLHPGSPEVTMNISQMITYWGYPNEEYEVVTEDGYILEVNRIPYGKKNSGNTGQRPVVFLQHGLLASATNWISNLPNNSLAFILADAGYDVWLGNSRGNTWARRNLYYSPDSVEFWAFSFDEMAKYDLPATIDFIVKKTGQKQLHYVGHSQGTTIGFIAFSTNPSLAKRIKTFYALAPVATVKYTKSLINKLRFVPQSLFKFIFGDKIFYPHNFFDQFLATEVCSREMLNLLCSNALFIICGFDSKNFNTSRLDVYLSHNPAGTSVQNMFHWTQAVKSGKFQAYDWGSPVQNRMHYDQSQPPYYNVTAMNVPIAVWNGGKDLLADPQDVGLLLPKLPNLIYHKEIPFYNHLDFIWAMDAPQEVYNDIVSMISEDKK

SEQ ID NO: 905278 - protein, 108 aa, Homo sapiens
MFHWTQAVKSGKFQAYDWGSPVQNRMHYDQSQPPYYNVTAMNVPIAVWNGGKDLLADPQDVGLLLPKLPNLIYHKEIPFYNHLDFIWAMDAPQEVYNDIVSMISEDKK

SEQ ID NO: 905279 - protein, 149 aa, Homo sapiens
ASSQVLRCPVCCQAVRELRTLALAGRVVESHFGLFADGSDFRHPVFSAVKSGKFQAYDWGSPVQNRMHYDQSQPPYYNVTAMNVPIAVWNGGKDLLADPQDVGLLLPKLPNLIYHKEIPFYNHLDFIWAMDAPQEVYNDIVSMISEDKK

SEQ ID NO: 905280 - protein, 398 aa, Homo sapiens; identical to SEQ ID NO: 905277

SEQ ID NO: 905281 - protein, 802 aa, Homo sapiens
MPRIMIKGGVWRNTEDEILKAAVMKYGKNQWSRIASLLHRKSAKQCKARWYEWLDPSIKKTEWSREEEEKLLHLAKLMPTQWRTIAPIIGRTAAQCLEHYEFLLDKAAQRDNEEETTDDPRKLKPGEIDPNPETKPARPDPIDMDEDELEMLSEARARLANTQGKKAKRKAREKQLEEARRLAALQKRRELRAAGIEIQKKRKRKRGVDYNAEIPFEKKPALGFYDTSEENYQALDADFRKLRQQDLDGELRSEKEGRDRKKDKQHLKRKKESDLPSAILQTSGVSEFTKKRSKLVLPAPQISDAELQEVVKVGQASEIARQTAEESGITNSASSTLLSEYNVTNNSVALRTPRTPASQDRILQEAQNLMALTNVDTPLKGGLNTPLHESDFSGVTPQRQVVQTPNTVLSTPFRTPSNGAEGLTPRSGTTPKPVINSTPGRTPLRDKLNINPEDGMADYSDPSYVKQMERESREHLRLGLLGLPAPKNDFEIVLPENAEKELEEREIDDTYIEDAADVDARKQAIRDAERVKEMKRMHKAVQKDLPRPSEVNETILRPLNVEPPLTDLQKSEELIKKEMITMLHYDLLHHPYEPSGNKKGKTVGFGTNNSEHITYLEHNPYEKFSKEELKKAQDVLVQEMEVVKQGMSHGELSSEAYNQVWEECYSQVLYLPGQSRYTRANLASKKDRIESLEKRLEINRGHMTTEAKRAAKMEKKMKILLGGYQSRAMGLMKQLNDLWDQIEQAHLELRTFEELKKHEDSAIPRRLECLKEDVQRQQEREKELQHRYADLLLEKETLKSKF

SEQ ID NO: 905282 - protein, 802 aa, Homo sapiens; identical to SEQ ID NO: 905281

SEQ ID NO: 905283 - protein, 802 aa, Homo sapiens; identical to SEQ ID NO: 905281

SEQ ID NO: 905284 - protein, 784 aa, Homo sapiens
MPRIMIKGGVWRNTEDEILKAAVMKYGKNQWSRIASLLHRKSAKQCKARWYEWLDPSIKKTEWSREEEEKLLHLAKLMPTQWRTIAPIIGRTAAQCLEHYEFLLDKAAQRDNEEETTDDPRKLKPGEIDPNPETKPARPDPIDMDEDELEMLSEARARLANTQGKKAKRKAREKQLEEARRLAALQKRRELRAAGIEIQKKRKRKRGVDYNAEIPFEKKPALGFYDTSEENYQALDADFRKLRQQDLDGELRSEKEGRDRKKDKQHLKRKKESDLPSAILQTSGVSEFTKKRSKLVLPAPQISDAELQEVITNSASSTLLSEYNVTNNSVALRTPRTPASQDRILQEAQNLMALTNVDTPLKGGLNTPLHESDFSGVTPQRQVVQTPNTVLSTPFRTPSNGAEGLTPRSGTTPKPVINSTPGRTPLRDKLNINPEDGMADYSDPSYVKQMERESREHLRLGLLGLPAPKNDFEIVLPENAEKELEEREIDDTYIEDAADVDARKQAIRDAERVKEMKRMHKAVQKDLPRPSEVNETILRPLNVEPPLTDLQKSEELIKKEMITMLHYDLLHHPYEPSGNKKGKTVGFGTNNSEHITYLEHNPYEKFSKEELKKAQDVLVQEMEVVKQGMSHGELSSEAYNQVWEECYSQVLYLPGQSRYTRANLASKKDRIESLEKRLEINRGHMTTEAKRAAKMEKKMKILLGGYQSRAMGLMKQLNDLWDQIEQAHLELRTFEELKKHEDSAIPRRLECLKEDVQRQQEREKELQHRYADLLLEKETLKSKF

SEQ ID NO: 905285 - protein, 736 aa, Homo sapiens
MPRIMIKGGVWRNTEDEILKAAVMKYGKNQWSRIASLLHRKSAKQCKARWYEWLDPSIKKTEWSREEEEKLLHLAKLMPTQWRTIAPIIGRTAAQCLEHYEFLLDKAAQRDNEEETTDDPRKLKPGEIDPNPETKPARPDPIDMDEDELEMLSEARARLANTQGKKAKRKAREKQLEEARRLAALQKRRELRAAGIEIQKKRKRKRGVDYNAEIPFEKKPALGFYDTSEENYQALDADFRKLRQQDLDGELRSEKEGRDRKKDKQHLKRKKESDLPSAILQTSGVSEFTKKRSKLVLPAPQISDAELQEVVKVGQASEIARQTAEESGITNSASSTLLSEYNVTNNSVALRTPRTPASQDRILQEAQNLMALTNVDTPLKGGLNTPLHESDFSGVTPQRQVVQTPNTVLSTPFRTPSNGAEGLTPRSGTTPKPVINSTPGRTPLRDKLNINPEDGMADYSDPSYVKQMERESREHLRLGLLGLPAPKNDFEIVLPENAEKELEEREIDDTYIEDAADVDARKQAIRDAERVKEMKRMHKAVQKDLPRPSEVNETILRPLNVEPPLTDLQKSEELIKKEMITMLHYDLLHHPYEPSGNKKGKTVGFGTNNSEHITYLEHNPYEKFSKEELKKINRGHMTTEAKRAAKMEKKMKILLGGYQSRAMGLMKQLNDLWDQIEQAHLELRTFEELKKHEDSAIPRRLECLKEDVQRQQEREKELQHRYADLLLEKETLKSKF

SEQ ID NO: 905286 - protein, 118 aa, Homo sapiens
EGPPRPARFRFSPRYCLQPLWGNQPAAKMEKKMKILLGGYQSRAMGLMKQLNDLWDQIEQAHLELRTFEELKKHEDSAIPRRLECLKEDVQRQQEREKELQHRYADLLLEKETLKSKF

SEQ ID NO: 905287 - protein, 802 aa, Homo sapiens; identical to SEQ ID NO: 905281

SEQ ID NO: 905288 - protein, 802 aa, Homo sapiens; identical to SEQ ID NO: 905281

SEQ ID NO: 905289 - protein, 802 aa, Homo sapiens; identical to SEQ ID NO: 905281

SEQ ID NO: 905290 - protein, 705 aa, Homo sapiens
MPRIMIKGGVWRNTEDEILKAAVMKYGKNQWSRIASLLHRKSAKQCKARWYEWLDPSIKKTEWSREEEEKLLHLAKLMPTQWRTIAPIIGRTAAQCLEHYEFLLDKAAQRDNEEETTDDPRKLKPGEIDPNPETKPARPDPIDMDEDELEMLSEARARLANTQGKKAKRKAREKQLEEARRLAALQKRRELRAAGIEIQKKRKRKRGVDYNAEIPFEKKPALGFYDTSEENYQALDADFRKLRQQDLDGELRSEKEGRDRKKDKQHLKRKKESDLPSAILQTSGVSEFTKKRSKLVLPAPQISDAELQEVVKVGQASEIARQTAEESGITNSASSTLLSEYNVTNNSVALRTPRTPASQDRILQEAQNLMALTNVDTPLKGGLNTPLHESDFSGVTPQRQVVQTPNTVLSTPFRTPSNGAEGLTPRSGTTPKPVINSTPGRTPLRDKLNINPEDGMADYSDPSYVKQMERESREHLRLGLLGLPAPKNDFEIVLPENAEKELEEREIDDTYIEDAADVDARKQAIRDAERVKEMKRMHKAVQKDLPRPSEVNETILRPLNVEPPLTDLQKSEELIKKEMITMLHYDLLHHPYEPSGNKKGKTVGFGTNNSEHITYLEHNPYEKFSKEELKKAQDVLVQEMEVVKQGMSHGELSSEAYNQVWEECYSQVLYLPGQSRYTRANLASKKDRIESLEKRLEVQEISPSL

SEQ ID NO: 905291 - protein, 635 aa, Homo sapiens
MPRIMIKGGVWRNTEDEILKAAVMKYGKNQWSRIASLLHRKSAKQCKARWYEWLDPSIKKTEWSREEEEKLLHLAKLMPTQWRTIAPIIGRTAAQCLEHYEFLLDKAAQRDNEEETTDDPRKLKPGEIDPNPETKPARPDPIDMDEDELEMLSEARARLANTQGKKAKRKAREKQLEEARRLAALQKRRELRAAGIEIQKKRKRKRGVDYNAEIPFEKKPALGFYDTSEENYQALDADFRKLRQQDLDGELRSEKEGRDRKKDKQHLKRKKESDLPSAILQTSGVSEFTKKRSKLVLPAPQISDAELQEVVKVGQASEIARQTAEESGITNSASSTLLSEYNVTNNSVALRTPRTPASQDRILQEAQNLMALTNVDTPLKGGLNTPLHESDFSGVTPQRQVVQTPNTVLSTPFRTPSNGAEGLTPRSGTTPKPVINSTPGRTPLRDKLNINPEDGMADYSDPSYVKQMERESREHLRLGLLGLPAPKNDFEIVLPENAEKELEEREIDDTYIEDAADVDARKQAIRDAERVKEMKRMHKAVQKDLPRPSEVNETILRPLNVEPPLTDLQKSEELIKKEMITMLHYDLLHHPYEPSGNKKGKTVGFGTNNSEHITYLEHNPYVQLLTHGLAPWISS

SEQ ID NO: 905292 - protein, 489 aa, Homo sapiens
GPLCSRVRAAGPLRRTGRRKFDGAGRVAVERRRGSSAGFPCSQRSRRPAEPGRGIPDRRRRGPIGRVNMDLENKVKKMGLGHEQGFGAPCLKCKEKCEGFELHFWRKICRNCKCGQEEHDVLLSNEEDRKVGKLFEDTKYTTLIAKLKSDGIPMYKRNVMILTNPVAAKKNVSINTVTYEWAPPVQNQALARQYMQMLPKEKQPVAGSEGAQYRKKQLAKQLPAHDQDPSKCHELSPREVKEMEQFVKKYKSEALGVGDVKLPCEMDAQGPKQMNIPGGDRSTPAAVGAMEDKSAEHKRTQYSCYCCKLSMKEGDPAIYAERAGYDKLWHPACFVCSTCHELLVDMIYFWKNEKLYCGRHYCDSEKPRCAGCDELIFSNEYTQAENQNWHLKHFCCFDCDSILAGEIYVMVNDKPVCKPCYVKNHAVVCQGCHNAIDPEVQRVTYNNFSWHASTECFLCSCCSKCLIGQKFMPVEGMVFCSVECKKRMS

SEQ ID NO: 905293 - protein, 412 aa, Homo sapiens
MGLGHEQGFGAPCLKCKEKCEGFELHFWRKICRNCKCGQEEHDVLLSNEEDRKVGKLFEDTKYTTLIAKLKSDGIPMYKRNVMILTNPVAAKKNVSINTVTYEWAPPVQNQALARQYMQMLPKEKQPVAGSEGAQYRKKQLAKQLPAHDQDPSKCHELSPREVKEMEQFVKKYKSEALGVGDVKLPCEMDAQGPKQMNIPGGDRSTPAAVGAMEDKSAEHKRTQYSCYCCKLSMKEGDPAIYAERAGYDKLWHPACFVCSTCHELLVDMIYFWKNEKLYCGRHYCDSEKPRCAGCDELIFSNEYTQAENQNWHLKHFCCFDCDSILAGEIYVMVNDKPVCKPCYVKNHAVVCQGCHNAIDPEVQRVTYNNFSWHASTECFLCSCCSKCLIGQKFMPVEGMVFCSVECKKRMS

SEQ ID NO: 905294 - protein, 489 aa, Homo sapiens; identical to SEQ ID NO: 905292

SEQ ID NO: 905295 - protein, 489 aa, Homo sapiens; identical to SEQ ID NO: 905292

SEQ ID NO: 905296 - protein, 410 aa, Homo sapiens
RVPDCTPRDFTMHQNDVNDSDTALLSEKYVVTWERPCEEHDVLLSNEEDRKVGKLFEDTKYTTLIAKLKSDGIPMYKRNVMILTNPVAAKKNVSINTVTYEWAPPVQNQALARQYMQMLPKEKQPVAGSEGAQYRKKQLAKQLPAHDQDPSKCHELSPREVKEMEQFVKKYKSEALGVGDVKLPCEMDAQGPKQMNIPGGDRSTPAAVGAMEDKSAEHKRTQYSCYCCKLSMKEGDPAIYAERAGYDKLWHPACFVCSTCHELLVDMIYFWKNEKLYCGRHYCDSEKPRCAGCDELIFSNEYTQAENQNWHLKHFCCFDCDSILAGEIYVMVNDKPVCKPCYVKNHAVVCQGCHNAIDPEVQRVTYNNFSWHASTECFLCSCCSKCLIGQKFMPVEGMVFCSVECKKRMS

SEQ ID NO: 905297 - protein, 489 aa, Homo sapiens; identical to SEQ ID NO: 905292

SEQ ID NO: 905298 - protein, 473 aa, Homo sapiens
GPLCSRVRAAGPLRRTGRRKFDGAGRVAVERRRGSSAGFPCSQRSRRPAEPGRGIPDRRRRGPIGRVNMDLENKVKKMGLGHEQGFGAPCLKCKEKCEGFELHFWRKICRNCKCGQEEHDVLLSNEEDRKVGKLFEDTKYTTLIAKLKSDGIPMYKRNVMILTNPVAAKKNVSINTVTYEWAPPVQNQALARQYMQMLPKEKQPVAGSEGAQYRKKQLAKQLPAHDQDPSKCHELSPREVKEMEQFVKKYKSEALGVGDVKLPCEMDAQGPKQMNIPGGDRSTPAAVGAMEDKSAEHKRTQYSCYCCKLSMKEGDPAIYAERAGYDKLWHPACFVCSTCHELLVDMIYFWKNEKLYCGRHYCDSEKPRCAGCDELIFSNEYTQAENQNWHLKHFCCFDCDSILAGEIYVMVNDKPVCKPCYVKNHAVVRSVLRIWLPQPALGLEFMLFLKPLTNGKQKAVLLSRKQIIPTTGC

SEQ ID NO: 905299 - protein, 208 aa, Homo sapiens
GPLCSRVRAAGPLRRTGRRKFDGAGRVAVERRRGSSAGFPCSQRSRRPAEPGRGIPDRRRRGPIGRVNMDLENKVKKVGGRSWRAAAASPARVARRAAAGGAEVGGARGPPGVSPALGLRCPGPRDLAPWVEEVLGGPASSPHSGATELEARARAGAGLFSPVSRNPSGCRCWKLYLRCFSSACASSKGKDELRASAGETVTLPGSGS

SEQ ID NO: 905300 - protein, 489 aa, Homo sapiens; identical to SEQ ID NO: 905292

SEQ ID NO: 905301 - protein, 489 aa, Homo sapiens; identical to SEQ ID NO: 905292

SEQ ID NO: 905302 - protein, 330 aa, Homo sapiens [sequence omitted]

SEQ ID NO: 905303 - protein, 179 aa, Homo sapiens
MKEGDPAIYAERAGYDKLWHPACFVCSTCHELLVDMIYFWKNEKLYCGRHYCDSEKPRCAGCDELIFSNEYTQAENQNWHLKHFCCFDCDSILAGEIYVMVNDKPVCKPCYVKNHAVVCQGCHNAIDPEVQRVTYNNFSWHASTECFLCSCCSKCLIGQKFMPVEGMVFCSVECKKRMS

SEQ ID NO: 905304 - protein, 395 aa, Homo sapiens
GPLCSRVRAAGPLRRTGRRKFDGAGRVAVERRRGSSAGFPCSQRSRRPAEPGRGIPDRRRRGPIGRVNMDLENKVKKMGLGHEQGFGAPCLKCKEKCEGFELHFWRKICRNCKCGQEEHDVLLSNEEDRKVGKLFEDTKYTTLIAKLKSDGIPMYKRNVMILTNPVAAKKNVSINTVTYEWAPPVQNQALARQYMQMLPKEKQPVAGSEGAQYRKKQLAKQLPAHDQDPSKCHELSPREVKEMEQFVKKYKSEALGVGDVKLPCEMDAQGPKQMNIPGGDRSTPAAVGAMEDKSAEHKRTQYSCYCCKLSMKEGDPAIYAERAGYDKLWHPACFVCSTCHELLVDMIYFWKNEKLYCGRHYCDSEKPRCAGCDELIITTEYTQPSSPARDPLDDS

SEQ ID NO: 905305 - protein, 370 aa, Homo sapiens
MISWNDAQNSGKHSASYTGYYKGHYSRTAQRKRCGGQGRRAQRSTPRSLARVSQRGPTRYADAPTPIRPSQDSTMTLNNVTMRQGTVGMQPQQQRWSIPADGRHLMVQKEPHQYSHRNRHSATPEDHCRRSWSSDSTDSVISSESGNTYYRVVLIGEQGVGKSTLANIFAGVHDSMDSDCEVLGEDTYERTLMVDGESATIILLDMWENKGENEWLHDHCMQVGDAYLIVYSITDRASFEKASELRIQLRRARQTEDIPIILVGNKSDLVRCREVSVSEGRACAVVFDCKFIETSAAVQHNVKELFEGIVRQVRLRRDSKEKNERRLAYQKRKESMPRKARRFWGKIVAKNNKNMAFKLKSKSCHDLSVL

SEQ ID NO: 905306 - protein, 296 aa, Homo sapiens
MTLNNVTMRQGTVGMQPQQQRWSIPADGRHLMVQKEPHQYSHRNRHSATPEDHCRRSWSSDSTDSVISSESGNTYYRVVLIGEQGVGKSTLANIFAGVHDSMDSDCEVLGEDTYERTLMVDGESATIILLDMWENKGENEWLHDHCMQVGDAYLIVYSITDRASFEKASELRIQLRRARQTEDIPIILVGNKSDLVRCREVSVSEGRACAVVFDCKFIETSAAVQHNVKELFEGIVRQVRLRRDSKEKNERRLAYQKRKESMPRKARRFWGKIVAKNNKNMAFKLKSKSCHDLSVL

SEQ ID NO: 905307 - protein, 296 aa, Homo sapiens; identical to SEQ ID NO: 905306

SEQ ID NO: 905308 - protein, 95 aa, Homo sapiens
SMISWNDAQNSGKHSASYTGYYKGHYSRTAQRKRCGGQGRRAQRSTPRSLARVSQRGPTRYADAPTPIRPSQVRGTARDGEGREWEFPSPQNFRS

SEQ ID NO: 905309 - protein, 296 aa, Homo sapiens; identical to SEQ ID NO: 905306

SEQ ID NO: 905310 - protein, 278 aa, Homo sapiens
MTLNNVTMRQGTVGMQPQQQRWSIPADGRHLMVQKEPHQYSHRNRHSATPEDHCRRSWSSDSTDSVISSESGNTYYRVVLIGEQGVGKSTLANIFAGVHDSMDSDCEVLGEDTYERTLMVDGESATIILLDMWENKGENEWLHDHCMQVGDAYLIVYSITDRASFEKASELRIQLRRARQTEDIPIILVGNKMVFDCKFIETSAAVQHNVKELFEGIVRQVRLRRDSKEKNERRLAYQKRKESMPRKARRFWGKIVAKNNKNMAFKLKSKSCHDLSVL

SEQ ID NO: 905311 - protein, 207 aa, Homo sapiens
MISWNDAQNSGKHSASYTGYYKGHYSRTAQRKRCGGQGRRAQRSTPRSLARVSQRGPTRYADAPTPIRPSQDSTMTLNNVTMRQGTVGMQPQQQRWSIPADGRHLMVQKEPHQYSHRNRHSATPEDHCRRSWSSDSTDSVISSESGNTYYRVVLIGEQGVGKSTLANIFAGVHDSMDSDCEVLGGRCPSPSGLLSTRGGPGRKSEGG

SEQ ID NO: 905312 - protein, 171 aa, Homo sapiens
MAAACGPGAAGYCLLLGLHLFLLTAGPALGWNDPDRMLLRDVKALTLHYDRYTTSRRLDPIPQLKCVGGTAGCDSYTPKVIQCQNKGWDGYDVQWECKTDLDIAYKFGKTVVSCEGYESSEDQYVLRGSCGLEYNLDYTELGLQKLKESGKQHGFASFSDYYYKVVLGGFL

SEQ ID NO: 905313 - protein, 171 aa, Homo sapiens; identical to SEQ ID NO: 905312

SEQ ID NO: 905314 - protein, 171 aa, Homo sapiens; identical to SEQ ID NO: 905312

SEQ ID NO: 905315 - protein, 171 aa, Homo sapiens; identical to SEQ ID NO: 905312

SEQ ID NO: 905316 - protein, 171 aa, Homo sapiens; identical to SEQ ID NO: 905312

SEQ ID NO: 905317 - protein, 135 aa, Homo sapiens
MLLRDVKALTLHYDRYTTSRRLDPIPQLKCVGGTAGCDSYTPKVIQCQNKGWDGYDVQWECKTDLDIAYKFGKTVVSCEGYESSEDQYVLRGSCGLEYNLDYTELGLQKLKESGKQHGFASFSDYYYKVVLGGFL

SEQ ID NO: 905318 - protein, 135 aa, Homo sapiens; identical to SEQ ID NO: 905317

SEQ ID NO: 905319 - protein, 132 aa, Homo sapiens
TIEPVPGNSYDRYTTSRRLDPIPQLKCVGGTAGCDSYTPKVIQCQNKGWDGYDVQWECKTDLDIAYKFGKTVVSCEGYESSEDQYVLRGSCGLEYNLDYTELGLQKLKESGKQHGFASFSDYYYKVVLGGFL

SEQ ID NO: 905320 - protein, 171 aa, Homo sapiens; identical to SEQ ID NO: 905312

SEQ ID NO: 905321 - protein, 167 aa, Homo sapiens
MSGLITIVVLLGIAFVVYKLFLSDGQYSPPPYSEYPPFSHRYQRFTNSAGPPPPGFKSEFTGPQNTGHGATSGFGSAFTGQQGYENSGPGFWTGLGTGGILGYLFGSNRAATPFSDSWYYPSYPPSYPGTWNRAYSPLHGGSGSYSVCSNSDTKTRTASGYGGTRRR

SEQ ID NO: 905322 - protein, 167 aa, Homo sapiens; identical to SEQ ID NO: 905321

SEQ ID NO: 905323 - protein, 143 aa, Homo sapiens
MAAACGPGAAGYCLLLGLHLFLLTAGPALGWNDPDRMLLRDVKALTLHYDRYTTSRRLDPIPQLKCVGGTAGCDSYTPKVIQCQNKGWDGYDVQWECKTDLDIAYKFGKTVVSCEGYESSEDQYVLRGSCGLEYNLDYTELGL

SEQ ID NO: 905324 - protein, 171 aa, Homo sapiens; identical to SEQ ID NO: 905312

SEQ ID NO: 905325 - protein, 158 aa, Homo sapiens
QRNLKQVMSVPGREPSTSFPCSPGQKPHSSLLHSPVSRAPASVQLPPGNLPSSHDYLCPSHSCFSLFPIPFLSQVIVPASCRIRHELHRTLSILHFPTVTRDSPTQQDLLPQALSLSSQDHRILAMVQLLVLAVLLQDNKDMKIQDQGSGQAWELVEY

SEQ ID NO: 905326 - protein, 171 aa, Homo sapiens; identical to SEQ ID NO: 905312

SEQ ID NO: 905327 - protein, 171 aa, Homo sapiens; identical to SEQ ID NO: 905312

SEQ ID NO: 905328 - protein, 175 aa, Homo sapiens
MSGLITIVVLLGIAFVVYKLFLSDGQYSPPPYSEYPPFSHRYQRFTNSAGPPPPGFKSEFTGPQNTGHGATSGFGSAFTGQQGYENSGPGFWTGLGTGGILGYLFGSNRAATPFSDSWYYPSYPPSYPGTWNRAYSPLHGGSGSYSDMVVPGDDKVESWSQTLDAEILDFSSLSL

SEQ ID NO: 905329 - protein, 171 aa, Homo sapiens; identical to SEQ ID NO: 905312

SEQ ID NO: 905330 - protein, 164 aa, Homo sapiens
MAAACGPGAAGYCLLLGLHLFLLTAGPALGWNDPDRMLLRDVKALTLHYDRYTTSRRLDPIPQLKCVGGTAGCDSYTPKVIQCQNKGWDGYDVQWECKTDLDIAYKFGKTVVSCEGYESSEDQYVLRGSCGLEYNLDYTELGLQKLKESVFSQGNGRKQLRATD

SEQ ID NO: 905331 - protein, 74 aa, Homo sapiens
MAAACGPGAAGYCLLLGLHLFLLTAGPALGWNDPGECCQGPQALRSPFSAAVSRCRLPCVSVRRLPGAWVPGYP

SEQ ID NO: 905332 - protein, 171 aa, Homo sapiens; identical to SEQ ID NO: 905312

SEQ ID NO: 905333 - protein, 171 aa, Homo sapiens; identical to SEQ ID NO: 905312

SEQ ID NO: 905334 - protein, 171 aa, Homo sapiens; identical to SEQ ID NO: 905312

SEQ ID NO: 905335 - protein, 171 aa, Homo sapiens; identical to SEQ ID NO: 905312

SEQ ID NO: 905336 - protein, 135 aa, Homo sapiens; identical to SEQ ID NO: 905317

SEQ ID NO: 905337 - protein, 167 aa, Homo sapiens; identical to SEQ ID NO: 905321

SEQ ID NO: 905338 - protein, 167 aa, Homo sapiens; identical to SEQ ID NO: 905321

SEQ ID NO: 905339 - protein, 117 aa, Homo sapiens
MAAACGPGAAGYCLLLGLHLFLLTAGPALGWNDPDRMLLRDVKALTLHYDRYTTSRRLDPIPQLKCVGGTAGCDSYTPKVIQCQNKGWDGYDVQWECKTDLDIAYKFGKKRFLWLGV

SEQ ID NO: 905340 - protein, 167 aa, Homo sapiens; identical to SEQ ID NO: 905321

SEQ ID NO: 905341 - protein, 171 aa, Homo sapiens; identical to SEQ ID NO: 905312

SEQ ID NO: 905342 - protein, 171 aa, Homo sapiens; identical to SEQ ID NO: 905312

SEQ ID NO: 905343 - protein, 143 aa, Homo sapiens
MAAACGPGAAGYCLLLGLHLFLLTAGPALGWNDPDRMLLRDVKALTLHYDRYTTSRRLDPIPQLKCVGGTAGCDSYTPKVIQCQNKGWDGYDVQWECKTDLDIAYKFGKTVVSCEGYESSEDQYVLMKIQDQGSGQAWELVEY

SEQ ID NO: 905344 - protein, 171 aa, Homo sapiens; identical to SEQ ID NO: 905312

SEQ ID NO: 905345 - protein, 102 aa, Homo sapiens
MAAACGPGAAGYCLLLGLHLFLLTAGPALGWNDPDRMLLRDVKALTLHYDRYTTSRRLDPIPQLKCVGGTAGCDSYTPKVIQCQNKGWDGYDVQVISTTVMA

SEQ ID NO: 905346 - protein, 753 aa, Homo sapiens
TRQQLGFGDKTRCGERAGAFLPEMAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGVGTPAAAAAKAAAKAAQFALLNLAGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 905347 - protein, 780 aa, Homo sapiens
TRQQLGFGDKTRCGERAGAFLPEMAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGVGTPAAAAAKAAAKAAQFGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAGADEGVRRSLSPELREGDPSSSQHLPSTPSSPRVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 905348 - protein, 747 aa, Homo sapiens
TRQQLGFGDKTRCGERAGAFLPEMAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGVGTPAAAAAKAAAKAAQFGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 905349 - protein, 753 aa, Homo sapiens; identical to SEQ ID NO: 905346

SEQ ID NO: 905350 - protein, 728 aa, Homo sapiens
TRQQLGFGDKTRCGERAGAFLPEMAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 905351 - protein, 637 aa, Homo sapiens
TRQQLGFGDKTRCGERAGAFLPEMAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGELKPQEGQGGEGI

SEQ ID NO: 905352 - protein, 753 aa, Homo sapiens; identical to SEQ ID NO: 905346

SEQ ID NO: 905353 - protein, 199 aa, Homo sapiens [sequence omitted]

SEQ ID NO: 905354 - protein, 376 aa, Homo sapiens
MVEVLGTQASQFSVFYGQGLGEIYILFPNPSASLRARPASLTELLFYLAPFLSAGARPGVGVGGIPTYGVGAGGFPGFGVGVGGIPGVAGVPGVGGVPGVGGVPGVGISPEAQAAAAAKAAKYGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 905355 - protein, 753 aa, Homo sapiens; identical to SEQ ID NO: 905346

SEQ ID NO: 905356 - protein, 199 aa, Homo sapiens [sequence omitted]

SEQ ID NO: 905357 - protein, 199 aa, Homo sapiens [sequence omitted]

SEQ ID NO: 905358 - protein, 710 aa, Homo sapiens
TRQQLGFGDKTRCGERAGAFLPEMAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGVAARPGFGLSPIFPGGACLGKACGRKRK

SEQ ID NO: 905359 - protein, 386 aa, Homo sapiens
TRQQLGFGDKTRCGERAGAFLPEMAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGECLPGWQVHGSGPCIDLGDPSRKARWTWPLFLPKYALFMPPYLCPF

SEQ ID NO: 905360 - protein, 753 aa, Homo sapiens; identical to SEQ ID NO: 905346

SEQ ID NO: 905361 - protein, 753 aa, Homo sapiens; identical to SEQ ID NO: 905346

SEQ ID NO: 905362 - protein, 753 aa, Homo sapiens; identical to SEQ ID NO: 905346

SEQ ID NO: 905363 - protein, 753 aa, Homo sapiens; identical to SEQ ID NO: 905346

SEQ ID NO: 905364 - protein, 710 aa, Homo sapiens; identical to SEQ ID NO: 905358

SEQ ID NO: 905365 - protein, 694 aa, Homo sapiens
TRQQLGFGDKTRCGERAGAFLPEMAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 905366 - protein, 706 aa, Homo sapiens
TRQQLGFGDKTRCGERAGAFLPEMAGLTAAAPRPGVLLLLLSILHPSRPGGVPGAIPGGVPGGVFYPGAGLGALGGGALGPGGKPLKPGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 905367 - protein, 527 aa, Homo sapiens
VLGPELALFIPTGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 905368 - protein, 199 aa, Homo sapiens [sequence omitted]

SEQ ID NO: 905369 - protein, 801 aa, Homo sapiens
TRQQLGFGDKTRCGERAGAFLPEMAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPAPAHQDPPLAAIQLVPKHLKPQSWIRSSIPPLLGPLGRLLPTDRCSPHLGRFWVGKPPHTGNSHLALVESIRPSVHSSIGPSIHVPS

SEQ ID NO: 905370 - protein, 670 aa, Homo sapiens
TRQQLGFGDKTRCGERAGAFLPEMAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGEHWVEVGAAARPPGPQGVGGASDQAL

SEQ ID NO: 905371 - protein, 191 aa, Homo sapiens
MSRKIWRSSGKNTTNHVEVNFIKKFTSERDFHPSISCSITWFLSWSPCWECSQAIREFLSRHPGVTLVIYVARLFWHMDQQNRQGLRDLVNSGVTIQIMRASEYYHCWRNFVNYPPGDEAHWPQYPPLWMMLYALELHCIILSLPPCLKISRRWQNHLTFFRLHLQNCHYQTIPPHILLATGLIHPSVAWR

SEQ ID NO: 905372 - protein, 247 aa, Homo sapiens
IPEEEVQRQSTMTSEKGPSTGDPTLRRRIEPWEFDVFYDPRELRKEACLLYEIKWGMSRKIWRSSGKNTTNHVEVNFIKKFTSERDFHPSISCSITWFLSWSPCWECSQAIREFLSRHPGVTLVIYVARLFWHMDQQNRQGLRDLVNSGVTIQIMRASEYYHCWRNFVNYPPGDEAHWPQYPPLWMMLYALELHCIILSLPPCLKISRRWQNHLTFFRLHLQNCHYQTIPPHILLATGLIHPSVAWR

SEQ ID NO: 905373 - protein, 917 aa, Homo sapiens
REWLNSPNRENFYQLQVRKFPADYIKYWEFAVYLEECELAKQLYPKENDLVFLAPERINEEKKDTERNDIQDLHEYHSGYVHKFRRTSVMRNGKTECYLSIQTQENFPANLNELVNCIVISSLVTTQRKLKAMSLLGSRNQLARAVLNPNPMDFCTKDLLTTTSERIIAYLRDFNEDQKKAIETAYAMVKHSPSVAKICLIHGPPGTGKSKTIVGLLYRLLTENQRKGHSDENSNAKIKQNRVLVCAPSNAAVDELMKKIILEFKEKCKDKKNPLGNCGDINLVRLGPEKSINSEVLKFSLDSQVNHRMKKELPSHVQAMHKRKEFLDYQLDELSRQRALCRGGREIQRQELDENISKVSKERQELASKIKEVQGRPQKTQSIIILESHIICCTLSTSGGLLLESAFRGQGGVPFSCVIVDEAGQSCEIETLTPLIHRCNKLILVGDPKQLPPTVISMKAQEYGYDQSMMARFCRLLEENVEHNMISRLPILQLTVQYRMHPDICLFPSNYVYNRNLKTNRQTEAIRCSSDWPFQPYLVFDVGDGSERRDNDSYINVQEIKLVMEIIKLIKDKRKDVSFRNIGIITHYKAQKTMIQKDLDKEFDRKGPAEVDTVDAFQGRQKDCVIVTCVRANSIQGSIGFLASLQRLNVTITRAKYSLFILGHLRTLMENQHWNQLIQDAQKRGAIIKTCDKNYRHDAVKILKLKPVLQRSLTHPPTIAPEGSRPQGGLPSSKLDSGFAKTSVAASLYHTPSDSKEITLTVTSKDPERPPVHDQLQDPRLLKRMGIEVKGGIFLWDPQPSSPQHPGATPPTGEPGFPVVHQDLSHIQQPAAVVAALSSHKPPVRGEPPAASPEASTCQSKCDDPEEELCHRREARAFSEGEQEKCGSETHHTRRNSRWDKRTLEQEDSSSKKRKLL

SEQ ID NO: 905374 - protein, 917 aa, Homo sapiens; identical to SEQ ID NO: 905373

SEQ ID NO: 905375 - protein, 917 aa, Homo sapiens; identical to SEQ ID NO: 905373

SEQ ID NO: 905376 - protein, 684 aa, Homo sapiens
MKTKIKQNRVLVCAPSNAAVDELMKKIILEFKEKCKDKKNPLGNCGDINLVRLGPEKSINSEVLKFSLDSQVNHRMKKELPSHVQAMHKRKEFLDYQLDELSRQRALCRGGREIQRQELDENISKVSKERQELASKIKEVQGRPQKTQSIIILESHIICCTLSTSGGLLLESAFRGQGGVPFSCVIVDEAGQSCEIETLTPLIHRCNKLILVGDPKQLPPTVISMKAQEYGYDQSMMARFCRLLEENVEHNMISRLPILQLTVQYRMHPDICLFPSNYVYNRNLKTNRQTEAIRCSSDWPFQPYLVFDVGDGSERRDNDSYINVQEIKLVMEIIKLIKDKRKDVSFRNIGIITHYKAQKTMIQKDLDKEFDRKGPAEVDTVDAFQGRQKDCVIVTCVRANSIQGSIGFLASLQRLNVTITRAKYSLFILGHLRTLMENQHWNQLIQDAQKRGAIIKTCDKNYRHDAVKILKLKPVLQRSLTHPPTIAPEGSRPQGGLPSSKLDSGFAKTSVAASLYHTPSDSKEITLTVTSKDPERPPVHDQLQDPRLLKRMGIEVKGGIFLWDPQPSSPQHPGATPPTGEPGFPVVHQDLSHIQQPAAVVAALSSHKPPVRGEPPAASPEASTCQSKCDDPEEELCHRREARAFSEGEQEKCGSETHHTRRNSRWDKRTLEQEDSSSKKRKLL

SEQ ID NO: 905377 - protein, 249 aa, Homo sapiens [sequence omitted]

SEQ ID NO: 905378 - protein, 133 aa, Homo sapiens
MGIEVKGGIFLWDPQPSSPQHPGATPPTGEPGFPVVHQDLSHIQQPAAVVAALSSHKPPVRGEPPAASPEASTCQSKCDDPEEELCHRREARAFSEGEQEKCGSETHHTRRNSRWDKRTLEQEDSSSKKRKLL

SEQ ID NO: 905379 - protein, 680 aa, Homo sapiens
REWLNSPNRENFYQLQVRKFPADYIKYWEFAVYLEECELAKQLYPKENDLVFLAPERINEEKKDTERNDIQDLHEYHSGYVHKFRRTSVMRNGKTECYLSIQTQENFPANLNELVNCIVISSLVTTQRKLKAMSLLGSRNQLARAVLNPNPMDFCTKDLLTTTSERIIAYLRDFNEDQKKAIETAYAMVKHSPSVAKICLIHGPPGTGKSKTIVGLLYRLLTENQRKGHSDENSNAKIKQNRVLVCAPSNAAVDELMKKIILEFKEKCKDKKNPLGNCGDINLVRLGPEKSINSEVLKFSLDSQVNHRMKKELPSHVQAMHKRKEFLDYQLDELSRQRALCRGGREIQRQELDENISKVSKERQELASKIKEVQGRPQKTQSIIILESHIICCTLSTSGGLLLESAFRGQGGVPFSCVIVDEAGQSCEIETLTPLIHRCNKLILVGDPKQLPPTVISMKAQEYGYDQSMMARFCRLLEENVEHNMISRLPILQLTVQYRMHPDICLFPSNYVYNRNLKTNRQTEAIRCSSDWPFQPYLVFDVGDGSERRDNDSYINVQEIKLVMEIIKLIKDKRKDVSFRNIGIITHYKAQKTMIQKDLDKEFDRKGPAEVDTVDAFQGRQKDCVIVTCVRANSIQGSIGFLASLQRLNVTITRAKYSLFILGHLRTLMMRKQAQRGQVT

SEQ ID NO: 905380 - protein, 597 aa, Homo sapiens
REWLNSPNRENFYQLQVRKFPADYIKYWEFAVYLEECELAKQLYPKENDLVFLAPERINEEKKDTERNDIQDLHEYHSGYVHKFRRTSVMRNGKTECYLSIQTQENFPANLNELVNCIVISSLVTTQRKLKAMSLLGSRNQLARAVLNPNPMDFCTKDLLTTTSERIIAYLRDFNEDQKKAIETAYAMVKHSPSVAKICLIHGPPGTGKSKTIVGLLYRLLTENQRKGHSDENSNAKIKQNRVLVCAPSNAAVDELMKKIILEFKEKCKDKKNPLGNCGDINLVRLGPEKSINSEVLKFSLDSQVNHRMKKELPSHVQAMHKRKEFLDYQLDELSRQRALCRGGREIQRQELDENISKVSKERQELASKIKEVQGRPQKTQSIIILESHIICCTLSTSGGLLLESAFRGQGGVPFSCVIVDEAGQSCEIETLTPLIHRCNKLILVGDPKQLPPTVISMKAQEYGYDQSMMARFCRLLEENVEHNMISRLPILQLTVQYRMHPDICLFPSNYVYNRNLKTNRQTEAIRCSSDWPFQPYLVFDVGDGSERRDNDSIIITCSTQHQHTGAWQHHTSTALIHTHQHSKGLLRSVSTPIGNN

SEQ ID NO: 905381 - protein, 917 aa, Homo sapiens; identical to SEQ ID NO: 905373

SEQ ID NO: 905382 - protein, 917 aa, Homo sapiens; identical to SEQ ID NO: 905373

SEQ ID NO: 905383 - protein, 946 aa, Homo sapiens
REWLNSPNRENFYQLQVRKFPADYIKYWEFAVYLEECELAKQLYPKENDLVFLAPERINEEKKDTERNDIQDLHEYHSGYVHKFRRTSVMRNGKTECYLSIQTQENFPANLNELVNCIVISSLVTTQRKLKAMSLLGSRNQLARAVLNPNPMDFCTKDLLTTTSERIIAYLRDFNEDQKKAIETAYAMVKHSPSVAKICLIHGPPGTGKSKTIVGLLYRLLTENQRKGHSDENSNAKIKQNRVLVCAPSNAAVDELMKKIILEFKEKCKDKKNPLGNCGDINLVRLGPEKSINSEVLKFSLDSQVNHRMKKELPSHVQAMHKRKEFLDYQLDELSRQRALCRGGREIQRQELDENISKVSKERQELASKIKEVQGRPQKTQSIIILESHIICCTLSTSGGLLLESAFRGQGGVPFSCVIVDEAGQSCEIETLTPLIHRCNKLILVGDPKQLPPTVISMKAQEYGYDQSMMARFCRLLEENVEHNMISRLPILQLTVQYRMHPDICLFPSNYVYNRNLKTNRQTEAIRCSSDWPFQPYLVFDVGDGSERRDNDSYINVQEIKLVMEIIKLIKDKRKDVSFRNIGIITHYKAQKTMIQKDLDKEFDRKGPAEVDTVDAFQGRQKDCVIVTCVRANSIQGSIGFLASLQRLNVTITRAKYSLFILGHLRTLMQLLPRSFCVHVNHSPFFSPEPKYLHWALKENQHWNQLIQDAQKRGAIIKTCDKNYRHDAVKILKLKPVLQRSLTHPPTIAPEGSRPQGGLPSSKLDSGFAKTSVAASLYHTPSDSKEITLTVTSKDPERPPVHDQLQDPRLLKRMGIEVKGGIFLWDPQPSSPQHPGATPPTGEPGFPVVHQDLSHIQQPAAVVAALSSHKPPVRGEPPAASPEASTCQSKCDDPEEELCHRREARAFSEGEQEKCGSETHHTRRNSRWDKRTLEQEDSSSKKRKLL

SEQ ID NO: 905384 - protein, 960 aa, Homo sapiens
REWLNSPNRENFYQLQVRKFPADYIKYWEFAVYLEECELAKQLYPKENDLVFLAPERINEEKKDTERNDIQDLHEYHSGYVHKFRRTSVMRNGKTECYLSIQTQENFPANLNELVNCIVISSLVTTQRKLKAMSLLGSRNQLARAVLNPNPMDFCTKDLLTTTSERIIAYLRDFNEDQKKAIETAYAMVKHSPSVAKICLIHGPPGTGKSKTIVGLLYRLLTENQRKGHSDENSNAKIKQNRVLVCAPSNAAVDELMKKIILEFKEKCKDKKNPLGNCGDINLVRLGPEKSINSEVLKFSLDSQVNHRMKKELPSHVQAMHKRKEFLDYQLDELSRQRALCRGGREIQRQELDENISKVSKERQELASKIKEVQGRPQKTQSIIILESHIICCTLSTSGGLLLESAFRGQGGVPFSCVIVDEAGQSCEIETLTPLIHRCNKLILVGDPKQLPPTVISMKAQEYGYDQSMMARFCRLLEENVEHNMISRLPILQLTVQYRMHPDICLFPSNYVYNRNLKTNRQTEAIRCSSDWPFQPYLVFDVGDGSERRDNDSYINVQEIKLVMEIIKLIKDKRKDVSFRNIGIITHYKAQKTMIQKDSNSLSKSFCIIVFWACNEFDRKGPAEVDTVDAFQGRQKDCVIVTCVRANSIQGSIGFLASLQRLNVTITRAKYSLFILGHLRTLMQLLPRSFCVHVNHSPFFSPEPKYLHWALKENQHWNQLIQDAQKRGAIIKTCDKNYRHDAVKILKLKPVLQRSLTHPPTIAPEGSRPQGGLPSSKLDSGFAKTSVAASLYHTPSDSKEITLTVTSKDPERPPVHDQLQDPRLLKRMGIEVKGGIFLWDPQPSSPQHPGATPPTGEPGFPVVHQDLSHIQQPAAVVAALSSHKPPVRGEPPAASPEASTCQSKCDDPEEELCHRREARAFSEGEQEKCGSETHHTRRNSRWDKRTLEQEDSSSKKRKLL

SEQ ID NO: 905385 - protein, 257 aa, Homo sapiens
LFLPSHCFKENQHWNQLIQDAQKRGAIIKTCDKNYRHDAVKILKLKPVLQRSLTHPPTIAPEGSRPQGGLPSSKLDSGFAKTSVAASLYHTPSDSKEITLTVTSKDPERPPVHDQLQDPRLLKRMGIEVKGGIFLWDPQPSSPQHPGATPPTGEPGFPVVHQDLSHIQQPAAVVAALSSHKPPVRGEPPAASPEASTCQSKCDDPEEELCHRREARAFSEGEQEKCGSETHHTRRNSRWDKRTLEQEDSSSKKRKLL

SEQ ID NO: 905386 - protein, 680 aa, Homo sapiens; identical to SEQ ID NO: 905379

SEQ ID NO: 905387 - protein, 459 aa, Homo sapiens
REWLNSPNRENFYQLQVRKFPADYIKYWEFAVYLEECELAKQLYPKENDLVFLAPERINEEKKDTERNDIQDLHEYHSGYVHKFRRTSVMRNGKTECYLSIQTQENFPANLNELVNCIVISSLVTTQRKLKAMSLLGSRNQLARAVLNPNPMDFCTKDLLTTTSERIIAYLRDFNEDQKKAIETAYAMVKHSPSVAKICLIHGPPGTGKSKTIVGLLYRLLTENQRKGHSDENSNAKIKQNRVLVCAPSNAAVDELMKKIILEFKEKCKDKKNPLGNCGDINLVRLGPEKSINSEVLKFSLDSQVNHRMKKELPSHVQAMHKRKEFLDYQLDELSRQRALCRGGREIQRQELDENISKVSKERQELASKIKEVQGRPQKTQSIIILESHIICCTLSTSGGLLLESAFRGQGGVPFSCVIVDEAGQSCEIETLTPLIHRCNKLILVGDPKQLPPTVISMF

SEQ ID NO: 905388 - protein, 606 aa, Homo sapiens
MAVAGPAPGAGARPRLDLQFLQRFLQILKVLFPSWSSQNALMFLTLLCLTLLEQFVIYQVGLIPSQYYGVLGNKDLEGFKTLTFLAVMLIVLNSTLKSFDQFTCNLLYVSWRKDLTEHLHRLYFRGRAYYTLNVLRDDIDNPDQRISQDVERFCRQLSSMASKLIISPFTLVYYTYQCFQSTGWLGPVSIFGYFILGTVVNKTLMGPIVMKLVHQEKLEGDFRFKHMQIRVNAEPAAFYRAGHVEHMRTDRRLQRLLQTQRELMSKELWLYIGINTFDYLGSILSYVVIAIPIFSGVYGDLSPAELSTLVSKNAFVCIYLISCFTQLIDLSTTLSDVAGYTHRIGQLRETLLDMSLKSQDCEILGESEWGLDTPPGWPAAEPADTAFLLERVSISAPSSDKPLIKDLSLKISEGQSLLITGNTGTGKTSLLRVLGGLWTSTRGSVQMLTDFGPHGVLFLPQKPFFTDGTLREQVIYPLKEVYPDSGSADDERILRFLELAGLSNLVARTEGLDQQVDWNWYDVLSPGEMQRLSFARLFYLQPKYAVLDEATSALTEEVESELYRIGQQLGMTFISVGHRQSLEKFHSLVLKLCGGGRWELMRIKVE

SEQ ID NO: 905389 - protein, 592 aa, Homo sapiens
MAVAGPAPGAGARPRLDLQFLQRFLQILKVLFPSWSSQNALMFLTLLCLTLLEQFVIYQVGLIPSQYYGVLGNKDLEGFKTLTFLAVMLIVLNSTLKSFDQFTCNLLYVSWRKDLTEHLHRLYFRGRAYYTLNVLRDDIDNPDQRISQDVERFCRQLSSMASKLIISPFTLVYYTYQCFQSTGWLGPVSIFGYFILGTVVNKTLMGPIVMKLVHQEKLEGDFRFKHMQIRVNAEPAAFYRAGHVEHMRTDRRLQRLLQTQRELMSKELWLYIGINTFDYLGSILSYVVIAIPIFSGVYGDLSPAELSTLVSKNAFVCIYLISCFTQLIDLSTTLSDVAGYTHRIGQLRETLLDMSLKSQDCEILGESEWGLDTPPGWPAAEPADTAFLLERVSISAPSSDKPLIKDLSLKISEGQSLLITGNTGTGKTSLLRVLGGLWTSTRGSVQMLTDFGPHGVLFLPQKPFFTDGTLREQVIYPLKEVYPDSGSADDERILRFLELAGLSNLVARTEGLDQQVDWNWYDVLSPGEMQRLSFARLFYLQPKYAVLDEATSALTEEVESELYRIGQQLGMTFISVGHRQSLEKVPVLTRMA

SEQ ID NO: 905390 - protein, 447 aa, Homo sapiens
MASKLIISPFTLVYYTYQCFQSTGWLGPVSIFGYFILGTVVNKTLMGPIVMKLVHQEKLEGDFRFKHMQIRVNAEPAAFYRAGHVEHMRTDRRLQRLLQTQRELMSKELWLYIGINTFDYLGSILSYVVIAIPIFSGVYGDLSPAELSTLVSKNAFVCIYLISCFTQLIDLSTTLSDVAGYTHRIGQLRETLLDMSLKSQDCEILGESEWGLDTPPGWPAAEPADTAFLLERVSISAPSSDKPLIKDLSLKISEGQSLLITGNTGTGKTSLLRVLGGLWTSTRGSVQMLTDFGPHGVLFLPQKPFFTDGTLREQVIYPLKEVYPDSGSADDERILRFLELAGLSNLVARTEGLDQQVDWNWYDVLSPGEMQRLSFARLFYLQPKYAVLDEATSALTEEVESELYRIGQQLGMTFISVGHRQSLEKFHSLVLKLCGGGRWELMRIKVE

SEQ ID NO: 905391 - protein, 503 aa, Homo sapiens
MAVAGPAPGAGARPRLDLQFLQRFLQILKVLFPSWSSQNALMFLTLLCLTLLEQFVIYQVGLIPSQYYGVLGNKDLEGFKTLTFLAVMLIVLNSTLKSFDQFTCNLLYVSWRKDLTEHLHRLYFRGRAYYTLNVLRDDIDNPDQRISQDVERFCRQLSSMASKLIISPFTLVYYTYQCFQSTGWLGPVSIFGYFILGTVVNKTLMGPIVMKLVHQEKLEGDFRFKHMQIRVNAEPAAFYRAGHVEHMRTDRRLQRLLQTQRELMSKELWLYIGINTFDYLGSILSYVVIAIPIFSGVYGDLSPAELSTLVSKNAFVCIYLISCFTQLIDLSTTLSDVAGYTHRIGQLRETLLDMSLKSQDCEILGESEWGLDTPPGWPAAEPADTAFLLERVSISAPSSDKPLIKDLSLKISEGQSLLITGNTGTGKTSLLRVLGGLWTSTRGSVQMLTDFGPHGVLFLPQKPFFTDGTLREQGQSSSGGSLLPPQPRPPTAGTSGTVTSLRS

SEQ ID NO: 905392 - protein, 447 aa, Homo sapiens; identical to SEQ ID NO: 905390

SEQ ID NO: 905393 - protein, 458 aa, Homo sapiens
MAVAGPAPGAGARPRLDLQFLQRFLQILKVLFPSWSSQNALMFLTLLCLTLLEQFVIYQVGLIPSQYYGVLGNKDLEGFKTLTFLAVMLIVLNSTLKSFDQFTCNLLYVSWRKDLTEHLHRLYFRGRAYYTLNVLRDDIDNPDQRISQDVERFCRQLSSMASKLIISPFTLVYYTYQCFQSTGWLGPVSIFGYFILGTVVNKTLMGPIVMKLVHQEKLEGDFRFKHMQIRVNAEPAAFYRAGHVEHMRTDRRLQRLLQTQRELMSKELWLYIGINTFDYLGSILSYVVIAIPIFSGVYGDLSPAELSTLVSKNAFVCIYLISCFTQLIDLSTTLSDVAGYTHRIGQLRETLLDMSLKSQDCEILGESEWGLDTPPGWPAAEPADTAFLLERVSISAPSSDKPLIKDLSLKISEGQSLLITGNTGTGKTSLLRVLGGLWTSTRGDISPEGGLPRLRFCR

SEQ ID NO: 905394 - protein, 447 aa, Homo sapiens; identical to SEQ ID NO: 905390

SEQ ID NO: 905395 - protein, 343 aa, Homo sapiens
MRSLLLSTVGINTFDYLGSILSYVVIAIPIFSGVYGDLSPAELSTLVSKNAFVCIYLISCFTQLIDLSTTLSDVAGYTHRIGQLRETLLDMSLKSQDCEILGESEWGLDTPPGWPAAEPADTAFLLERVSISAPSSDKPLIKDLSLKISEGQSLLITGNTGTGKTSLLRVLGGLWTSTRGSVQMLTDFGPHGVLFLPQKPFFTDGTLREQVIYPLKEVYPDSGSADDERILRFLELAGLSNLVARTEGLDQQVDWNWYDVLSPGEMQRLSFARLFYLQPKYAVLDEATSALTEEVESELYRIGQQLGMTFISVGHRQSLEKFHSLVLKLCGGGRWELMRIKVE

SEQ ID NO: 905396 - protein, 503 aa, Homo sapiens; identical to SEQ ID NO: 905391

SEQ ID NO: 905397 - protein, 592 aa, Homo sapiens; identical to SEQ ID NO: 905389

SEQ ID NO: 905398 - protein, 503 aa, Homo sapiens; identical to SEQ ID NO: 905391

SEQ ID NO: 905399 - protein, 606 aa, Homo sapiens; identical to SEQ ID NO: 905388

SEQ ID NO: 905400 - protein, 546 aa, Homo sapiens
MAVAGPAPGAGARPRLDLQFLQRFLQILKVLFPSWSSQNALMFLTLLCLTLLEQFVIYQVGLIPSQYYGVLGNKDLEGFKTLTFLAVMLIVLNSTLKSFDQFTCNLLYVSWRKDLTEHLHRLYFRGRAYYTLNVLRDDIDNPDQRISQDVERFCRQLSSMASKLIISPFTLVYYTYQCFQSTGWLGPVSIFGYFILGTVVNKTLMGPIVMKLVHQEKLEGDFRFKHMQIRVNAEPAAFYRAGHVEHMRTDRRLQRLLQTQRELMSKELWLYIGINTFDYLGSILSYVVIAIPIFSGVYGDLSPAELSTLVSKNAFVCIYLISCFTQLIDLSTTLSDVAGYTHRIGQLRETLLDMSLKSQDCEILGESEWGLDTPPGWPAAEPADTAFLLERVSISAPSSDKPLIKDLSLKISEGQSLLITGNTGTGKTSLLRVLGGLWTSTRGSVQMLTDFGPHGVLFLPQKPFFTDGTLREQVIYPLKEVYPDSGELVLLRSCPLLLSWLSLLYLTVASSVPLGRGSSQAADSRKRGSSPLPLTVLGSVPRSHLI

SEQ ID NO: 905401 - protein, 149 aa, Homo sapiens
RLVRSECGIGRGAAPGAGARPRLDLQFLQRFLQILKVLFPSWSSQNALMFLTLLCLTLLEQFVIYQVGLIPSQYYGVLGNKDLEGFKTLTFLAVMLIVLNSTLKSFDQFTCNLLYVSWRKDLTEHLHRLYFRGRAYYTLNVLRDDIDNP

SEQ ID NO: 905402 - protein, 503 aa, Homo sapiens; identical to SEQ ID NO: 905391

SEQ ID NO: 905403 - protein, 447 aa, Homo sapiens; identical to SEQ ID NO: 905390

SEQ ID NO: 905404 - protein, 606 aa, Homo sapiens; identical to SEQ ID NO: 905388

SEQ ID NO: 905405 - protein, 613 aa, Homo sapiens
RLVRSECGIGRGAAPGAGARPRLDLQFLQRFLQILKVLFPSWSSQNALMFLTLLCLTLLEQFVIYQVGLIPSQYYGVLGNKDLEGFKTLTFLAVMLIVLNSTLKSFDQFTCNLLYVSWRKDLTEHLHRLYFRGRAYYTLNVLRDDIDNPDQRISQDVERFCRQLSSMASKLIISPFTLVYYTYQCFQSTGWLGPVSIFGYFILGTVVNKTLMGPIVMKLVHQEKLEGDFRFKHMQIRVNAEPAAFYRAGHVEHMRTDRRLQRLLQTQRELMSKELWLYIGINTFDYLGSILSYVVIAIPIFSGVYGDLSPAELSTLVSKNAFVCIYLISCFTQLIDLSTTLSDVAGYTHRIGQLRETLLDMSLKSQDCEILGESEWGLDTPPGWPAAEPADTAFLLERVSISAPSSDKPLIKDLSLKISEGQSLLITGNTGTGKTSLLRVLGGLWTSTRGSVQMLTDFGPHGVLFLPQKPFFTDGTLREQVIYPLKEVYPDSGSADDERILRFLELAGLSNLVARTEGLDQQVDWNWYDVLSPGEMQRLSFARLFYLQPKYAVLDEATSALTEEVESELYRIGQQLGMTFISVGHRQSLEKFHSLVLKLCGGGRWELMRIKVE

SEQ ID NO: 905406 - protein, 503 aa, Homo sapiens; identical to SEQ ID NO: 905391

SEQ ID NO: 905407 - protein, 457 aa, Homo sapiens
MASKLIISPFTLVYYTYQCFQSTGWLGPVSIFGYFILGTVVNKTLMGPIVMKLVHQEKLEGDFRFKHMQIRVNAEPAAFYSPVDIPAFLVRAGHVEHMRTDRRLQRLLQTQRELMSKELWLYIGINTFDYLGSILSYVVIAIPIFSGVYGDLSPAELSTLVSKNAFVCIYLISCFTQLIDLSTTLSDVAGYTHRIGQLRETLLDMSLKSQDCEILGESEWGLDTPPGWPAAEPADTAFLLERVSISAPSSDKPLIKDLSLKISEGQSLLITGNTGTGKTSLLRVLGGLWTSTRGSVQMLTDFGPHGVLFLPQKPFFTDGTLREQVIYPLKEVYPDSGSADDERILRFLELAGLSNLVARTEGLDQQVDWNWYDVLSPGEMQRLSFARLFYLQPKYAVLDEATSALTEEVESELYRIGQQLGMTFISVGHRQSLEKFHSLVLKLCGGGRWELMRIKVE

SEQ ID NO: 905408 - protein, 227 aa, Homo sapiens
EQAEEKHRPSLEIASSSFSLVIPLSSLHISVSPLLAPSVRHSCGCDPLCHRPGNPISSFRPGRTSGHPVGPPLLPGCYLHRPWLPCPGPRVQLIYPLTRSSPTPLRPDDERILEAHWNRHALSNLGDKRQRSGNHQLTGHWYDVLSPGEMQRLSFARLFYLQPKYAVLDEATSALTEEVESELYRIGQQLGMTFISVGHRQSLEKFHSLVLKLCGGGRWELMRIKVE

SEQ ID NO: 905409 - protein, 389 aa, Homo sapiens
MAVAGPAPGAGARPRLDLQFLQRFLQILKVLFPSWSSQNALMFLTLLCLTLLEQFVIYQVGLIPSQYYGVLGNKDLEGFKTLTFLAVMLIVLNSTLKSFDQFTCNLLYVSWRKDLTEHLHRLYFRGRAYYTLNVLRDDIDNPDQRISQDVERFCRQLSSMASKLIISPFTLVYYTYQCFQSTGWLGPVSIFGYFILGTVVNKTLMGPIVMKLVHQEKLEGDFRFKHMQIRVNAEPAAFYRAGHVEHMRTDRRLQRLLQTQRELMSKELWLYIGINTFDYLGSILSYVVIAIPIFSGVYGDLSPAELSTLVSKNAFVCIYLISCFTQLIDLSTTLSDVAGYTHRIGQLRETLLDMSLKSQDDSEDRAQVRHIDPVQEPHGSCAGPLAVVG

SEQ ID NO: 905410 - protein, 606 aa, Homo sapiens; identical to SEQ ID NO: 905388

SEQ ID NO: 905411 - protein, 240 aa, Homo sapiens
MAVAGPAPGAGARPRLDLQFLQRFLQILKVLFPSWSSQNALMFLTLLCLTLLEQFVIYQVGLIPSQYYGVLGNKDLEGFKTLTFLAVMLIVLNSTLKSFDQFTCNLLYVSWRKDLTEHLHRLYFRGRAYYTLNVLRDDIDNPDQRISQDVERFCRQLSSMASKLIISPFTLVYYTYQCFQSTGWLGPVSIFGYFILGTVVNKTLMGPIVMKLVHQEKLEGDFRFKHMQIRVNAEPAAFYR

SEQ ID NO: 905412 - protein, 837 aa, Homo sapiens
MPAERPAGSGGSEAPAMVEQLDTAVITPAMLEEEEQLEAAGLERERKMLEKARMSWDRESTEIRYRRLQHLLEKSNIYSKFLLTKMEQQQLEEQKKKEKLERKKESLKVKKGKNSIDASEEKPVMRKKRGREDESYNISEVMSKEEILSVAKKNKKENEDENSSSTNLCVEDLQKNKDSNSIIKDRLSETVRQNTKFFFDPVRKCNGQPVPFQQPKHFTGGVMRWYQVEGMEWLRMLWENGINGILADEMGLGKTVQCIATIALMIQRGVPGPFLVCGPLSTLPNWMAEFKRFTPDIPTMLYHGTQEERQKLVRNIYKRKGTLQIHPVVITSFEIAMRDRNALQHCYWKYLIVDEGHRIKNMKCRLIRELKRFNADNKLLLTGTPLQNNLSELWSLLNFLLPDVFDDLKSFEILVDITSLSETAEDIMLKKENRMYAYAAPDFNTFLMRRLKSDVALEVPPKREVVVYAPLSKKQEIFYTAIVNRTIANMFGSSEKETIELSPTGRPKRRTRKSINYSKIDDFPNELEKLISQIQPEVDRERAVVEVNIPVESEVNLKLQNIMMLLRKCCNHPYLIEYPIDPVTQEFKIDEELVTNSGKFLILDRMLPELKKRGHKVLLFSQMTSMLDILMDYCHLRDFNFSRLDGSMSYSEREKNMHSFNTDPEVFIFLVSTRAGGLGINLTAADTVIIYDSDWNPQSDLQAQDRCHRIGQTKPVVVYRLVTANTIDQKIVERAAAKRKLEKLIIHKNHFKGGQSGLNLSKNFLDPKELMELLKSRDYEREIKGSREKVISDKDLELLLDRSDLIDQMNASGPIKEKMGIFKILENSEDSSPECLF

SEQ ID NO: 905413 - protein, 156 aa, Homo sapiens
MPAERPAGSGGSEAPAMVEQLDTAVITPAMLEEEEQLEAAGLERERKMLEKARMSWDRESTEIRYRRLQHLLEKSNIYSKFLLTKMEQQQLEEQKKKEKLERKKESLKVKKGKNSIDASEEKPVMRKKRGREDESYNISEVMSKEECKLRCLSTEA

SEQ ID NO: 905414 - protein, 856 aa, Homo sapiens
MVEQLDTAVITPAMLEEEEQLEAAGLERERKMLEKARMSWDRESTEIRYRRLQHLLEKSNIYSKFLLTKMEQQQLEEQKKKEKLERKKESLKVKKGKNSIDASEEKPVMRKKRGREDESYNISEVMSKEEILSVAKKNKKENEDENSSSTNLCVEDLQKNKDSNSIIKDRLSETVRQNTKFFFDPVRKCNGQPVPFQQPKHFTGGVMRWYQVEGMEWLRMLWENGINGILADEMGLGKTVQCIATIALMIQRGVPGPFLVCGPLSTLPNWMAEFKRFTPDIPTMLYHGTQEERQKLVRNIYKRKGTLQIHPVVITSFEIAMRDRNALQHCYWKYLIVDEGHRIKNMKCRLIRELKRFNADNKLLLTGTPLQNNLSELWSLLNFLLPDVFDDLKSFEILVDITSLSETAEDIMLKKENRMYAYAAPDFNTFLMRRLKSDVALEVPPKREVVVYAPLSKKQEIFYTAIVNRTIANMFGSSEKETIELSPTGRPKRRTRKSINYSKIDDFPNELEKLISQIQPEVDRERAVVEVNIPVESEVNLKLQNIMMLLRKCCNHPYLIEYPIDPVTQEFKIDEELVTNSGKFLILDRMLPELKKRGHKVLLFSQMTSMLDILMDYCHLRDFNFSRLDGSMSYSEREKNMHSFNTDPEVFIFLVSTRAGGLGINLTAADTVIIYDSDWNPQSDLQAQDRCHRIGQTKPVVVYRLVTANTIDQKIVERAAAKRKLEKLIIHKNHFKGGQSGLNLSKNFLDPKELMELLKSRDYEREIKGSREKVISDKDLELLLDRSDLIDQMNASGPIKEKMGIFKILENSEDSSPELETGFHHLGLTGPELISGDLPTSASQSAGITSVSHCVA

SEQ ID NO: 905415 - protein, 156 aa, Homo sapiens; identical to SEQ ID NO: 905413

SEQ ID NO: 905416 - protein, 156 aa, Homo sapiens; identical to SEQ ID NO: 905413

SEQ ID NO: 905417 - protein, 156 aa, Homo sapiens; identical to SEQ ID NO: 905413

SEQ ID NO: 905418 - protein, 140 aa, Homo sapiens
MVEQLDTAVITPAMLEEEEQLEAAGLERERKMLEKARMSWDRESTEIRYRRLQHLLEKSNIYSKFLLTKMEQQQLEEQKKKEKLERKKESLKVKKGKNSIDASEEKPVMRKKRGREDESYNISEVMSKEECKLRCLSTEA

SEQ ID NO: 905419 - protein, 650 aa, Homo sapiens
MRWYQVEGMEWLRMLWENGINGILADEMGLGKTVQCIATIALMIQRGVPGPFLVCGPLSTLPNWMAEFKRFTPDIPTMLYHGTQEERQKLVRNIYKRKGTLQIHPVVITSFEIAMRDRNALQHCYWKYLIVDEGHRIKNMKCRLIRELKRFNADNKLLLTGTPLQNNLSELWSLLNFLLPDVFDDLKSFEFLVDITSLSETAEDIMLKKENRMYAYAAPDFNTFLMRRLKSDVALEVPPKREVVVYAPLSKKQEIFYTAIVNRTIANMFGSSEKETIELSPTGRPKRRTRKSINYSKIDDFPNELEKLISQIQPEVDRERAVVEVNIPVESEVNLKLQNIMMLLRKCCNHPYLIEYPIDPVTQEFKIDEELVTNSGKFLILDRMLPELKKRGHKVLLFSQMTSMLDILMDYCHLRDFNFSRLDGSMSYSEREKNMHSFNTDPEVFIFLVSTRAGGLGINLTAADTVIIYDSDWNPQSDLQAQDRCHRIGQTKPVVVYRLVTANTIDQKIVERAAAKRKLEKLIIHKNHFKGGQSGLNLSKNFLDPKELMELLKSRDYEREIKGSREKVISDKDLELLLDRSDLIDQMNASGPIKEKMGIFKILENSEDSSPELETGFHHLGLTGPELISGDLPTSASQSAGITSVSHCVA

SEQ ID NO: 905420 - protein, 156 aa, Homo sapiens; identical to SEQ ID NO: 905413

SEQ ID NO: 905421 - protein, 159 aa, Homo sapiens
MPAERPAGSGGSEAPAMVEQLDTAVITPAMLEEEEQLEAAGLERERKMLEKARMSWDRESTEIRYRRLQHLLEKSNIYSKFLLTKMEQQQLEEQKKKEKLERKKESLKVKKGKNSIDASEEKPVMRKKRGREDESYNISEVMSKEVKIKGRGHLTFDVE

SEQ ID NO: 905422 - protein, 110 aa, Homo sapiens
GSWSPRAWRKDEKKKRTWQPLLHTDLCPLLGGRDHAAGECLLGQPLPREALQQLFSSMPRPARHLPSQPAPGPGRAPGTVWLLGAAAGLSLPRGHDFPPACSLGQDCSEI

SEQ ID NO: 905423 - protein, 862 aa, Homo sapiens
MPLPGGLWWLLCCRRGFTLLHRDYGDGELSGDGDEDEDEETFELRTPSPAGGGRGPLEVTLTQPVRSGPVSNRLQSWEETWSLIPEKGLPEDDPDIVVKGWLYREPRGGGARPWLPPRRAWFVLTRDSLDQFSSSGKGARRLGSLVLTSLCSVTGPERRRKETGLWSVTVSGRKHSVRLCSPRQAEAERWGVALREVIASKAPLETPTQLLLRDIQESCGDPEAVALIYLRNPILRHTSGALYAPLLPLPYGVSAPGPGYAPLREEAVRLFLALQALEGARRPGPLMQGVLQTCRDLPALRDELFLQLAKQTSGPAGPPGLPATQDPAALRYWQLLTCMSCTFRPGGAVRGHLLGHLERTEQALPDSELAEYARFIRKALGRTRGRELVPSLAEISALSQRQELLCTVHCPGAPNAFTFTASAANCGHYNRSCGTEAYPGESAQGATLCPRGNPHLLVKPPLPLTSNQDSLLFQAVGSCLFWLRTGWGERARDPQEGLSLRLRGRHNKGWGPAGGAGRTGDIKPRAPASPHSLTMARTVVLITGCSSGIGLHLAVRLASDPSQSFKVYATLRDLKTQGRLWEAARALACPPGSLETLQLDVRDSKSVAAARERVTEGRVDVLVCNAGLGLLGPLEALGEDAVASVLDVNVVGTVRMLQAFLPDMKRRGSGRVLVTGSVGGLMGLPFNDVYCASKFALEGLCESLAVLLLPFGVHLSLIECGPVHTAFMEKVLGSPEEVLDRTDIHTFHRFYQYLAHSKQVFREAAQNPEEVAEVFLTALRAPKPTLRYFTTERFLPLLRMRLDDPSGSNYVTAMHREVFGDVPAKAEAGAEAGGGAGPGAEDEAGRGAVGDPELGDPPAAPQ

SEQ ID NO: 905424 - protein, 190 aa, Homo sapiens
MEKVLGSPEEVLDRTDIHTFHRFYQYLAHSKQVFREAAQNPEEVAEVSAGLDSRSGGGASSGAQRWPQLSSRRRRSSSPLCAPRSRPCATSPPSASCPCCGCAWTTPAAPTTSPPCTGKCSATFRQRPRLGPRLGAGPGLGQRTRPGAVRWGTLSSAILRPPRSKGFLSRCLPRPSLSPGSVWSLGMGRR

SEQ ID NO: 905425 - protein, 190 aa, Homo sapiens; identical to SEQ ID NO: 905424

SEQ ID NO: 905426 - protein, 135 aa, Homo sapiens
MEKVLGSPEEVLDRTDIHTFHRFYQYLAHSKQVFREAAQNPEEVAEVFLTALRAPKPTLRYFTTERFLPLLRMRLDDPSGSNYVTAMHREVFGDVPAKAEAGAEAGGGAGPGAEDEAGRGAVGDPELGDPPAAPQ

SEQ ID NO: 905427 - protein, 190 aa, Homo sapiens; identical to SEQ ID NO: 905424

SEQ ID NO: 905428 - protein, 152 aa, Homo sapiens
MARTVVLITGCSSGIGLHLAVRLASDPSQSFKVYATLRDLKTQGRLWEAARALACPPGSLETLQLDVRDSKSVAAARERVTEGRVDVLVCNAGLGLLGPLEALGEDAVASVLDVNVVGTVRMLQAFLPDMKRRGSGRVLVTGSVGGLMVGEW

SEQ ID NO: 905429 - protein, 795 aa, Homo sapiens
MPLPGGLWWLLCCRRGFTLLHRDYGDGELSGDGDEDEDEETFELRTPSPAGGGRGPLEVTLTQPVRSGPVSNRLQSWEETWSLIPEKGLPEDDPDIVVKGWLYREPRGGGARPWLPPRRAWFVLTRDSLDQFSSSGKGARRLGSLVLTSLCSVTGPERRRKETGLWSVTVSGRKHSVRLCSPRQAEAERWGVALREVIASKAPLETPTQLLLRDIQESCGDPEAVALIYLRNPILRHTSGALYAPLLPLPYGVSAPGPGYAPLREEAVRLFLALQALEGARRPGPLMQGVLQTCRDLPALRDELFLQLAKQTSGPAGPPGLPATQDPAALRYWQLLTCMSCTFRPGGAVRGHLLGHLERTEQALPDSELAEYARFIRKALGRTRGRELVPSLAEISALSQRQELLCTVHCPGAGACAVAIDSHTTAGEVARELVGRLGLARSRNAFALYEQRGAQERALAGGTLVADVLTRFDLAAEEAGLEDSPDSGWRLCLRLHGPLHPEGLSPDGHELPFLFEQAHALLLRGRPPPPDDTLRALAALRLQSLQRDFSPRVPLPRLDRCPRRLPPPAPPREDPPRPTPRPPPSAALLAGALWSPGLAKRRAERARRGGAGRTAGSIAREGGGGAGTAAAVLGGWKRLRGMGRAEAMAAYLALAAQCPGFGAARYDVLELSTEPGRGAPQKLCLGLGAKAMSLSRPGETEPIHSVSYGHVAACQLMGPHTLALRVGESQLLLQSPQVEEIMQLVNAYLANPSPERPCSSSSPPCQDLPDTSPPSQRPGLDEPQGQSGCLGQLQD

SEQ ID NO: 905430 - protein, 321 aa, Homo sapiens
MPLPGGLWWLLCCRRGFTLLHRDYGDGELSGDGDEDEDEETFELRTPSPAGGGRGPLEVTLTQPVRSGPVSNRLQSWEETWSLIPEKGLPEDDPDIVVKGWLYREPRGGGARPWLPPRRAWFVLTRDSLDQFSSSGAGRTAGSIAREGGGGAGTAAAVLGGWKRLRGMGRAEAMAAYLALAAQCPGFGAARYDVLELSTEPGRGAPQKLCLGLGAKAMSLSRPGETEPIHSVSYGHVAACQLMGPHTLALRVGESQLLLQSPQVEEIMQLVNAYLANPSPERPCSSSSPPCQDLPDTSPPSQRPGLDEPQGQSGCLGQLQD

SEQ ID NO: 905431 - protein, 780 aa, Homo sapiens
MPLPGGLWWLLCCRRGFTLLHRDYGDGELSGDGDEDEDEETFELRTPSPAGGGRGPLEVTLTQPVRSGPVSNRLQSWEETWSLIPEKGLPEDDPDIVVKGWLYREPRGGGARPWLPPRRAWFVLTRDSLDQFSSSGKGARRLGSLVLTSLCSVTGPERRRKETGLWSVTVSGRKHSVRLCSPRQAEAERWGVALREVIASKAPLETPTQLLLRDIQESCGDPEAVALIYLRNPILRHTSGALYAPLLPLPYGVSAPGPGYAPLREEAVRLFLALQALEGARRPGPLMQGVLQTCRDLPALRDELFLQLAKQTSGPAGPPGLPATQDPAALRYWQLLTCMSCTFRPGGAVRGHLLGHLERTEQALPDSELAEYARFIRKALGRTRGRELVPSLAEISALSQRQELLCTVHCPGAGACAVAIDSHTTAGESISSLFLSNSFSLYYHLQDLALSTSPCSPAWPRRKLGWRTRPTPGGDYVCVFTDLCTLRGCPQTVTNCLSSLSRLTLCCCGAGRPHPTTRCAPWRRCACRACIGTSLRGCPCPAWTLSRALLPPPAPPREDPPRPTPRPPPSAALLAGALWSPGLAKRRAERARRGGAGRTAGSIAREGGGGAGTAAAVLGGWKRLRGMGRAEAMAAYLALAAQCPGFGAARYDVLELSTEPGRGAPQKLCLGLGAKAMSLSRPGETEPIHSVSYGHVAACQLMGPHTLALRVGESQLLLQSPQVEEIMQLVNAYLANPSPERPCSSSSPPCQDLPDTSPPSQRPGLDEPQGQSGCLGQLQD

SEQ ID NO: 905432 - protein, 574 aa, Homo sapiens
MPLPGGLWWLLCCRRGFTLLHRDYGDGELSGDGDEDEDEETFELRTPSPAGGGRGPLEVTLTQPVRSGPVSNRLQSWEETWSLIPEKGLPEDDPDIVVKGWLYREPRGGGARPWLPPRRAWFVLTRDSLDQFSSSGKGARRLGSLVLTSLCSVTGPERRRKETGLWSVTVSGRKHSVRLCSPRQAEAERWGVALREVIASKAPLETPTQLLLRDIQESCGDPEAVALIYLRNPILRHTSGALYAPLLPLPYGVSAPGPGYAPLREEAVRLFLALQALEGARRPGPLMQGVLQTCRDLPALRDELFLQLAKQTSGPAGPPGLPATQDPAALRYWQLLTCMSCTFRPGGAVRGHLLGHLERTEQALPDSELAEYARFIRKALGRTRGRELVPSLAEISALSQRQELLCTVHCPGAGACAVAIDSHTTAGEVARELVGRLGLARSRNAFALYEQRGAQERALAGGTLVADVLTRFDLAAEEAGLEDSPDSGWRLCLRLHGPLHPEGLSPDGHELPFLFEQLFSSMPRPARHLPSQPAPGPGRAPGTVWLLGAAAGLSLPRGHDFPPACSLGQDCSEI

SEQ ID NO: 905433 - protein, 780 aa, Homo sapiens; identical to SEQ ID NO: 905431

SEQ ID NO: 905434 - protein, 328 aa, Homo sapiens
MARTVVLITGCSSGIGLHLAVRLASDPSQSFKVYATLRDLKTQGRLWEAARALACPPGSLETLQLDVRDSKSVAAARERVTEGRVDVLVCNAGLGLLGPLEALGEDAVASVLDVNVVGTVRMLQAFLPDMKRRGSGRVLVTGSVGGLMGLPFNDVYCASKFALEGLCESLAVLLLPFGVHLSLIECGPVHTAFMEKVLGSPEEVLDRTDIHTFHRFYQYLAHSKQVFREAAQNPEEVAEVFLTALRAPKPTLRYFTTERFLPLLRMRLDDPSGSNYVTAMHREVFGDVPAKAEAGAEAGGGAGPGAEDEAGRGAVGDPELGDPPAAPQ

SEQ ID NO: 905435 - protein, 104 aa, Homo sapiens
MTGGGTCVRGRPPASRERGRHVHRAGLARAVVGQGCGGPRVDGASQKQACQEVTTSLLPAAWARTALRFEGNMDPFGPAGTGHIPHPRATMGVGNFLVCFLIYL

SEQ ID NO: 905436 - protein, 190 aa, Homo sapiens; identical to SEQ ID NO: 905424

SEQ ID NO: 905437 - protein, 190 aa, Homo sapiens; identical to SEQ ID NO: 905424

SEQ ID NO: 905438 - protein, 527 aa, Homo sapiens
MPLPGGLWWLLCCRRGFTLLHRDYGDGELSGDGDEDEDEETFELRTPSPAGGGRGPLEVTLTQPVRSGPVSNRLQSWEETWSLIPEKGLPEDDPDIVVKGWLYREPRGGGARPWLPPRRAWFVLTRDSLDQFSSSGKGARRLGSLVLTSLCSVTGPERRRKETGLWSVTVSGRKHSVRLCSPRQAEAERWGVALREVIASKAPLETPTQLLLRDIQESCGDPEAVALIYLRNPILRHTSGALYAPLLPLPYGVSAPGPGYAPLREEAVRLFLALQALEGARRPGPLMQGVLQTCRDLPALRDELFLQLAKQTSGPAGPPGLPATQDPAALRYWQLLTCMSCTFRPGGAVRGHLLGHLERTEQALPDSELAEYARFIRKALGRTRGRELVPSLAEISALSQRQELLCTVHCPGAGACAVAIDSHTTAGEVARELVGRLGLARSRNAFALYEQRGAQERALAGGTLVADVLTRFDLAAEEAGLEDSPDSGWRLCLRLHGPLHPEGLSPDGQPAKRSRLPSCLQPGPGLL

SEQ ID NO: 905439 - protein, 780 aa, Homo sapiens; identical to SEQ ID NO: 905431

SEQ ID NO: 905440 - protein, 153 aa, Homo sapiens
MARTVVLITGCSSGIGLHLAVRLASDPSQSFKGIDRQGQGGREGRSPWRPEGKSDLPPLPKPPVYATLRDLKTQGRLWEAARALACPPGSLETLQLDVRDSKSVAAARERVTEGRVDVLGEPPGSIWAPRSLLRPALKPTCSQAQGARGDRPC

SEQ ID NO: 905441 - protein, 104 aa, Homo sapiens [sequence omitted]

SEQ ID NO: 905442 - protein, 731 aa, Homo sapiens
MPLPGGLWWLLCCRRGFTLLHRDYGDGELSGDGDEDEDEETFELRTPSPAGGGRGPLEVTLTQPVRSGPVSNRLQSWEETWSLIPEKGLPEDDPDIVVKGWLYREPRGGGARPWLPPRRAWFVLTRDSLDQFSSSGKGARRLGSLVLTSLCSVTGPERRRKETGLWSVTVSGRKHSVRLCSPRQAEAERWGVALREVIASKAPLETPTQLLLRDIQESCGDPEAVALIYLRNPILRHTSGALYAPLLPLPYGVSAPGPGYAPLREEAVRLFLALQALEGARRPGPLMQGVLQTCRDLPALRDELFLQLAKQTSGPAGPPGLPATQDPAALRYWQLLTCMSCTFRPGGAVRGHLLGHLERTEQALPDSELAEYARFIRKALGRTRGRELVPSLAEISALSQRQELLCTVHCPGAGACAVAIDSHTTAGESISSLFLSNSFSLYYHLQDLALSTSPCSPAWPRRKLGWRTRPTPGGDYVCVFTDLCTLRGCPQTVTNCLSSLSRLTLCCCGAGRPHPTTRCAPWRRCACRACIGTSLRGCPCPAWTLSRALLPPPAPPREDPPRPTPRPPPSAALLAGALWSPGLAKRRAERARRGGAGRTAGSIAREGGGGAGTAAAVLGGWKRLRGMGRAEAMAAYLALAAQCPGFGAARYDVLELSTEPGRGAPQKLCLGLGAKAMSLSRPGETEPIHSVSYGHVAACQLMGPHTLALRVGESQLLLQSPQAEVKRAEWQ

SEQ ID NO: 905443 - protein, 329 aa, Homo sapiens
MPLPGGLWWLLCCRRGFTLLHRDYGDGELSGDGDEDEDEETFELRTPSPAGGGRGPLEVTLTQPVRSGPVSNRLQSWEETWSLIPEKGLPEDDPDIVVKGWLYREPRGGGARPWLPPRRAWFVLTRDSLDQFSSSGKGARRLGSLVLTSLCSVTGPERRRKETGLWSVTVSGRKHSVRLCSPRQAEAERWGVALREVIASKAPLETPTQLLLRDIQESCGDPEAVALIYLRNPILRHTSGALYAPLLPLPYGVSAPGPGYAPLREEAVRLFLALQALEGARWPPGGGPPFFWGTKFWGAPKKGGGGDFLGGVIVGPPLFTPEENLGPGG

SEQ ID NO: 905444 - protein, 289 aa, Homo sapiens
MKDRLEQLKAKQLTQDDDTDAVEIAIDNTAFMDEFFSEIEETRLNIDKISEHVEEAKKLYSIILSAPIPEPKTKDDLEQLTTEIKKRANNVRNKLKSMEKHIEEDEVRSSADLRIRKSQHSVLSRKFVEVMTKYNEAQVDFRERSKGRIQRQLEITGKKTTDEELEEMLESGNPAIFTSGIIDSQISKQALSEIEGRHKDIVRLESSIKELHDMFMDIAMLVENQGEMLDNIELNVMHTVDHVEKARDETKKAVKYQSQARKKLIIIIVLVVVLLGILALIIGLSVGLN

SEQ ID NO: 905445 - protein, 289 aa, Homo sapiens; identical to SEQ ID NO: 905444

SEQ ID NO: 905446 - protein, 277 aa, Homo sapiens
MKDRLEQLKAKQLTQDDDTDAVEIAIDNTAFMDEFFSEIEETRLNIDKISEHVEEAKKLYSIILSAPIPEPKTKDDLEQLTTEIKKRANNVRNKLKSMEKHIEEDEVRSSADLRIRKSQHSVLSRKFVEVMTKYNEAQVDFRERSKGRIQRQLEITGKKTTDEELEEMLESGNPAIFTSGIIDSQISKQALSEIEGRHKDIVRLESSIKELHDMFMDIAMLVENQGEMLDNIELNVMHTVDHVEKARDETKKAVKYQSQARKKLISLQTGVATLVFR

SEQ ID NO: 905447 - protein, 258 aa, Homo sapiens
MDEFFSEIEETRLNIDKISEHVEEAKKLYSIILSAPIPEPKTKDDLEQLTTEIKKRANNVRNKLKSMEKHIEEDEVRSSADLRIRKSQHSVLSRKFVEVMTKYNEAQVDFRERSKGRIQRQLEITGKKTTDEELEEMLESGNPAIFTSGIIDSQISKQALSEIEGRHKDIVRLESSIKELHDMFMDIAMLVENQGEMLDNIELNVMHTVDHVEKARDETKKAVKYQSQARKKLIIIIVLVVVLLGILALIIGLSVGLN

SEQ ID NO: 905448 - protein, 289 aa, Homo sapiens; identical to SEQ ID NO: 905444

SEQ ID NO: 905449 - protein, 192 aa, Homo sapiens
MEKHIEEDEVRSSADLRIRKSQHSVLSRKFVEVMTKYNEAQVDFRERSKGRIQRQLEITGKKTTDEELEEMLESGNPAIFTSGIIDSQISKQALSEIEGRHKDIVRLESSIKELHDMFMDIAMLVENQGEMLDNIELNVMHTVDHVEKARDETKKAVKYQSQARKKLIIIIVLVVVLLGILALIIGLSVGLN

SEQ ID NO: 905450 - protein, 289 aa, Homo sapiens; identical to SEQ ID NO: 905444

SEQ ID NO: 905451 - protein, 289 aa, Homo sapiens; identical to SEQ ID NO: 905444

SEQ ID NO: 905452 - protein, 255 aa, Homo sapiens
MKDRLEQLKAKQLTQDDDTDAVEIAIDNTAFMDEFFSEIEETRLNIDKISEHVEEAKKLYSIILSAPIPEPKTKDDLEQLTTEIKKRANNVRNKLKSMEKHIEEDEVRSSADLRIRKSQHSVLSRKFVEVMTKYNEAQVDFRERSKGRIQRQLEITGKKTTDEELEEMLESGNPAIFTSGIIDSQISKQALSEIEGRHKDIVRLESSIKELHDMFMDIAMLVENQVSGSESQRGEGGEESSGSTENREKGNTGSQ

SEQ ID NO: 905453 - protein, 122 aa, Homo sapiens [sequence omitted]

SEQ ID NO: 905454 - protein, 252 aa, Homo sapiens
MKDRLEQLKAKQLTQDDDTDAVEIAIDNTAFMDEFFSEIEETRLNIDKISEHVEEAKKLYSIILSAPIPEPKTKDDLEQLTTEIKKRANNVRNKLKSMEKHIEEDEVRSSADLRIRKSQHSVLSRKFVEVMTKYNEAQVDFRERSKGRIQRQLEITGKKTTDEELEEMLESGNPAIFTSGIIDSQISKQALSEIEGRHKDIVRLESSIKELHDMFMDIAMLVENQKLIIIIVLVVVLLGILALIIGLSVGLN

SEQ ID NO: 905455 - protein, 289 aa, Homo sapiens; identical to SEQ ID NO: 905444

SEQ ID NO: 905456 - protein, 289 aa, Homo sapiens; identical to SEQ ID NO: 905444

SEQ ID NO: 905457 - protein, 289 aa, Homo sapiens; identical to SEQ ID NO: 905444

SEQ ID NO: 905458 - protein, 252 aa, Homo sapiens; identical to SEQ ID NO: 905454

SEQ ID NO: 905459 - protein, 67 aa, Homo sapiens
SSTAAARSRPVAPPPGSRDCGLHDPVLGPVRAEAARDCAAPRVPVSDPGRAVPRSPSGARLSGCAAA

SEQ ID NO: 905460 - protein, 884 aa, Homo sapiens
MCKFYTFSDCVKEKKSYFIISFLLCSHPVLMSHLLYYHHSFLQNYLLDTLIQKSILVFLLVSFNLGKLHREIKQIFLMICASYILLECMIVSPEKDGKYEAFAFSHLILNLFSSSFELIFLLYLLLVEFESEKNKNLKQVKDRREIKMVCDYFQRELSNCQNKPGTKQAVINKTTNTHSGEAEVYAIKHLERVNEAFSFSEVNVQCAFFHGNRIGINTLFYTALRPYPEDMVKICYRNFSDTSWNNFKLHPSRLVILIKSSTITNLCMLIAHWPFLEFFPMFFLRDFPQFHEYQQRRVIGSLSFRRGRKGMKKLRDWLKITYLLSSTTGARSSISVSHICVLSFKIYIGNALLTQIGMIKNERKVQIVSSDKLILLDYDFGSIVFYKYFKWRMNTYKMLWNIIFSLIFCYNLVPLHHSNKDKTDPLSKEIIYKIIEINLFEIGNKNSMKILDTTINCLKLLNNHLKYGTFKWLYFICVQFFCALLASEAIIFSKKMTIKYNTLQIVWFTVWKGHRNVQIGRRPSKTQLSNILGDLKLQPNKSFMVLSLIIVIYILDIFLEGMCPTLPHPILLSFKVLRINSSLYNNYILFKKIVVRYFLKDVNFKFTNTYGSLISNRNELQVTEGYKQKVAYHNVIRSRFLAHIWKQQLLGSSTYKSELVLFSLFYKIGFQMRCLSYDYFREKFYMFEMVEYKRLLNISFKKLFLHYNNIFMMCQIKNLTSVSQIYFQSEIFTCQLKFLTRTNVCVFLCLVGIQISQWIFEVVLKLDKIKVIKVTKEIKMVISIFKSNLVVFIVICTSIYHRLYIEKYSMIYIGPKKCWINLTNMADFSYLSLKSSKKEAVTLLFLITLIEMCFKRYNFSIFYILKNKKGLVLSQWPKGNITTM

SEQ ID NO: 905461 - protein, 319 aa, Homo sapiens
QLYGGRALQAGRSTPRLPGLWTPRPCPRPCPRRSSPGLRSAPRADMGKSLSHLPLHSSKEDAYDGVTSENMRNGLVNSEVHNEDGRNGDVSQFPYVEFTGRDSVTCPTCQGTGRIPRGQENQLVALIPYSDQRLRPRRTKLYVMASVFVCLLLSGLAVFFLFPRSIDVKYIGVKSAYVSYDVQKRTIYLNITNTLNITNNNYYSVEVENITAQVQFSKTVIGKARLNNITIIGPLDMKQIDYTVPTVIAEEMSYMYDFCTLISIKVHNIVLMMQVTVTTTYFGHSEQISQERYQYVDCGRNTTYQLGQSEYLNVLQPQQ

SEQ ID NO: 905462 - protein, 765 aa, Homo sapiens
MIVSPEKDGKYEAFAFSHLILNLFSSSFELIFFIISTFSGVRVRKKQEFETSKKIEEKYKMVCDYFQRELSNCQNEAWNKTGCKLIKLQTHIQVKQKYSHKTSRKSELRLLAFLQVNVQCAFFHGNRIGINTLFYTALRPYPEDMVKICYRNFSDTSWNNFKLHPSRLVILIKSSTITNLCMLIAHWPFLEFFPMFFLRDFPQFHEYQQRRVIGSLSFRRGRKGMKKLRDWLKITYLLSSTTGARSSISVSHICVLSFKIYIGNALLTQIGMIKNERKVQIVSSDKLILLDYDFGSIVFYKYFKWRMNTYKMLWNIIFSLIFCENLVPLHHSNKDKTDPLSKEIIYKIIEINLFEIGNKNSMKILDTTINCLKLLNNHLKYGTFKWLYFICVQFFCALLGQEAIIFSKKMTIKYNTLQIVWFTVWKGHRNVQIGRRPSKTQLKNILGDLKLQPNKSFMVLSLIIVIYILDIFLEGMCPTLPHPICLSFKVLRINSSLYNNYILFKKIVCEVLFKRCKFLKFTNTYGSLISNRNELQVTRVISKRLLTIMSLGHRFLAHIWKQQLLGSSTYKSNVVLFSLFYKIGFQMRCLSYDYFREKFYMFEMVEYKRLLNISFKKLFLHYNNIFMMCQIKNLTSVSQIYFQSEIFTCQLKFLTRTNVCVFLCLVGIQISQWIFEVVLKLDKIKWIKVTKEIKMVISIFKSNLVVFIVICTSIYHRLQIEKYSMIYIVTLKMLDLFNKYGRFFITTVLSLLKGSCYPSVFNYIN

SEQ ID NO: 905463 - protein, 319 aa, Homo sapiens; identical to SEQ ID NO: 905461

SEQ ID NO: 905464 - protein, 884 aa, Homo sapiens; identical to SEQ ID NO: 905460

SEQ ID NO: 905465 - protein, 704 aa, Homo sapiens
MVCDYFQRELSNCQNKPGTKQAVINKTTNTHSGEAEVYAIKHLERVNEAFSFSEVNVQCAFFHGNRIGINTLFYTALRPYPEDMVKICYRNFSDTSWNNFKLHPSRLVILIKSSTITNLCMLIAHWPFLEFFPMFFLRDFPQFHEYQQRRVIGSLSFRRGRKGMKKLRDWLKITYLLSSTTGARSSISVSHICVLSFKIYIGNALLTQIGMIKNERKVQIVSSDKLILLDYDFGSIVFYKYFKWRMNTYKMLWNIIFSLIFCYNLVPLHHSNKDKTDPLSKEIIYKIIEINLFEIGNKNSMKILDTTINCLKLLNNHLKYGTFKWLYFICVQFFCALLGQEAIIFSKKMTIKYNTLQIVWFTVWKGHRNVQIGRRPSKTQLKNILGDLKLQPNKSFMVLSLIIVIYILDIFLEGMCPTLPHPICLSFKVLRINSSLYNNYILFKKIVCEVLFKRCEIFKFTNTYGSLISNRNELQVTEGYKQKVAYHNVIRSRFLAHIWKQQLLGSSTYKSELVLFSLFYKIGFQMRCLSYTILGKNFTCLRWWSKKTVNISFKKLFLHYNNIFMMCQIKNLTSVSQIYFQSEIFTCQLKFLTRTNVCVFLCLVGIQISQWIFEVCPVNWIKSSDYKLLKKIKMVISIFKSNLVVFIVICTSIYHRLYIEKYSMIYIVTLKMLDLFNKYGRFFITEVLSLLKGSCYPSVFNYIN

SEQ ID NO: 905466 - protein, 777 aa, Homo sapiens
MICASYILLECMIVSPEKDGKYEAFAFSHLILNLFSSSFELIFFIISTFSGVRVRKKQEFETSKKIEEKYKMVCDYFQRELSNCQNEAWNKTGCKLIKLQTHIQVKQKYSHKTSRKSELRLLAFLQVNVQCAFFHGNRIGINTLFYTALRPYPEDMVKICYRNFSDTSWNNFKLHPSRLVILIKSSTITNLCMLIAHWPFLEFFPMFFLRDFPQFHEYQQRRVIGSLSFRRGRKGMKKLRDWLKITYLLSSTTGARSSISVSHICVLSFKIYIGNALLTQIGMIKNERKVQIVSSDKLILLDYDFGSIVFYKYFKWRMNTYKMLWNIIFSLIFCENLVPLHHSNKDKTDPLSKEIIYKIIEINLFEIGNKNSMKILDTTINCLKLLNNHLKYGTFKWLYFICVQFFCALLGQEAIIFSKKMTIKYNTLQIVWFTVWKGHRNVQIGRRPSKTQLKNILGDLKLQPNKSFMVLSLIIVIYILDIFLEGMCPTLPHPICLSFKVLRINSSLYNNYILFKKIVCEVLFKRCEIFKFTNTYGSLISNRNELQVTEGYKQKVAYHNVIRSRFLAHIWKQQLLGSSTYKSELVLFSLFYKIGFQMRCLSYDYFREKFYMFEMVEYKRLLNISFKKLFLHYNNIFMMCQIKNLTSVSQIYFQSEIFTCQLKFLTRTNVCVFLCLVGIQISQWIFEVCPVNWIKSSDYKLLKSIKMVISIFKSNLVVFIVICTSIYHRLQIEKYSMIYIVTLKMLDLFNKYGRFFITEVLSLLKGSCYPSVFNYIN

SEQ ID NO: 905467 - protein, 319 aa, Homo sapiens; identical to SEQ ID NO: 905461

SEQ ID NO: 905468 - protein, 530 aa, Homo sapiens
MHNGGILPATQSMLKQMSPVQSLHWHGNRQVYGMFPNSGYYTVSTTVNFVNLKKKSVIYGFQSVPSAPPPKAQSVSPVQAPPPGGSAQLLPGKVLVPLAAPSMSVRGGGAGQPLPLVSPPFSVPVQNGAQPPSKIIQLTPVPVSTPSGLVPPLSPATLPGPTSQPQKVLLPSSTRITYVQSAGGHALPLGTSPASSQAGTVTSYGPTSSVALGFTSLGPSGPAFVQPLLSAGQAPLLAPGQVGVSPVPSPQLPPACAAPGGPVITAFYSGSPAPTSSAPLAQPSQAPPSLVYTVATSTTPPAATILPKGPPAPATATPAPTSPFPSATAGSMTYSLVAPKAQRPSPKAPQKVKAAIASIPVGSFEAGASGRPGPAPRQPLEPGPVREPTAPESELEGQPTPPAPPPLPETWTPTARSSPPLPPPAEERTSAKGPETMASKFPSSSSDWRVPGQGLENRGEPPTPPSPAPAPAVAPGGSSESSSGRAAGDTPERKEAAGTGKKVKVRPPPLKKTFDSVDKSGLRRALGRFT

SEQ ID NO: 905469 - protein, 1620 aa, Homo sapiens
FHPSPAALLPVLVPSSYTSHPAPKKEVIMGRPGTVWTNVEPRSVAVFPWHSLVPFLAPSQPDPSVQPSEAQQPASHPVASNQSKEPAESAAVAHERPPGGTGSADPERPPGATCPESPGPGPPHPLGVVESGKGPPPTTEEEASGPPGEPRLDSETESDHDDAFLSIMSPEIQLPLPPGKRRTQSLSALPKERDSSSEKDGRSPNKREKDHIRRPMNAFMIFSKRHRALVHQRHPNQDNRTVSKILGEWWYALGPKEKQKYHDLAFQVKEAHFKAHPDWKWCNKDRKKSSSEAKPTSLGLAGGHKETRERSMSETGTAAAPGVSSELLSVAAQTLLSSDTKAPGSSSCGAERLHTVGGPGSARPRAFSHSGVHSLDGGEVDSQALQELTQMVSGPASYSGPKPSTQYGAPGPFAAPGEGGALAATGRPPLLPTRASRSQRAASEDMTSDEERMVICEEEGDDDVIADDGFGTTDIDLKCKERVTDSESGDSSGEDPEGNKGFGRKVFSPVIRSSFTHCRPPLDPEPPGPPDPPVAFGKGYGSAPSSSASSPASSSASAATSFSLGSGTFKAQESGQGSTAGPLRPPPPGAGGPATPSKATRFLPMDPATFRRKRPESVGGLEPPGPSVIAAPPSGGGNILQTLVLPPNKEEQEGGGARVPSAPAPSLAYGAPAAPLSRPAATMVTNVVRPVSSTPVPIASKPFPTSGRAEASPNDTAGARTEMGTGSRVPGGSPLGVSLVYSDKKSAAATSPAPHLVAGPLLGTVGKAPATVTNLLVGTPGYGAPAPPAVQFIAQGAPGGGTTAGSGAGAGSGPNGPVPLGILQPGALGKAGGITQVQYILPTLPQQLQVAPAPAPAPGTKAAAPSGPAPTTSIRFTLPPGTSTNGKVLAATAPTPGIPILQSVPSAPPPKAQSVSPVQAPPPGGSAQLLPGKVLVPLAAPSMSVRGGGAGQPLPLVSPPFSVPVQNGAQPPSKIIQLTPVPVSTPSGLVPPLSPATLPGPTSQPQKVLLPSSTRITYVQSAGGHALPLGTSPASSQAGTVTSYGPTSSVALGFTSLGPSGPAFVQPLLSAGQAPLLAPGQVGVSPVPSPQLPPACAAPGGPVITAFYSGSPAPTSSAPLAQPSQAPPSLVYTVATSTTPPAATILPKGPPAPATATPAPTSPFPSATAGSMTYSLVAPKAQRPSPKAPQKVKAAIASIPVGSFEAGASGRPGPAPRQPLEPGPVREPTAPESELEGQPTPPAPPPLPETWTPTARSSPPLPPPAEERTSAKGPETMASKFPSSSSDWRVPGQGLENRGEPPTPPSPAPAPAVAPGGSSESSSGRAAGDTPERKEAAGTGKKVKVRPPPLKKTFDSVDNRVLSEVDFEERFAELPEFRPEEVLPSPTLQSLATSPRAILGSYRKKRKNSTDLDSAPEDPTSPKRKMRRRSSCSSEPNTPKSAKCEGDIFTFDRTGTEAEDVLGELEYDKVPYSSLRRTLDQRRALVMQLFQDHGFFPSAQATAAFQARYADIFPSKVCLQLKIREVRQKIMQAATPTEQPPGAEAPLPVPPPTGTAAAPAPTPSPAGGPDPTSPSSDSGTAQAAPPLPPPPESGPGQPGWEGAPQPSPPPPGPSTAATGR

SEQ ID NO: 905470 - protein, 563 aa, Homo sapiens
MTHSVTFVQPLLSAGQAPLLAPGQVGVSPVPSPQLPPACAAPGGPVITAFYSGSPAPTSSAPLAQPSQAPPSLVYTVATSTTPPAATILPKGPPAPATATPAPTSPFPSATAGSMTYSLVAPKAQRPSPKAPQKVKAAIASIPVGSFEAGASGRPGPAPRQPLEPGPVREPTAPESELEGQPTPPAPPPLPETWTPTARSSPPLPPPAEERTSAKGPETMASKFPSSSSDWRVPGQGLENRGEPPTPPSPAPAPAVAPGGSSESSSGRAAGDTPERKEAAGTGKKVKVRPPPLKKTFDSVDNRVLSEVDFEERFAELPEFRPEEVLPSPTLQSLATSPRAILGSYRKKRKNSTDLDSAPEDPTSPKRKMRRRSSCSSEPNTPKSAKCEGDIFTFDRTGTEAEDVLGELEYDKVPYSSLRRTLDQRRALVMQLFQDHGFFPSAQATAAFQARYADIFPSKVCLQLKIREVRQKIMQAATPTEQPPGAEAPLPVPPPTGTAAAPAPTPSPAGGPDPTSPSSDSGTAQAAPPLPPPPESGPGQPGWEGAPQPSPPPPGPSTAATGR

SEQ ID NO: 905471 - protein, 1464 aa, Homo sapiens
FHPSPAALLPVLVPSSYTSHPAPKKEVIMGRPGTVWTNVEPRSVAVFPWHSLVPFLAPSQPDPSVQPSEAQQPASHPVASNQSKEPAESAAVAHERPPGGTGSADPERPPGATCPESPGPGPPHPLGVVESGKGPPPTTEEEASGPPGEPRLDSETESDHDDAFLSIMSPEIQLPLPPGKRRTQSLSALPKERDSSSEKDGRSPNKREKDHIRRPMNAFMIFSKRHRALVHQRHPNQDNRTVSKILGEWWYALGPKEKQKYHDLAFQVKEAHFKAHPDWKWCNKDRKKSSSEAKPTSLGLAGGHKETRERSMSETGTAAAPGVSSELLSVAAQTLLSSDTKAPGSSSCGAERLHTVGGPGSARPRAFSHSGVHSLDGGEVDSQALQELTQMVSGPASYSGPKPSTQYGAPGPFAAPGEGGALAATGRPPLLPTRASRSQRAASEDMTSDEERMVICEEEGDDDVIADDGFGTTDIDLKCKERVTDSESGDSSGEDPEGNKGFGRKVFSPVIRSSFTHCRPPLDPEPPGPPDPPVAFGKGYGSAPSSSASSPASSSASAATSFSLGSGTFKAQESGQGSTAGPLRPPPPGAGGPATPSKATRFLPMDPATFRRKRPESVGGLEPPGPSVIAAPPSGGGNILQTLVLPPNKEEQEGGGARVPSAPAPSLAYGAPAAPLSRPAATMVTNVVRPVSSTPVPIASKPFPTSGRAEASPNDTAGARTEMGTGSRVPGGSPLGVSLVYSDKKSAAATSPAPHLVAGPLLGTVGKAPATVTNLLVGTPGYGAPAPPAVQFIAQGAPGGGTTAGSGAGAGSGPNGPVPLGILQPGALGKAGGITQVQYILPTLPQQLQVAPAPAPAPGTKAAAPSGPAPTTSIRFTLPPGTSTNGKVLAATAPTPGIPILQSVPSAPPPKAQSVSPVQAPPPGGSAQLLPGKVLVPLAAPSMSVRGGGAGQPLPLVSPPFSVPVQNGAQPPSKIIQLTPVPVSTPSGLVPPLSPATLPGPTSQPQKVLLPSSTRITYVQSAGGHALPLGTSPASSQAGTVTSYGPTSSVALGFTSLGPSGPAFVQPLLSAGQAPLLAPGQVGVSPVPSPQLPPACAAPGGPVITAFYSGSPAPTSSAPLAQPSQAPPSLVYTVATSTTPPAATILPKGPPAPATATPAPTSPFPSATAGSMTYSLVAPKAQRPSPKAPQKVKAAIASIPVGSFEAGASGRPGPAPRQPLEPGPVREPTAPESELEGQPTPPAPPPLPETWTPTARSSPPLPPPAEERTSAKGPETMASKFPSSSSDWRVPGQGLENRGEPPTPPSPAPAPAVAPGGSSESSSGRAAGDTPERKEAAGTGKKVKVRPPPLKKTFDSVDNRVLSEVDFEERFAELPEFRPEEVLPSPTLQSLATSPRAILGSYRKKRKNSTDLDSAPEDPTSPKRKMRRRSSCSSEPNTPKSAKCEGDIFTFDRTGAVVGRTLGA

SEQ ID NO: 905472 - protein, 1621 aa, Homo sapiens
EVRAPAGSPLRRTMYSAHRPLMPASSAASRGLGMFVWTNVEPRSVAVFPWHSLVPFLAPSQPDPSVQPSEAQQPASHPVASNQSKEPAESAAVAHERPPGGTGSADPERPPGATCPESPGPGPPHPLGVVESGKGPPPTTEEEASGPPGEPRLDSETESDHDDAFLSIMSPEIQLPLPPGKRRTQSLSALPKERDSSSEKDGRSPNKREKDHIRRPMNAFMIFSKRHRALVHQRHPNQDNRTVSKILGEWWYALGPKEKQKYHDLAFQVKEAHFKAHPDWKWCNKDRKKSSSEAKPTSLGLAGGHKETRERSMSETGTAAAPGVSSELLSVAAQTLLSSDTKAPGSSSCGAERLHTVGGPGSARPRAFSHSGVHSLDGGEVDSQALQELTQMVSGPASYSGPKPSTQYGAPGPFAAPGEGGALAATGRPPLLPTRASRSQRAASEDMTSDEERMVICEEEGDDDVIADDGFGTTDIDLKCKERVTDSESGDSSGEDPEGNKGFGRKVFSPVIRSSFTHCRPPLDPEPPGPPDPPVAFGKGYGSAPSSSASSPASSSASAATSFSLGSGTFKAQESGQGSTAGPLRPPPPGAGGPATPSKATRFLPMDPATFRRKRPESVGGLEPPGPSVIAAPPSGGGNILQTLVLPPNKEEQEGGGARVPSAPAPSLAYGAPAAPLSRPAATMVTNVVRPVSSTPVPIASKPFPTSGRAEASPNDTAGARTEMGTGSRVPGGSPLGVSLVYSDKKSAAATSPAPHLVAGPLLGTVGKAPATVTNLLVGTPGYGAPAPPAVQFIAQGAPGGGTTAGSGAGAGSGPNGPVPLGILQPGALGKAGGITQVQYILPTLPQQLQVAPAPAPAPGTKAAAPSGPAPTTSIRFTLPPGTSTNGKVLAATAPTPGIPILQSVPSAPPPKAQSVSPVQAPPPGGSAQLLPGKVLVPLAAPSMSVRGGGAGQPLPLVSPPFSVPVQNGAQPPSKIIQLTPVPVSTPSGLVPPLSPATLPGPTSQPQKVLLPSSTRITYVQSAGGHALPLGTSPASSQAGTVTSYGPTSSVALGFTSLGPSGPAFVQPLLSAGQAPLLAPGQVGVSPVPSPQLPPACAAPGGPVITAFYSGSPAPTSSAPLAQPSQAPPSLVYTVATSTTPPAATILPKGPPAPATATPAPTSPFPSATAGSMTYSLVAPKAQRPSPKAPQKVKAAIASIPVGSFEAGASGRPGPAPRQPLEPGPVREPTAPESELEGQPTPPAPPPLPETWTPTARSSPPLPPPAEERTSAKGPETMASKFPSSSSDWRVPGQGLENRGEPPTPPSPAPAPAVAPGGSSESSSGRAAGDTPERKEAAGTGKKVKVRPPPLKKTFDSVDNRVLSEVDFEERFAELPEFRPEEVLPSPTLQSLATSPRAILGSYRKKRKNSTDLDSAPEDPTSPKRKMRRRSSCSSEPNTPKSAKCEGDIFTFDRTGTEAEDVLGELEYDKVPYSSLRRTLDQRRALVMQLFQDHGFFPSAQATAAFQARYADIFPSKVCLQLKIREVRQKIMQAATPTEQPPGAEAPLPVPPPTGTAAAPAPTPSPAGGPDPTSPSSDSGTAQAAPPLPPPPESGPGQPGWEGAPQPSPPPPGPSTAATGR

SEQ ID NO: 905473 - protein, 82 aa, Homo sapiens
EVRAPAGSPLRRTMYSAHRPLMPASSAASRGLGMFVWTNVEPRSVAVFPWHSLAPFPRTKHVDHVQYFLLCREAAMSEIKAV

SEQ ID NO: 905474 - protein, 246 aa, Homo sapiens
PGILGRGGRDCRVGEGSTSSPRAILGSYRKKRKNSTDLDSAPEDPTSPKRKMRRRSSCSSEPNTPKSAKCEGDIFTFDRTGTEAEDVLGELEYDKVPYSSLRRTLDQRRALVMQLFQDHGFFPSAQATAAFQARYADIFPSKVCLQLKIREVRQKIMQAATPTEQPPGAEAPLPVPPPTGTAAAPAPTPSPAGGPDPTSPSSDSGTAQAAPPLPPPPESGPGQPGWEGAPQPSPPPPGPSTAATGR

SEQ ID NO: 905475 - protein, 172 aa, Homo sapiens
VGVSPVPSPQLPPACAAPGGPVITAFYSGSPAPTSSAPLAQPSQAPPSLVYTVATSTTPPAATILPKGPPAPATATPAPTSPFPSATGRCQINPEQSELGDPGDGLQSGLAQQTIFSPLAGSMTYSLVAPKAQRPSPKAPQKVKAAIASIPVGSFEAGASGRPGPAPRQPLE

SEQ ID NO: 905476 - protein, 586 aa, Homo sapiens
MSATVVDAVNAAPLSGSKEMSLEEPKKMTREDWRKKKELEEQRKLGNAPAEVDEEGKDINPHIPQYISSVPWYIDPSKRPTLKHQRPQPEKQKQFSSSGEWYKRGVKENSIITKYRKGACENCGAMTHKKKDCFERPRRVGAKFTGTNIAPDEHVQPQLMFDYDGKRDRWNGYNPEEHMKIVEEYAKVDLAKRTLKAQKLQEELASGKLVEQANSPKHQWGEEEPNSQTEKDHNSEDEDEDKYADDIDMPGQNFDSKRRITVRNLRIREDIAKYLRNLDPNSAYYDPKTRAMRENPYANAGKNPDEVSYAGDNFVRYTGDTISMAQTQLFAWEAYDKGSEVHLQADPTKLELLYKSFKVKKEDFKEQQKESILEKYGGQEHLDAPPAELLLAQTEDYVEYSRHGTVIKGQERAVACSKYEEDVKIHNHTHIWGSYWKEGRWGYKCCHSFFKYSYCTGEAGKEIVNSEECIINEITGEESVKKPQTLMELHQEKLKEEKKKKKKKKKKHRKSSSDSDDEEKKHEKLKKALNAEEARLLHVKETMQIDERKRPYNSMYETREPTEEEMEAYRMKRQRPDDPMASFLGQ

SEQ ID NO: 905477 - protein, 79 aa, Homo sapiens
GSVPIRVGVGGGQITMSATVVDAVNAAPLSGSKEMSLEEPKKMTREDWRKKKELEEQRKLGNAPAEVDEEGKDINPEHG

SEQ ID NO: 905478 - protein, 115 aa, Homo sapiens
AVSELYPVLTQTEDYVEYSRHGTVIKGQERAVACSKYEEDVKIHNHTHIWGSYWKEGRWGYKCCHSFFKYSYCTGEAGKEIVNSEECIINEITGEEGGWWKGAGGREKYWAPAPR

SEQ ID NO: 905479 - protein, 586 aa, Homo sapiens; identical to SEQ ID NO: 905476

SEQ ID NO: 905480 - protein, 586 aa, Homo sapiens; identical to SEQ ID NO: 905476

SEQ ID NO: 905481 - protein, 309 aa, Homo sapiens
CSRNPLCVQIENYSMRENLYANAGQNPDEVSYAGDNFVRYTGDTISMAQTQLFAWEAYDKGSEVHLQADPTKLELLYKSFKVKKEDFKEQQKESILEKYGGQEHLDAPPAELLLAQTEDYVEYSRHGTVIKGQERAVACSKYEEDVKIHNHTHIWGSYWKEGRWGYKCCHSFFKYSYCTGEAGKEIVNSEECIINEITGEESVKKPQTLMELHQEKLKEEKKKKKKKKKKHRKSSSDSDDEEKKHEKLKKALNAEEARLLHVKETMQIDERKRPYNSMYETREPTEEEMEAYRMKRQRPDDPMASFLGQ

SEQ ID NO: 905482 - protein, 240 aa, Homo sapiens
MSVVVKILQSQGEKIRKQHGLGNESILEKYGGQEHLDAPPAELLLAQTEDYVEYSRHGTVIKGQERAVACSKYEEDVKIHNHTHIWGSYWKEGRWGYKCCHSFFKYSYCTGEAGKEIVNSEECIINEITGEESVKKPQTLMELHQEKLKEEKKKKKKKKKKHRKSSSDSDDEEKKHEKLKKALNAEEARLLHVKETMQIDERKRPYNSMYETREPTEEEMEAYRMKRQRPDDPMASFLGQ

SEQ ID NO: 905483 - protein, 530 aa, Homo sapiens
MSATVVDAVNAAPLSGSKEMSLEEPKKMTREDWRKKKELEEQRKLGNAPAEVDEEGKDINPHIPQYISSVPWYIDPSKRPTLKHQRPQPEKQKQFSSSGEWYKRGVKENSIITKYRKGACENCGAMTHKKKDCFERPRRVGAKFTGTNIAPDEHVQPQLMFDYDGKRDRWNGYNPEEHMKIVEEYAKVDLAKRTLKAQKLQEELASGKLVEQANSPKHQWGEEEPNSQTEKDHNSEDEDEDKYADDIDMPGQNFDSKRRITVRNLRIREDIAKYLRNLDPNSAYYDPKTRAMRENPYANAGKNPDEVSYAGDNFVRYTGDTISMAQTQLFAWEAYDKGSEVHLQADPTKLELLYKSFKVKKEDFKEQQKESILEKYGGQEHLDAPPAELLLAQTEDYVEYSRHGTVIKGQERAVACSKYEEDVKIHNHTHIWGSYWKEGRWGYKCCHSFFKYSYCTGEAGKEIVNSEECIINEITGEESVKKPQTLMELHQEKLKEEKKKKKKKKKKHRKSSSDSDDEEKKHEKLKKALS

SEQ ID NO: 905484 - protein, 117 aa, Homo sapiens
ILTVHSSISTCEKTQNLMELHQEKLKEEKKKKKKKKKKHRKSSSDSDDEEKKHEKLKKALNAEEARLLHVKETMQIDERKRPYNSMYETREPTEEEMEAYRMKRQRPDDPMASFLGQ

SEQ ID NO: 905485 - protein, 342 aa, Homo sapiens [sequence omitted]

SEQ ID NO: 905486 - protein, 287 aa, Homo sapiens
MSATVVDAVNAAPLSGSKEMSLEEPKKMTREDWRKKKELEEQRKLGNAPAEVDEEGKDINPHIPQYISSVPWYIDPSKRPTLKHQRPQPEKQKQFSSSGEWYKRGVKENSIITKYRKGACENCGAMTHKKKDCFERPRRVGAKFTGTNIAPDEHVQPQLMFDYDGKRDRWNGYNPEEHMKIVEEYAKVDLAKRTLKAQKLQEELASGKLVEQANSPKTPVGGKRDPFSEREKILLGEHEVRDILRLFCCPADFGPRRILGGISGLSLAIGGYPRRAMVIAGNLAGRT

SEQ ID NO: 905487 - protein, 119 aa, Homo sapiens
QVVHLSFVFTLITLHFNPPFQLHQEKLKEEKKKKKKKKKKHRKSSSDSDDEEKKHEKLKKALNAEEARLLHVKETMQIDERKRPYNSMYETREPTEEEMEAYRMKRQRPDDPMASFLGQ

SEQ ID NO: 905488 - protein, 99 aa, Homo sapiens
SPPFTTISVIKGQERAVACSKYEEDVKIHNHTHIWGSYWKEGRWGYKCCHSFFKYSYCTGEAGKEIVNSEECIINEITGEEERAVQIVVNGAIYNYLMK

SEQ ID NO: 905489 - protein, 586 aa, Homo sapiens; identical to SEQ ID NO: 905476

SEQ ID NO: 905490 - protein, 610 aa, Homo sapiens
QAVPAESKDGLGASCGGAGGGQITMSATVVDAVNAAPLSGSKEMSLEEPKKMTREDWRKKKELEEQRKLGNAPAEVDEEGKDINPHIPQYISSVPWYIDPSKRPTLKHQRPQPEKQKQFSSSGEWYKRGVKENSIITKYRKGACENCGAMTHKKKDCFERPRRVGAKFTGTNIAPDEHVQPQLMFDYDGKRDRWNGYNPEEHMKIVEEYAKVDLAKRTLKAQKLQEELASGKLVEQANSPKHQWGEEEPNSQTEKDHNSEDEDEDKYADDIDMPGQNFDSKRRITVRNLRIREDIAKYLRNLDPNSAYYDPKTRAMRENPYANAGKNPDEVSYAGDNFVRYTGDTISMAQTQLFAWEAYDKGSEVHLQADPTKLELLYKSFKVKKEDFKEQQKESILEKYGGQEHLDAPPAELLLAQTEDYVEYSRHGTVIKGQERAVACSKYEEDVKIHNHTHIWGSYWKEGRWGYKCCHSFFKYSYCTGEAGKEIVNSEECIINEITGEESVKKPQTLMELHQEKLKEEKKKKKKKKKKHRKSSSDSDDEEKKHEKLKKALNAEEARLLHVKETMQIDERKRPYNSMYETREPTEEEMEAYRMKRQRPDDPMASFLGQ

SEQ ID NO: 905491 - protein, 623 aa, Homo sapiens
MSATVVDAVNAAPLSGSKEMSLEEPKKMTREDWRKKKELEEQRKLGNAPAEVDEEGKDINPHIPQYISSVPWYIDPSKRPTLKHQRPQPEKQKQFSSSGEWYKRGVKENSIITKYRKGACENCGAMTHKKKDCFERPRRVGAKFTGTNIAPDEHVQPQLMFDYDGKRDRWNGYNPEEHMKIVEEYAKVDLAKRTLKAQKLQEELASGKLVEQANSPKHQWGEEEPNSQTEKDHNSEDEDEDKYADDIDMPGQNFDSKRRITVRNLRIREDIAKYLRNLDPNSAYYDPKTRAMRENPYANAGKNPDEVSYAGDNFVRYTGDTISMAQTQLFAWEAYDKGSEVHLQADPTKLELLYKSFKVKKEDFKEQQKESILEKYGGQEHLDAPPAELLLAQTEDYVEYSRHGTVIKGQERAVACSKYEEDVKIHNHTHIWGSYWKEGRWGYKCCHSFFKYSYCTGEAGKEIVNSEECIINEITGEESVKKPQTLMELHQEKLKEEKKKKKKKKAKALSTWRQKIRKYNRDFESHITSYKQNPEQSADEDAEKNEEDSEGSSDEDEDEDGVSAATFLKKKSEAPSGESRKFLKKMADDDEDSEDSEDDEDCDTGPHLRFDSRRRGNNGWLRF

SEQ ID NO: 905492 - protein, 175 aa, Homo sapiens
VDPRLHHTYPPSSYLPHTHIWGSYWKEGRWGYKCCHSFFKYSYCTGEAGKEIVNSEECIINEITGEESVKKPQTLMELHQEKLKEEKKKKKKKKKKHRKSSSDSDDEEKKHEKLKKALNAEEARLLHVKETMQIDERKRPYNSMYETREPTEEEMEAYRMKRQRPDDPMASFLGQ

SEQ ID NO: 905493 - protein, 454 aa, Homo sapiens
MSATVVDAVNAAPLSGSKEMSLEEPKKMTREDWRKKKELEEQRKLGNAPAEVDEEGKDINPHIPQYISSVPWYIDPSKRPTLKHQRPQPEKQKQFSSSGEWYKRGVKENSIITKYRKGACENCGAMTHKKKDCFERPRRVGAKFTGTNIAPDEHVQPQLMFDYDGKRDRWNGYNPEEHMKIVEEYAKVDLAKRTLKAQKLQEELASGKLVEQANSPKHQWGEEEPNSQTEKDHNSEDEDEDKYADDIDMPGQNFDSKRRITVRNLRIREDIAKYLRNLDPNSAYYDPKTRAMRENPYANAGKNPDEVSYAGDNFVRYTGDTISMAQTQLFAWEAYDKGSEVHLQADPTKLELLYKSFKVKKEDFKEQQKESILEKYGGQEHLDAPPAELLLAQTEDYVEYSRHGTVIKGQERAVACSKYEEDVKIHNHTVCAKLEQFCVLVGFALYCIFPLQLY

SEQ ID NO: 905494 - protein, 81 aa, Homo sapiens
RHSSSARCLSSASFSLRSGTLLWQRIVMYMAPKSRHPEEQQKVLFLFYSSFNPMLNPLIYNLRNVEVKGALRRALCKESHS

SEQ ID NO: 905495 - protein, 194 aa, Homo sapiens
MSYDRYVAICHPLRYFIIMTWKVCITLAITSWTCGSLLAMVHVSLILRLPFCGPREINHFFCEILSVPQLACADTWLNQVVIFAACMFILVGPLCLVLVSYSHILAAILRIQSGEGRRKAFSTCSSHLCVVGLFFGSASVMYMAPKSRHPEEQQKVLFLFYSSFNPMLNPLIYNLRNVEVKGALRRALCKESHS

SEQ ID NO: 905496 - protein, 194 aa, Homo sapiens; identical to SEQ ID NO: 905495

SEQ ID NO: 905497 - protein, 194 aa, Homo sapiens; identical to SEQ ID NO: 905495

SEQ ID NO: 905498 - protein, 194 aa, Homo sapiens; identical to SEQ ID NO: 905495

SEQ ID NO: 905499 - protein, 194 aa, Homo sapiens; identical to SEQ ID NO: 905495

SEQ ID NO: 905500 - protein, 102 aa, Homo sapiens
MSSEMVKNQTMVTEFLLLGFLLGPRIQMLLFGLFSLFYVFTLLGNGTILGLISLDSRLHTPMYFFLSHLAVVNIAYACNTVPQMLVNLLHPAKPISFAGCMT

SEQ ID NO: 905501 - protein, 424 aa, Homo sapiens
MDFSRRSFHRSLSSSLQAPVVSTVGMQRLGTTPSVYGGAGGRGIRISNSRHTVNYGSDLTGGGDLFVGNEKMAMQNLNDRLASYLEKVRTLEQSNSKLEVQIKQWYETNAPRAGRDYSAYYRQIEELRSQIKDAQLQNARCVLQIDNAKLAAEDFRLKYETERGIRLTVEADLQGLNKVFDDLTLHKTDLEIQIEELNKDLALLKKEHQEEVDGLHKHLGNTVNVEVDAAPGLNLGVIMNEMRQKYEVMAQKNLQEAKEQFERQTAVLQQQVTVNTEELKGTEVQLTELRRTSQSLEIELQSHLSMKESLEHTLEETKARYSSQLANLQSLLSSLEAQLMQIRSNMERQNNEYHILLDIKTRLEQEIATYRRLLEGEDVKTTEYQLSTLEERDIKKTRKIKTVVQEVVDGKVVSSEVKEVEENI

SEQ ID NO: 905502 - protein, 158 aa, Homo sapiens
MDFSRRSFHRSLSSSLQAPVVSTVGMQRLGTTPSVYGGAGGRGIRISNSRHTVNYGSDLTGGGDLFVGNEKMAMQNLNDRLASYLEKVRTLEQSNSKLEVQIKQWYETNAPRAGRDYSAYYRQIEELRSQIKDAQLQNARCVLQIDNAKLAAEDFRLK

SEQ ID NO: 905503 - protein, 424 aa, Homo sapiens; identical to SEQ ID NO: 905501

SEQ ID NO: 905504 - protein, 424 aa, Homo sapiens; identical to SEQ ID NO: 905501

SEQ ID NO: 905505 - protein, 137 aa, Homo sapiens
MLFLQFLLLALLLPGGDNADASQEHVSFHVIQIFSFVNQSWARGQGSGWLDELQTHGWDSESGTIIFLHNWSKGNFSNEELSDLELLFRFYLFGLTREIQDHASQDYSKYPFEVQVKAGCELHSGKSPNKGFPLKVP

SEQ ID NO: 905506 - protein, 333 aa, Homo sapiens
MLFLQFLLLALLLPGGDNADASQEHVSFHVIQIFSFVNQSWARGQGSGWLDELQTHGWDSESGTIIFLHNWSKGNFSNEELSDLELLFRFYLFGLTREIQDHASQDYSKYPFEVQVKAGCELHSGKSPEGFFQVAFNGLDLLSFQNTTWVPSPGCGSLAQSVCHLLNHQYEGVTETVYNLIRSTCPRFLLGLLDAGKMYVHRQVRPEAWLSSRPSLGSGQLLLVCHASGFYPKPVWVTWMRNEQEQLGTKHGDILPNADGTWYLQVILEVASEEPAGLSCRVRHSSLGGQDIILYWGHHFSMNWIALVVIVPLVILIVLVLWFKKHCSYQDIL

SEQ ID NO: 905507 - protein, 346 aa, Homo sapiens
MARPGQRWLGKWLVAMVVWALCRLATPLAKNLEPVSWSSLNPKFLSGKGLVIYPKIGDKLDIICPRAEAGRPYEYYKLYLVRPEQAAACSTVLDPNVLVTCNRPEQEIRFTIKFQEFSPNYMGLEFKKHHDYYITSTSNGSLEGLENREGGVCRTRTMKIIMKVGQDPNAVTPEQLTTSRPSKEADNTVKMATQAPGSRGSLGDSDGKHETVNQEEKSGPGASGGSSGDPDGFFNSKVALFAAVGAGCVIFLLIIIFLTVLLLKLRKRHRKHTQQRAAALSLSTLASPKGGSGTAGTEPSDIIIPLRTTENNYCPHYEKVSGDYGHPVYIVQEMPPQSPANIYYKV

SEQ ID NO: 905508 - protein, 323 aa, Homo sapiens
LISQPWSRRRQLQFSSPRLRFLSGKGLVIYPKIGDKLDIICPRAEAGRPYEYYKLYLVRPEQAAACSTVLDPNVLVTCNRPEQEIRFTIKFQEFSPNYMGLEFKKHHDYYITSTSNGSLEGLENREGGVCRTRTMKIIMKVGQDPNAVTPEQLTTSRPSKEADNTVKMATQAPGSRGSLGDSDGKHETVNQEEKSGPGASGGSSGDPDGFFNSKVALFAAVGAGCVIFLLIIIFLTVLLLKLRKRHRKHTQQRAAALSLSTLASPKGGSGTAGTEPSDIIIPLRTTENNYCPHYEKVSGDYGHPVYIVQEMPPQSPANIYYKV

SEQ ID NO: 905509 - protein, 346 aa, Homo sapiens; identical to SEQ ID NO: 905507

SEQ ID NO: 905510 - protein, 346 aa, Homo sapiens; identical to SEQ ID NO: 905507

SEQ ID NO: 905511 - protein, 346 aa, Homo sapiens; identical to SEQ ID NO: 905507

SEQ ID NO: 905512 - protein, 186 aa, Homo sapiens
MVVLLGATTLVLVAVAPWVLSAAAGGKNLKSPQKVEVDIIDDNFILRWNRSDESVGNVTFSFDYQKTGMDNWIKLSGCQNITSTKCNFSSLKLNVYEEIKLRIRAEKENTSSWYEVDSFTPFRKAQIGPPEVHLEAEDKAIVIHISPGTKDSVMWALDGLSFTYSLVIWKNSSGVEKKGLENLFPT

SEQ ID NO: 905513 - protein, 556 aa, Homo sapiens [sequence omitted]

SEQ ID NO: 905514 - protein, 556 aa, Homo sapiens
MTSHDARCSAGCMLAGVLLKREIQVVDIASQNMQHAVDIIDDNFILRWNRSDESVGNVTFSFDYQKTGMDNWIKLSGCQNITSTKCNFSSLKLNVYEEIKLRIRAEKENTSSWYEVDSFTPFRKAQIGPPEVHLEAEDKAIVIHISPGTKDSVMWALDGLSFTYSLVIWKNSSGVEERIENIYSRHKIYKLSPETTYCLKVKAALLTSWKIGVYSPVHCIKTTVENELPPPENIEVSVQNQNYVLKWDYTYANMTFQVQWLHAFLKRNPGNHLYKWKQIPDCENVKTTQCVFPQNVFQKGIYLLRVQASDGNNTSFWSEEIKFDTEIQAFLLPPVFNIRSLSDSFHIYIGAPKQSGNTPVIQDYPLIYEIIFWENTSNAERKIIEKKTDVTVPNLKPLTVYCVKARAHTMDEKLNKSSVFSDAVCEKTKPGNTSKIWLIVGICIALFALPFVIYAAKVFLRCINYVFFPSLKPSSSIDEYFSEQPLKNLLLSTSEEQIEKCFIIENISTIATVEETNQTDEDHKKYSSQTSQDSGNYSNEDESESKTSEELQQDFV

SEQ ID NO: 905515 - protein, 389 aa, Homo sapiens
MVVLLGATTLVLVAVAPWVLSAAAGGKNLKSPQKVEVDIIDDNFILRWNRSDESVGNVTFSFDYQKTGMDNWIKLSGCQNITSTKCNFSSLKLNVYEEIKLRIRAEKENTSSWYEVDSFTPFRKAQIGPPEVHLEAEDKAIVIHISPGTKDSVMWALDGLSFTYSLVIWKNSSGVEERIENIYSRHKIYKLSPETTYCLKVKAALLTSWKIGVYSPVHCIKTTVENELPPPENIEVSVQNQNYVLKWDYTYANMTFQVQWLHAFLKRNPGNHLYKWKQIPDCENVKTTQCVFPQNVFQKGIYLLRVQASDGNNTSFWSEEIKFDTEIQAFLLPPVFNIRSLSDSFHIYIGAPKQSGNTPVIQDYPLIYEIIFWENTSNAEVKRLYSIIL

SEQ ID NO: 905516 - protein, 441 aa, Homo sapiens
MVVLLGATTLVLVAVAPWVLSAAAGGKNLKSPQKVEVDIIDDNFILRWNRSDESVGNVTFSFDYQKTGMDNWIKLSGCQNITSTKCNFSSLKLNVYEEIKLRIRAEKENTSSWYEVDSFTPFRKAQIGPPEVHLEAEDKAIVIHISPGTKDSVMWALDGLSFTYSLVIWKNSSGVEERIENIYSRHKIYKLSPETTYCLKVKAALLTSWKIGVYSPVHCIKTTVENELPPPENIEVSVQNQNYVLKWDYTYANMTFQVQWLHAFLKRNPGNHLYKWKQIPDCENVKTTQCVFPQNVFQKGIYLLRVQASDGNNTSFWSEEIKFDTEIQAFLLPPVFNIRSLSDSFHIYIGAPKQSGNTPVIQDYPLIYEIIFWENTSNAERKIIEKKTDVTVPNLKPLTVYCVKARAHTMDEKLNKSSVFSDAVCEKTKPGQNLLLSFLKM

SEQ ID NO: 905517 - protein, 391 aa, Homo sapiens [sequence omitted]

SEQ ID NO: 905518 - protein, 457 aa, Homo sapiens
MVVLLGATTLVLVAVAPWVLSAAAGGKNLKSPQKVEVDIIDDNFILRWNRSDESVGNVTFSFDYQKTGMDNWIKLSGCQNITSTKCNFSSLKLNVYEEIKLRIRAEKENTSSWYEVDSFTPFRKVENELPPPENIEVSVQNQNYVLKWDYTYANMTFQVQWLHAFLKRNPGNHLYKWKQIPDCENVKTTQCVFPQNVFQKGIYLLRVQASDGNNTSFWSEEIKFDTEIQAFLLPPVFNIRSLSDSFHIYIGAPKQSGNTPVIQDYPLIYEIIFWENTSNAERKIIEKKTDVTVPNLKPLTVYCVKARAHTMDEKLNKSSVFSDAVCEKTKPGNTSKIWLIVGICIALFALPFVIYAAKVFLRCINYVFFPSLKPSSSIDEYFSEQPLKNLLLSTSEEQIEKCFIIENISTIATVEETNQTDEDHKKYSSQTSQDSGNYSNEDESESKTSEELQQDFV

SEQ ID NO: 905519 - protein, 111 aa, Homo sapiens
MKLFVDTDADTRLSRRVLRDISERGRDLEQILSQYITFVKPAFEEFCLPTKKYADVIIPRGADNLVAINLIVQHIQDILNGGPSKRQTNGCLNGYTPSRKRQASESSSRPH

SEQ ID NO: 905520 - protein, 138 aa, Homo sapiens
MAGDSEQTLQNHQQPNGGEPFLIGVSGGTASGKSSVCAKIVQLLGQNEVDYRQKQVVILSQDSFYRVLTSEQKAKALKGQFNFDHPEPFDNETSFSSKNIFQEQKFYFENGGNNTEGLPNGFRPPAWFIWNPFMGSFP

SEQ ID NO: 905521 - protein, 261 aa, Homo sapiens
MAGDSEQTLQNHQQPNGGEPFLIGVSGGTASGKSSVCAKIVQLLGQNEVDYRQKQVVILSQDSFYRVLTSEQKAKALKGQFNFDHPDAFDNELILKTLKEITEGKTVQIPVYDFVSHSRKEETVTVYPADVVLFEGILAFYSQEVRDLFQMKLFVDTDADTRLSRRVLRDISERGRDLEQILSQYITFVKPAFEEFCLPTKKYADVIIPRGADNLVAINLIVQHIQDILNGGPSKRQTNGCLNGYTPSRKRQASESSSRPH

SEQ ID NO: 905522 - protein, 261 aa, Homo sapiens; identical to SEQ ID NO: 905521

SEQ ID NO: 905523 - protein, 111 aa, Homo sapiens; identical to SEQ ID NO: 905519

SEQ ID NO: 905524 - protein, 111 aa, Homo sapiens; identical to SEQ ID NO: 905519

SEQ ID NO: 905525 - protein, 261 aa, Homo sapiens; identical to SEQ ID NO: 905521

SEQ ID NO: 905526 - protein, 261 aa, Homo sapiens; identical to SEQ ID NO: 905521

SEQ ID NO: 905527 - protein, 261 aa, Homo sapiens; identical to SEQ ID NO: 905521

SEQ ID NO: 905528 - protein, 105 aa, Homo sapiens
MLCYLGVTDFEEFCLPTKKYADVIIPRGADNLVAINLIVQHIQDILNGGPSGPFNASGPFNASGPFNASGPFNASGPFNASGPFNASGPFNASGHSRGSCYSDRQ

SEQ ID NO: 905529 - protein, 261 aa, Homo sapiens; identical to SEQ ID NO: 905521

SEQ ID NO: 905530 - protein, 261 aa, Homo sapiens; identical to SEQ ID NO: 905521

SEQ ID NO: 905531 - protein, 168 aa, Homo sapiens
WPLCWFGVEPDQTDVGILYFLTNAFSKEETVTVYPADVVLFEGILAFYSQEVRDLFQMKLFVDTDADTRLSRRVLRDISERGRDLEQILSQYITFVKPAFEEFCLPTKKYADVIIPRGADNLVAINLIVQHIQDILNGGPSKRQTNGCLNGYTPSRKRQASESSSRPH

SEQ ID NO: 905532 - protein, 96 aa, Homo sapiens
LRPGGREGRAWDLTWSWLRYTGKAGISEDIEDLETKKYADVIIPRGADNLVAINLIVQHIQDILNGGPSKRQTNGCLNGYTPSRKRQASESSSRPH

SEQ ID NO: 905533 - protein, 106 aa, Homo sapiens
MPGHESIPGDAFREKKKSHLFLSAFILHSTAGFFNSKEKDVCRVFLFHGESSEVVKGDLCPGRDHPWLFGGGPRALNSRFPRSHGVELLCQGGTALPTRPQVLLWS

SEQ ID NO: 905534 - protein, 451 aa, Homo sapiens
MTPVRMQHSLAGQTYAVPLIQPDLRREEAVQQMADALQYLQKVSGDIFSRISQRVEQSRSQVQAIGEKVSLAQAKIEKIKGSKKAIKVFSSAKYPAPERLQEYGSIFTGAQDPGLQRRPRHRIQSKHRPLDERALQEKLKDFPVCVSTKPEPEDDAEEGLGGLPSNISSVSSLLLFNTTENLYGQKAGPRGVGGGPAWLSGDPGHQTQVQHIGQEPGGDWGGSAREAWDPTVHAVPLMMWERNMGSGQRVSACLTPCRLRRYKKYVFLDPLAGAVTKTHVMLGAETEEKLFDAPLSISKREQLEQQVPENYFYVPDLGQVPEIDVPSYLPDLPGIANDLMYSADLGPGIAPSAPGTIPELPTFHTEVAEPLKADLQDGVLTPPPPPPPPPPAPEVLASASPLPPSTAAPVGQGARQDDSSSSASPSGGSSSLRPPDFWRAQCTRVDFLWVC

SEQ ID NO: 905535 - protein, 374 aa, Homo sapiens
MTPVRMQHSLAGQTYAVPLIQPDLRREEAVQQMADALQYLQKVSGDIFSRISQRVEQSRSQVQAIGEKVSLAQAKIEKIKGSKKAIKVFSSAKYPAPERLQEYGSIFTGAQDPGLQRRPRHRIQSKHRPLDERALQEKLKDFPVCVSTKPEPEDDAEEGLGGLPSNISSVSSLLLFNTTENLYKKYVFLDPLAGAVTKTHVMLGAETEEKLFDAPLSISKREQLEQQVPENYFYVPDLGQVPEIDVPSYLPDLPGIANDLMYSADLGPGIAPSAPGTIPELPTFHTEVAEPLKADLQDGVLTAPATEPPTEREEDKVHAAMENCQGAKDTVQETSRDHTPETAAESDKKLPEDQKAHTRGERRTQIEATGKAQQ

SEQ ID NO: 905536 - protein, 465 aa, Homo sapiens
MTPVRMQHSLAGQTYAVPLIQPDLRREEAVQQMADALQYLQKVSGDIFSRISQRVEQSRSQVQAIGEKVSLAQAKIEKIKGSKKAIKVFSSAKYPAPERLQEYGSIFTGAQDPGLQRRPRHRIQSKHRPLDERALQEKLKDFPVCVSTKPEPEDDAEEGLGGLPSNISSVSSLLLFNTTENLYKKYVFLDPLAGAVTKTHVMLGAETEEKLFDAPLSISKREQLEQQVPENYFYVPDLGQVPEIDVPSYLPDLPGIANDLMYSADLGPGIAPSAPGTIPELPTFHTEVAEPLKADLQDGVLTPPPPPPPPPPAPEVLASASPLPPSTAAPVGQGARQDDSSSSASPSVQGAPREVVDPSGGWATLLESIRQAGGIGKAKLRSMKERKLEKKKQKEQEQVRATSQGGHLMSDLFNKLVMRRKGISGKGPGAGEGPGGAFARVSDSIPPVPPPQQPQAEEDEDDWES

SEQ ID NO: 905537 - protein, 372 aa, Homo sapiens
MTPVRMQHSLAGQTYAVPLIQPDLRREEAVQQMADALQYLQKVSGDIFSRISQRVEQSRSQVQAIGEKVSLAQAKIEKIKGSKKAIKVFSSAKYPAPERLQEYGSIFTGAQDPGLQRRPRHRIQSKHRPLDERALQEKLKDFPVCVSTKPEPEDDAEEGLGGLPSNISSVSSLLLFNTTENLYKKYVFLDPLAGAVTKTHVMLGAETEEKLFDAPLSISKREQLEQQVPENYFYVPDLGQVPEIDVPSYLPDLPGIANDLMYSADLGPGIAPSAPGTIPELPTFHTEVAEPLKADLQDGVLTPPPPPPPPPPAPEVLASASPLPPSTAAPVGQGARQDDSSSSASPSGGSSSLRPPDFWRAQCTRVDFLWVC

SEQ ID NO: 905538 - protein, 248 aa, Homo sapiens
QIFTIPWPSWPSEKLKDFPVCVSTKPEPEDDAEEGLGGLPSNISSVSSLLLFNTTENLYKKYVFLDPLAGAVTKTHVMLGAETEEKLFDAPLSISKREQLEQQVPENYFYVPDLGQVPEIDVPSYLPDLPGIANDLMYSADLGPGIAPSAPGTIPELPTFHTEVAEPLKADLQDGVLTPPPPPPPPPPAPEVLASASPLPPSTAAPVGQGARQDDSSSSASPSGGSSSLRPPDFWRAQCTRVDFLWVC

SEQ ID NO: 905539 - protein, 281 aa, Homo sapiens
MTPVRMQHSLAGQTYAVPLIQPDLRREEAVQQMADALQYLQKVSGDIFSRISQRVEQSRSQVQAIGEKVSLAQAKIEKIKGSKKAIKVFSSAKYPAPERLQEYGSIFTGAQDPGLQRRPRHRIQSKHRPLDERALQVPENYFYVPDLGQVPEIDVPSYLPDLPGIANDLMYSADLGPGIAPSAPGTIPELPTFHTEVAEPLKADLQDGVLTPPPPPPPPPPAPEVLASASPLPPSTAAPVGQGARQDDSSSSASPSGGSSSLRPPDFWRAQCTRVDFLWVC

SEQ ID NO: 905540 - protein, 372 aa, Homo sapiens; identical to SEQ ID NO: 905537

SEQ ID NO: 905541 - protein, 199 aa, Homo sapiens
MTPVRMQHSLAGQTYAVPLIQPDLRREEAVQQMADALQYLQKVSGDIFSRISQRVEQSRSQVQAIGEKVSLAQAKIEKIKGSKKAIKVFSSAKYPAPERLQEYGSIFTGAQDPGLQRRPRHRIQSKHRPLDERALQEKLKDFPVCVSTKPEPEDDAEEGLGGLPSNISSVSSLLLFNTTENLYGQKAGPRGVGGRPGLA

SEQ ID NO: 905542 - protein, 372 aa, Homo sapiens; identical to SEQ ID NO: 905537

SEQ ID NO: 905543 - protein, 399 aa, Homo sapiens
MTPVRMQHSLAGQTYAVPLIQPDLRREEAVQQMADALQYLQKVSGDIFSRISQRVEQSRSQVQAIGEKVSLAQAKIEKIKGSKKAIKVFSSAKYPAPERLQEYGSIFTGAQDPGLQRRPRHRIQSKHRPLDERALQEKLKDFPVCVSTKPEPEDDAEEGLGGLPSNISSVSSLLLFNTTENLYGQKAEAEGCGREARPGLVGTQGIRHRYKKYVFLDPLAGAVTKTHVMLGAETEEKLFDAPLSISKREQLEQQVPENYFYVPDLGQVPEIDVPSYLPDLPGIANDLMYSADLGPGIAPSAPGTIPELPTFHTEVAEPLKADLQDGVLTPPPPPPPPPPAPEVLASASPLPPSTAAPVGQGARQDDSSSSASPSGGSSSLRPPDFWRAQCTRVDFLWVC

SEQ ID NO: 905544 - protein, 171 aa, Homo sapiens
MLGAETEEKLFDAPLSISKREQLEQQVPENYFYVPDLGQVPEIDVPSYLPDLPGIANDLMYSADLGPGIAPSAPGTIPELPTFHTEVAEPLKADLQDGVLTPPPPPPPPPPAPEVLASASPLPPSTAAPVGQGARQDDSSSSASPSGGSSSLRPPDFWRAQCTRVDFLWVC

SEQ ID NO: 905545 - protein, 372 aa, Homo sapiens; identical to SEQ ID NO: 905537

SEQ ID NO: 905546 - protein, 383 aa, Homo sapiens
MTPVRMQHSLAGQTYAVPLIQPDLRREEAVQQMADALQYLQKVSGDIFSRISQRVEQSRSQVQAIGEKVSLAQAKIEKIKGSKKAIKVFSSAKYPAPERLQEYGSIFTGAQDPGLQRRPRHRIQSKHRPLDERALQEKLKDFPVCVSTKPEPEDDAEEGLGGLPSNISSVSSLLLFNTTENLYKKYVFLDPLAGAVTKTHVMLGAETEEKLFDAPLSISKREQLEQQVPENYFYVPDLGQVPEIDVPSYLPDLPGIANDLMYSADLGPGIAPSAPGTIPELPTFHTEVAEPLKADLQDGVLTPPPPPPPSPPDPDLGRCSDMDTARTSCSDLLPWEGVTEPALCGDQLQGAEGWLEATQLGRGLLSACAPWGDGSTQPAPLCS

SEQ ID NO: 905547 - protein, 83 aa, Homo sapiens
QAKIEKIKGSKKAIKVVPIPLCPEATGQSLHFPMPLRPPILCPAAHLYLGLSSRPGFQLHPLLPSNPSPLSLLGPPQTCPCVH

SEQ ID NO: 905548 - protein, 2039 aa, Homo sapiens
MDIVDTFNHLIPTEHLDDALFLGSNLENEVCEDFSASQNVLEDSLKNMLSDKDPMLGSASNQFCLPVLDSNDPNFQMPCSTVVGLDDIMDEGVVKESGNDTIDEEELILPNRNLRDKVEENSVRSPRKSPRLMAQEQVRSLRQSTIAKRSNAAPLSNTKKASGKTVSTAKAGVKQPERSQVKEEVCMSLKPEYHKENRRCSRNSGQIEVVPEVSVSSSHSSVSSCLEMKDEDGLDSKHKCNNPGEIDVPSHELNCSLLSETCVTIGEKKNEALMECKAKPVGSPLFKFSDKEEHEQNDSISGKTGETVVEEMIATRKVEQDSKETVKLSHEDDHILEDAGSSDISSDAACTNPNKTENSLVGLPSCVDEVTECNLELKDTMGIADKTENTLERNKIEPLGYCEDAESNRQLESTEFNKSNLEVVDTSTFGPESNILENAICDVPDQNSKQLNAIESTKIESHETANLQDDRNSQSSSVSYLESKSVKSKHTKPVIHSKQNMTTDAPKKIVAAKYEVIHSKTKVNVKSVKRNTDVPESQQNFHRPVKVRKKQIDKEPKIQSCNSGVKSVKNQAHSVLKKTLQDQTLVQIFKPLTHSLSDKSHAHPGCLKEPHHPAQTGHVSHSSQKQCHKPQQQAPAMKTNSHVKEELEHPGVEHFKEEDKLKLKKPEKNLQPRQRRSSKSFSLDEPPLFIPDNIATIRREGSDHSSSFESKYMWTPSKQCGFCKKPHGNRFMVGCGRCDDWFHGDCVGLSLSQAQQMGEEDKEYVCVKCCAEEDKKTEILDPDTLENQATVEFHSGDKTMECEKLGLSKHTTNDRTKYIDDTVKHKVKILKRESGEGRNSSDCRDNEIKKWQLAPLRKMGQPVLPRRSSEEKSEKIPKESTTVTCTGEKASKPGTHEKQEMKKKKVEKGVLNVHPAASASKPSADQIRQSVRHSLKDILMKRLTDSNLKVPEEKAAKVATKIEKELFSFFRDTDAKYKNKYRSLMFNLKDPKNNILFKKVLKGEVTPDHLIRMSPEELASKELAAWRRRENRHTIEMIEKEQREVERRPITKITHKGEIEIESDAPMKEQEAAMEIQEPAANKSLEKPEGSEKQKEEVDSMSKDTTSQHRQHLFDLNCKICIGRMAPPVDDLSPKKVKVVVGVARKHSDNEAESIADALSSTSNILASEFFEEEKQESPKSTFSPAPRPEMPGTVEVESTFLARLNFIWKGFINMPSVAKFVTKAYPVSGSPEYLTEDLPDSIQVGGRISPQTVWDYVEKIKASGTKEICVVRFTPVTEEDQISYTLLFAYFSSRKRYGVAANNMKQVKDMYLIPLGATDKIPHPLVPFDGPGLELHRPNLLLGLIIRQKLKRQHSACASTSHIAETPESAPPIALPPDKKSKIEVSTEEAPEEENDFFNSFTTVLHKQRNKPQQNLQEDLPTAVEPLMEVTKQEPPKPLRFLPGVLIGWENQPTTLELANKPLPVDDILQSLLGTTGQVYDQAQSVMEQNTVKEIPFLNEQTNSKIEKTDNVEVTDGENKEIKVKVDNISESTDKSAEIETSVVGSSSISAGSLTSLSLRGKPPDVSTEAFLTNLSIQSKQEETVESKEKTLKRQLQEDQENNLQDNQTSNSSPCRSNVGKGNIDGNVSCSENLVANTARSPQFINLKRDPRQAAGRSQPVTTSESKDGDSCRNGEKHMLPGLSHNKEHLTEQINVEEKLCSAEKNSCVQQSDNLKVAQNSPSVENIQTSQAEQAKPLQEDILMQNIETVHPFRRGSAVATSHFEVGNTCPSEFPSKSITFTSRSTSPRTSTNFSPMRPQQPNLQHLKSSPPGFPFPGPPNFPPQSMFGFPPHLPPPLLPPPGFGFAQNPMVPWPPVVHLPGQPQRMMGPLSQASRYIGPQNFYQVKDIRRPERRHSDPWGRQDQQQLDRPFNRGKGDRQRFYSDSHHLKRERHEKEWEQESERHRRRDRSQDKDRDRKSREEGHKDKERARLSHGDRGTDGKASRDSRNVDKKPDKPKSEDYEKDKEREKSKHREGEKDRDRYHKDRDHTDRTKSKR

SEQ ID NO: 905549 - protein, 1985 aa, Homo sapiens
MDIVDTFNHLIPTEHLDDALFLGSNLENEVCEDFSASQNVLEDSLKNMLSDKDPMLGSASNQFCLPVLDSNDPNFQMPCSTEQVRSLRQSTIAKRSNAAPLSNTKKASGKTVSTAKAGVKQPERSQVKEEVCMSLKPEYHKENRRCSRNSGQIEVVPEVSVSSSHSSVSSCLEMKDEDGLDSKHKCNNPGEIDVPSHELNCSLLSETCVTIGEKKNEALMECKAKPVGSPLFKFSDKEEHEQNDSISGKTGETVVEEMIATRKVEQDSKETVKLSHEDDHILEDAGSSDISSDAACTNPNKTENSLVGLPSCVDEVTECNLELKDTMGIADKTENTLERNKIEPLGYCEDAESNRQLESTEFNKSNLEVVDTSTFGPESNILENAICDVPDQNSKQLNAIESTKIESHETANLQDDRNSQSSSVSYLESKSVKSKHTKPVIHSKQNMTTDAPKKIVAAKYEVIHSKTKVNVKSVKRNTDVPESQQNFHRPVKVRKKQIDKEPKIQSCNSGVKSVKNQAHSVLKKTLQDQTLVQIFKPLTHSLSDKSHAHPGCLKEPHHPAQTGHVSHSSQKQCHKPQQQAPAMKTNSHVKEELEHPGVEHFKEEDKLKLKKPEKNLQPRQRRSSKSFSLDEPPLFIPDNIATIRREGSDHSSSFESKYMWTPSKQCGFCKKPHGNRFMVGCGRCDDWFHGDCVGLSLSQAQQMGEEDKEYVCVKCCAEEDKKTEILDPDTLENQATVEFHSGDKTMECEKLGLSKHTTNDRTKYIDDTVKHKVKILKRESGEGRNSSDCRDNEIKKWQLAPLRKMGQPVLPRRSSEEKSEKIPKESTTVTCTGEKASKPGTHEKQEMKKKKVEKGVLNVHPAASASKPSADQIRQSVRHSLKDILMKRLTDSNLKVPEEKAAKVATKIEKELFSFFRDTDAKYKNKYRSLMFNLKDPKNNILFKKVLKGEVTPDHLIRMSPEELASKELAAWRRRENRHTIEMIEKEQREVERRPITKITHKGEIEIESDAPMKEQEAAMEIQEPAANKSLEKPEGSEKQKEEVDSMSKDTTSQHRQHLFDLNCKICIGRMAPPVDDLSPKKVKVVVGVARKHSDNEAESIADALSSTSNILASEFFEEEKQESPKSTFSPAPRPEMPGTVEVESTFLARLNFIWKGFINMPSVAKFVTKAYPVSGSPEYLTEDLPDSIQVGGRISPQTVWDYVEKIKASGTKEICVVRFTPVTEEDQISYTLLFAYFSSRKRYGVAANNMKQVKDMYLIPLGATDKIPHPLVPFDGPGLELHRPNLLLGLIIRQKLKRQHSACASTSHIAETPESAPPIALPPDKKSKIEVSTEEAPEEENDFFNSFTTVLHKQRNKPQQNLQEDLPTAVEPLMEVTKQEPPKPLRFLPGVLIGWENQPTTLELANKPLPVDDILQSLLGTTGQVYDQAQSVMEQNTVKEIPFLNEQTNSKIEKTDNVEVTDGENKEIKVKVDNISESTDKSAEIETSVVGSSSISAGSLTSLSLRGKPPDVSTEAFLTNLSIQSKQEETVESKEKTLKRQLQEDQENNLQDNQTSNSSPCRSNVGKGNIDGNVSCSENLVANTARSPQFINLKRDPRQAAGRSQPVTTSESKDGDSCRNGEKHMLPGLSHNKEHLTEQINVEEKLCSAEKNSCVQQSDNLKVAQNSPSVENIQTSQAEQAKPLQEDILMQNIETVHPFRRGSAVATSHFEVGNTCPSEFPSKSITFTSRSTSPRTSTNFSPMRPQQPNLQHLKSSPPGFPFPGPPNFPPQSMFGFPPHLPPPLLPPPGFGFAQNPMVPWPPVVHLPGQPQRMMGPLSQASRYIGPQNFYQVKDIRRPERRHSDPWGRQDQQQLDRPFNRGKGDRQRFYSDSHHLKRERHEKEWEQESERHRRRDRSQDKDRDRKSREEGHKDKERARLSHGDRGTDGKASRDSRNVDKKPDKPKSEDYEKDKEREKSKHREGEKDRDRYHKDRDHTDRTKSKR

SEQ ID NO: 905550 - protein, 870 aa, Homo sapiens
GRSNIRKVDSTSTVPGISGRGAGENVDFESTFLARLNFIWKGFINMPSVAKFVTKAYPVSGSPEYLTEDLPDSIQVGGRISPQTVWDYVEKIKASGTKEICVVRFTPVTEEDQISYTLLFAYFSSRKRYGVAANNMKQVKDMYLIPLGATDKIPHPLVPFDGPGLELHRPNLLLGLIIRQKLKRQHSACASTSHIAETPESAPPIALPPDKKSKIEVSTEEAPEEENDFFNSFTTVLHKQRNKPQQNLQEDLPTAVEPLMEVTKQEPPKPLRFLPGVLIGWENQPTTLELANKPLPVDDILQSLLGTTGQVYDQAQSVMEQNTVKEIPFLNEQTNSKIEKTDNVEVTDGENKEIKVKVDNISESTDKSAEIETSVVGSSSISAGSLTSLSLRGKPPDVSTEAFLTNLSIQSKQEETVESKEKTLKRQLQEDQENNLQDNQTSNSSPCRSNVGKGNIDGNVSCSENLVANTARSPQFINLKRDPRQAAGRSQPVTTSESKDGDSCRNGEKHMLPGLSHNKEHLTEQINVEEKLCSAEKNSCVQQSDNLKVAQNSPSVENIQTSQAEQAKPLQEDILMQNIETVHPFRRGSAVATSHFEVGNTCPSEFPSKSITFTSRSTSPRTSTNFSPMRPQQPNLQHLKSSPPGFPFPGPPNFPPQSMFGFPPHLPPPLLPPPGFGFAQNPMVPWPPVVHLPGQPQRMMGPLSQASRYIGPQNFYQVKDIRRPERRHSDPWGRQDQQQLDRPFNRGKGDRQRFYSDSHHLKRERHEKEWEQESERHRRRDRSQDKDRDRKSREEGHKDKERARLSHGDRGTDGKASRDSRNVDKKPDKPKSEDYEKDKEREKSKHREGEKDRDRYHKDRDHTDRTKSKR

SEQ ID NO: 905551 - protein, 621 aa, Homo sapiens
MDIVDTFNHLIPTEHLDDALFLGSNLENEVCEDFSASQNVLEDSLKNMLSDKDPMLGSASNQFCLPVLDSNDPNFQMPCSTEQVRSLRQSTIAKRSNAAPLSNTKKASGKTVSTAKAGVKQPERSQVKEEVCMSLKPEYHKENRRCSRNSGQIEVVPEVSVSSSHSSVSSCLEMKDEDGLDSKHKCNNPGEIDVPSHELNCSLLSETCVTIGEKKNEALMECKAKPVGSPLFKFSDKEEHEQNDSISGKTGETVVEEMIATRKVEQDSKETVKLSHEDDHILEDAGSSDISSDAACTNPNKTENSLVGLPSCVDEVTECNLELKDTMGIADKTENTLERNKIEPLGYCEDAESNRQLESTEFNKSNLEVVDTSTFGPESNILENAICDVPDQNSKQLNAIESTKIESHETANLQDDRNSQSSSVSYLESKSVKSKHTKPVIHSKQNMTTDAPKKIVAAKYEVIHSKTKVNVKSVKRNTDVPESQQNFHRPVKVRKKQIDKEPKIQSCNSGVKSVKNQAHSVLKKTLQDQTLVQIFKPLTHSLSDKSHAHPGCLKEPHHPAQTGHVSHSSQKQCHKPQQQAPAMKTNSHVKEELEHPGVEHFKEEDKLKLKKPERINLLLWN

SEQ ID NO: 905552 - protein, 1958 aa, Homo sapiens
MDIVDTFNHLIPTEHLDDALFLGSNLENEVCEDFSASQNVLEDSLKNMLSDKDPMLGSASNQFCLPVLDSNDPNFQMPCSTEQVRSLRQSTIAKRSNAAPLSNTKKASGKTVSTAKAGVKQPERSQVKEEVCMSLKPEYHKENRRCSRNSGQIEVVPEVSVSSSHSSVSSCLEMKDEDGLDSKHKCNNPGEIDVPSHELNCSLLSETCVTIGEKKNEALMECKAKPVGSPLFKFSDKEEHEQNDSISGKTGETVVEEMIATRKVEQDSKETVKLSHEDDHILEDAGSSDISSDAACTNPNKTENSLVGLPSCVDEVTECNLELKDTMGIADKTENTLERNKIEPLGYCEDAESNRQLESTEFNKSNLEVVDTSTFGPESNILENAICDVPDQNSKQLNAIESTKIESHETANLQDDRNSQSSSVSYLESKSVKSKHTKPVIHSKQNMTTDAPKKIVAAKYEVIHSKTKVNVKSVKRNTDVPESQQNFHRPVKVRKKQIDKEPKIQSCNSGVKSVKNQAHSVLKKTLQDQTLVQIFKPLTHSLSDKSHAHPGCLKEPHHPAQTGHVSHSSQKQCHKPQQQAPAMKTNSHVKEELEHPGVEHFKEEDKLKLKKPEKNLQPRQRRSSKSFSLDEPPLFIPDNIATIRREGSDHSSSFESKYMWTPSKQCGFCKKPHGNRFMVGCGRCDDWFHGDCVGLSLSQAQQMGEEDKEYVCVKCCAEEDKKTEILDPDTLENQATVEFHSGDKTMECEKLGLSKHTTNDRTKYIDDTVKHKVKILKRESGEGRNSSDCRDNEIKKWQLAPLRKMGQPVLPRRSSEEKSEKIPKESTTVTCTGEKASKPGTHEKQEMKKKKVEKGVLNVHPAASASKPSADQIRQSVRHSLKDILMKRLTDSNLKVPEEKAAKVATKIEKELFSFFRDTDAKYKNKYRSLMFNLKDPKNNILFKKVLKGEVTPDHLIRMSPEELASKELAAWRRRENRHTIEMIEKEQREVERRPITKITHKGEIEIESDAPMKEQEAAMEIQEPAANKSLEKPEGSEKQKEEVDSMSKDTTSQHRQHLFDLNCKICIGRMAPPVDDLSPKKVKVVVGVARKHSDNEAESIADALSSTSNILASEFFEEEKQESPKSTFSPAPRPEMPGTVEVESTFLARLNFIWKGFINMPSVAKFVTKAYPVSGSPEYLTEDLPDSIQVGGRISPQTVWDYVEKIKASGTKEICVVRFTPVTEEDQISYTLLFAYFSSRKRYGVAANNMKQVKDMYLIPLGATDKIPHPLVPFDGPGLELHRPNLLLGLIIRQKLKRQHSACASTSHIAETPESAPPIALPPDKKSKIEVSTEEAPEEENDFFNSFTTVLHKQRNKPQQNLQEDLPTAVEPLMEVTKQEPPKPLRFLPGVLIGWENQPTTLELANKPLPVDDILQSLLGTTGQVYDQAQSVMEQNTVKEIPFLNEQTNSKIEKTDNVEVTDGENKEIKVKVDNISESTDKSAEIETSVVGSSSISAGSLTSLSLRGKPPDVSTEAFLTNLSIQSKQEETVESKEKTLKRQLQEDQENNLQDNQTSNSSPCRSNVGKGNIDGNVSCSENLVANTARSPQFINLKRDPRQAAGRSQPVTTSESKDGDSCRNGEKHMLPGLSHNKEHLTEQINVEEKLCSAEKNSCVQQSDNLKVAQNSPSVENIQTSQAEQAKPLQEDILMQNIETVHPFRRGSAVATSHFEVGNTCPSEFPSKSITFTSRSTSPRTSTNFSPMRPQQPNLQHLKSSPPGFPFPGPPNFPPQSMFGFPPHLPPPLLPPPGFGFAQNPMVPWPPVVHLPGQPQRMMGPLSQASRYIGPQNFYQVKDIRRPERRHSDPWGRQDQQQLDRPFNRGKGDRQRFYSDSHHLKRERHEKEWEQESERHRRRDRSQDKDRDRKSREEGHKDKERARLSHGDRGTDGKASRDSRNVDKKPDKPKSEDFQELIETCS

SEQ ID NO: 905553 - protein, 682 aa, Homo sapiens
MDIVDTFNHLIPTEHLDDALFLGSNLENEVCEDFSASQNVLEDSLKNMLSDKDPMLGSASNQFCLPVLDSNDPNFQMPCSTEQVRSLRQSTIAKRSNAAPLSNTKKASGKTVSTAKAGVKQPERSQVKEEVCMSLKPEYHKENRRCSRNSGQIEVVPEVSVSSSHSSVSSCLEMKDEDGLDSKHKCNNPGEIDVPSHELNCSLLSETCVTIGEKKNEALMECKAKPVGSPLFKFSDKEEHEQNDSISGKTGETVVEEMIATRKVEQDSKETVKLSHEDDHILEDAGSSDISSDAACTNPNKTENSLVGLPSCVDEVTECNLELKDTMGIADKTENTLERNKIEPLGYCEDAESNRQLESTEFNKSNLEVVDTSTFGPESNILENAICDVPDQNSKQLNAIESTKIESHETANLQDDRNSQSSSVSYLESKSVKSKHTKPVIHSKQNMTTDAPKKIVAAKYEVIHSKTKVNVKSVKRNTDVPESQQNFHRPVKVRKKQIDKEPKIQSCNSGVKSVKNQAHSVLKKTLQDQTLVQIFKPLTHSLSDKSHAHPGCLKEPHHPAQTGHVSHSSQKQCHKPQQQAPAMKTNSHVKEELEHPGVEHFKEEDKLKLKKPEKNLQPRQRRSSKSFSLDEPPLFIPDNIATIRREGSDHSSSFESKYMWTPSKQCGFCKKPHGNRCVCMCV

SEQ ID NO: 905554 - protein, 1985 aa, Homo sapiens; identical to SEQ ID NO: 905549

SEQ ID NO: 905555 - protein, 1985 aa, Homo sapiens; identical to SEQ ID NO: 905549

SEQ ID NO: 905556 - protein, 1641 aa, Homo sapiens
MDIVDTFNHLIPTEHLDDALFLGSNLENEVCEDFSASQNVLEDSLKNMLSDKDPMLGSASNQFCLPVLDSNDPNFQMPCSTEQVRSLRQSTIAKRSNAAPLSNTKKASGKTVSTAKAGVKQPERSQVKEEVCMSLKPEYHKENRRCSRNSGQIEVVPEVSVSSSHSSVSSCLEMKDEDGLDSKHKCNNPGEIDVPSHELNCSLLSETCVTIGEKKNEALMECKAKPVGSPLFKFSDKEEHEQNDSISGKTGETVVEEMIATRKVEQDSKETVKLSHEDDHILEDAGSSDISSDAACTNPNKTENSLVGLPSCVDEVTECNLELKDTMGIADKTENTLERNKIEPLGYCEDAESNRQLESTEFNKSNLEVVDTSTFGPESNILENAICDVPDQNSKQLNAIESTKIESHETANLQDDRNSQSSSVSYLESKSVKSKHTKPVIHSKQNMTTDAPKKIVAAKYEVIHSKTKVNVKSVKRNTDVPESQQNFHRPVKVRKKQIDKEPKIQSCNSGVKSVKNQAHSVLKKTLQDQTLVQIFKPLTHSLSDKSHAHPGCLKEPHHPAQTGHVSHSSQKQCHKPQQQAPAMKTNSHVKEELEHPGVEHFKEEDKLKLKKPEKNLQPRQRRSSKSFSLDEPPLFIPDNIATIRREGSDHSSSFESKYMWTPSKQCGFCKKPHGNRFMVGCGRCDDWFHGDCVGLSLSQAQQMGEEDKEYVCVKCCAEEDKKTEILDPDTLENQATVEFHSGDKTMECEKLGLSKHTTNDRTKYIDDTVKHKVKILKRESGEGRNSSDCRDNEIKKWQLAPLRKMGQPVLPRRSSEEKSEKIPKESTTVTCTGEKASKPGTHEKQEMKKKKVEKGVLNVHPAASASKPSADQIRQSVRHSLKDILMKRLTDSNLKVPEEKAAKVATKIEKELFSFFRDTDAKYKNKYRSLMFNLKDPKNNILFKKVLKGEVTPDHLIRMSPEELASKELAAWRRRENRHTIEMIEKEQREVERRPITKITHKGEIEIESDAPMKEQEAAMEIQEPAANKSLEKPEGSEKQKEEVDSMSKDTTSQHRQHLFDLNCKICIGRMAPPVDDLSPKKVKVVVGVARKHSDNEAESIADALSSTSNILASEFFEEEKQESPKSTFSPAPRPEMPGTVEVESTFLARLNFIWKGFINMPSVAKFVTKAYPVSGSPEYLTEDLPDSIQVGGRISPQTVWDYVEKIKASGTKEICVVRFTPVTEEDQISYTLLFAYFSSRKRYGVAANNMKQVKDMYLIPLGATDKIPHPLVPFDGPGLELHRPNLLLGLIIRQKLKRQHSACASTSHIAETPESAPPIALPPDKKSKIEVSTEEAPEEENDFFNSFTTVLHKQRNKPQQNLQEDLPTAVEPLMEVTKQEPPKPLRFLPGVLIGWENQPTTLELANKPLPVDDILQSLLGTTGQVYDQAQSVMEQNTVKEIPFLNEQTNQNPMVPWPPVVHLPGQPQRMMGPLSQASRYIGPQNFYQVKDIRRPERRHSDPWGRQDQQQLDRPFNRGKGDRQRFYSDSHHLKRERHEKEWEQESERHRRRDRSQDKDRDRKSREEGHKDKERARLSHGDRGTDGKASRDSRNVDKKPDKPKSEDYEKDKEREKSKHREGEKDRDRYHKDRDHTDRTKSKR

SEQ ID NO: 905557 - protein, 125 aa, Homo sapiens
MAKYLAQIIVMGVQVVGRAFARALRQEFAASRAAADARGRAGHRSAAASNLSGLSLQEAQQILNVSKLSPEEVQKNYEHLFKVNDKSVGGSFYLQSKVVRAKERLDEELKIQAQEDREKGQMPHT

SEQ ID NO: 905558 - protein, 125 aa, Homo sapiens; identical to SEQ ID NO: 905557

SEQ ID NO: 905559 - protein, 138 aa, Homo sapiens
TGSGLLTGCLLCPQAKYLAQIIVMGVQVVGRAFARALRQEFAASRAAADARGRAGHRSAAASNLSGLSLQEAQQILNVSKLSPEEVQKNYEHLFKVNDKSVGGSFYLQSKVVRAKERLDEELKIQAQEDREKGQMPHT

SEQ ID NO: 905560 - protein, 145 aa, Homo sapiens
MRWGQSASGSSVKFTRLPACPAKYLAQIIVMGVQVVGRAFARALRQEFAASRAAADARGRAGHRSAAASNLSGLSLQEAQQILNVSKLSPEEVQKNYEHLFKVNDKSVGGSFYLQSKVVRAKERLDEELKIQAQEDREKGQMPHT

SEQ ID NO: 905561 - protein, 72 aa, Homo sapiens
PPLTEPPPLTEPPPLTQNPLLYTEPPPLTEPPPLTEPPPLTERPPLTQNPLLSPNPISVLSFPSTLLLPLTS

SEQ ID NO: 905562 - protein, 145 aa, Homo sapiens; identical to SEQ ID NO: 905560

SEQ ID NO: 905563 - protein, 137 aa, Homo sapiens
MESHVQCSGMFSLAKYLAQIIVMGVQVVGRAFARALRQEFAASRAAADARGRAGHRSAAASNLSGLSLQEAQQILNVSKLSPEEVQKNYEHLFKVNDKSVGGSFYLQSKVVRAKERLDEELKIQAQEDREKGQMPHT

SEQ ID NO: 905564 - protein, 73 aa, Homo sapiens
RRPQGQGKPSAWKRPGKRGRAVPSPRVSEQPWAAVEHESVLAKYLAQIIVMGVQVVGRAFARALRQEFAASTP

SEQ ID NO: 905565 - protein, 72 aa, Homo sapiens; identical to SEQ ID NO: 905561

SEQ ID NO: 905566 - protein, 145 aa, Homo sapiens
MAAEGPKAVGVRGSLRPEPCFKPRGPSDFHLCPSDSTSIPSLSLLFHSGGALGRRRSQERAGPRRLNKASSGVESTGIWSKPLWPRGWVLDTCRLAQVPYLQTPGPCVVTAVTDSTSLGFPICLRGTCCYVLGPVSSPPPLSCQN

SEQ ID NO: 905567 - protein, 472 aa, Homo sapiens
MLNEMDELKELKNNPHRDFYNCRKVDTHIHAAACMNQKHLLRFIKKSYQIDADRVVYSTKEKNLTLKELFAKLKMHPYDLTVDSLDVHAGRQTFQRFDKFNDKYNPVGASELRDLYLKTDNYINGEYFATIIKEVGADLVEAKYQHAEPRLSIYGRSPDEWSKLSSWFVCNRIHCPNMTWMIQVPRIYDVFRSKNFLPHFGKMLENIFMPVFEATINPQADPELSVFLKHITGFDSVDDESKHSGHMFSSKSPKPQEWTLEKNPSYTYYAYYMYANIMVLNSLRKERGMNTFLFRPHCGEAGALTHLMTAFMIADDISHGLNLKKSPVLQYLFFLAQIPIAMSPLSNNSLFLEYAKNPFLDFLQKGLMISLSTDDPMQFHFTKEPLMEEYAIAAQVFKLSTCDMCEVARNSVLQCGISHEEKVKFLGDNYLEEGPAGNDIRRTNVAQIRMAYRYETWCYELNLIAEGLKSTE

SEQ ID NO: 905568 - protein, 775 aa, Homo sapiens
FYSVSQSPHSLLSLLFYCAILESRISATMPLFKLPAEEKQIDDAMRNFAEKVFASEVKDEGGRQEISPFDVDEICPISHHEMQAHIFHLETLSTSTEARRKKRFQGRKTVNLSIPLSETSSTKLSHIDEYISSSPTYQTVPDFQRVQITGDYASGVTVEDFEIVCKGLYRALCIREKYMQKSFQRFPKTPSKYLRNIDGEAWVANESFYPVFTPPVKKGEDPFRTDNLPENLGYHLKMKDGVVYVYPNEAAVSKDEPKPLPYPNLDTFLDDMNFLLALIAQGPVKTYTHRRLKFLSSKFQVHQMLNEMDELKELKNNPHRDFYNCRKVDTHIHAAACMNQKHLLRFIKKSYQIDADRVVYSTKEKNLTLKELFAKLKMHPYDLTVDSLDVHAGRQTFQRFDKFNDKYNPVGASELRDLYLKTDNYINGEYFATIIKEVGADLVEAKYQHAEPRLSIYGRSPDEWSKLSSWFVCNRIHCPNMTWMIQVPRIYDVFRSKNFLPHFGKMLENIFMPVFEATINPQADPELSVFLKHITGFDSVDDESKHSGHMFSSKSPKPQEWTLEKNPSYTYYAYYMYANIMVLNSLRKERGMNTFLFRPHCGEAGALTHLMTAFMIADDISHGLNLKKSPVLQYLFFLAQIPIAMSPLSNNSLFLEYAKNPFLDFLQKGLMISLSTDDPMQFHFTKEPLMEEYAIAAQVFKLSTCDMCEVARNSVLQCGISHEEKVKFLGDNYLEEGPAGNDIRRTNVAQIRMAYRYETWCYELNLIAEGLKSTE

SEQ ID NO: 905569 - protein, 742 aa, Homo sapiens
FYSVSQSPHSLLSLLFYCAILESRISATMPLFKLPAEEKQIDDAMRNFAEKVFASEVKDEGGRQEISPFDVDEICPISHHEMQAHIFHLETLSTSTEARRKKRFQGRKTVNLSIPLSETSSTKLSHIDEYISSSPTYQTVPDFQRVQITGDYASGVTVEDFEIVCKGLYRALCIREKYMQKSFQRFPKTPSKYLRNIDGEAWVANESFYPVFTPPVKKGEDPFRTDNLPENLGYHLKMKDGVVYVYPNEAAVSKDEPKPLPYPNLDTFLDDMNFLLALIAQGPVKTYTHRRLKFLSSKFQVHQMLNEMDELKELKNNPHRDFYNCRKVDTHIHAAACMNQKHLLRFIKKSYQIDADRVVYSTKEKNLTLKELFAKLKMHPYDLTVDSLDVHAGRQTFQRFDKFNDKYNPVGASELRDLYLKTDNYINGEYFATIIKEVGADLVEAKYQHAEPRLSIYGRSPDEWSKLSSWFVCNRIHCPNMTWMIQVPRIYDVFRSKNFLPHFGKMLENIFMPVFEATINPQADPELSVFLKHITGFDSVDDESKHSGHMFSSKSPKPQEWTLEKNPSYTYYAYYMYANIMVLNSLRKERGMNTFLFRPHCGEAGALTHLMTAFMIADDISHGLNLKKSPVLQYLFFLAQIPIAMSPLSNNSLFLEYAKNPFLDFLQKGLMISLSTDDPMQFHFTKEPLMEEYAIAAQVFKLSTCDMCEVARNSVLQCGISHEFARSTITKYRRLSGSNARD

SEQ ID NO: 905570 - protein, 211 aa, Homo sapiens
PPPPVGWLVILQAGGAVRAPASGLCPPPPFPGPRLSFGKMSDTAVADTRRLNSKPQDLTDAYGPPSNFLEIDIFNPQTVGVGRARFTTYEVRMRTNLPIFKLKESCVRRRYSDFEWLKNELERDSKIVVPPLPGKALKRQLPFRGDEGIFEESFIEERRQGLEQFINKIAGHPLAQNERCLHMFLQEEAIDRNYVPGKSLAVSCPGWSAVA

SEQ ID NO: 905571 - protein, 163 aa, Homo sapiens
PPPPVGWLVILQAGGAVRAPASGLCPPPPFPGPRLSFGKMSDTAVADTRRLNSKPQDLTDAYGPPSNFLEIDIFNPQTVGVGRARFTTYEVRMRTNLPIFKLKESCVRRRYSDFEWLKNELERDSKIAIFLWASASLHLKKENSDYIGGSQQEKEYVFQWLPF

SEQ ID NO: 905572 - protein, 135 aa, Homo sapiens
PPPPVGWLVILQAGGAVRAPASGLCPPPPFPGPRLSFGKMSDTAVADTRRLNSKPQDLTDAYGPPSNFLEIDIFNPQTVGVGRARFTTYEVRMRTNLPIFKLKESCVRRRYSDFEWLKNELERDSKNCWAPTGSE

SEQ ID NO: 905573 - protein, 201 aa, Homo sapiens
PPPPVGWLVILQAGGAVRAPASGLCPPPPFPGPRLSFGKMSDTAVADTRRLNSKPQDLTDAYGPPSNFLEIDIFNPQTVGVGRARFTTYEVRMRTNLPIFKLKESCVRRRYSDFEWLKNELERDSKIVVPPLPGKALKRQLPFRGDEGIFEESFIEERRQGLEQFINKIAGHPLAQNERCLHMFLQEEAIDRNYVPGKVRQ

SEQ ID NO: 905574 - protein, 201 aa, Homo sapiens; identical to SEQ ID NO: 905573

SEQ ID NO: 905575 - protein, 201 aa, Homo sapiens; identical to SEQ ID NO: 905573

SEQ ID NO: 905576 - protein, 169 aa, Homo sapiens
PPPPVGWLVILQAGGAVRAPASGLCPPPPFPGPRLSFGKMSDTAVADTRRLNSKPQDLTDAYGPPSNFLEIDIFNPQTVGVGRARFTTYEVRMRTNLPIFKLKESCVRRRYSDFEWLKNELERDSKIVVPPLPGKALKRQLPFRGDEGIFEESFIEERRQGLEQFINKG

SEQ ID NO: 905577 - protein, 176 aa, Homo sapiens
PPPPVGWLVILQAGGAVRAPASGLCPPPPFPGPRLSFGKMSDTAVADTRRLNSKPQDLTDAYGPPSNFLEIDIFNPQTVGVGRARFTTYEVRMRTNLPIFKLKESCVRRRYSDFEWLKNELERDSKIVVPPLPGKALKRLCSLSHLANVVVAAFLICILCYRHFLKTISSFIVHKC

SEQ ID NO: 905578 - protein, 78 aa, Homo sapiens
GLTVACGLTVVCGLTVAVWVDRGLLRKVRIIWSLFPSFEVVNLSSHRNGLIFDLSHPDCSYGLSSCKLLAVGQDGPYA

SEQ ID NO: 905579 - protein, 201 aa, Homo sapiens; identical to SEQ ID NO: 905573

SEQ ID NO: 905580 - protein, 165 aa, Homo sapiens
PPPPVGWLVILQAGGAVRAPASGLCPPPPFPGPRLSFGKMSDTAVADTRRLNSKPQDLTDAYGPPSNFLEIDIFNPQTVGVGRARFTTYEVRMRTNLPIFKLKESCVRRRYSDFEWLKNELERDSKLVAFHGSNPPRVQAVCCMEQGVWVFWAHHYGCFRVRRKP

SEQ ID NO: 905581 - protein, 201 aa, Homo sapiens; identical to SEQ ID NO: 905573

SEQ ID NO: 905582 - protein, 201 aa, Homo sapiens; identical to SEQ ID NO: 905573

SEQ ID NO: 905583 - protein, 649 aa, Homo sapiens
MGIGKNTTSKSMEAGSSTEGKYEDEAKHPAFFTLPVVINGGATSSGEQDNEDTELMAIYTTENGIAEKSSLAETLDSTGSLDPQRSDMIYTIEDVPPWYLCIFLGLQHYLTCFSGTIAVPFLLADAMCVGYDQWATSQLIGTIFFCVGITTLLQTTFGCRLPLFQASAFAFLAPARAILSLDKWKCNTTDVSVANGTAELLHTEHIWYPRIREIQGAIIMSSLIEVVIGLLGLPGALLKYIGPLTITPTVALIGLSGFQAAGERAGKHWGIAMLTIFLVLLFSQYARNVKFPLPIYKSKKGWTAYKLQLFKMFPIILAILVSWLLCFIFTVTDVFPPDSTKYGFYARTDARQGVLLVAPWFKVPYPFQWGLPTVSAAGVIGMLSAVVASIIESIGDYYACARLSCAPPPPIHAINRGIFVEGLSCVLDGIFGTGNGSTSSSPNIGVLGITKVGSRRVIQCGAALMLALGMIGKFSALFASLPDPVLGALFCTLFGMITAVGLSNLQFIDLNSSRNLFVLGFSIFFGLVLPSYLRQNPLVTGITGIDQVLNVLLTTAMFVGGCVAFILDNTIPGTPEERGIRKWKKGVGKGNKSLDGMESYNLPFGMNIIKKYRCFSYLPISPTFVGYTWKGLRKSDNSRSSDEDSQATG

SEQ ID NO: 905584 - protein, 424 aa, Homo sapiens
MGIGKNTTSKSMEAGSSTEGKYEDEAKHPAFFTLPVVINGGATSSGEQDNEDTELMAIYTTENGIAEKSSLAETLDSTGSLDPQRSDMIYTIEDVPPWYLCIFLGLQHYLTCFSGTIAVPFLLADAMCVGYDQWATSQLIGTIFFCVGITTLLQTTFGCRLPLFQASAFAFLAPARAILSLDKWKCNTTDVSVANGTAELLHTEHIWYPRIREIQGAIIMSSLIEVVIGLLGLPGALLKYIGPLTITPTVALIGLSGFQAAGERAGKHWGIAMLTIFLVLLFSQYARNVKFPLPIYKSKKGWTAYKLQLFKMFPIILAILVSWLLCFIFTVTDVFPPDSTKYGFYARTDARQGVLLVAPWFKVPYPFQWGLPTVSAAGVIGMLSAVVASIIESIGDYYACARLSCAPPPPIHAINRYVPEKTSS

SEQ ID NO: 905585 - protein, 649 aa, Homo sapiens; identical to SEQ ID NO: 905583

SEQ ID NO: 905586 - protein, 649 aa, Homo sapiens; identical to SEQ ID NO: 905583

SEQ ID NO: 905587 - protein, 649 aa, Homo sapiens; identical to SEQ ID NO: 905583

SEQ ID NO: 905588 - protein, 649 aa, Homo sapiens; identical to SEQ ID NO: 905583

SEQ ID NO: 905589 - protein, 649 aa, Homo sapiens; identical to SEQ ID NO: 905583

SEQ ID NO: 905590 - protein, 268 aa, Homo sapiens
MLSAVVASIIESIGDYYACARLSCAPPPPIHAINRGIFVEGLSCVLDGIFGTGNGSTSSSPNIGVLGITKVGSRRVIQCGAALMLALGMIGKFSALFASLPDPVLGALFCTLFGMITAVGLSNLQFIDLNSSRNLFVLGFSIFFGLVLPSYLRQNPLVTGITGIDQVLNVLLTTAMFVGGCVAFILDNTIPGTPEERGIRKWKKGVGKGNKSLDGMESYNLPFGMNIIKKYRCFSYLPISPTFVGYTWKGLRKSDNSRSSDEDSQATG

SEQ ID NO: 905591 - protein, 649 aa, Homo sapiens; identical to SEQ ID NO: 905583

SEQ ID NO: 905592 - protein, 560 aa, Homo sapiens
TREEHLLWYKSCLIAGGPHYLTCFSGTIAVPFLLADAMCVGYDQWATSQLIGTIFFCVGITTLLQTTFGCRLPLFQASAFAFLAPARAILSLDKWKCNTTDVSVANGTAELLHTEHIWYPRIREIQGAIIMSSLIEVVIGLLGLPGALLKYIGPLTITPTVALIGLSGFQAAGERAGKHWGIAMLTIFLVLLFSQYARNVKFPLPIYKSKKGWTAYKLQLFKMFPIILAILVSWLLCFIFTVTDVFPPDSTKYGFYARTDARQGVLLVAPWFKVPYPFQWGLPTVSAAGVIGMLSAVVASIIESIGDYYACARLSCAPPPPIHAINRGIFVEGLSCVLDGIFGTGNGSTSSSPNIGVLGITKVGSRRVIQCGAALMLALGMIGKFSALFASLPDPVLGALFCTLFGMITAVGLSNLQFIDLNSSRNLFVLGFSIFFGLVLPSYLRQNPLVTGITGIDQVLNVLLTTAMFVGGCVAFILDNTIPGTPEERGIRKWKKGVGKGNKSLDGMESYNLPFGMNIIKKYRCFSYLPISPTFVGYTWKGLRKSDNSRSSDEDSQATG

SEQ ID NO: 905593 - protein, 519 aa, Homo sapiens
LWKRLLSCQIVNYLGSSRCRDHGFGLVSFRLPLFQASAFAFLAPARAILSLDKWKCNTTDVSVANGTAELLHTEHIWYPRIREIQGAIIMSSLIEVVIGLLGLPGALLKYIGPLTITPTVALIGLSGFQAAGERAGKHWGIAMLTIFLVLLFSQYARNVKFPLPIYKSKKGWTAYKLQLFKMFPIILAILVSWLLCFIFTVTDVFPPDSTKYGFYARTDARQGVLLVAPWFKVPYPFQWGLPTVSAAGVIGMLSAVVASIIESIGDYYACARLSCAPPPPIHAINRGIFVEGLSCVLDGIFGTGNGSTSSSPNIGVLGITKVGSRRVIQCGAALMLALGMIGKFSALFASLPDPVLGALFCTLFGMITAVGLSNLQFIDLNSSRNLFVLGFSIFFGLVLPSYLRQNPLVTGITGIDQVLNVLLTTAMFVGGCVAFILDNTIPGTPEERGIRKWKKGVGKGNKSLDGMESYNLPFGMNIIKKYRCFSYLPISPTFVGYTWKGLRKSDNSRSSDEDSQATG

SEQ ID NO: 905594 - protein, 649 aa, Homo sapiens; identical to SEQ ID NO: 905583

SEQ ID NO: 905595 - protein, 649 aa, Homo sapiens; identical to SEQ ID NO: 905583

SEQ ID NO: 905596 - protein, 372 aa, Homo sapiens [sequence omitted]

SEQ ID NO: 905597 - protein, 170 aa, Homo sapiens
SSTETLQYSFRCICPEGPHHPSCYSQVNECLSNPCIHGNCTGGLSGYKCLCDAGWVGINCEVDKNECLSNPCQNGGTCDNLVNGYRCTCKKGFKGYNCQVNIDECASNPCLNQGTCFDDISGYTCHCVLPYTGKNCQTVLAPCSPNPCENAAVCKESPNFESLRHTGTEL

SEQ ID NO: 905598 - protein, 2554 aa, Homo sapiens
AGCTPEKVSAKLRAAAEAAAEERRTRGAGSRGICAWASERSARPEPLKQEEGRREWGSSIGTPSPCGSAQAAAAAAEEEATEKMPALRPALLWALLALWLCCAAPAHALQCRDGYEPCVNEGMCVTYHNGTGYCKCPEGFLGEYCQHRDPCEKNRCQNGGTCVAQAMLGKATCRCASGFTGEDCQYSTSHPCFVSRPCLNGGTCHMLSRDTYECTCQVGFTGKECQWTDACLSHPCANGSTCTTVANQFSCKCLTGFTGQKCETDVNECDIPGHCQHGGTCLNLPGSYQCQCPQGFTGQYCDSLYVPCAPSPCVNGGTCRQTGDFTFECNCLPGFEGSTCERNIDDCPNHRCQNGGVCVDGVNTYNCRCPPQWTGQFCTEDVDECLLQPNACQNGGTCANRNGGYGCVCVNGWSGDDCSENIDDCAFASCTPGSTCIDRVASFSCMCPEGKAGLLCHLDDACISNPCHKGALCDTNPLNGQYICTCPQGYKGADCTEDVDECAMANSNPCEHAGKCVNTDGAFHCECLKGYAGPRCEMDINECHSDPCQNDATCLDKIGGFTCLCMPGFKGVHCELEINECQSNPCVNNGQCVDKVNRFQCLCPPGFTGPVCQIDIDDCSSTPCLNGAKCIDHPNGYECQCATGFTGVLCEENIDNCDPDPCHHGQCQDGIDSYTCICNPGYMGAICSDQIDECYSSPCLNDGRCIDLVNGYQCNCQPGTSGVNCEINFDDCASNPCIHGICMDGINRYSCVCSPGFTGQRCNIDIDECASNPCRKGATCINGVNGFRCICPEGPHHPSCYSQVNECLSNPCIHGNCTGGLSGYKCLCDAGWVGINCEVDKNECLSNPCQNGGTCDNLVNGYRCTCKKGFKGYNCQVNIDECASNPCLNQGTCFDDISGYTCHCVLPYTGKNCQTVLAPCSPNPCENAAVCKESPNFESYTCLCAPGWQGQRCTIDIDECISKPCMNHGLCHNTQGSYMCECPPGFSGMDCEEDIDDCLANPCQNGGSCMDGVNTFSCLCLPGFTGDKCQTDMNECLSEPCKNGGTCSDYVNSYTCKCQAGFDGVHCENNINECTESSCFNGGTCVDGINSFSCLCPVGFTGSFCLHEINECSSHPCLNEGTCVDGLGTYRCSCPLGYTGKNCQTLVNLCSRSPCKNKGTCVQKKAESQCLCPSGWAGAYCDVPNVSCDIAASRRGVLVEHLCQHSGVCINAGNTHYCQCPLGYTGSYCEEQLDECASNPCQHGATCSDFIGGYRCECVPGYQGVNCEYEVDECQNQPCQNGGTCIDLVNHFKCSCPPGTRGLLCEENIDDCARGPHCLNGGQCMDRIGGYSCRCLPGFAGERCEGDINECLSNPCSSEGSLDCIQLTNDYLCVCRSAFTGRHCETFVDVCPQMPCLNGGTCAVASNMPDGFICRCPPGFSGARCQSSCGQVKCRKGEQCVHTASGPRCFCPSPRDCESGCASSPCQHGGSCHPQRQPPYYSCQCAPPFSGSRCELYTAPPSTPPATCLSQYCADKARDGVCDEACNSHACQWDGGDCSLTMENPWANCSSPLPCWDYINNQCDELCNTVECLFDNFECQGNSKTCKYDKYCADHFKDNHCDQGCNSEECGWDGLDCAADQPENLAEGTLVIVVLMPPEQLLQDARSFLRALGTLLHTNLRIKRDSQGELMVYPYYGEKSAAMKKQRMTRRSLPGEQEQEVAGSKVFLEIDNRQCVQDSDHCFKNTDAAAALLASHAIQGTLSYPLVSVVSESLTPERTQLLYLLAVAVVIILFIILLGVIMAKRKRKHGSLWLPEGFTLRRDASNHKRREPVGQDAVGLKNLSVQVSEANLIGTGTSEHWVDDEGPQPKKVKAEDEALLSEEDDPIDRRPWTQQHLEAADIRRTPSLALTPPQAEQEVDVLDVNVRGPDGCTPLMLASLRGGSSDLSDEDEDAEDSSANIITDLVYQGASLQAQTDRTGEMALHLAARYSRADAAKRLLDAGADANAQDNMGRCPLHAAVAADAQGVFQILIRNRVTDLDARMNDGTTPLILAARLAVEGMVAELINCQADVNAVDDHGKSALHWAAAVNNVEATLLLLKNGANRDMQDNKEETPLFLAAREGSYEAAKILLDHFANRDITDHMDRLPRDVARDRMHHDIVRLLDEYNVTPSPPGTVLTSALSPVICGPNRSFLSLKHTPMGKKSRRPSAKSTMPTSLPNLAKEAKDAKGSRRKKSLSEKVQLSESSVTLSPVDSLESPHTYVSDTTSSPMITSPGILQASPNPMLATAAPPAPVHAQHALSFSNLHEMQPLAHGASTVLPSVSQLLSHHHIVSPGSGSAGSLSRLHPVPVPADWMNRMEVNETQYNEMFGMVLAPAEGTHPGIAPQSRPPEGKHITTPREPLPPIVTFQLIPKGSIAQPAGAPQPQSTCPPAVAGPLPTMYQIPEMARLPSVAFPTAMMPQQDGQVAQTILPAYHPFPASVGKYPTPPSQHSYASSNAAERTPSHSGHLQGEHPYLTPSPESPDQWSSSSPHSASDWSDVTTSPTPGGAGGGQRGPGTHMSEPPHNNMQVYA

SEQ ID NO: 905599 - protein, 1589 aa, Homo sapiens
MNHGLCHNTQGSYMCECPPGFSGMDCEEDIDDCLANPCQNGGSCMDGVNTFSCLCLPGFTGDKCQTDMNECLSEPCKNGGTCSDYVNSYTCKCQAGFDGVHCENNINECTESSCFNGGTCVDGINSFSCLCPVGFTGSFCLHEINECSSHPCLNEGTCVDGLGTYRCSCPLGYTGKNCQTLVNLCSRSPCKNKGTCVQKKAESQCLCPSGWAGAYCDVPNVSCDIAASRRGVLVEHLCQHSGVCINAGNTHYCQCPLGYTGSYCEEQLDECASNPCQHGATCSDFIGGYRCECVPGYQGVNCEYEVDECQNQPCQNGGTCIDLVNHFKCSCPPGTRGLLCEENIDDCARGPHCLNGGQCMDRIGGYSCRCLPGFAGERCEGDINECLSNPCSSEGSLDCIQLTNDYLCVCRSAFTGRHCETFVDVCPQMPCLNGGTCAVASNMPDGFICRCPPGFSGARCQSSCGQVKCRKGEQCVHTASGPRCFCPSPRDCESGCASSPCQHGGSCHPQRQPPYYSCQCAPPFSGSRCELYTAPPSTPPATCLSQYCADKARDGVCDEACNSHACQWDGGDCSLTMENPWANCSSPLPCWDYINNQCDELCNTVECLFDNFECQGNSKTCKYDKYCADHFKDNHCDQGCNSEECGWDGLDCAADQPENLAEGTLVIVVLMPPEQLLQDARSFLRALGTLLHTNLRIKRDSQGELMVYPYYGEKSAAMKKQRMTRRSLPGEQEQEVAGSKVFLEIDNRQCVQDSDHCFKNTDAAAALLASHAIQGTLSYPLVSVVSESLTPERTQLLYLLAVAVVIILFIILLGVIMAKRKRKHGSLWLPEGFTLRRDASNHKRREPVGQDAVGLKNLSVQVSEANLIGTGTSEHWVDDEGPQPKKVKAEDEALLSEEDDPIDRRPWTQQHLEAADIRRTPSLALTPPQAEQEVDVLDVNVRGPDGCTPLMLASLRGGSSDLSDEDEDAEDSSANIITDLVYQGASLQAQTDRTGEMALHLAARYSRADAAKRLLDAGADANAQDNMGRCPLHAAVAADAQGVFQILIRNRVTDLDARMNDGTTPLILAARLAVEGMVAELINCQADVNAVDDHGKSALHWAAAVNNVEATLLLLKNGANRDMQDNKEETPLFLAAREGSYEAAKILLDHFANRDITDHMDRLPRDVARDRMHHDIVRLLDEYNVTPSPPGTVLTSALSPVICGPNRSFLSLKHTPMGKKSRRPSAKSTMPTSLPNLAKEAKDAKGSRRKKSLSEKVQLSESSVTLSPVDSLESPHTYVSDTTSSPMITSPGILQASPNPMLATAAPPAPVHAQHALSFSNLHEMQPLAHGASTVLPSVSQLLSHHHIVSPGSGSAGSLSRLHPVPVPADWMNRMEVNETQYNEMFGMVLAPAEGTHPGIAPQSRPPEGKHITTPREPLPPIVTFQLIPKGSIAQPAGAPQPQSTCPPAVAGPLPTMYQIPEMARLPSVAFPTAMMPQQDGQVAQTILPAYHPFPASVGKYPTPPSQHSYASSNAAERTPSHSGHLQGEHPYLTPSPESPDQWSSSSPHSASDWSDVTTSPTPGGAGGGQRGPGTHMSEPPHNNMQVYA

SEQ ID NO: 905600 - protein, 1416 aa, Homo sapiens
PLPLFQTLVNLCSRSPCKNKGTCVQKKAESQCLCPSGWAGAYCDVPNVSCDIAASRRGVLVEHLCQHSGVCINAGNTHYCQCPLGYTGSYCEEQLDECASNPCQHGATCSDFIGGYRCECVPGYQGVNCEYEVDECQNQPCQNGGTCIDLVNHFKCSCPPGTRGLLCEENIDDCARGPHCLNGGQCMDRIGGYSCRCLPGFAGERCEGDINECLSNPCSSEGSLDCIQLTNDYLCVCRSAFTGRHCETFVDVCPQMPCLNGGTCAVASNMPDGFICRCPPGFSGARCQSSCGQVKCRKGEQCVHTASGPRCFCPSPRDCESGCASSPCQHGGSCHPQRQPPYYSCQCAPPFSGSRCELYTAPPSTPPATCLSQYCADKARDGVCDEACNSHACQWDGGDCSLTMENPWANCSSPLPCWDYINNQCDELCNTVECLFDNFECQGNSKTCKYDKYCADHFKDNHCDQGCNSEECGWDGLDCAADQPENLAEGTLVIVVLMPPEQLLQDARSFLRALGTLLHTNLRIKRDSQGELMVYPYYGEKSAAMKKQRMTRRSLPGEQEQEVAGSKVFLEIDNRQCVQDSDHCFKNTDAAAALLASHAIQGTLSYPLVSVVSESLTPERTQLLYLLAVAVVIILFIILLGVIMAKRKRKHGSLWLPEGFTLRRDASNHKRREPVGQDAVGLKNLSVQVSEANLIGTGTSEHWVDDEGPQPKKVKAEDEALLSEEDDPIDRRPWTQQHLEAADIRRTPSLALTPPQAEQEVDVLDVNVRGPDGCTPLMLASLRGGSSDLSDEDEDAEDSSANIITDLVYQGASLQAQTDRTGEMALHLAARYSRADAAKRLLDAGADANAQDNMGRCPLHAAVAADAQGVFQILIRNRVTDLDARMNDGTTPLILAARLAVEGMVAELINCQADVNAVDDHGKSALHWAAAVNNVEATLLLLKNGANRDMQDNKEETPLFLAAREGSYEAAKILLDHFANRDITDHMDRLPRDVARDRMHHDIVRLLDEYNVTPSPPGTVLTSALSPVICGPNRSFLSLKHTPMGKKSRRPSAKSTMPTSLPNLAKEAKDAKGSRRKKSLSEKVQLSESSVTLSPVDSLESPHTYVSDTTSSPMITSPGILQASPNPMLATAAPPAPVHAQHALSFSNLHEMQPLAHGASTVLPSVSQLLSHHHIVSPGSGSAGSLSRLHPVPVPADWMNRMEVNETQYNEMFGMVLAPAEGTHPGIAPQSRPPEGKHITTPREPLPPIVTFQLIPKGSIAQPAGAPQPQSTCPPAVAGPLPTMYQIPEMARLPSVAFPTAMMPQQDGQVAQTILPAYHPFPASVGKYPTPPSQHSYASSNAAERTPSHSGHLQGEHPYLTPSPESPDQWSSSSPHSASDWSDVTTSPTPGGAGGGQRGPGTHMSEPPHNNMQVYA

SEQ ID NO: 905601 - protein, 2554 aa, Homo sapiens; identical to SEQ ID NO: 905598

SEQ ID NO: 905602 - protein, 1318 aa, Homo sapiens
AGCTPEKVSAKLRAAAEAAAEERRTRGAGSRGICAWASERSARPEPLKQEEGRREWGSSIGTPSPCGSAQAAAAAAEEEATEKMPALRPALLWALLALWLCCAAPAHALQCRDGYEPCVNEGMCVTYHNGTGYCKCPEGFLGEYCQHRDPCEKNRCQNGGTCVAQAMLGKATCRCASGFTGEDCQYSTSHPCFVSRPCLNGGTCHMLSRDTYECTCQVGFTGKECQWTDACLSHPCANGSTCTTVANQFSCKCLTGFTGQKCETDVNECDIPGHCQHGGTCLNLPGSYQCQCPQGFTGQYCDSLYVPCAPSPCVNGGTCRQTGDFTFECNCLPGFEGSTCERNIDDCPNHRCQNGGVCVDGVNTYNCRCPPQWTGQFCTEDVDECLLQPNACQNGGTCANRNGGYGCVCVNGWSGDDCSENIDDCAFASCTPGSTCIDRVASFSCMCPEGKAGLLCHLDDACISNPCHKGALCDTNPLNGQYICTCPQGYKGADCTEDVDECAMANSNPCEHAGKCVNTDGAFHCECLKGYAGPRCEMDINECHSDPCQNDATCLDKIGGFTCLCMPGFKGVHCELEINECQSNPCVNNGQCVDKVNRFQCLCPPGFTGPVCQIDIDDCSSTPCLNGAKCIDHPNGYECQCATGFTGVLCEENIDNCDPDPCHHGQCQDGIDSYTCICNPGYMGAICSDQIDECYSSPCLNDGRCIDLVNGYQCNCQPGTSGVNCEINFDDCASNPCIHGICMDGINRYSCVCSPGFTGQRCNIDIDECASNPCRKGATCINGVNGFRCICPEGPHHPSCYSQVNECLSNPCIHGNCTGGLSGYKCLCDAGWVGINCEVDKNECLSNPCQNGGTCDNLVNGYRCTCKKGFKGYNCQVNIDECASNPCLNQGTCFDDISGYTCHCVLPYTGKNCQTVLAPCSPNPCENAAVCKESPNFESYTCLCAPGWQGQRCTIDIDECISKPCMNHGLCHNTQGSYMCECPPGFSGMDCEEDIDDCLANPCQNGGSCMDGVNTFSCLCLPGFTGDKCQTDMNECLSEPCKNGGTCSDYVNSYTCKCQAGFDGVHCENNINECTESSCFNGGTCVDGINSFSCLCPVGFTGSFCLHEINECSSHPCLNEGTCVDGLGTYRCSCPLGYTGKNCQTLVNLCSRSPCKNKGTCVQKKAESQCLCPSGWAGAYCDVPNVSCDIAASRRGVLVEHLCQHSGVCINAGNTHYCQCPLGYTGSYCEEQLDECASNPCQHGATCSDFIGGYRCECVPGYQGVNCEYEVDECQNQPCQNGGTCIDLVNHFKCSCPPGTRGMKSSLSIFHPGHCLKL

SEQ ID NO: 905603 - protein, 357 aa, Homo sapiens
AGCTPEKVSAKLRAAAEAAAEERRTRGAGSRGICAWASERSARPEPLKQEEGRREWGSSIGTPSPCGSAQAAAAAAEEEATEKMPALRPALLWALLALWLCCAAPAHALQCRDGYEPCVNEGMCVTYHNGTGYCKCPEGFLGEYCQHRDPCEKNRCQNGGTCVAQAMLGKATCRCASGFTGEDCQYSTSHPCFVSRPCLNGGTCHMLSRDTYECTCQVGFTGKECQWTDACLSHPCANGSTCTTVANQFSCKCLTGFTGQKCETDVNECDIPGHCQHGGTCLNLPGSYQCQCPQGFTGQYCDSLYVPCAPSPCVNGGTCRQTGDFTFECNCLPETVRNKRNRALGKGQASLEWKRTR

SEQ ID NO: 905604 - protein, 141 aa, Homo sapiens
FTGVLCEENIDNCDPDPCHHGQCQDGIDSYTCICNPGYMGAICSDQIDECYSSPCLNDGRCIDLVNGYQCNCQPGTSGKPTLFMFGMGFSLFLKSVYTDVSDCWHMLRYLKNSPDSEKHSQSHKHKCLKANGPSQWRSQRQ

SEQ ID NO: 905605 - protein, 2554 aa, Homo sapiens; identical to SEQ ID NO: 905598

SEQ ID NO: 905606 - protein, 202 aa, Homo sapiens
LTLSPFSTGQRCNIDIDECASNPCRKGATCINGVNGFRCICPEGPHHPSCYSQVNECLSNPCIHGNCTGGLSGYKCLCDAGWVGINCEVDKNECLSNPCQNGGTCDNLVNGYRCTCKKGFKGYNCQVNIDECASNPCLNQGTCFDDISGYTCHCVLPYTGGSWRYQQGPEGILDLALSVPESQCPGLWGCNAPPRAHSSVVL

SEQ ID NO: 905607 - protein, 1777 aa, Homo sapiens
SSTETLQYSFRCICPEGPHHPSCYSQVNECLSNPCIHGNCTGGLSGYKCLCDAGWVGINCEVDKNECLSNPCQNGGTCDNLVNGYRCTCKKGFKGYNCQVNIDECASNPCLNQGTCFDDISGYTCHCVLPYTGKNCQTVLAPCSPNPCENAAVCKESPNFESYTCLCAPGWQGQRCTIDIDECISKPCMNHGLCHNTQGSYMCECPPGFSGMDCEEDIDDCLANPCQNGGSCMDGVNTFSCLCLPGFTGDKCQTDMNECLSEPCKNGGTCSDYVNSYTCKCQAGFDGVHCENNINECTESSCFNGGTCVDGINSFSCLCPVGFTGSFCLHEINECSSHPCLNEGTCVDGLGTYRCSCPLGYTGKNCQTLVNLCSRSPCKNKGTCVQKKAESQCLCPSGWAGAYCDVPNVSCDIAASRRGVLVEHLCQHSGVCINAGNTHYCQCPLGYTGSYCEEQLDECASNPCQHGATCSDFIGGYRCECVPGYQGVNCEYEVDECQNQPCQNGGTCIDLVNHFKCSCPPGTRGLLCEENIDDCARGPHCLNGGQCMDRIGGYSCRCLPGFAGERCEGDINECLSNPCSSEGSLDCIQLTNDYLCVCRSAFTGRHCETFVDVCPQMPCLNGGTCAVASNMPDGFICRCPPGFSGARCQSSCGQVKCRKGEQCVHTASGPRCFCPSPRDCESGCASSPCQHGGSCHPQRQPPYYSCQCAPPFSGSRCELYTAPPSTPPATCLSQYCADKARDGVCDEACNSHACQWDGGDCSLTMENPWANCSSPLPCWDYINNQCDELCNTVECLFDNFECQGNSKTCKYDKYCADHFKDNHCDQGCNSEECGWDGLDCAADQPENLAEGTLVIVVLMPPEQLLQDARSFLRALGTLLHTNLRIKRDSQGELMVYPYYGEKSAAMKKQRMTRRSLPGEQEQEVAGSKVFLEIDNRQCVQDSDHCFKNTDAAAALLASHAIQGTLSYPLVSVVSESLTPERTQLLYLLAVAVVIILFIILLGVIMAKRKRKHGSLWLPEGFTLRRDASNHKRREPVGQDAVGLKNLSVQVSEANLIGTGTSEHWVDDEGPQPKKVKAEDEALLSEEDDPIDRRPWTQQHLEAADIRRTPSLALTPPQAEQEVDVLDVNVRGPDGCTPLMLASLRGGSSDLSDEDEDAEDSSANIITDLVYQGASLQAQTDRTGEMALHLAARYSRADAAKRLLDAGADANAQDNMGRCPLHAAVAADAQGVFQILIRNRVTDLDARMNDGTTPLILAARLAVEGMVAELINCQADVNAVDDHGKSALHWAAAVNNVEATLLLLKNGANRDMQDNKEETPLFLAAREGSYEAAKILLDHFANRDITDHMDRLPRDVARDRMHHDIVRLLDEYNVTPSPPGTVLTSALSPVICGPNRSFLSLKHTPMGKKSRRPSAKSTMPTSLPNLAKEAKDAKGSRRKKSLSEKVQLSESSVTLSPVDSLESPHTYVSDTTSSPMITSPGILQASPNPMLATAAPPAPVHAQHALSFSNLHEMQPLAHGASTVLPSVSQLLSHHHIVSPGSGSAGSLSRLHPVPVPADWMNRMEVNETQYNEMFGMVLAPAEGTHPGIAPQSRPPEGKHITTPREPLPPIVTFQLIPKGSIAQPAGAPQPQSTCPPAVAGPLPTMYQIPEMARLPSVAFPTAMMPQQDGQVAQTILPAYHPFPASVGKYPTPPSQHSYASSNAAERTPSHSGHLQGEHPYLTPSPESPDQWSSSSPHSASDWSDVTTSPTPGGAGGGQRGPGTHMSEPPHNNMQVYA

SEQ ID NO: 905608 - protein, 2554 aa, Homo sapiens; identical to SEQ ID NO: 905598

SEQ ID NO: 905609 - protein, 1505 aa, Homo sapiens
AGCTPEKVSAKLRAAAEAAAEERRTRGAGSRGICAWASERSARPEPLKQEEGRREWGSSIGTPSPCGSAQAAAAAAEEEATEKMPALRPALLWALLALWLCCAAPAHALQCRDGYEPCVNEGMCVTYHNGTGYCKCPEGFLGEYCQHRDPCEKNRCQNGGTCVAQAMLGKATCRCASGFTGEDCQYSTSHPCFVSRPCLNGGTCHMLSRDTYECTCQVGFTGKECQWTDACLSHPCANGSTCTTVANQFSCKCLTGFTGQKCETDVNECDIPGHCQHGGTCLNLPGSYQCQCPQGFTGQYCDSLYVPCAPSPCVNGGTCRQTGDFTFECNCLPGFEGSTCERNIDDCPNHRCQNGGVCVDGVNTYNCRCPPQWTGQFCTEDVDECLLQPNACQNGGTCANRNGGYGCVCVNGWSGDDCSENIDDCAFASCTPGSTCIDRVASFSCMCPEGKAGLLCHLDDACISNPCHKGALCDTNPLNGQYICTCPQGYKGADCTEDVDECAMANSNPCEHAGKCVNTDGAFHCECLKGYAGPRCEMDINECHSDPCQNDATCLDKIGGFTCLCMPGFKGVHCELEINECQSNPCVNNGQCVDKVNRFQCLCPPGFTGPVCQIDIDDCSSTPCLNGAKCIDHPNGYECQCATGFTGVLCEENIDNCDPDPCHHGQCQDGIDSYTCICNPGYMGAICSDQIDECYSSPCLNDGRCIDLVNGYQCNCQPGTSGVNCEINFDDCASNPCIHGICMDGINRYSCVCSPGFTGQRCNIDIDECASNPCRKGATCINGVNGFRCICPEGPHHPSCYSQVNECLSNPCIHGNCTGGLSGYKCLCDAGWVGINCEVDKNECLSNPCQNGGTCDNLVNGYRCTCKKGFKGYNCQVNIDECASNPCLNQGTCFDDISGYTCHCVLPYTGKNCQTVLAPCSPNPCENAAVCKESPNFESYTCLCAPGWQGQRCTIDIDECISKPCMNHGLCHNTQGSYMCECPPGFSGMDCEEDIDDCLANPCQNGGSCMDGVNTFSCLCLPGFTGDKCQTDMNECLSEPCKNGGTCSDYVNSYTCKCQAGFDGVHCENNINECTESSCFNGGTCVDGINSFSCLCPVGFTGSFCLHEINECSSHPCLNEGTCVDGLGTYRCSCPLGYTGKNCQTLVNLCSRSPCKNKGTCVQKKAESQCLCPSGWAGAYCDVPNVSCDIAASRRGVLVEHLCQHSGVCINAGNTHYCQCPLGYTGSYCEEQLDECASNPCQHGATCSDFIGGYRCECVPGYQGVNCEYEVDECQNQPCQNGGTCIDLVNHFKCSCPPGTRGLLCEENIDDCARGPHCLNGGQCMDRIGGYSCRCLPGFAGERCEGDINECLSNPCSSEGSLDCIQLTNDYLCVCRSAFTGRHCETFVDVCPQMPCLNGGTCAVASNMPDGFICRCPPGFSGARCQSSCGQVKCRKGEQCVHTASGPRCFCPSPRDCESGCASSPCQHSACQHPCRVLLDARDSRAVDSLQRCSPETSECPSHKN

SEQ ID NO: 905610 - protein, 926 aa, Homo sapiens
AGCTPEKVSAKLRAAAEAAAEERRTRGAGSRGICAWASERSARPEPLKQEEGRREWGSSIGTPSPCGSAQAAAAAAEEEATEKMPALRPALLWALLALWLCCAAPAHALQCRDGYEPCVNEGMCVTYHNGTGYCKCPEGFLGEYCQHRDPCEKNRCQNGGTCVAQAMLGKATCRCASGFTGEDCQYSTSHPCFVSRPCLNGGTCHMLSRDTYECTCQVGFTGKECQWTDACLSHPCANGSTCTTVANQFSCKCLTGFTGQKCETDVNECDIPGHCQHGGTCLNLPGSYQCQCPQGFTGQYCDSLYVPCAPSPCVNGGTCRQTGDFTFECNCLPGFEGSTCERNIDDCPNHRCQNGGVCVDGVNTYNCRCPPQWTGQFCTEDVDECLLQPNACQNGGTCANRNGGYGCVCVNGWSGDDCSENIDDCAFASCTPGSTCIDRVASFSCMCPEGKAGLLCHLDDACISNPCHKGALCDTNPLNGQYICTCPQGYKGADCTEDVDECAMANSNPCEHAGKCVNTDGAFHCECLKGYAGPRCEMDINECHSDPCQNDATCLDKIGGFTCLCMPGFKGVHCELEINECQSNPCVNNGQCVDKVNRFQCLCPPGFTGPVCQIDIDDCSSTPCLNGAKCIDHPNGYECQCATGFTGVLCEENIDNCDPDPCHHGQCQDGIDSYTCICNPGYMGAICSDQIDECYSSPCLNDGRCIDLVNGYQCNCQPGTSGVNCEINFDDCASNPCIHGICMDGINRYSCVCSPGFTGQRCNIDIDECASNPCRKGATCINGVNGFRCICPEGPHHPSCYSQVNECLSNPCIHGNCTGGLSGYKCLCDAGWVGINCEVDKNECLSNPCQNGGTCDNLVNGYRCTCKKGFKGYNCQVNIDECASNPCLNQGTCFDDISGYTCHCVLPYTVPLHLTQRCHPFDGCYN

SEQ ID NO: 905611 - protein, 35 aa, Homo sapiens
MNHGLCHNTQGSYMCECPPGFSGMDCEEDIDDCLA

SEQ ID NO: 905612 - protein, 1267 aa, Homo sapiens
SRGWTELAGGALPASAAASFQDPDGGFALPPPPRGSRGAGSPARGARGRGHGTAPDPVTAGSQAARALSASSPGGLALLLAGPGLLLRLLALLLAVAAARIMSGRRCAGGGAACASAAAEAVEPAARELFEACRNGDVERVKRLVTPEKVNSRDTAGRKSTPLHFAAGFGRKDVVEYLLQNGANVQARDDGGLIPLHNACSFGHAEVVNLLLRHGADPNARDNWNYTPLHEAAIKGKIDVCIVLLQHGAEPTIRNTDGRTALDLADPSAKAVLTGEYKKDELLESARSGNEEKMMALLTPLNVNCHASDGRKSTPLHLAAGYNRVKIVQLLLQHGADVHAKDKGDLVPLHNACSYGHYEVTELLVKHGACVNAMDLWQFTPLHEAASKNRVEVCSLLLSYGADPTLLNCHNKSAIDLAPTPQLKERLAYEFKGHSLLQAAREADVTRIKKHLSLEMVNFKHPQTHETALHCAAASPYPKRKQICELLLRKGANINEKTKEFLTPLHVASEKAHNDVVEVVVKHEAKVNALDNLGQTSLHRAAYCGHLQTCRLLLSYGCDPNIISLQGFTALQMGNENVQQLLQEGISLGNSEADRQLLEAAKAGDVETVKKLCTVQSVNCRDIEGRQSTPLHFAAGYNRVSVVEYLLQHGADVHAKDKGGLVPLHNACSYGHYEVAELLVKHGAVVNVADLWKFTPLHEAAAKGKYEICKLLLQHGADPTKKNRDGNTPLDLVKDGDTDIQDLLRGDAALLDAAKKGCLARVKKLSSPDNVNCRDTQGRHSTPLHLAAGYNNLEVAEYLLQHGADVNAQDKGGLIPLHNAASYGHVDVAALLIKYNACVNATDKWAFTPLHEAAQKGRTQLCALLLAHGADPTLKNQEGQTPLDLVSADDVSALLTAAMPPSALPSCYKPQVLNGVRSPGATADALSSGPSSPSSLSAASSLDNLSGSFSELSSVVSSSGTEGASSLEKKEVPGVDFSITQFVRNLGLEHLMDIFEREQITLDVLVEMGHKELKEIGINAYGHRHKLIKGVERLISGQQGLNPYLTLNTSGSGTILIDLSPDDKEFQSVEEEMQSTVREHRDGGHAGGIFNRYNILKIQKVCNKKLWERYTHRRKEVSEENHNHANERMLFHGSPFVNAIIHKGFDERHAYIGGMFGAGIYFAENSSKSNQYVYGIGGGTGCPVHKDRSCYICHRQLLFCRVTLGKSFLQFSAMKMAHSPPGHHSVTGRPSVNGLALAEYVIYRGEQAYPEYLITYQIMRPEGMVDG

SEQ ID NO: 905613 - protein, 1267 aa, Homo sapiens; identical to SEQ ID NO: 905612

SEQ ID NO: 905614 - protein, 369 aa, Homo sapiens [sequence omitted]

SEQ ID NO: 905615 - protein, 693 aa, Homo sapiens
VLEDPSSQQEGISLGNSEADRQLLEAAKAGDVETVKKLCTVQSVNCRDIEGRQSTPLHFAAGYNRVSVVEYLLQHGADVHAKDKGGLVPLHNACSYGHYEVAELLVKHGAVVNVADLWKFTPLHEAAAKGKYEICKLLLQHGADPTKKNRDGNTPLDLVKDGDTDIQDLLRGDAALLDAAKKGCLARVKKLSSPDNVNCRDTQGRHSTPLHLAAGYNNLEVAEYLLQHGADVNAQDKGGLIPLHNAASYGHVDVAALLIKYNACVNATDKWAFTPLHEAAQKGRTQLCALLLAHGADPTLKNQEGQTPLDLVSADDVSALLTAAMPPSALPSCYKPQVLNGVRSPGATADALSSGPSSPSSLSAASSLDNLSGSFSELSSVVSSSGTEGASSLEKKEVPGVDFSITQFVRNLGLEHLMDIFEREQITLDVLVEMGHKELKEIGINAYGHRHKLIKGVERLISGQQGLNPYLTLNTSGSGTILIDLSPDDKEFQSVEEEMQSTVREHRDGGHAGGIFNRYNILKIQKVCNKKLWERYTHRRKEVSEENHNHANERMLFHGSPFVNAIIHKGFDERHAYIGGMFGAGIYFAENSSKSNQYVYGIGGGTGCPVHKDRSCYICHRQLLFCRVTLGKSFLQFSAMKMAHSPPGHHSVTGRPSVNGLALAEYVIYRGEQAYPEYLITYQIMRPEGMVDG

SEQ ID NO: 905616 - protein, 354 aa, Homo sapiens
MPPSALPSCYKPQVLNGVRSPGATADALSSGPSSPSSLSAASSLDNLSGSFSELSSVVSSSGTEGASSLEKKEGLEHLMDIFEREQITLDVLVEMGHKELKEIGINAYGHRHKLIKGVERLISGQQGLNPYLTLNTSGSGTILIDLSPDDKEFQSVEEEMQSTVREHRDGGHAGGIFNRYNILKIQKVCNKKLWERYTHRRKEVSEENHNHANERMLFHGSPFVNAIIHKGFDERHAYIGGMFGAGIYFAENSSKSNQYVYGIGGGTGCPVHKDRSCYICHRQLLFCRVTLGKSFLQFSAMKMAHSPPGHHSVTGRPSVNGLALAEYVIYRGEQAYPEYLITYQIMRPEGMVDG

SEQ ID NO: 905617 - protein, 789 aa, Homo sapiens
SRGWTELAGGALPASAAASFQDPDGGFALPPPPRGSRGAGSPARGARGRGHGTAPDPVTAGSQAARALSASSPGGLALLLAGPGLLLRLLALLLAVAAARIMSGRRCAGGGAACASAAAEAVEPAARELFEACRNGDVERVKRLVTPEKVNSRDTAGRKSTPLHFAAGFGRKDVVEYLLQNGANVQARDDGGLIPLHNACSFGHAEVVNLLLRHGADPNARDNWNYTPLHEAAIKGKIDVCIVLLQHGAEPTIRNTDGRTALDLADPSAKAVLTGEYKKDELLESARSGNEEKMMALLTPLNVNCHASDGRKSTPLHLAAGYNRVKIVQLLLQHGADVHAKDKGDLVPLHNACSYGHYEVTELLVKHGACVNAMDLWQFTPLHEAASKNRVEVCSLLLSYGADPTLLNCHNKSAIDLAPTPQLKERLAYEFKGHSLLQAAREADVTRIKKHLSLEMVNFKHPQTHETALHCAAASPYPKRKQICELLLRKGANINEKTKEFLTPLHVASEKAHNDVVEVVVKHEAKVNALDNLGQTSLHRAAYCGHLQTCRLLLSYGCDPNIISLQGFTALQMGNENVQQLLQEGISLGNSEADRQLLEAAKAGDVETVKKLCTVQSVNCRDIEGRQSTPLHFAAGYNRVSVVEYLLQHGADVHAKDKGGLVPLHNACSYGHYEVAELLVKHGAVVNVADLWKFTPLHEAAAKGKYEICKLLLQHGADPTKKNRDGNTPLDLVKDGDTDIQDLLRGDAALLDAAKKGCLARVKKLSSPDNVNCRDTQGRHSTPLHLAGK

SEQ ID NO: 905618 - protein, 293 aa, Homo sapiens
SRGWTELAGGALPASAAASFQDPDGGFALPPPPRGSRGAGSPARGARGRGHGTAPDPVTAGSQAARALSASSPGGLALLLAGPGLLLRLLALLLAVAAARIMSGRRCAGGGAACASAAAEAVEPAARELFEACRNGDVERVKRLVTPEKVNSRDTAGRKSTPLHFAAGFGRKDVVEYLLQNGANVQARDDGGLIPLHNACSFGHAEVVNLLLRHGADPNARDNWNYTPLHEAAIKGKIDVCIVLLQHGAEPTIRNTDGRTALDLADPSAKAVLTGKSVYSGYSRKPVKNNLAR

SEQ ID NO: 905619 - protein, 1267 aa, Homo sapiens; identical to SEQ ID NO: 905612

SEQ ID NO: 905620 - protein, 1267 aa, Homo sapiens; identical to SEQ ID NO: 905612

SEQ ID NO: 905621 - protein, 369 aa, Homo sapiens [sequence omitted]

SEQ ID NO: 905622 - protein, 1249 aa, Homo sapiens
SRGWTELAGGALPASAAASFQDPDGGFALPPPPRGSRGAGSPARGARGRGHGTAPDPVTAGSQAARALSASSPGGLALLLAGPGLLLRLLALLLAVAAARIMSGRRCAGGGAACASAAAEAVEPAARELFEACRNGDVERVKRLVTPEKVNSRDTAGRKSTPLHFAAGFGRKDVVEYLLQNGANVQARDDGGLIPLHNACSFGHAEVVNLLLRHGADPNARDNWNYTPLHEAAIKGKIDVCIVLLQHGAEPTIRNTDGRTALDLADPSAKAVLTGEYKKDELLESARSGNEEKMMALLTPLNVNCHASDGRKSTPLHLAAGYNRVKIVQLLLQHGADVHAKDKGDLVPLHNACSYGHYEVTELLVKHGACVNAMDLWQFTPLHEAASKNRVEVCSLLLSYGADPTLLNCHNKSAIDLAPTPQLKERLAYEFKGHSLLQAAREADVTRIKKHLSLEMVNFKHPQTHETALHCAAASPYPKRKQICELLLRKGANINEKTKEFLTPLHVASEKAHNDVVEVVVKHEAKVNALDNLGQTSLHRAAYCGHLQTCRLLLSYGCDPNIISLQGFTALQMGNENVQQLLQEGISLGNSEADRQLLEAAKAGDVETVKKLCTVQSVNCRDIEGRQSTPLHFAAGYNRVSVVEYLLQHGADVHAKDKGGLVPLHNACSYGHYEVAELLVKHGAVVNVADLWKFTPLHEAAAKGKYEICKLLLQHGADPTKKNRDGNTPLDLVKDGDTDIQDLLRGDAALLDAAKKGCLARVKKLSSPDNVNCRDTQGRHSTPLHLAAGYNNLEVAEYLLQHGADVNAQDKGGLIPLHNAASYGHVDVAALLIKYNACVNATDKWAFTPLHEAAQKGRTQLCALLLAHGADPTLKNQEGQTPLDLVSADDVSALLTAAMPPSALPSCYKPQVLNGVRSPGATADALSSGPSSPSSLSAASSLDNLSGSFSELSSVVSSSGTEGASSLEKKEVPGVDFSITQFVRNLGLEHLMDIFEREQITLDVLVEMGHKELKEIGINAYGHRHKLIKGVERLISGQQGLNPYLTLNTSGSGTILIDLSPDDKEFQSVEEEMQSTVREHRDGGHAGGIFNRYNILKIQKVCNKKLWERYTHRRKEVSEENHNHANERMLFHGSPFVNAIIHKGFDERHAYIGGMFGAGIYFAENSSKSNQYVYGIGGGTGCPVHKDRSCYICHRQLLFCRVTLGKSFLQFSAMKMAHSPPGHHSVTGRPSVNGLALAEYVIYRGEQVM

SEQ ID NO: 905623 - protein, 789 aa, Homo sapiens
SRGWTELAGGALPASAAASFQDPDGGFALPPPPRGSRGAGSPARGARGRGHGTAPDPVTAGSQAARALSASSPGGLALLLAGPGLLLRLLALLLAVAAARIMSGRRCAGGGAACASAAAEAVEPAARELFEACRNGDVERVKRLVTPEKVNSRDTAGRKSTPLHFAAGFGRKDVVEYLLQNGANVQARDDGGLIPLHNACSFGHAEVVNLLLRHGADPNARDNWNYTPLHEAAIKGKIDVCIVLLQHGAEPTIRNTDGRTALDLADPSAKAVLTGEYKKDELLESARSGNEEKMMALLTPLNVNCHASDGRKSTPLHLAAGYNRVKIVQLLLQHGADVHAKDKGDLVPLHNACSYGHYEVTELLVKHGACVNAMDLWQFTPLHEAASKNRVEVCSLLLSYGADPTLLNCHNKSAIDLAPTPQLKERLAYEFKGHSLLQAAREADVTRIKKHLSLEMVNFKHPQTHETALHCAAASPYPKRKQICELLLRKGANINEKTKEFLTPLHVASEKAHNDVVEVVVKHEAKVNALDNLGQTSLHRAAYCGHLQTCRLLLSYGCDPNIISLQGFTALQMGNENVQQLLQEGISLGNSEADRQLLEAAKAGDVETVKKLCTVQSVNCRDIEGRQSTPLHFAAGYNRVSVVEYLLQHGADVHAKDKGGLVPLHNACSYGHYEVAELLVKHGAVVNVADLWKFTPLHEAAAKGKYEICKLLLQHGADPTKKNRDGNTPLDLVKDGDTDIQDLLRGDAALLDAAKKGFDDRHQTLGLIGKLPGFRVSMTVIKPSIKLRC

SEQ ID NO: 905624 - protein, 508 aa, Homo sapiens
MQRLLTPVKRILQLTRAVQETSLTPARLLPVAHQRFSTASAVPLAKTDTWPKDVGILALEVYFPAQYVDQTDLEKYNNVEAGKYTVGLGQTRMGFCSVQEDINSLCLTVVQRLMERIQLPWDSVGRLEVGTETIIDKSKAVKTVLMELFQDSGNTDIEGIDTTNACYGGTASLFNAANWMESSSWDGRYAMVVCGDIAVYPSGNARPTGGAGAVAMLIGPKAPLALERGLRGTHMENVYDFYKPNLASEYPIVDGKLSIQCYLRALDRCYTSYRKKIQNQWKQAGSDRPFTLDDLQYMIFHTPFCKMVQKSLARLMFNDFLSASSDTQTSLYKGLEAFGGLKLEDTYTNKDLDKALLKASQDMFDKKTKASLYLSTHNGNMYTSSLYGCLASLLSHHSAQELAGSRIGAFSYGSGLAASFFSFRVSQDAAPGSPLDKLVSSTSDLPKRLASRKCVSPEEFTEIMNQREQFYHKVNFSPPGDTNSLFPGTWYLERVDEQHRRKYARRPV

SEQ ID NO: 905625 - protein, 490 aa, Homo sapiens
MQRLLTPVKRILQLTRAVQETSLTPARLLPVAHQRFSTASAVPLAKTDTWPKDVGILALEVYFPAQYVDQTDLEKYNNVEAGKYTVGLGQTRMGFCSVQEDINSLCLTVVQRLMERIQLPWDSVGRLEVGTETIIDKSKAVKTVLMELFQDSGNTDIEGIDTTNACYGGTASLFNAANWMESSSWDGRYAMVVCGDIAVYPSGNARPTGGAGAVAMLIGPKAPLALERGLRGTHMENVYDFYKPNLASEYPIVDGKLSIQCYLRALDRCYTSYRKDLQYMIFHTPFCKMVQKSLARLMFNDFLSASSDTQTSLYKGLEAFGGLKLEDTYTNKDLDKALLKASQDMFDKKTKASLYLSTHNGNMYTSSLYGCLASLLSHHSAQELAGSRIGAFSYGSGLAASFFSFRVSQDAAPGSPLDKLVSSTSDLPKRLASRKCVSPEEFTEIMNQREQFYHKVNFSPPGDTNSLFPGTWYLERVDEQHRRKYARRPV

SEQ ID NO: 905626 - protein, 490 aa, Homo sapiens
MQRLLTPVKRILQLTRAVQETSLTPARLLPVAHQRFSTASAVPLAKTDTWPKDVGILALEVYFPAQYVDQTDLEKYNNVEAGKYTVGLGQTRMGFCSVQEDINSLCLTVVQRLMERIQLPWDSVGRLEVGTETIIDKSKAGIDTTNACYGGTASLFNAANWMESSSWDGRYAMVVCGDIAVYPSGNARPTGGAGAVAMLIGPKAPLALERGLRGTHMENVYDFYKPNLASEYPIVDGKLSIQCYLRALDRCYTSYRKKIQNQWKQAGSDRPFTLDDLQYMIFHTPFCKMVQKSLARLMFNDFLSASSDTQTSLYKGLEAFGGLKLEDTYTNKDLDKALLKASQDMFDKKTKASLYLSTHNGNMYTSSLYGCLASLLSHHSAQELAGSRIGAFSYGSGLAASFFSFRVSQDAAPGSPLDKLVSSTSDLPKRLASRKCVSPEEFTEIMNQREQFYHKVNFSPPGDTNSLFPGTWYLERVDEQHRRKYARRPV

SEQ ID NO: 905627 - protein, 508 aa, Homo sapiens; identical to SEQ ID NO: 905624

SEQ ID NO: 905628 - protein, 490 aa, Homo sapiens
MQRLLTPVKRILQLTRAVQETSLTPARLLPVAHQRFSTASAVPLAKTDTWPKDVGILALEVYFPAQYVDQTDLEKYNNVEAGKYTVGLGQTRMGFCSVQEDINSLCLTVVQRLMERIQLPWDSVGRLEVGTETIIDKSKAVKTVLMELFQDSGNTDIEGIDTTNACYGGTASLFNAANWMESSSWDGRYAMVVCGDIAVYPSGNARPTGGAGAVAMLIGPKAPLALERGLRGTHMENVYDFYKPNLASEYPIVDGKLSIQCYLRALDRCYTSYRKKIQNQWKQAGSDRPFTLDDLQYMIFHTPFCKMVQKSLARLMFNDFLSASSDTQTSLYKGLEAFGGLKLEDTYTNKDLDKALLKASQDMFDKKTKASLYLSTHNGNMYTSSLYGCLASLLSHHSAQELAGSRIGAFSYGSGLAASFFSFRVSQDAAPGSPLDKLVSSTSDLPNQREQFYHKVNFSPPGDTNSLFPGTWYLERVDEQHRRKYARRPV

SEQ ID NO: 905629 - protein, 318 aa, Homo sapiens
MVVCGDIAVYPSGNARPTGGAGAVAMLIGPKAPLALERGLRGTHMENVYDFYKPNLASEYPIVDGKLSIQCYLRALDRCYTSYRKKIQNQWKQAGSDRPFTLDDLQYMIFHTPFCKMVQKSLARLMFNDFLSASSDTQTSLYKGLEAFGGLKLEDTYTNKDLDKALLKASQDMFDKKTKASLYLSTHNGNMYTSSLYGCLASLLSHHSAQELAGSRIGAFSYGSGLAASFFSFRVSQDAAPGSPLDKLVSSTSDLPKRLASRKCVSPEEFTEIMNQREQFYHKVNFSPPGDTNSLFPGTWYLERVDEQHRRKYARRPV

SEQ ID NO: 905630 - protein, 508 aa, Homo sapiens; identical to SEQ ID NO: 905624

SEQ ID NO: 905631 - protein, 365 aa, Homo sapiens
MQRLLTPVKRILQLTRAVQETSLTPARLLPVAHQRFSTASAVPLAKTDTWPKDVGILALEVYFPAQYVDQTDLEKYNNVEAGKYTVGLGQTRMGFCSVQEDINSLCLTVVQRLMERIQLPWDSVGRLEVGTETIIDKSKAVKTVLMELFQDSGNTDIEGIDTTNACYGGTASLFNAANWMESSSWDGRYAMVVCGDIAVYPSGNARPTGGAGAVAMLIGPKAPLALERGLRGTHMENVYDFYKPNLASEYPIVDGKLSIQCYLRALDRCYTSYRKKIQNQWKQAGSDRPFTLDDLQYMIFHTPFCKMVQKSLARLMFNELPFTSPLTMGTCTPHPCTGAWPRFCPTTLPKNWLAPGLVPSLMALV

SEQ ID NO: 905632 - protein, 196 aa, Homo sapiens
MQRLLTPVKRILQLTRAVQETSLTPARLLPVAHQRFSTASAVPLAKTDTWPKDVGILALEVYFPAQYVDQTDLEKYNNVEAGKYTVGLGQTRMGFCSVQEDINSLCLTVVQRLMERIQLPWDSVGRLEVGTETIIDKSKAGIDTTNACYGGTASLFNAANWMESSSWDGMYGHEPYVRVLELEADITSFAFVPRGF

SEQ ID NO: 905633 - protein, 51 aa, Homo sapiens
MAILQQNRNNPRSFHGVVGYCLGRALHELLQGNMGDLAALQDQGAVRNYRG

SEQ ID NO: 905634 - protein, 490 aa, Homo sapiens
MQRLLTPVKRILQLTRAVQETSLTPARLLPVAHQRFSTASAVPLAPAQYVDQTDLEKYNNVEAGKYTVGLGQTRMGFCSVQEDINSLCLTVVQRLMERIQLPWDSVGRLEVGTETIIDKSKAVKTVLMELFQDSGNTDIEGIDTTNACYGGTASLFNAANWMESSSWDGRYAMVVCGDIAVYPSGNARPTGGAGAVAMLIGPKAPLALERGLRGTHMENVYDFYKPNLASEYPIVDGKLSIQCYLRALDRCYTSYRKKIQNQWKQAGSDRPFTLDDLQYMIFHTPFCKMVQKSLARLMFNDFLSASSDTQTSLYKGLEAFGGLKLEDTYTNKDLDKALLKASQDMFDKKTKASLYLSTHNGNMYTSSLYGCLASLLSHHSAQELAGSRIGAFSYGSGLAASFFSFRVSQDAAPGSPLDKLVSSTSDLPKRLASRKCVSPEEFTEIMNQREQFYHKVNFSPPGDTNSLFPGTWYLERVDEQHRRKYARRPV

SEQ ID NO: 905635 - protein, 256 aa, Homo sapiens
MQRLLTPVKRILQLTRAVQETSLTPARLLPVAHQRFSTASAVPLAKTDTWPKDVGILALEVYFPAQYVDQTDLEKYNNVEAGKYTVGLGQTRMGFCSVQEDINSLCLTVVQRLMERIQLPWDSVGRLEVGTETIIDKSKAVKTVLMELFQDSGNTDIEGIDTTNACYGGTASLFNAANWMESSSWDGRYAMVVCGDIAVYPSGNARPTGGAGAVAMLIGPKAPLALERGLRGTHMENVYDFYKPIAGLGSMLHIIP

SEQ ID NO: 905636 - protein, 453 aa, Homo sapiens
MQRLLTPVKRILQLTRAVQETSLTPARLLPVAHQRFSTASAVPLAKTDTWPKDVGILALEVYFPAQYVDQTDLEKYNNVEAGKYTVGLGQTRMGFCSVQEDINSLCLTVVQRLMERIQLPWDSVGRLEVGTETIIDKSKAVKTVLMELFQDSGNTDIEGIDTTNACYGGTASLFNAANWMESSSWDGRYAMVVCGDIAVYPSGNARPTGGAGAVAMLIGPKAPLALERAGSDRPFTLDDLQYMIFHTPFCKMVQKSLARLMFNDFLSASSDTQTSLYKGLEAFGGLKLEDTYTNKDLDKALLKASQDMFDKKTKASLYLSTHNGNMYTSSLYGCLASLLSHHSAQELAGSRIGAFSYGSGLAASFFSFRVSQDAAPGSPLDKLVSSTSDLPKRLASRKCVSPEEFTEIMNQREQFYHKVNFSPPGDTNSLFPGTWYLERVDEQHRRKYARRPV

SEQ ID NO: 905637 - protein, 274 aa, Homo sapiens [sequence omitted]

SEQ ID NO: 905638 - protein, 448 aa, Homo sapiens
MQRLLTPVKRILQLTRAVQETSLTPARLLPVAHQRFSTASAVPLAKTDTWPKDVGILALEVYFPAQYVDQTDLEKYNNVEAGKYTVGLGQTRMGFCSVQEDINSLCLTVVQRLMERIQLPWDSVGRLEVGTETIIDKSKAVKTVLMELFQDSGNTDIEGIDTTNACYGGTASLFNAANWMESSSWDGRYAMVVCGDIAVYPSGNARPTGGAGAVAMLIGPKAPLALERGLRGTHMENVYDFYKPNLASEYPIVDGKLSIQCYLRALDRCYTSYRKKIQNQWKQAGSDRPFTLDDLQYMIFHTPFCKMVQKSLARLMFNDFLSASSDTQTSLYKGLEAFGGLKLEDTYTNKDLDKALLKASQDMFDKKTKASLYLSTHNGNMYTSSLYGCLASLLSHHSAQELAGSRIGAFSYGSGLAASFFSFRAKVCPASRLKVFCRSMESFLGNVC

SEQ ID NO: 905639 - protein, 297 aa, Homo sapiens
MQRLLTPVKRILQLTRAVQETSLTPARLLPVAHQRFSTASAVPLAKTDTWPKDVGILALEVYFPAQYVDQTDLEKYNNVEAGKYTVGLGQTRMGFCSVQEDINSLCLTVVQRLMERIQLPWDSVGRLEVGTETIIDKSKAVKTVLMELFQDSGNTDIEGIDTTNACYGGTASLFNAANWMESSSWDGRYAMVVCGDIAVYPSGNARPTGGAGAVAMLIGPKAPLALERGLRGTHMENVYDFYKPNLASEYPIVDGKLSIQCYLRALDRCYTSYRKKIQNQWKQGMRFRGQKVGALFT

SEQ ID NO: 905640 - protein, 214 aa, Homo sapiens
MQRLLTPVKRILQLTRAVQETSLTPARLLPVAHQRFSTASAVPLAKTDTWPKDVGILALEVYFPAQYVDQTDLEKYNNVEAGKYTVGLGQTRMGFCSVQEDINSLCLTVVQRLMERIQLPWDSVGRLEVGTETIIDKSKAVKTVLMELFQDSGNTDIEGIDTTNACYGGTASLFNAANWMESSSWDGMYGHEPYVRVLELEADITSFAFVPRGF

SEQ ID NO: 905641 - protein, 713 aa, Homo sapiens
MQPRTPLVLCVLLSQVLLLTSAEDLDCTPGFQQKVFHINQPAEFIEDQSILNLTFSDCKGNDKLRYEVSSPYFKVNSDGGLVALRNITAVGKTLFVHARTPHAEDMAELVIVGGKDIQGSLQDIFKFARTSPVPRQKRSIVVSPILIPENQRQPFPRDVGKVVDSDRPERSKFRLTGKGVDQEPKGIFRINENTGSVSVTRTLDREVIAVYQLFVETTDVNGKTLEGPVPLEVIVIDQNDNRPIFREGPYIGHVMEGSPTGTTVMRMTAFDADDPATDNALLRYNIRQQTPDKPSPNMFYIDPEKGDIVTVVSPALLDRETLENPKYELIIEAQDMAGLDVGLTGTATATIMIDDKNDHSPKFTKKEFQATVEEGAVGVIVNLTVEDKDDPTTGAWRAAYTIINGNPGQSFEIHTNPQTNEGMLSVVKPLDYEISAFHTLLIKVENEDPLVPDVSYGPSSTATVHITVLDVNEGPVFYPDPMMVTRQEDLSVGSVLLTVNATDPDSLQHQTIRYSVYKDPAGWLNINPINGTVDTTAVLDRESPFVDNSVYTALFLAIDSGNPPATGTGTLLITLEDVNDNAPFIYPTVAEVCDDAKNLSVVILGASDKDLHPNTDPFKFEIHKQAVPDKVWKISKINNTHALVSLLQNLNKANYNLPIMVTDSGKPPMTNITDLRVQVCSCRNSKVDCNAAGALRFSLPSVLLLSLFSLACL

SEQ ID NO: 905642 - protein, 713 aa, Homo sapiens; identical to SEQ ID NO: 905641

SEQ ID NO: 905643 - protein, 713 aa, Homo sapiens; identical to SEQ ID NO: 905641

SEQ ID NO: 905644 - protein, 685 aa, Homo sapiens
AELPTRASDQHRITSRRVGVIPDSVTFSDCKGNDKLRYEVSSPYFKVNSDGGLVALRNITAVGKTLFVHARTPHAEDMAELVIVGGKDIQGSLQDIFKFARTSPVPRQKRSIVVSPILIPENQRQPFPRDVGKVVDSDRPERSKFRLTGKGVDQEPKGIFRINENTGSVSVTRTLDREVIAVYQLFVETTDVNGKTLEGPVPLEVIVIDQNDNRPIFREGPYIGHVMEGSPTGTTVMRMTAFDADDPATDNALLRYNIRQQTPDKPSPNMFYIDPEKGDIVTVVSPALLDRETLENPKYELIIEAQDMAGLDVGLTGTATATIMIDDKNDHSPKFTKKEFQATVEEGAVGVIVNLTVEDKDDPTTGAWRAAYTIINGNPGQSFEIHTNPQTNEGMLSVVKPLDYEISAFHTLLIKVENEDPLVPDVSYGPSSTATVHITVLDVNEGPVFYPDPMMVTRQEDLSVGSVLLTVNATDPDSLQHQTIRYSVYKDPAGWLNINPINGTVDTTAVLDRESPFVDNSVYTALFLAIDSGNPPATGTGTLLITLEDVNDNAPFIYPTVAEVCDDAKNLSVVILGASDKDLHPNTDPFKFEIHKQAVPDKVWKISKINNTHALVSLLQNLNKANYNLPIMVTDSGKPPMTNITDLRVQVCSCRNSKVDCNAAGALRFSLPSVLLLSLFSLACL

SEQ ID NO: 905645 - protein, 713 aa, Homo sapiens; identical to SEQ ID NO: 905641

SEQ ID NO: 905646 - protein, 713 aa, Homo sapiens; identical to SEQ ID NO: 905641

SEQ ID NO: 905647 - protein, 713 aa, Homo sapiens; identical to SEQ ID NO: 905641

SEQ ID NO: 905648 - protein, 695 aa, Homo sapiens
MQPRTPLVLCVLLSQVLLLTSAEDLDCTPGFQQKVFHINQPAEFIEDQSILNLTFSDCKGNDKLRYEVSSPYFKVNSDGGLVALRNITAVGKTLFVHARTPHAEDMAELVIVGGKDIQGSLQDIFKFARTSPVPRQKRSIVVSPILIPENQRQPFPRDVGKVVDSDRPERSKFRLTGKGVDQEPKGIFRINENTGSVSVTRTLDREVIAVYQLFVETTDVNDNRPIFREGPYIGHVMEGSPTGTTVMRMTAFDADDPATDNALLRYNIRQQTPDKPSPNMFYIDPEKGDIVTVVSPALLDRETLENPKYELIIEAQDMAGLDVGLTGTATATIMIDDKNDHSPKFTKKEFQATVEEGAVGVIVNLTVEDKDDPTTGAWRAAYTIINGNPGQSFEIHTNPQTNEGMLSVVKPLDYEISAFHTLLIKVENEDPLVPDVSYGPSSTATVHITVLDVNEGPVFYPDPMMVTRQEDLSVGSVLLTVNATDPDSLQHQTIRYSVYKDPAGWLNINPINGTVDTTAVLDRESPFVDNSVYTALFLAIDSGNPPATGTGTLLITLEDVNDNAPFIYPTVAEVCDDAKNLSVVILGASDKDLHPNTDPFKFEIHKQAVPDKVWKISKINNTHALVSLLQNLNKANYNLPIMVTDSGKPPMTNITDLRVQVCSCRNSKVDCNAAGALRFSLPSVLLLSLFSLACL

SEQ ID NO: 905649 - protein, 191 aa, Homo sapiens
MQPRTPLVLCVLLSQVLLLTSAEDLDCTPGFQQKVFHINQPAEFIEDQSILNLTFSDCKGNDKLRYEVSSPYFKVNSDGGLVALRNITAVGKTLFVHARTPHAEDMAELVIVGGKDIQGSLQDIFKFARTSPVPRQKRSIVVSPILIPENQRQPFPRDVGKVRTHNPINSELLLNEGITADLNPCITILAI

SEQ ID NO: 905650 - protein, 116 aa, Homo sapiens
MAGVLKKTTGLVGLAVCNTPHERLRILYTKILDVLEEIPKNAAYRKYTEQITNEKLAMVKAEPDVKKLEDQLQGGQLEEVILQAEHELNLARKMREWKLWEPLVEEPPADQWKWPI

SEQ ID NO: 905651 - protein, 116 aa, Homo sapiens; identical to SEQ ID NO: 905650

SEQ ID NO: 905652 - protein, 240 aa, Homo sapiens [sequence omitted]

SEQ ID NO: 905653 - protein, 116 aa, Homo sapiens; identical to SEQ ID NO: 905650

SEQ ID NO: 905654 - protein, 116 aa, Homo sapiens; identical to SEQ ID NO: 905650

SEQ ID NO: 905655 - protein, 116 aa, Homo sapiens; identical to SEQ ID NO: 905650

SEQ ID NO: 905656 - protein, 137 aa, Homo sapiens
GAKLFPGGQSGDLGGRLSRSENCSQRVVRHRVVGAVMAGVLKKRLRILYTKILDVLEEIPKNAAYRKYTEQITNEKLAMVKAEPDVKKLEDQLQGGQLEEVILQAEHELNLARKMREWKLWEPLVEEPPADQWKWPI

SEQ ID NO: 905657 - protein, 89 aa, Homo sapiens
LVHPPRGLDPKLVSGPKCAEVSDLVPMRAGYGEAEPDVKKLEDQLQGGQLEEVILQAEHELNLARKMREWKLWEPLVEEPPADQWKWPI

SEQ ID NO: 905658 - protein, 116 aa, Homo sapiens; identical to SEQ ID NO: 905650

SEQ ID NO: 905659 - protein, 116 aa, Homo sapiens; identical to SEQ ID NO: 905650

SEQ ID NO: 905660 - protein, 116 aa, Homo sapiens; identical to SEQ ID NO: 905650

SEQ ID NO: 905661 - protein, 116 aa, Homo sapiens; identical to SEQ ID NO: 905650

SEQ ID NO: 905662 - protein, 116 aa, Homo sapiens; identical to SEQ ID NO: 905650

SEQ ID NO: 905663 - protein, 113 aa, Homo sapiens
MPYRTTGLVGLAVCNTPHERLRILYTKILDVLEEIPKNAAYRKYTEQITNEKLAMVKAEPDVKKLEDQLQGGQLEEVILQAEHELNLARKMREWKLWEPLVEEPPADQWKWPI

SEQ ID NO: 905664 - protein, 182 aa, Homo sapiens
MGFDLVVQAGFKLLSSSNLPTLQSVGITDILPLQYRWRFSSINKRCSLFTNGNGATVHNFCPRIHGWCRWKYWHSSRGVKGLTQAVQLRLRILYTKILDVLEEIPKNAAYRKYTEQITNEKLAMVKAEPDVKKLEDQLQGGQLEEVILQAEHELNLARKMREWKLWEPLVEEPPADQWKWPI

SEQ ID NO: 905665 - protein, 137 aa, Homo sapiens
GAKLFPGGQSGDLGGRLSRSENCSQRVVRHRVVGAVMAGVLKKTTGLVGLAVCNTPHERLRILYTKILDVLEEIPKNAAYRKYTEQITNEKLAMVKAEPDVKKLEDQLQGGQLEEVILQGKVLNYYSLNKFIDYCLK

SEQ ID NO: 905666 - protein, 587 aa, Homo sapiens
MVTAAMLLQCCPVLARGPTSLLGKVVKTHQFLFGIGRCPILATQGPNCSQIHLKATKAGGDSPSWAKGHCPFMLSELQDGKSKIVQKAAPEVQEDVKAFKTDLPSSLVSVSLRKPFSGPQEQEQISGKVTHLIQNNMPGNYVFSYDQFFRDKIMEKKQDHTYRVFKTVNRWADAYPFAQHFSEASVASKDVSVWCSNDYLGMSRHPQVLQATQETLQRHGAGAGGTRNISGTSKFHVELEQELAELHQKDSALLFSSCFVANDSTLFTLAKILPGCEIYSDAGNHASMIQGIRNSGAAKFVFRHNDPDHLKKLLEKSNPKIPKIVAFETVHSMDGAICPLEELCDVSHQYGALTFVDEVHAVGLYGSRGAGIGERDGIMHKIDIISGTLGKAFGCVGGYIASTRDLVDMVRSYAAGFIFTTSLPPMVLSGALESVRLLKGEEGQALRRAHQRNVKHMRQLLMDRGLPVIPCPSHIIPIRVGNAALNSKLCDLLLSKHGIYVQAINYPTVPRGEELLRLAPSPHHSPQMMEDFVEKLLLAWTAVGLPLQDVSVAACNFCRRPVHFELMSEWERSYFGNMGPQYVTTYA

SEQ ID NO: 905667 - protein, 587 aa, Homo sapiens; identical to SEQ ID NO: 905666

SEQ ID NO: 905668 - protein, 512 aa, Homo sapiens
MVTAAMLLQCCPVLARGPTSLLGKVVKTHQFLFGIGRCPILATQGPNCSQIHLKATKAGGDSPSWAKGHCPFMLSELQDGKSKIVQKAAPEVQEDVKAFKTDLPSSLVSVSLRKPFSGPQEQEQISGKVTHLIQNNMPGNYVFSYDQFFRDKIMEKKQDHTYRVFKTVNRWADAYPFAQHFSEASVASKDVSVWCSNDYLGMSRHPQVLQATQETLQRHGAGAGGTRNISGTSKFHVELEQELAELHQKDSALLFSSCFVANDSTLFTLAKILPGCEIYSDAGNHASMIQGIRNSGAAKFVFRHNDPDHLKKLLEKSNPKIPKIVAFETVHSMDGAICPLEELCDVSHQYGALTFVDEVHAVGLYGSRGAGIGERDGIMHKIDIISGTLGKAFGCVGGYIASTRDLVDMVRSYAAGFIFTTSLPPMVLSGALESVRLLKGEEGQALRRAHQRNVKHMRQLLMDRGLPVIPCPSHIIPIRRSCCWLGLRWGCPSRMCLWLPAISVAVLYTLSS

SEQ ID NO: 905669 - protein, 527 aa, Homo sapiens
MVTAAMLLQCCPVLARGPTSLLGKVVKTHQFLFGIGRCPILATQGPNCSQIHLKATKAGGDSPSWAKGHCPFMLSELQDGKSKIVQKAAPEVQEDVKAFKTDLPSSLVSVSLRKPFSGPQEQEQISGKVTHLIQNNMPGNYVFSYDQFFRDKIMEKKQDHTYRVFKTVNRWADAYPFAQHFSEASVASKDVSVWCSNDYLGMSRHPQVLQATQETLQRHGAGAGGTRNISGTSKFHVELEQELAELHQKDSALLFSSCFVANDSTLFTLAKILPGCEIYSDAGNHASMIQGIRNSGAAKFVFRHNDPDHLKKLLEKSNPKIPKIVAFETVHSMDGAICPLEELCDVSHQYGALTFVDEVHAVGLYGSRGAGIGERDGIMHKIDIISGTLGKAFGCVGGYIASTRDLVDMVRSYAAGFIFTTSLPPMVLSGALESVRLLKGEEGQALRRAHQRNVKHMRQLLMDRGLPVIPCPSHIIPIRVRAPPCPLPSPPIYSGSLTLPTNLHLLLSSIICFPANHSLYCQLCFPF

SEQ ID NO: 905670 - protein, 587 aa, Homo sapiens; identical to SEQ ID NO: 905666

SEQ ID NO: 905671 - protein, 550 aa, Homo sapiens
MVTAAMLLQCCPVLARGPTSLLGKVVKTHQFLFGIGRCPILATQGPNCSQIHLKATKAGGDSPSWAKGHCPFMLSELQDGKSKIVQKAAPEVQEDVKAFKTGNYVFSYDQFFRDKIMEKKQDHTYRVFKTVNRWADAYPFAQHFSEASVASKDVSVWCSNDYLGMSRHPQVLQATQETLQRHGAGAGGTRNISGTSKFHVELEQELAELHQKDSALLFSSCFVANDSTLFTLAKILPGCEIYSDAGNHASMIQGIRNSGAAKFVFRHNDPDHLKKLLEKSNPKIPKIVAFETVHSMDGAICPLEELCDVSHQYGALTFVDEVHAVGLYGSRGAGIGERDGIMHKIDIISGTLGKAFGCVGGYIASTRDLVDMVRSYAAGFIFTTSLPPMVLSGALESVRLLKGEEGQALRRAHQRNVKHMRQLLMDRGLPVIPCPSHIIPIRVGNAALNSKLCDLLLSKHGIYVQAINYPTVPRGEELLRLAPSPHHSPQMMEDFVEKLLLAWTAVGLPLQDVSVAACNFCRRPVHFELMSEWERSYFGNMGPQYVTTYA

SEQ ID NO: 905672 - protein, 192 aa, Homo sapiens
MASKGPSASASPENSSAGGPSGSSNGAGESGGQDSTFECNICLDTAKDAVISLCGHLFCWPCLHQWLETRPNRQVCPVCKAGISRDKVIPLYGRGSTGQQDPREKTPPRPQGQRPEPENRGGFQGFGFGDGGFQMSFGIGAFPFGIFATAFNINDGRPPPAVPGTPQYVDEQFLSRLFLFVALVIMFWLLIA

SEQ ID NO: 905673 - protein, 192 aa, Homo sapiens; identical to SEQ ID NO: 905672

SEQ ID NO: 905674 - protein, 137 aa, Homo sapiens
MASKGPSASASPENSSAGGPSGSSNGAGESGGQDSTFECNICLDTAKDAVISLCGHLFCWPCLPHQGFQGFGFGDGGFQMSFGIGAFPFGIFATAFNINDGRPPPAVPGTPQYVDEQFLSRLFLFVALVIMFWLLIA

SEQ ID NO: 905675 - protein, 192 aa, Homo sapiens; identical to SEQ ID NO: 905672

SEQ ID NO: 905676 - protein, 192 aa, Homo sapiens; identical to SEQ ID NO: 905672

SEQ ID NO: 905677 - protein, 192 aa, Homo sapiens; identical to SEQ ID NO: 905672

SEQ ID NO: 905678 - protein, 143 aa, Homo sapiens
MASKGPSASASPENSSAGGPSGSSNGAGESGGQDSTFECNICLDTAKDAVISLCGHLFCWPCLHQWLETRPNRQVCPVCKAGISRDKVIPLYGRGSTGQQDPREKTPPRPQGQRPEPENRGGFQGFGFGDGGFQMSFVCFLCS

SEQ ID NO: 905679 - protein, 74 aa, Homo sapiens
SSACVATSSGQYPYFHPREHIAKFGKPVALGGLEQNASCSLWEYTQAQGTRDLSSHPSSATNELDDLGQILSPL

SEQ ID NO: 905680 - protein, 157 aa, Homo sapiens
MASKGPSASASPENSSAGGPSGSSNGAGESGGQDSTFECNICLDTAKDAVISLCGHLFCWPCLHQWLETRPNRQVCPVCKAGISRDKVIPLYGRGSTGQQDPREKTPPRPQGQRPEPENRGVRNILGEASTNELMALEVSFLALQFFSLIIKVKENL

SEQ ID NO: 905681 - protein, 192 aa, Homo sapiens; identical to SEQ ID NO: 905672

SEQ ID NO: 905682 - protein, 192 aa, Homo sapiens; identical to SEQ ID NO: 905672

SEQ ID NO: 905683 - protein, 192 aa, Homo sapiens; identical to SEQ ID NO: 905672

SEQ ID NO: 905684 - protein, 192 aa, Homo sapiens; identical to SEQ ID NO: 905672

SEQ ID NO: 905685 - protein, 566 aa, Homo sapiens
PFPPLPSTRPSLLPPPSSLLLPLLKSAPRGGRPGYFLQRLTSAVSLQLRAPGAARPASGLPDRLWPAPSPSPGAHRAAAGAEQPPSRPSAGPARSGRMNDFGIKNMDQVAPVANSYRGTLKRQPAFDTFDGSLFAVFPSLNEEQTLQEVPTGLDSISHDSANCELPLLTPCSKAVMSQALKATFSGFKKEQRRLGIPKNPWLWSEQQVCQWLLWATNEFSLVNVNLQRFGMNGQMLCNLGKERFLELAPDFVGDILWEHLEQMIKENQEKTEDQYEENSHLTSVPHWINSNTLGFGTEQAPYGMQTQNYPKGGLLDSMCPASTPSVLSSEQEFQMFPKSRLSSVSVTYCSVSQDFPGSNLNLLTNNSGTPKDHDSPENGADSFESSDSLLQSWNSQSSLLDVQRVPSFESFEDDCSQSLCLNKPTMSFKDYIQERSDPVEQGKPVIPAAVLAGFTGSGPIQLWQFLLELLSDKSCQSFISWTGDGWEFKLADPDEVARRWGKRKNKPKMNYEKLSRGLRYYYDKNIIHKTSGKRYVYRFVCDLQNLLGFTPEELHAILGVQPDTED

SEQ ID NO: 905686 - protein, 566 aa, Homo sapiens; identical to SEQ ID NO: 905685

SEQ ID NO: 905687 - protein, 566 aa, Homo sapiens; identical to SEQ ID NO: 905685

SEQ ID NO: 905688 - protein, 566 aa, Homo sapiens; identical to SEQ ID NO: 905685

SEQ ID NO: 905689 - protein, 566 aa, Homo sapiens; identical to SEQ ID NO: 905685

SEQ ID NO: 905690 - protein, 548 aa, Homo sapiens
PFPPLPSTRPSLLPPPSSLLLPLLKSAPRGGRPGYFLQRLTSAVSLQLRAPGAARPASGLPDRLWPAPSPSPGAHRAAAGAEQPPSRPSAGPARSGRMNDFGIKNMDQVAPVANSYRGTLKRQPAFDTFDGSLFAVFPSLNEEQTLQEVPTGLDSISHDSANCELPLLTPCSKAVMSQALKATFSGFKQVCQWLLWATNEFSLVNVNLQRFGMNGQMLCNLGKERFLELAPDFVGDILWEHLEQMIKENQEKTEDQYEENSHLTSVPHWINSNTLGFGTEQAPYGMQTQNYPKGGLLDSMCPASTPSVLSSEQEFQMFPKSRLSSVSVTYCSVSQDFPGSNLNLLTNNSGTPKDHDSPENGADSFESSDSLLQSWNSQSSLLDVQRVPSFESFEDDCSQSLCLNKPTMSFKDYIQERSDPVEQGKPVIPAAVLAGFTGSGPIQLWQFLLELLSDKSCQSFISWTGDGWEFKLADPDEVARRWGKRKNKPKMNYEKLSRGLRYYYDKNIIHKTSGKRYVYRFVCDLQNLLGFTPEELHAILGVQPDTED

SEQ ID NO: 905691 - protein, 346 aa, Homo sapiens
MRLNVKHSVHLIILKLSSHRNSESQFVLCSFHLHLPSYVSCVCFSENQEKTEDQYEENSHLTSVPHWINSNTLGFGTEQAPYGMQTQNYPKGGLLDSMCPASTPSVLSSEQEFQMFPKSRLSSVSVTYCSVSQDFPGSNLNLLTNNSGTPKDHDSPENGADSFESSDSLLQSWNSQSSLLDVQRVPSFESFEDDCSQSLCLNKPTMSFKDYIQERSDPVEQGKPVIPAAVLAGFTGSGPIQLWQFLLELLSDKSCQSFISWTGDGWEFKLADPDEVARRWGKRKNKPKMNYEKLSRGLRYYYDKNIIHKTSGKRYVYRFVCDLQNLLGFTPEELHAILGVQPDTED

SEQ ID NO: 905692 - protein, 263 aa, Homo sapiens [sequence omitted]

SEQ ID NO: 905693 - protein, 263 aa, Homo sapiens [sequence omitted]

SEQ ID NO: 905694 - protein, 566 aa, Homo sapiens; identical to SEQ ID NO: 905685

SEQ ID NO: 905695 - protein, 297 aa, Homo sapiens
PFPPLPSTRPSLLPPPSSLLLPLLKSAPRGGRPGYFLQRLTSAVSLQLRAPGAARPASGLPDRLWPAPSPSPGAHRAAAGAEQPPSRPSAGPARSGRMNDFGIKNMDQVAPVANSYRGTLKRQPAFDTFDGSLFAVFPSLNEEQTLQEVPTGLDSISHDSANCELPLLTPCSKAVMSQALKATFSGFKKEQRRLGIPKNPWLWSEQQVCQWLLWATNEFSLVNVNLQRFGMNGQMLCNLGKERFLELAPDFVGDILWEHLEQMIKENQEKTEDQYEENSHLTSVPHWINSNTLGQSD

SEQ ID NO: 905696 - protein, 268 aa, Homo sapiens
PFPPLPSTRPSLLPPPSSLLLPLLKSAPRGGRPGYFLQRLTSAVSLQLRAPGAARPASGLPDRLWPAPSPSPGAHRAAAGAEQPPSRPSAGPARSGRMNDFGIKNMDQVAPVANSYRGTLKRQPAFDTFDGSLFAVFPSLNEEQTLQEVPTGLDSISHDSANCELPLLTPCSKAVMSQALKATFSGFKKEQRRLGIPKNPWLWSEQQVCQWLLWATNEFSLVNVNLQRFGMNGQMLCNLGKERFLELAPDFVGDILWEHLEQMIKGTS

SEQ ID NO: 905697 - protein, 203 aa, Homo sapiens
PFPPLPSTRPSLLPPPSSLLLPLLKSAPRGGRPGYFLQRLTSAVSLQLRAPGAARPASGLPDRLWPAPSPSPGAHRAAAGAEQPPSRPSAGPARSGRMNDFGIKNMDQVAPVANSYRGTLKRQPAFDTFDGSLFAVFPSLNEEQTLQEVPTGLDSISHDSANCELPLLTPCSKDFVHLGVFMRNLNVIIWAYIWPLLSPLIVK

SEQ ID NO: 905698 - protein, 566 aa, Homo sapiens; identical to SEQ ID NO: 905685

SEQ ID NO: 905699 - protein, 566 aa, Homo sapiens; identical to SEQ ID NO: 905685

SEQ ID NO: 905700 - protein, 566 aa, Homo sapiens; identical to SEQ ID NO: 905685

SEQ ID NO: 905701 - protein, 469 aa, Homo sapiens
MNDFGIKNMDQVAPVANSYRGTLKRQPAFDTFDGSLFAVFPSLNEEQTLQEVPTGLDSISHDSANCELPLLTPCSKAVMSQALKATFSGFKKEQRRLGIPKNPWLWSEQQVCQWLLWATNEFSLVNVNLQRFGMNGQMLCNLGKERFLELAPDFVGDILWEHLEQMIKENQEKTEDQYEENSHLTSVPHWINSNTLGFGTEQAPYGMQTQNYPKGGLLDSMCPASTPSVLSSEQEFQMFPKSRLSSVSVTYCSVSQDFPGSNLNLLTNNSGTPKDHDSPENGADSFESSDSLLQSWNSQSSLLDVQRVPSFESFEDDCSQSLCLNKPTMSFKDYIQERSDPVEQGKPVIPAAVLAGFTGSGPIQLWQFLLELLSDKSCQSFISWTGDGWEFKLADPDEVARRWGKRKNKPKMNYEKLSRGLRYYYDKNIIHKTSGKRYVYRFVCDLQNLLGFTPEELHAILGVQPDTED

SEQ ID NO: 905702 - protein, 695 aa, Homo sapiens
PFPPLPSTRPSLLPPPSSLLLPLLKSAPRGGRPGYFLQRLTSAVSLQLRAPGAARPASGLPDRLWPAPSPSPGAHRAAAGAEQPPSRPSAGPARSGRMNDFGIKNMDQVAPVANSYRGTLKRQPAFDTFDGSLFAVFPSLNEEQTLQEVPTGLDSISHDSANCELPLLTPCSKAVMSQALKATFSGFKKEQRRLGIPKSKYCFPEPALGEKNQLQCSCLILTCLLSFCLGYSAKSSMDVVNLSHFCFTPINPRLDPELIKYVVEGRITGVLKCAWVVSEWCRVIMVSCSFVGSGVCRYLVHKLGMTVVSLPFHCFYLMCSIFSSLLVDPWLWSEQQVCQWLLWATNEFSLVNVNLQRFGMNGQMLCNLGKERFLELAPDFVGDILWEHLEQMIKENQEKTEDQYEENSHLTSVPHWINSNTLGFGTEQAPYGMQTQNYPKGGLLDSMCPASTPSVLSSEQEFQMFPKSRLSSVSVTYCSVSQDFPGSNLNLLTNNSGTPKDHDSPENGADSFESSDSLLQSWNSQSSLLDVQRVPSFESFEDDCSQSLCLNKPTMSFKDYIQERSDPVEQGKPVIPAAVLAGFTGSGPIQLWQFLLELLSDKSCQSFISWTGDGWEFKLADPDEVARRWGKRKNKPKMNYEKLSRGLRYYYDKNIIHKTSGKRYVYRFVCDLQNLLGFTPEELHAILGVQPDTED

SEQ ID NO: 905703 - protein, 566 aa, Homo sapiens; identical to SEQ ID NO: 905685

SEQ ID NO: 905704 - protein, 307 aa, Homo sapiens
QGIRDNGQETEDQEMKRYVTADLRSLMGLTAIEYSFGTEQAPYGMQTQNYPKGGLLDSMCPASTPSVLSSEQEFQMFPKSRLSSVSVTYCSVSQDFPGSNLNLLTNNSGTPKDHDSPENGADSFESSDSLLQSWNSQSSLLDVQRVPSFESFEDDCSQSLCLNKPTMSFKDYIQERSDPVEQGKPVIPAAVLAGFTGSGPIQLWQFLLELLSDKSCQSFISWTGDGWEFKLADPDEVARRWGKRKNKPKMNYEKLSRGLRYYYDKNIIHKTSGKRYVYRFVCDLQNLLGFTPEELHAILGVQPDTED

SEQ ID NO: 905705 - protein, 566 aa, Homo sapiens; identical to SEQ ID NO: 905685

SEQ ID NO: 905706 - protein, 90 aa, Homo sapiens
IDSWTQLARMGVKLADPDEVARRWGKRKNKPKMNYEKLSRGLRYYYDKNIIHKTSGKRYVYRFVCDLQNLLGFTPEELHAILGVQPDTED

SEQ ID NO: 905707 - protein, 254 aa, Homo sapiens
PFPPLPSTRPSLLPPPSSLLLPLLKSAPRGGRPGYFLQRLTSAVSLQLRAPGAARPASGLPDRLWPAPSPSPGAHRAAAGAEQPPSRPSAGPARSGRMNDFGIKNMDQVAPVANSYRGTLKRQPAFDTFDGSLFAVFPSLNEEQTLQEVPTGLDSISHDSANCELPLLTPCSKAVMSQALKATFSGFKKEQRRLGIPKSKYCFPEPALGEKNQLQCSCLILTCLLSFCLGYSAKSSMDVVNLSQFLFHPNQPKT

SEQ ID NO: 905708 - protein, 300 aa, Homo sapiens
PAEFLQRNYRPGRKRLFSFNTDDWAWEPTRLQSGGRQQQLPGLLFLNTLQARQGSRSPLTMDKFVIRTPRIQNSPQKKDSGGKVYKQATIESLKRVVVVEDIKRWKTMLELPDQTKENLVEALQELKKKIPSREVLKSTRIGHTVNKMRKHSDSEVASLAREVYTEWKTFTEKHSNRPSIEVRSDPKTESLRKNAQKLLSEALELKMDTYWLKIVNVDEVGGEALGRLLVVYPWTQRFFESFGDLSTPDAVMGNPKVKAHGKKVLGAFSDGLAHLDNLKGTFATLSELHCDKLHVDPENF

SEQ ID NO: 905709 - protein, 268 aa, Homo sapiens
PAEFLQRNYRPGRKRLFSFNTDDWAWEPTRLQSGGRQQQLPGLLFLNTLQARQGSRSPLTMDKFVIRTPRIQNSPQKKDSGGKVYKQATIESLKRVVVVEDIKRWKTMLELPDQTKENLVEALQELKKKIPSREVLKSTRIGHTVNKMRKHSDSEVASLAREVYTEWKTFTEKHSNRPSIEVRSDPKTESLRKNAQKLLSEALELKMDHLLVENIERETFHLCSRLINGPYRRTVRALVFTLKHRAEIRAQVKSGSLPVGTFVQTHKK

SEQ ID NO: 905710 - protein, 497 aa, Homo sapiens
ETESGGRDAGMWSGCGAAAAELRDCGSRRISRSPSSNSHLSPRISLSGNLGPQTSRLGGPPSPSATWSVFWQLPRQQSLPGRGSANLLPSVRSESAVLSDCVGGFPGRSSVRAWIAGPRCTPASPTRVLSLSWRLFNSASLLLLATSTSGSECRFPRSPRARERGIPDCERLLVRRSCWRSGDPRPAGPAGHAAGAFSTPQYLGGTAMVLLHVKRGDESQFLLQAPGSTELEELTVQVARVYNGRLKVQRLCSEMEELAEHGIFLPPNMQGLTDDQIEELKLKDEWGEKCVPSGGAVFKKDDIGRRNGQAPNEKMKQVLKKTIEEAKAIISKKQVEAGVCVTMEMVKDALDQLRGAVMIVYPMGLPPYDPIRMEFENKEDLSGTQAGLNVIKEAEAQLWWAAKELRRTKKLSDYVGKNEKTKIIAKIQQRGQGAPAREPIISSEEQKQLMLYYHRRQEELKRLEENDDDAYLNSPWADNTALKRHFHGVKDIKWRPR

SEQ ID NO: 905711 - protein, 476 aa, Homo sapiens
ETESGGRDAGMWSGCGAAAAELRDCGSRRISRSPSSNSHLSPRISLSGNLGPQTSRLGGPPSPSATWSVFWQLPRQQSLPGRGSANLLPSVRSESAVLSDCVGGFPGRSSVRAWIAGPRCTPASPTRVLSLSWRLFNSASLLLLATSTSGSECRFPRSPRARERGIPDCERLLVRRSCWRSGDPRPAGPAGHAAGAFSTPQYLGGTAMVLLHVKRGDESQFLLQAPGSTELEELTVQVARVYNGRLKVQRLCSEMEELAEHGIFLPPNMQGLTDDQIEELKLKDEWGEKCVPSGGAVFKKDDIGRRNGQAPNEKMKQVLKKTIEEAKAIISKKQVEAGVCVTMEMVKDALDQLRGAVMIVYPMGLPPYDPIRMEFENKEDLSGTQAGLNVIKEAEAQLWWAAKELRRTKKLSDYVGKNEKTKIIAKIQQRGQGAPAREPIISSEEQKQLMLYYHRRQEELKVAGDRWAFCSAGAHT

SEQ ID NO: 905712 - protein, 452 aa, Homo sapiens
ETESGGRDAGMWSGCGAAAAELRDCGSRRISRSPSSNSHLSPRISLSGNLGPQTSRLGGPPSPSATWSVFWQLPRQQSLPGRGSANLLPSVRSESAVLSDCVGGFPGRSSVRAWIAGPRCTPASPTRVLSLSWRLFNSASLLLLATSTSGSECRFPRSPRARERGIPDCERLLVRRSCWRSGDPRPAGPAGHAAGAFSTPQYLGGTAMVLLHVKRGDESQFLLQAPGSTELEELTVQVARVYNGRLKVQRLCSEMEELAEHGIFLPPNMQGLTDDQIEELKLKDEWGEKCVPSGGAVFKKDDIGRRNGQAPNEKMKQVLKKTIEEAKAIISKKQVEAGVCVTMEMVKDALDQLRGAVMIVYPMGLPPYDPIRMEFENKEDLSGTQAGLNVIKEAEAQLWWAAKELRRTKKLSDYVGKNEKTKIIAKIQQVSTFCFNVSVVFVISLQTDKNVQ

SEQ ID NO: 905713 - protein, 465 aa, Homo sapiens
ETESGGRDAGMWSGCGAAAAELRDCGSRRISRSPSSNSHLSPRISLSGNLGPQTSRLGGPPSPSATWSVFWQLPRQQSLPGRGSANLLPSVRSESAVLSDCVGGFPGRSSVRAWIAGPRCTPASPTRVLSLSWRLFNSASLLLLATSTSGSECRFPRSPRARERGIPDCERLLVRRSCWRSGDPRPAGPAGHAAGAFSTPQYLGGTAMVLLHVKRGDESQFLLQAPGSTELEELTVQVARVYNGRLKVQRLCSEMEELAEHGIFLPPNMQGLTDDQIEELKLKDEWGEKCVPSGGAVFKKDDIGRRNGQAPNEKMKQVLKKTIEEAKAIISKKQVEAGVCVTMEMVKDALDQLRGAVMIVYPMGLPPYDPIRMEFENKEDLSGTQAGLNVIKEAEAQLWWAAKELRRTKKLSDYVGKNEKTKIIAKIQQRLEENDDDAYLNSPWADNTALKRHFHGVKDIKWRPR

SEQ ID NO: 905714 - protein, 345 aa, Homo sapiens
ETESGGRDAGMWSGCGAAAAELRDCGSRRISRSPSSNSHLSPRISLSGNLGPQTSRLGGPPSPSATWSVFWQLPRQQSLPGRGSANLLPSVRSESAVLSDCVGGFPGRSSVRAWIAGPRCTPASPTRVLSLSWRLFNSASLLLLATSTSGSECRFPRSPRARERGIPDCERLLVRRSCWRSGDPRPAGPAGHAAGAFSTPQYLGGTAMVLLHVKRGDESQFLLQAPGSTELEELTVQVARVYNGRLKVQRLCSEMEELAEHGIFLPPNMQGLTDDQIEELKLKDEWGEKCVPSGGAVFKKDDIGRRNGQETSGSRCLCYHGDGERCLGPASRRGDDCLPHGVATV

SEQ ID NO: 905715 - protein, 264 aa, Homo sapiens
MAHLRSSQLLGCPPQQRLCSEMEELAEHGIFLPPNMQGLTDDQIEELKLKDEWGEKCVPSGGAVFKKDDIGRRNGQAPNEKMKQVLKKTIEEAKAIISKKQVEAGVCVTMEMVKDALDQLRGAVMIVYPMGLPPYDPIRMEFENKEDLSGTQAGLNVIKEAEAQLWWAAKELRRTKKLSDYVGKNEKTKIIAKIQQRGQGAPAREPIISSEEQKQLMLYYHRRQEELKRLEENDDDAYLNSPWADNTALKRHFHGVKDIKWRPR

SEQ ID NO: 905716 - protein, 87 aa, Homo sapiens
IGTSVRTRIMYSLLDSCDRRGQGAPAREPIISSEEQKQLMLYYHRRQEELKRLEENDDDAYLNSPWADNTALKRHFHGVKDIKWRPR

SEQ ID NO: 905717 - protein, 497 aa, Homo sapiens; identical to SEQ ID NO: 905710

SEQ ID NO: 905718 - protein, 452 aa, Homo sapiens; identical to SEQ ID NO: 905712

SEQ ID NO: 905719 - protein, 482 aa, Homo sapiens
ETESGGRDAGMWSGCGAAAAELRDCGSRRISRSPSSNSHLSPRISLSGNLGPQTSRLGGPPSPSATWSVFWQLPRQQSLPGRGSANLLPSVRSESAVLSDCVGGFPGRSSVRAWIAGPRCTPASPTRVLSLSWRLFNSASLLLLATSTSGSECRFPRSPRARERGIPDCERLLVRRSCWRSGDPRPAGPAGHAAGAFSTPQYLGGTAMVLLHVKRGDESQFLLQAPGSTELEELTVQVARVYNGRLKVQRLCSEMEELAEHGIFLPPNMQGLTDDQIEELKLKDEWGEKCVPSGGAVFKKDDIGRRNGQAPNEKMKQVLKKTIEEAKAIISKKQVEAGVCVTMEMVKDALDQLRGAVMIVYPMGLPPYDPIRMEFENKEDLSGTQAGLNVIKEAEAQLWWAAKELRRTKKLSDYVGKNEKTKIIAKIQQIFATFQVVVLCPPELGPRSLGPLDQNPNQLRNRLLADEPGGSGARDAVSNVAP

SEQ ID NO: 905720 - protein, 290 aa, Homo sapiens
MVLLHVKRGDESQFLLQAPGSTELEELTVQVARVYNGRLKVQRLCSEMEELAEHGIFLPPNMQGLTDDQIEELKLKDEWGEKCVPSGGAVFKKDDIGRRNGQAPNEKMKQVLKKTIEEAKAIISKKQVEAGVCVTMEMVKDALDQLRGAVMIVYPMGLPPYDPIRMEFENKEDLSGTQAGLNVIKEAEAQLWWAAKELRRTKKLSDYVGKNEKTKIIAKIQQRGQGAPAREPIISSEEQKQLMLYYHRRQEELKRLEENDDDAYLNSPWADNTALKRHFHGVKDIKWRPR

SEQ ID NO: 905721 - protein, 183 aa, Homo sapiens [sequence omitted]

SEQ ID NO: 905722 - protein, 249 aa, Homo sapiens
MAVILSLEQGNRLREQYGLGPYEAVTPLTKAADISLDNLVEGKRKRRSNVSSPATPTASSSSSTTPTRKITESPRASMGVLSGKRKLITSEEERSPAKRGRKSATVKPGAVGAGEFVSPCESGDNTGEPSALEEQRGPLPLNKTLFLGYAFLLTMATTSDKLASRSKLPDGPTGSSEEEEAIREFLLSQGRYKNPRSRGGVIPKFHEPRHTLHGLKGGENWHPEIRRHGTGARGAKGARKRIARRRDMV

SEQ ID NO: 905723 - protein, 1977 aa, Homo sapiens
MPGEQMDPTGSQLDSDFSQQDTPCLIIEDSQPESQVLEDDSGSHFSMLSRHLPNLQTHKENPVLDVVSNPEQTAGEERGDGNSGFNEHLKENKVADPVDSSNLDTCGSISQVIEQLPQPNRTSSVLGMSVESAPAVEEEKGEELEQKEKEKEEDTSGNTTHSLGAEDTASSQLGFGVLELSQSQDVEENTVPYEVDKEQLQSVTTNSGYTRLSDVDANTAIKHEEQSNEDIPIAEQSSKDIPVTAQPSKDVHVVKEQNPPPARSEDMPFSPKASVAAMEAKEQLSAQELMESGLQIQKSPEPEVLSTQEDLFDQSNKTVSSDGCSTPSREEGGCSLASTPATTLHLLQLSGQRSLVQDSLSTNSSDLVAPSPDAFRSTPFIVPSSPTEQEGRQDKPMDTSVLSEEGGEPFQKKLQSGEPVELENPPLLPESTVSPQASTPISQSTPVFPPGSLPIPSQPQFSHDIFIPSPSLEEQSNDGKKDGDMHSSSLTVECSKTSEIEPKNSPEDLGLSLTGDSCKLMLSTSEYSQSPKMESLSSHRIDEDGENTQIEDTEPMSPVLNSKFVPAENDSILMNPAQDGEVQLSQNDDKTKGDDTDTRDDISILATGCKGREETVAEDVCIDLTCDSGSQAVPSPATRSEALSSVLDQEEAMEIKEHHPEEGSSGSEVEEIPETPCESQGEELKEENMESVPLHLSLTETQSQGLCLQKEMPKKECSEAMEVETSVISIDSPQKLAILDQELEHKEQEAWEEATSEDSSVVIVDVKEPSPRVDVSCEPLEGVEKCSDSQSWEDIAPEIEPCAENRLDTKEEKSVEYEGDLKSGTAETEPVEQDSSQPSLPLVRADDPLRLDQELQQPQTQEKTSNSLTEDSKMANAKQLSSDAEAQKLGKPSAHASQSFCESSSETPFHFTLPKEGDIIPPLTGATPPLIGHLKLEPKRHSTPIGISNYPESTIATSDVMSESMVETHDPILGSGKGDSGAAPDVDDKLCLRMKLVSPETEASEESLQFNLEKPATGERKNGSTAVAESVASPQKTMSVLSCICEARQENEARSEDPPTTPIRGNLLHFPSSQGEEEKEKLEGDHTIRQSQQPMKPISPVKDPVSPASQKMVIQGPSSPQGEAMVTDVLEDQKEGRSTNKENPSKALIERPSQNNIGIQTMECSLRVPETVSAATQTIKNVCEQGTSTVDQNFGKQDATVQTERGSGEKPVSAPGDDTESLHSQGEEEFDMPQPPHGHVLHRHMRTIREVRTLVTRVITDVYYVDGTEVERKVTEETEEPIVECQECETEVSPSQTGGSSGDLGDISSFSSKASSLHRTSSGTSLSAMHSSGSSGKGAGPLRGKTSGTEPADFALPSSRGGPGKLSPRKGVSQTGTPVCEEDGDAGLGIRQGGKAPVTPRGRGRRGRPPSRTTGTRETAVPGPLGIEDISPNLSPDDKSFSRVVPRVPDSTRRTDVGAGALRRSDSPEIPFQAAAGPSDGLDASSPGNSFVGLRVVAKWSSNGYFYSGKITRDVGAGKYKLLFDDGYECDVLGKDILLCDPIPLDTEVTALSEDEYFSAGVVKGHRKESGELYYSIEKEGQRKWYKRMAVILSLEQGNRLREQYGLGPYEAVTPLTKAADISLDNLVEGKRKRRSNVSSPATPTASSSSSTTPTRKITESPRASMGVLSGKRKLITSEEERSPAKRGRKSATVKPGAVGAGEFVSPCESGDNTGEPSALEEQRGPLPLNKTLFLGYAFLLTMATTSDKLASRSKLPDGPTGSSEEEEEFLEIPPFNKQYTESQLRAGAGYILEDFNEAQCNTAYQCLLIADQHCRTRKYFLCLASGIPCVSHVWVHDSCHANQLQNYRNYLLPAGYSLEEQRILDWQPRENPFQNLKVLLVSDQQQNFLELWSEILMTGGAASVKQHHSSAHNKDIALGVFDVVVTDPSCPASVLKCAEALQLPVVSQEWVIQCLIVGERIGFKQHPKYKHDYVSH

SEQ ID NO: 905724 - protein, 1654 aa, Homo sapiens
RSTSLPLMRADDPLRLDQELQQPQTQEKTSNSLTEDSKMANAKQLSSDAEAQKLGKPSAHASQSFCESSSDKPMDTSVLSEEGGEPFQKKLQSGEPVELENPPLLPESTVSPQASTPISQSTPVFPPGSLPIPSQPQFSHDIFIPSPSLEEQSNDGKKDGDMHSSSLTVECSKTSEIEPKNSPEDLGLSLTGDSCKLMLSTSEYSQSPKMESLSSHRIDEDGENTQIEDTEPMSPVLNSKFVPAENDSILMNPAQDGEVQLSQNDDKTKGDDTDTRDDISILATGCKGREETVAEDVCIDLTCDSGSQAVPSPATRSEALSSVLDQEEAMEIKEHHPEEGSSGSEVEEIPETPCESQGEELKEENMESVPLHLSLTETQSQGLCLQKEMPKKECSEAMEVETSVISIDSPQKLAILDQELEHKEQEAWEEATSEDSSVVIVDVKEPSPRVDVSCEPLEGVEKCSDSQSWEDIAPEIEPCAENRLDTKEEKSVEYEGDLKSGTAETEPVEQDSSQPSLPLVRADDPLRLDQELQQPQTQEKTSNSLTEDSKMANAKQLSSDAEAQKLGKPSAHASQSFCESSSETPFHFTLPKEGDIIPPLTGATPPLIGHLKLEPKRHSTPIGISNYPESTIATSDVMSESMVETHDPILGSGKGDSGAAPDVDDKLCLRMKLVSPETEASEESLQFNLEKPATGERKNGSTAVAESVASPQKTMSVLSCICEARQENEARSEDPPTTPIRGNLLHFPSSQGEEEKEKLEGDHTIRQSQQPMKPISPVKDPVSPASQKMVIQGPSSPQGEAMVTDVLEDQKEGRSTNKENPSKALIERPSQNNIGIQTMECSLRVPETVSAATQTIKNVCEQGTSTVDQNFGKQDATVQTERGSGEKPVSAPGDDTESLHSQGEEEFDMPQPPHGHVLHRHMRTIREVRTLVTRVITDVYYVDGTEVERKVTEETEEPIVECQECETEVSPSQTGGSSGDLGDISSFSSKASSLHRTSSGTSLSAMHSSGSSGKGAGPLRGKTSGTEPADFALPSSRGGPGKLSPRKGVSQTGTPVCEEDGDAGLGIRQGGKAPVTPRGRGRRGRPPSRTTGTRETAVPGPLGIEDISPNLSPDDKSFSRVVPRVPDSTRRTDVGAGALRRSDSPEIPFQAAAGPSDGLDASSPGNSFVGLRVVAKWSSNGYFYSGKITRDVGAGKYKLLFDDGYECDVLGKDILLCDPIPLDTEVTALSEDEYFSAGVVKGHRKESGELYYSIEKEGQRKWYKRMAVILSLEQGNRLREQYGLGPYEAVTPLTKAADISLDNLVEGKRKRRSNVSSPATPTASSSSSTTPTRKITESPRASMGVLSGKRKLITSEEERSPAKRGRKSATVKPGAVGAGEFVSPCESGDNTGEPSALEEQRGPLPLNKTLFLGYAFLLTMATTSDKLASRSKLPDGPTGSSEEEEEFLEIPPFNKQYTESQLRAGAGYILEDFNEAQCNTAYQCLLIADQHCRTRKYFLCLASGIPCVSHVWVHDSCHANQLQNYRNYLLPAGYSLEEQRILDWQPRENPFQNLKVLLVSDQQQNFLELWSEILMTGGAASVKQHHSSAHNKDIALGVFDVVVTDPSCPASVLKCAEALQLPVVSQEWVIQCLIVGERIGFKQHPKYKHDYVSH

SEQ ID NO: 905725 - protein, 1806 aa, Homo sapiens [sequence omitted]

SEQ ID NO: 905726 - protein, 2009 aa, Homo sapiens
MPGEQMDPTGSQLDSDFSQQDTPCLIIEDSQPESQVLEDDSGSHFSMLSRHLPNLQTHKENPVLDVVSNPEQTAGEERGDGNSGFNEHLKENKVADPVDSSNLDTCGSISQVIEQLPQPNRTSSVLGMSVESAPAVEEEKGEELEQKEKEKEEDTSGNTTHSLGAEDTASSQLGFGVLELSQSQDVEENTVPYEVDKEQLQSVTTNSGYTRLSDVDANTAIKHEEQSNEDIPIAEQSSKDIPVTAQPSKDVHVVKEQNPPPARSEDMPFSPKASVAAMEAKEQLSAQELMESGLQIQKSPEPEVLSTQEDLFDQSNKTVSSDGCSTPSREEGGCSLASTPATTLHLLQLSGQRSLVQDSLSTNSSDLVAPSPDAFRSTPFIVPSSPTEQEGRQDKPMDTSVLSEEGGEPFQKKLQSGEPVELENPPLLPESTVSPQASTPISQSTPVFPPGSLPIPSQPQFSHDIFIPSPSLEEQSNDGKKDGDMHSSSLTVECSKTSEIEPKNSPEDLGLSLTGDSCKLMLSTSEYSQSPKMESLSSHRIDEDGENTQIEDTEPMSPVLNSKFVPAENDSILMNPAQDGEVQLSQNDDKTKGDDTDTRDDISILATGCKGREETVAEDVCIDLTCDSGSQAVPSPATRSEALSSVLDQEEAMEIKEHHPEEGSSGSEVEEIPETPCESQGEELKEENMESVPLHLSLTETQSQGLCLQKEMPKKECSEAMEVETSVISIDSPQKLAILDQELEHKEQEAWEEATSEDSSVVIVDVKEPSPRVDVSCEPLEGVEKCSDSQSWEDIAPEIEPCAENRLDTKEEKSVEYEGDLKSGTAETEPVEQDSSQPSLPLVRADDPLRLDQELQQPQTQEKTSNSLTEDSKMANAKQLSSDAEAQKLGKPSAHASQSFCESSSETPFHFTLPKEGDIIPPLTGATPPLIGHLKLEPKRHSTPIGISNYPESTIATSDVMSESMVETHDPILGSGKGDSGAAPDVDDKLCLRMKLVSPETEASEESLQFNLEKPATGERKNGSTAVAESVASPQKTMSVLSCICEARQENEARSEDPPTTPIRGNLLHFPSSQGEEEKEKLEGDHTIRQSQQPMKPISPVKDPVSPASQKMVIQGPSSPQGEAMVTDVLEDQKEGRSTNKENPSKALIERPSQNNIGIQTMECSLRVPETVSAATQTIKNVCEQGTSTVDQNFGKQDATVQTERGSGEKPVSAPGDDTESLHSQGEEEFDMPQPPHGHVLHRHMRTIREVRTLVTRVITDVYYVDGTEVERKVTEETEEPIVECQECETEVSPSQTGGSSGDLGDISSFSSKASSLHRTSSGTSLSAMHSSGSSGKGAGPLRGKTSGTEPADFALPSSRGGPGKLSPRKGVSQTGTPVCEEDGDAGLGIRQGGKAPVTPRGRGRRGRPPSRTTGTRETAVPGPLGIEDISPNLSPDDKSFSRVVPRVPDSTRRTDVGAGALRRSDSPEIPFQAAAGPSDGLDASSPGNSFVGLRVVAKWSSNGYFYSGKITRDVGAGKYKLLFDDGYECDVLGKDILLCDPIPLDTEVTALSEDEYFSAGVVKGHRKESGELYYSIEKEGQRKWYKRMAVILSLEQGNRLREQYGLGPYEAVTPLTKAADISLDNLVEGKRKRRSNVSSPATPTASSSSSTTPTRKITESPRASMGVLSGKRKLITSEEERSPAKRGRKSATVKPGAVGAGEFVSPCESGDNTGEPSALEEQRGPLPLNKTLFLGYAFLLTMATTSDKLASRSKLPDGPTGSSEEEEAYCNHPSQSGLNALPSSPFAFYGHLLEQTHVEEFLEIPPFNKQYTESQLRAGAGYILEDFNEAQCNTAYQCLLIADQHCRTRKYFLCLASGIPCVSHVWVHDSCHANQLQNYRNYLLPAGYSLEEQRILDWQPRENPFQNLKVLLVSDQQQNFLELWSEILMTGGAASVKQHHSSAHNKDIALGVFDVVVTDPSCPASVLKCAEALQLPVVSQEWVIQCLIVGERIGFKQHPKYKHDYVSH

SEQ ID NO: 905727 - protein, 1806 aa, Homo sapiens [sequence omitted]

SEQ ID NO: 905728 - protein, 1705 aa, Homo sapiens
MPGEQMDPTGSQLDSDFSQQDTPCLIIEDSQPESQVLEDDSGSHFSMLSRHLPNLQTHKENPVLDVVSNPEQTAGEERGDGNSGFNEHLKENKVADPVDSSNLDTCGSISQVIEQLPQPNRTSSVLGMSVESAPAVEEEKGEELEQKEKEKEEDTSGNTTHSLGAEDTASSQLGFGVLELSQSQDVEENTVPYEVDKEQLQSVTTNSGYTRLSDVDANTAIKHEEQSNEDIPIAEQSSKDIPVTAQPSKDVHVVKEQNPPPARSEDMPFSPKASVAAMEAKEQLSAQELMESGLQIQKSPEPEVLSTQEDLFDQSNKTVSSDGCSTPSREEGGCSLASTPATTLHLLQLSGQRSLVQDSLSTNSSDLVAPSPDAFRSTPFIVPSSPTEQEGRQDKPMDTSVLSEEGGEPFQKKLQSGEPVELENPPLLPESTVSPQASTPISQSTPVFPPGSLPIPSQPQFSHDIFIPSPSLEEQSNDGKKDGDMHSSSLTVECSKTSEIEPKNSPEDLGLSLTGDSCKLMLSTSEYSQSPKMESLSSHRIDEDGENTQIEDTEPMSPVLNSKFVPAENDSILMNPAQDGEVQLSQNDDKTKGDDTDTRDDISILATGCKGREETVAEDVCIDLTCDSGSQAVPSPATRSEALSSVLDQEEAMEIKEHHPEEGSSGSEVEEIPETPCESQGEELKEENMESVPLHLSLTETQSQGLCLQKEMPKKECSEAMEVETSVISIDSPQKLAILDQELEHKEQEAWEEATSEDSSVVIVDVKEPSPRVDVSCEPLEGVEKCSDSQSWEDIAPEIEPCAENRLDTKEEKSVEYEGDLKSGTAETEPVEQDSSQPSLPLVRADDPLRLDQELQQPQTQEKTSNSLTEDSKMANAKQLSSDAEAQKLGKPSAHASQSFCESSSETPFHFTLPKEGDIIPPLTGATPPLIGHLKLEPKRHSTPIGISNYPESTIATSDVMSESMVETHDPILGSGKGDSGAAPDVDDKLCLRMKLVSPETEASEESLQFNLEKPATGERKNGSTAVAESVASPQKTMSVLSCICEARQENEARSEDPPTTPIRGNLLHFPSSQGEEEKEKLEGDHTIRQSQQPMKPISPVKDPVSPASQKMVIQGPSSPQGEAMVTDVLEDQKEGRSTNKENPSKALIERPSQNNIGIQTMECSLRVPETVSAATQNSTRRTDVGAGALRRSDSPEIPFQAAAGPSDGLDASSPGNSFVGLRVVAKWSSNGYFYSGKITRDVGAGKYKLLFDDGYECDVLGKDILLCDPIPLDTEVTALSEDEYFSAGVVKGHRKESGELYYSIEKEGQRKWYKRMAVILSLEQGNRLREQYGLGPYEAVTPLTKAADISLDNLVEGKRKRRSNVSSPATPTASSSSSTTPTRKITESPRASMGVLSGKRKLITSEEERSPAKRGRKSATVKPGAVGAGEFVSPCESGDNTGEPSALEEQRGPLPLNKTLFLGYAFLLTMATTSDKLASRSKLPDGPTGSSEEEEEFLEIPPFNKQYTESQLRAGAGYILEDFNEAQCNTAYQCLLIADQHCRTRKYFLCLASGIPCVSHVWVHDSCHANQLQNYRNYLLPAGYSLEEQRILDWQPRENPFQNLKVLLVSDQQQNFLELWSEILMTGGAASVKQHHSSAHNKDIALGVFDVVVTDPSCPASVLKCAEALQLPVVSQEWVIQCLIVGERIGFKQHPKYKHDYVSH

SEQ ID NO: 905729 - protein, 806 aa, Homo sapiens
QYSTMFILYFIEIQYSPIRMNNSSQNHLGEKKKRTDPKCSVQWLLKILSNHYSKQIQNIPIIPESLLILTFLNYNFVPSVGFSNHHISIVLLWHLLSSVSIFSLQETEEPIVECQECETEVSPSQTGGSSGDLGDISSFSSKASSLHRTSSGTSLSAMHSSGSSGKGAGPLRGKTSGTEPADFALPSSRGGPGKLSPRKGVSQTGTPVCEEDGDAGLGIRQGGKAPVTPRGRGRRGRPPSRTTGTRETAVPGPLGIEDISPNLSPDDKSFSRVVPRVPDSTRRTDVGAGALRRSDSPEIPFQAAAGPSDGLDASSPGNSFVGLRVVAKWSSNGYFYSGKITRDVGAGKYKLLFDDGYECDVLGKDILLCDPIPLDTEVTALSEDEYFSAGVVKGHRKESGELYYSIEKEGQRKWYKRMAVILSLEQGNRLREQYGLGPYEAVTPLTKAADISLDNLVEGKRKRRSNVSSPATPTASSSSSTTPTRKITESPRASMGVLSGKRKLITSEEERSPAKRGRKSATVKPGAVGAGEFVSPCESGDNTGEPSALEEQRGPLPLNKTLFLGYAFLLTMATTSDKLASRSKLPDGPTGSSEEEEEFLEIPPFNKQYTESQLRAGAGYILEDFNEAQCNTAYQCLLIADQHCRTRKYFLCLASGIPCVSHVWVHDSCHANQLQNYRNYLLPAGYSLEEQRILDWQPRENPFQNLKVLLVSDQQQNFLELWSEILMTGGAASVKQHHSSAHNKDIALGVFDVVVTDPSCPASVLKCAEALQLPVVSQEWVIQCLIVGERIGFKQHPKYKHDYVSH

SEQ ID NO: 905730 - protein, 649 aa, Homo sapiens
MHSSGSSGKGAGPLRGKTSGTEPADFALPSSRGGPGKLSPRKGVSQTGTPVCEEDGDAGLGIRQGGKAPVTPRGRGRRGRPPSRTTGTRETAVPGPLGIEDISPNLSPDDKSFSRVVPRVPDSTRRTDVGAGALRRSDSPEIPFQAAAGPSDGLDASSPGNSFVGLRVVAKWSSNGYFYSGKITRDVGAGKYKLLFDDGYECDVLGKDILLCDPIPLDTEVTALSEDEYFSAGVVKGHRKESGELYYSIEKEGQRKWYKRMAVILSLEQGNRLREQYGLGPYEAVTPLTKAADISLDNLVEGKRKRRSNVSSPATPTASSSSSTTPTRKITESPRASMGVLSGKRKLITSEEERSPAKRGRKSATVKPGAVGAGEFVSPCESGDNTGEPSALEEQRGPLPLNKTLFLGYAFLLTMATTSDKLASRSKLPDGPTGSSEEEEEFLEIPPFNKQYTESQLRAGAGYILEDFNEAQCNTAYQCLLIADQHCRTRKYFLCLASGIPCVSHVWVHDSCHANQLQNYRNYLLPAGYSLEEQRILDWQPRENPFQNLKVLLVSDQQQNFLELWSEILMTGGAASVKQHHSSAHNKDIALGVFDVVVTDPSCPASVLKCAEALQLPVVSQEWVIQCLIVGERIGFKQHPKYKHDYVSH

SEQ ID NO: 905731 - protein, 389 aa, Homo sapiens
MAVILSLEQGNRLREQYGLGPYEAVTPLTKAADISLDNLVEGKRKRRSNVSSPATPTASSSSSTTPTRKITESPRASMGVLSGKRKLITSEEERSPAKRGRKSATVKPGAVGAGEFVSPCESGDNTGEPSALEEQRGPLPLNKTLFLGYAFLLTMATTSDKLASRSKLPDGPTGSSEEEEEFLEIPPFNKQYTESQLRAGAGYILEDFNEAQCNTAYQCLLIADQHCRTRKYFLCLASGIPCVSHVWVHDSCHANQLQNYRNYLLPAGYSLEEQRILDWQPRENPFQNLKVLLVSDQQQNFLELWSEILMTGGAASVKQHHSSAHNKDIALGVFDVVVTDPSCPASVLKCAEALQLPVVSQEWVIQCLIVGERIGFKQHPKYKHDYVSH

SEQ ID NO: 905732 - protein, 1760 aa, Homo sapiens
MPGEQMDPTGSQLDSDFSQQDTPCLIIEDSQPESQVLEDDSGSHFSMLSRHLPNLQTHKENPVLDVVSNPEQTAGEERGDGNSGFNEHLKENKVADPVDSSNLDTCGSISQVIEQLPQPNRTSSVLGMSVESAPAVEEEKGEELEQKEKEKEEDTSGNTTHSLGAEDTASSQLGFGVLELSQSQDVEENTVPYEVDKEQLQSVTTNSGYTRLSDVDANTAIKHEEQSNEDIPIAEQSSKDIPVTAQPSKDVHVVKEQNPPPARSEDMPFSPKASVAAMEAKEQLSAQELMESGLQIQKSPEPEVLSTQEDLFDQSNKTVSSDGCSTPSREEGGCSLASTPATTLHLLQLSGQRSLVQDSLSTNSSDLVAPSPDAFRSTPFIVPSSPTEQEGRQDKPMDTSVLSEEGGEPFQKKLQSGEPVELENPPLLPESTVSPQASTPISQSTPVFPPGSLPIPSQPQFSHDIFIPSPSLEEQSNDGKKDGDMHSSSLTVECSKTSEIEPKNSPEDLGLSLTGDSCKLMLSTSEYSQSPKMESLSSHRIDEDGENTQIEDTEPMSPVLNSKFVPAENDSILMNPAQDGEVQLSQNDDKTKGDDTDTRDDISILATGCKGREETVAEDVCIDLTCDSGSQAVPSPATRSEALSSVLDQEEAMEIKEHHPEEGSSGSEVEEIPETPCESQGEELKEENMESVPLHLSLTETQSQGLCLQKEMPKKECSEAMEVETSVISIDSPQKLAILDQELEHKEQEAWEEATSEDSSVVIVDVKEPSPRVDVSCEPLEGVEKCSDSQSWEDIAPEIEPCAENRLDTKEEKSVEYEGDLKSGTAETEPVEQDSSQPSLPLVRADDPLRLDQELQQPQTQEKTSNSLTEDSKMANAKQLSSDAEAQKLGKPSAHASQSFCESSSETPFHFTLPKEGDIIPPLTGATPPLIGHLKLEPKRHSTPIGISNYPESTIATSDVMSESMVETHDPILGSGKGDSGAAPDVDDKLCLRMKLVSPETEASEESLQFNLEKPATGERKNGSTAVAESVASPQKTMSVLSCICEARQENEARSEDPPTTPIRGNLLHFPSSQGEEEKEKLEGDHTIRQSQQPMKPISPVKDPVSPASQKMVIQGPSSPQGEAMVTDVLEDQKEGRSTNKENPSKALIERPSQNNIGIQTMECSLRVPETVSAATQTIKNVCEQGTSTVDQNFGKQDATVQTERGSGEKPVSAPGDDTESLHSQGEEEFDMPQPPHGHVLHRHMRTIREVRTLVTRVITDVYYVDGTEVERKVTEETEEPIVECQECETEVSPSQTGGSSGDLGDISSFSSKASSLHRTSSGTSLSAMHSSGSSGKGAGPLRGKTSGTEPADFALPSSRGGPGKLSPRKGVSQTGTPVCEEDGDAGLGIRQGGKAPVTPRGRGRRGRPPSRTTGTRETAVPGPLGIEDISPNLSPDDKSFSRVVPRVPDSTRRTDVGAGALRRSDSPEIPFQAAAGPSDGLDASSPGNSFVGLRVVAKWSSNGYFYSGKITRDVGAGKYKLLFDDGYECDVLGKDILLCDPIPLDTEVTALSEDEYFSAGVVKGHRKESGELYYSIEKEGQRKWYKRMAVILSLEQGNRLREQYGLGPYEAVTPLTKAADISLDNLVEGKRKRRSNVSSPATPTASSSSSTTPTRKITESPRASMGVLSGKRKLITSEEERSPAKRGRKSATVKPGKCSFLPHSSFRPWQNAGSAAGKMELNMWQWPFCPAIKSGSCPSPQVIFRDSSLYPSSPIPYRL

SEQ ID NO: 905733 - protein, 1582 aa, Homo sapiens
MPGEQMDPTGSQLDSDFSQQDTPCLIIEDSQPESQVLEDDSGSHFSMLSRHLPNLQTHKENPVLDVVSNPEQTAGEERGDGNSGFNEHLKENKVADPVDSSNLDTCGSISQVIEQLPQPNRTSSVLGMSVESAPAVEEEKGEELEQKEKEKEEDTSGNTTHSLGAEDTASSQLGFGVLELSQSQDVEENTVPYEVDKEQLQSVTTNSGYTRLSDVDANTAIKHEEQSNEDIPIAEQSSKDIPVTAQPSKDVHVVKEQNPPPARSEDMPFSPKASVAAMEAKEQLSAQELMESGLQIQKSPEPEVLSTQEDLFDQSNKTVSSDGCSTPSREEGGCSLASTPATTLHLLQLSGQRSLVQDSLSTNSSDLVAPSPDAFRSTPFIVPSSPTEQEGRQDKPMDTSVLSEEGGEPFQKKLQSGEPVELENPPLLPESTVSPQASTPISQSTPVFPPGSLPIPSQPQFSHDIFIPSPSLEEQSNDGKKDGDMHSSSLTVECSKTSEIEPKNSPEDLGLSLTGDSCKLMLSTSEYSQSPKMESLSSHRIDEDGENTQIEDTEPMSPVLNSKFVPAENDSILMNPAQDGEVQLSQNDDKTKGDDTDTRDDISILATGCKGREETVAEDVCIDLTCDSGSQAVPSPATRSEALSSVLDQEEAMEIKEHHPEEGSSGSEVEEIPETPCESQGEELKEENMESVPLHLSLTETQSQGLCLQKEMPKKECSEAMEVETSVISIDSPQKLAILDQELEHKEQEAWEEATSEDSSVVIVDVKEPSPRVDVSCEPLEGVEKCSDSQSWEDIAPEIEPCAENRLDTKEEKSVEYEGDLKSGTAETEPVEQDSSQPSLPLVRADDPLRLDQELQQPQTQEKTSNSLTEDSKMANAKQLSSDAEAQKLGKPSAHASQSFCESSSETPFHFTLPKEGDIIPPLTGATPPLIGHLKLEPKRHSTPIGISNYPESTIATSDVMSESMVETHDPILGSGKGDSGAAPDVDDKLCLRMKLVSPETEASEESLQFNLEKPATGERKNGSTAVAESVASPQKTMSVLSCICEARQENEARSEDPPTTPIRGNLLHFPSSQGEEEKEKLEGDHTIRQSQQPMKPISPVKDPVSPASQKMVIQGPSSPQGEAMVTDVLEDQKEGRSTNKENPSKALIERPSQNNIGIQTMECSLRVPETVSAATQTIKNVCEQGTSTVDQNFGKQDATVQTERGSGEKPVSAPGDDTESLHSQGEEEFDMPQPPHGHVLHRHMRTIREVRTLVTRVITDVYYVDGTEVERKVTEETEEPIVECQECETEVSPSQTGGSSGDLGDISSFSSKASSLHRTSSGTSLSAMHSSGSSGKGAGPLRGKTSGTEPADFALPSSRGGPGKLSPRKGVSQTGTPVCEEDGDAGLGIRQGGKAPVTPRGRGRRGRPPSRTTGTRETAVPGPLGIEDISPNLSPDDKSFSRVVPRVPDSTRRTDVGAGALRRSDSPEIPFQAAAGPSDGLDASSPGNSFVGLRVVAKWSSNGYFYSGKITRDVGAGKYKLLFDDGYECDVLGKDILLCDPIPLDTEVTALSEDEYFSAGNERSRVCRDFFVPWGNNTLLC

SEQ ID NO: 905734 - protein, 947 aa, Homo sapiens [sequence omitted]

SEQ ID NO: 905735 - protein, 752 aa, Homo sapiens
MPGEQMDPTGSQLDSDFSQQDTPCLIIEDSQPESQVLEDDSGSHFSMLSRHLPNLQTHKENPVLDVVSNPEQTAGEERGDGNSGFNEHLKENKVADPVDSSNLDTCGSISQVIEQLPQPNRTSSVLGMSVESAPAVEEEKGEELEQKEKEKEEDTSGNTTHSLGAEDTASSQLGFGVLELSQSQDVEENTVPYEVDKEQLQSVTTNSGYTRLSDVDANTAIKHEEQSNEDIPIAEQSSKDIPVTAQPSKDVHVVKEQNPPPARSEDMPFSPKASVAAMEAKEQLSAQELMESGLQIQKSPEPEVLSTQEDLFDQSNKTVSSDGCSTPSREEGGCSLASTPATTLHLLQLSGQRSLVQDSLSTNSSDLVAPSPDAFRSTPFIVPSSPTEQEGRQDKPMDTSVLSEEGGEPFQKKLQSGEPVELENPPLLPESTVSPQASTPISQSTPVFPPGSLPIPSQPQFSHDIFIPSPSLEEQSNDGKKDGDMHSSSLTVECSKTSEIEPKNSPEDLGLSLTGDSCKLMLSTSEYSQSPKMESLSSHRIDEDGENTQIEDTEPMSPVLNSKFVPAENDSILMNPAQDGEVQLSQNDDKTKGDDTDTRDDISILATGCKGREETVAEDVCIDLTCDSGSQAVPSPATRSEALSSVLDQEEAMEIKEHHPEEGSSGSEVEEIPETPCESQGEELKEENMESVPLHLSLTETQSRRWLASGPWSSGSISVKEEHPLLSRPAKGVSLSLGEGEDSTPPPLVEGL

SEQ ID NO: 905736 - protein, 556 aa, Homo sapiens
MPGEQMDPTGSQLDSDFSQQDTPCLIIEDSQPESQVLEDDSGSHFSMLSRHLPNLQTHKENPVLDVVSNPEQTAGEERGDGNSGFNEHLKENKVADPVDSSNLDTCGSISQVIEQLPQPNRTSSVLGMSVESAPAVEEEKGEELEQKEKEKEEDTSGNTTHSLGAEDTASSQLGFGVLELSQSQDVEENTVPYEVDKEQLQSVTTNSGYTRLSDVDANTAIKHEEQSNEDIPIAEQSSKDIPVTAQPSKDVHVVKEQNPPPARSEDMPFSPKASVAAMEAKEQLSAQELMESGLQIQKSPEPEVLSTQEDLFDQSNKTVSSDGCSTPSREEGGCSLASTPATTLHLLQLSGQRSLVQDSLSTNSSDLVAPSPDAFRSTPFIVPSSPTEQEGRQDKPMDTSVLSEEGGEPFQKKLQSGEPVELENPPLLPESTVSPQASTPISQSTPVFPPGSLPIPSQPQFSHDIFIPSPSLEEQSNDGKKDGDMHSSSLTVECSKTSEIEPKNSPEDLGLSLTGDSCKLMLSTSEYSQSPKMESLSPGVRDLPGQYSETPFSRKR

SEQ ID NO: 905737 - protein, 1972 aa, Homo sapiens
MDPTGSQLDSDFSQQDTPCLIIEDSQPESQVLEDDSGSHFSMLSRHLPNLQTHKENPVLDVVSNPEQTAGEERGDGNSGFNEHLKENKVADPVDSSNLDTCGSISQVIEQLPQPNRTSSVLGMSVESAPAVEEEKGEELEQKEKEKEEDTSGNTTHSLGAEDTASSQLGFGVLELSQSQDVEENTVPYEVDKEQLQSVTTNSGYTRLSDVDANTAIKHEEQSNEDIPIAEQSSKDIPVTAQPSKDVHVVKEQNPPPARSEDMPFSPKASVAAMEAKEQLSAQELMESGLQIQKSPEPEVLSTQEDLFDQSNKTVSSDGCSTPSREEGGCSLASTPATTLHLLQLSGQRSLVQDSLSTNSSDLVAPSPDAFRSTPFIVPSSPTEQEGRQDKPMDTSVLSEEGGEPFQKKLQSGEPVELENPPLLPESTVSPQASTPISQSTPVFPPGSLPIPSQPQFSHDIFIPSPSLEEQSNDGKKDGDMHSSSLTVECSKTSEIEPKNSPEDLGLSLTGDSCKLMLSTSEYSQSPKMESLSSHRIDEDGENTQIEDTEPMSPVLNSKFVPAENDSILMNPAQDGEVQLSQNDDKTKGDDTDTRDDISILATGCKGREETVAEDVCIDLTCDSGSQAVPSPATRSEALSSVLDQEEAMEIKEHHPEEGSSGSEVEEIPETPCESQGEELKEENMESVPLHLSLTETQSQGLCLQKEMPKKECSEAMEVETSVISIDSPQKLAILDQELEHKEQEAWEEATSEDSSVVIVDVKEPSPRVDVSCEPLEGVEKCSDSQSWEDIAPEIEPCAENRLDTKEEKSVEYEGDLKSGTAETEPVEQDSSQPSLPLVRADDPLRLDQELQQPQTQEKTSNSLTEDSKMANAKQLSSDAEAQKLGKPSAHASQSFCESSSETPFHFTLPKEGDIIPPLTGATPPLIGHLKLEPKRHSTPIGISNYPESTIATSDVMSESMVETHDPILGSGKGDSGAAPDVDDKLCLRMKLVSPETEASEESLQFNLEKPATGERKNGSTAVAESVASPQKTMSVLSCICEARQENEARSEDPPTTPIRGNLLHFPSSQGEEEKEKLEGDHTIRQSQQPMKPISPVKDPVSPASQKMVIQGPSSPQGEAMVTDVLEDQKEGRSTNKENPSKALIERPSQNNIGIQTMECSLRVPETVSAATQTIKNVCEQGTSTVDQNFGKQDATVQTERGSGEKPVSAPGDDTESLHSQGEEEFDMPQPPHGHVLHRHMRTIREVRTLVTRVITDVYYVDGTEVERKVTEETEEPIVECQECETEVSPSQTGGSSGDLGDISSFSSKASSLHRTSSGTSLSAMHSSGSSGKGAGPLRGKTSGTEPADFALPSSRGGPGKLSPRKGVSQTGTPVCEEDGDAGLGIRQGGKAPVTPRGRGRRGRPPSRTTGTRETAVPGPLGIEDISPNLSPDDKSFSRVVPRVPDSTRRTDVGAGALRRSDSPEIPFQAAAGPSDGLDASSPGNSFVGLRVVAKWSSNGYFYSGKITRDVGAGKYKLLFDDGYECDVLGKDILLCDPIPLDTEVTALSEDEYFSAGVVKGHRKESGELYYSIEKEGQRKWYKRMAVILSLEQGNRLREQYGLGPYEAVTPLTKAADISLDNLVEGKRKRRSNVSSPATPTASSSSSTTPTRKITESPRASMGVLSGKRKLITSEEERSPAKRGRKSATVKPGAVGAGEFVSPCESGDNTGEPSALEEQRGPLPLNKTLFLGYAFLLTMATTSDKLASRSKLPDGPTGSSEEEEEFLEIPPFNKQYTESQLRAGAGYILEDFNEAQCNTAYQCLLIADQHCRTRKYFLCLASGIPCVSHVWVHDSCHANQLQNYRNYLLPAGYSLEEQRILDWQPRENPFQNLKVLLVSDQQQNFLELWSEILMTGGAASVKQHHSSAHNKDIALGVFDVVVTDPSCPASVLKCAEALQLPVVSQEWVIQCLIVGERIGFKQHPKYKHDYVSH

SEQ ID NO: 905738 - protein, 177 aa, Homo sapiens
MPGEQMDPTGSQLDSDFSQQDTPCLIIEDSQPESQVLEDDSGSHFSMLSRHLPNLQTHKENPVLKKKNCVGRGPGPPEKGFFKTPTVVWGGAAPKSRGYGEASVATQSVLPQEGTSPGQEKEGPGSISTPNIRKGPGGTPGGVWEQHYEDGRFSEHTNGSSQRGAPGQARNQISRAG

SEQ ID NO: 905739 - protein, 1977 aa, Homo sapiens; identical to SEQ ID NO: 905723

SEQ ID NO: 905740 - protein, 1806 aa, Homo sapiens [sequence omitted]

SEQ ID NO: 905741 - protein, 1806 aa, Homo sapiens [sequence omitted]

SEQ ID NO: 905742 - protein, 1806 aa, Homo sapiens [sequence omitted]

SEQ ID NO: 905743 - protein, 619 aa, Homo sapiens
MTNLSSFSSPRKGVSQTGTPVCEEDGDAGLGIRQGGKAPVTPRGRGRRGRPPSRTTGTRETAVPGPLGIEDISPNLSPDDKSFSRVVPRVPDSTRRTDVGAGALRRSDSPEIPFQAAAGPSDGLDASSPGNSFVGLRVVAKWSSNGYFYSGKITRDVGAGKYKLLFDDGYECDVLGKDILLCDPIPLDTEVTALSEDEYFSAGVVKGHRKESGELYYSIEKEGQRKWYKRMAVILSLEQGNRLREQYGLGPYEAVTPLTKAADISLDNLVEGKRKRRSNVSSPATPTASSSSSTTPTRKITESPRASMGVLSGKRKLITSEEERSPAKRGRKSATVKPGAVGAGEFVSPCESGDNTGEPSALEEQRGPLPLNKTLFLGYAFLLTMATTSDKLASRSKLPDGPTGSSEEEEEFLEIPPFNKQYTESQLRAGAGYILEDFNEAQCNTAYQCLLIADQHCRTRKYFLCLASGIPCVSHVWVHDSCHANQLQNYRNYLLPAGYSLEEQRILDWQPRENPFQNLKVLLVSDQQQNFLELWSEILMTGGAASVKQHHSSAHNKDIALGVFDVVVTDPSCPASVLKCAEALQLPVVSQEWVIQCLIVGERIGFKQHPKYKHDYVSH

SEQ ID NO: 905744 - protein, 1755 aa, Homo sapiens
MPGEQMDPTGSQLDSDFSQQDTPCLIIEDSQPESQVLEDDSGSHFSMLSRHLPNLQTHKENPVLDVVSNPEQTAGEERGDGNSGFNEHLKENKVADPVDSSNLDTCGSISQVIEQLPQPNRTSSVLGMSVESAPAVEEEKGEELEQKEKEKEEDTSGNTTHSLGAEDTASSQLGFGVLELSQSQDVEENTVPYEVDKEQLQSVTTNSGYTRLSDVDANTAIKHEEQSNEDIPIAEQSSKDIPVTAQPSKDVHVVKEQNPPPARSEDMPFSPKASVAAMEAKEQLSAQELMESGLQIQKSPEPEVLSTQEDLFDQSNKTVSSDGCSTPSREEGGCSLASTPATTLHLLQLSGQRSLVQDSLSTNSSDLVAPSPDAFRSTPFIVPSSPTEQEGRQDKPMDTSVLSEEGGEPFQKKLQSGEPVELENPPLLPESTVSPQASTPISQSTPVFPPGSLPIPSQPQFSHDIFIPSPSLEEQSNDGKKDGDMHSSSLTVECSKTSEIEPKNSPEDLGLSLTGDSCKLMLSTSEYSQSPKMESLSSHRIDEDGENTQIEDTEPMSPVLNSKFVPAENDSILMNPAQDGEVQLSQNDDKTKGDDTDTRDDISILATGCKGREETVAEDVCIDLTCDSGSQAVPSPATRSEALSSVLDQEEAMEIKEHHPEEGSSGSEVEEIPETPCESQGEELKEENMESVPLHLSLTETQSQGLCLQKEMPKKECSEAMEVETSVISIDSPQKLAILDQELEHKEQEAWEEATSEDSSVVIVDVKEPSPRVDVSCEPLEGVEKCSDSQSWEDIAPEIEPCAENRLDTKEEKSVEYEGDLKSGTAETEPVEQDSSQPSLPLVRADDPLRLDQELQQPQTQEKTSNSLTEDSKMANAKQLSSDAEAQKLGKPSAHASQSFCESSSETPFHFTLPKEGDIIPPLTGATPPLIGHLKLEPKRHSTPIGISNYPESTIATSDVMSESMVETHDPILGSGKGDSGAAPDVDDKLCLRMKLVSPETEASEESLQFNLEKPATGERKNGSTAVAESVASPQKTMSVLSCICEARQENEARSEDPPTTPIRGNLLHFPSSQGEEEKEKLEGDHTIRQSQQPMKPISPVKDPVSPASQKMVIQGPSSPQGEAMVTDVLEDQKEGRSTNKENPSKALIERPSQNNIGIQTMECSLRVPETVSAATQTIKNVCEQGTSTVDQNFGKQDATVQTERGSGEKPVSAPGDDTESLHSQGEEEFDMPQPPHGHVLHRHMRTIREVRTLVTRVITDVYYVDGTEVERKVTEETEEPIVECQECETEVSPSQTGGSSGDLGDISSFSSKASSLHRTSSGTSLSAMHSSGSSGKGAGPLRGKTSGTEPADFALPSSRGGPGKLSPRKGVSQTGTPVCEEDGDAGLGIRQGGKAPVTPRGRGRRGRPPSRTTGTRETAVPGPLGIEDISPNLSPDDKSFSRVVPRVPDSTRRTDVGAGALRRSDSPEIPFQAAAGPSDGLDASSPGNSFVGLRVVAKWSSNGYFYSGKITRDVGAGKYKLLFDDGYECDVLGKDILLCDPIPLDTEVTALSEDEYFSAGVVKGHRKESGELYYSIEKEGQRKWYKRMAVILSLEQGNRLREQYGLGPYEAVTPLTKAADISLDNLVEGKRKRRSNVSSPATPTASSSSSTTPTRKITESPRASMGVLSGKRKLITSEEERSPAKRGRKSATVKPGAVGAGEFVSPCESGDNTGEPSALEEQRGPLPLNKTLFLGYAFPYTYGDSFSYGQQELF

SEQ ID NO: 905745 - protein, 326 aa, Homo sapiens
FLAQISSSGQCLPIRSCLVLGPFGVKAFAEAMVCIPLVTVPLSFPGAVGAGEFVSPCESGDNTGEPSALEEQRGPLPLNKTLFLGYAFLLTMATTSDKLASRSKLPDGPTGSSEEEEEFLEIPPFNKQYTESQLRAGAGYILEDFNEAQCNTAYQCLLIADQHCRTRKYFLCLASGIPCVSHVWVHDSCHANQLQNYRNYLLPAGYSLEEQRILDWQPRENPFQNLKVLLVSDQQQNFLELWSEILMTGGAASVKQHHSSAHNKDIALGVFDVVVTDPSCPASVLKCAEALQLPVVSQEWVIQCLIVGERIGFKQHPKYKHDYVSH

SEQ ID NO: 905746 - protein, 1393 aa, Homo sapiens
MPGEQMDPTGSQLDSDFSQQDTPCLIIEDSQPESQVLEDDSGSHFSMLSRHLPNLQTHKENPVLDVVSNPEQTAGEERGDGNSGFNEHLKENKVADPVDSSNLDTCGSISQVIEQLPQPNRTSSVLGMSVESAPAVEEEKGEELEQKEKEKEEDTSGNTTHSLGAEDTASSQLGFGVLELSQSQDVEENTVPYEVDKEQLQSVTTNSGYTRLSDVDANTAIKHEEQSNEDIPIAEQSSKDIPVTAQPSKDVHVVKEQNPPPARSEDMPFSPKASVAAMEAKEQLSAQELMESGLQIQKSPEPEVLSTQEDLFDQSNKTVSSDGCSTPSREEGGCSLASTPATTLHLLQLSGQRSLVQDSLSTNSSDLVAPSPDAFRSTPFIVPSSPTEQEGRQDKPMDTSVLSEEGGEPFQKKLQSGEPVELENPPLLPESTVSPQASTPISQSTPVFPPGSLPIPSQPQFSHDIFIPSPSLEEQSNDGKKDGDMHSSSLTVECSKTSEIEPKNSPEDLGLSLTGDSCKLMLSTSEYSQSPKMESLSSHRIDEDGENTQIEDTEPMSPVLNSKFVPAENDSILMNPAQDGEVQLSQNDDKTKGDDTDTRDDISILATGCKGREETVAEDVCIDLTCDSGSQAVPSPATRSEALSSVLDQEEAMEIKEHHPEEGSSGSEVEEIPETPCESQGEELKEENMESVPLHLSLTETQSQGLCLQKEMPKKECSEAMEVETSVISIDSPQKLAILDQELEHKEQEAWEEATSEDSSVVIVDVKEPSPRVDVSCEPLEGVEKCSDSQSWEDIAPEIEPCAENRLDTKEEKSVEYEGDLKSGTAETEPVEQDSSQPSLPLVRADDPLRLDQELQQPQTQEKTSNSLTEDSKMANAKQLSSDAEAQKLGKPSAHASQSFCESSSETPFHFTLPKEGDIIPPLTGATPPLIGHLKLEPKRHSTPIGISNYPESTIATSDVMSESMVETHDPILGSGKGDSGAAPDVDDKLCLRMKLVSPETEASEESLQFNLEKPATGERKNGSTAVAESVASPQKTMSVLSCICEARQENEARSEDPPTTPIRGNLLHFPSSQGEEEKEKLEGDHTIRQSQQPMKPISPVKDPVSPASQKMVIQGPSSPQGEAMVTDVLEDQKEGRSTNKENPSKALIERPSQNNIGIQTMECSLRVPETVSAATQTIKNVCEQGTSTVDQNFGKQDATVQTERGSGEKPVSAPGDDTESLHSQGEEEFDMPQPPHGHVLHRHMRTIREVRTLVTRVITDVYYVDGTEVERKVTEETEEPIVECQECETEVSPSQTGGSSGDLGDISSFSSKASSLHRTSSGTSLSAMHSSGSSGKGAGPLRGKTSGTEPADFALPSSRGGPGKLRCRQGLQRERATAGAGTASVSVDAAAN

SEQ ID NO: 905747 - protein, 780 aa, Homo sapiens
MPGEQMDPTGSQLDSDFSQQDTPCLIIEDSQPESQVLEDDSGSHFSMLSRHLPNLQTHKENPVLDVVSNPEQTAGEERGDGNSGFNEHLKENKVADPVDSSNLDTCGSISQVIEQLPQPNRTSSVLGMSVESAPAVEEEKGEELEQKEKEKEEDTSGNTTHSLGAEDTASSQLGFGVLELSQSQDVEENTVPYEVDKEQLQSVTTNSGYTRLSDVDANTAIKHEEQSNEDIPIAEQSSKDIPVTAQPSKDVHVVKEQNPPPARSEDMPFSPKASVAAMEAKEQLSAQELMESGLQIQKSPEPEVLSTQEDLFDQSNKTVSSDGCSTPSREEGGCSLASTPATTLHLLQLSGQRSLVQDSLSTNSSDLVAPSPDAFRSTPFIVPSSPTEQEGRQDKPMDTSVLSEEGGEPFQKKLQSGEPVELENPPLLPESTVSPQASTPISQSTPVFPPGSLPIPSQPQFSHDIFIPSPSLEEQSNDGKKDGDMHSSSLTVECSKTSEIEPKNSPEDLGLSLTGDSCKLMLSTSEYSQSPKMESLSSHRIDEDGENTQIEDTEPMSPVLNSKFVPAENDSILMNPAQDGEVQLSQNDDKTKGDDTDTRDDISILATGCKGREETVAEDVCIDLTCDSGSQAVPSPATRSEALSSVLDQEEAMEIKEHHPEEGSSGSEVEEIPETPCESQGEELKEENMESVPLHLSLTETQSQGLCLQKEMPKKECSEAMEVETSVISIDSPQKLAILDQELEHKEQEAWEEATSEDSSVVIVDVKEPSPRVDVSCQPS

SEQ ID NO: 905748 - protein, 110 aa, Homo sapiens
ETEEPIVECQECETEVSPSQTGGSSGDLGDISSFSSKASSLHRTSSGTSLSAMHSSGSSGKGAGPLRGKTSGTEPADFALPSSRGGPGKLRCRQGLQRERATAGAGLLTF

SEQ ID NO: 905749 - protein, 315 aa, Homo sapiens
MEARAQSGNGSQPLLQTPRDGGRQRGEPDPRDALTQQVHVLSLDQIRAIRNTNEYTEGPTVVPRPGLKPAPRPSTQHKHERLHGLPEHRQPPRLQHSQVHSSARAPLSRSISTVSSGSRSSTRTSTSSSSSEQRLLGSSFSSGPVADGIIRVQPKSELKPGELKPLSKEDLGLHAYRCEDCGKCKCKECTYPRPLPSDWICDKQCLCSAQNVIDYGTCVCCVKGLFYHCSNDDEDNCADNPCSCSQSHCCTRWSAMGVMSLFLPCLWCYLPAKGCLKLCQGCYDRVNRPGCRCKNSNTVCCKVPTVPPRNFEKPT

SEQ ID NO: 905750 - protein, 145 aa, Homo sapiens
HEGKAVFFSHSLICQEKGLAVGASASCSLRKKRKYSACACRRGVVSSSEPRSVHQRGIWLRILFFSPADCSEVGLFFLLVEGKVQGEAVPRRGAGGAGGHRLPASGAGDFQGEKKAGCRVEGVPASAPCGQSSPERVGASPCLAP

SEQ ID NO: 905751 - protein, 315 aa, Homo sapiens; identical to SEQ ID NO: 905749

SEQ ID NO: 905752 - protein, 315 aa, Homo sapiens; identical to SEQ ID NO: 905749

SEQ ID NO: 905753 - protein, 315 aa, Homo sapiens; identical to SEQ ID NO: 905749

SEQ ID NO: 905754 - protein, 668 aa, Homo sapiens
PGRPSPTRFRPRLGSPASASAAARGCPAMALSRGLPRELAEAVAGGRVLVVGAGGIGCELLKNLVLTGFSHIDLIDLDTIDVSNLNRQFLFQKKHVGRSKAQVAKESVLQFYPKANIVAYHDSIMNPDYNVEFFRQFILVMNALDNRAARNHVNRMCLAADVPLIESGTAGYLGQVTTIKKGVTECYECHPKPTQRTFPGCTIRNTPSEPIHCIVWAKYLFNQLFGEEDADQEVSPDRADPEAAWEPTEAEARARASNEDGDIKRISTKEWAKSTGYDPVKLFTKLFKDDIRYLLTMDKLWRKRKPPVPLDWAEVQSQGEETNASDQQNEPQLGLKDQQVLDVKSYARLFSKSIETLRVHLAEKGDGAELIWDKDDPSAMDFVTSAANLRMHIFSMNMKSRFDIKSMAGNIIPAIATTNAVIAGLIVLEGLKILSGKIDQCRTIFLNKQPNPRKKLLVPCALDPPNPNCYVCASKPEVTVRLNVHKVTVLTLQDKIVKEKFAMVAPDVQIEDGKGTILISSEEGETEANNHKKLSEFGIRNGSRLQADDFLQDYTLLINILHSEDLGKDVEFEVVGDAPEKVGPKQAEDAAKSITNGSDDGAQPSTSTAQEQDDVLIVDSDEEDSSNNADVSEEERSRKRKLDEKENLSAKRSRIEQKEELDDVIALD

SEQ ID NO: 905755 - protein, 260 aa, Homo sapiens
QAALPPPASGRGSVLPPPPPPRLVVVPPWHCRGGCPGSWLRRWPGAGCWWWGRAASAASSSRISCSPVSPTSTCHQGLTILLRLVLKVWAQAILSLCPPKVLGLQIDLDTIDVSNLNRQFLFQKKHVGRSKAQVAKESVLQFYPKANIVAYHDSIMNPDYNVEFFRQFILVMNALDNRAARNHVNRMCLAADVPLIESGTAGYLGQVTTIKKGVTECYECHPKPTQRTFPGCTIRNTPSEPIHCIVWAKYLFNQCWGTTM

SEQ ID NO: 905756 - protein, 668 aa, Homo sapiens; identical to SEQ ID NO: 905754

SEQ ID NO: 905757 - protein, 668 aa, Homo sapiens; identical to SEQ ID NO: 905754

SEQ ID NO: 905758 - protein, 610 aa, Homo sapiens
DSRGVPRIDGFSHIDLIDLDTIDVSNLNRQFLFQKKHVGRSKAQVAKESVLQFYPKANIVAYHDSIMNPDYNVEFFRQFILVMNALDNRAARNHVNRMCLAADVPLIESGTAGYLGQVTTIKKGVTECYECHPKPTQRTFPGCTIRNTPSEPIHCIVWAKYLFNQLFGEEDADQEVSPDRADPEAAWEPTEAEARARASNEDGDIKRISTKEWAKSTGYDPVKLFTKLFKDDIRYLLTMDKLWRKRKPPVPLDWAEVQSQGEETNASDQQNEPQLGLKDQQVLDVKSYARLFSKSIETLRVHLAEKGDGAELIWDKDDPSAMDFVTSAANLRMHIFSMNMKSRFDIKSMAGNIIPAIATTNAVIAGLIVLEGLKILSGKIDQCRTIFLNKQPNPRKKLLVPCALDPPNPNCYVCASKPEVTVRLNVHKVTVLTLQDKIVKEKFAMVAPDVQIEDGKGTILISSEEGETEANNHKKLSEFGIRNGSRLQADDFLQDYTLLINILHSEDLGKDVEFEVVGDAPEKVGPKQAEDAAKSITNGSDDGAQPSTSTAQEQDDVLIVDSDEEDSSNNADVSEEERSRKRKLDEKENLSAKRSRIEQKEELDDVIALD

SEQ ID NO: 905759 - protein, 528 aa, Homo sapiens [sequence omitted]

SEQ ID NO: 905760 - protein, 582 aa, Homo sapiens
DSRGVPRIDGFSHIDLVAKESVLQFYPKANIVAYHDSIMNPDYNVEFFRQFILVMNALDNRAARNHVNRMCLAADVPLIESGTAGYLGQVTTIKKGVTECYECHPKPTQRTFPGCTIRNTPSEPIHCIVWAKYLFNQLFGEEDADQEVSPDRADPEAAWEPTEAEARARASNEDGDIKRISTKEWAKSTGYDPVKLFTKLFKDDIRYLLTMDKLWRKRKPPVPLDWAEVQSQGEETNASDQQNEPQLGLKDQQVLDVKSYARLFSKSIETLRVHLAEKGDGAELIWDKDDPSAMDFVTSAANLRMHIFSMNMKSRFDIKSMAGNIIPAIATTNAVIAGLIVLEGLKILSGKIDQCRTIFLNKQPNPRKKLLVPCALDPPNPNCYVCASKPEVTVRLNVHKVTVLTLQDKIVKEKFAMVAPDVQIEDGKGTILISSEEGETEANNHKKLSEFGIRNGSRLQADDFLQDYTLLINILHSEDLGKDVEFEVVGDAPEKVGPKQAEDAAKSITNGSDDGAQPSTSTAQEQDDVLIVDSDEEDSSNNADVSEEERSRKRKLDEKENLSAKRSRIEQKEELDDVIALD

SEQ ID NO: 905761 - protein, 593 aa, Homo sapiens
AGNNHLVRKTNTKNISGEQSLGRSKAQVAKESVLQFYPKANIVAYHDSIMNPDYNVEFFRQFILVMNALDNRAARNHVNRMCLAADVPLIESGTAGYLGQVTTIKKGVTECYECHPKPTQRTFPGCTIRNTPSEPIHCIVWAKYLFNQLFGEEDADQEVSPDRADPEAAWEPTEAEARARASNEDGDIKRISTKEWAKSTGYDPVKLFTKLFKDDIRYLLTMDKLWRKRKPPVPLDWAEVQSQGEETNASDQQNEPQLGLKDQQVLDVKSYARLFSKSIETLRVHLAEKGDGAELIWDKDDPSAMDFVTSAANLRMHIFSMNMKSRFDIKSMAGNIIPAIATTNAVIAGLIVLEGLKILSGKIDQCRTIFLNKQPNPRKKLLVPCALDPPNPNCYVCASKPEVTVRLNVHKVTVLTLQDKIVKEKFAMVAPDVQIEDGKGTILISSEEGETEANNHKKLSEFGIRNGSRLQADDFLQDYTLLINILHSEDLGKDVEFEVVGDAPEKVGPKQAEDAAKSITNGSDDGAQPSTSTAQEQDDVLIVDSDEEDSSNNADVSEEERSRKRKLDEKENLSAKRSRIEQKEELDDVIALD

SEQ ID NO: 905762 - protein, 524 aa, Homo sapiens
PGRPSPTRFRPRLGSPASASAAARGCPAMALSRGLPRELAEAVAGGRVLVVGAGGIGCELLKNLVLTGFSHIDLIDLDTIDVSNLNRQFLFQKKHVGRSKAQVAKESVLQFYPKANIVAYHDSIMNPDYNVEFFRQFILVMNALDNRAARNHVNRMCLAADVPLIESGTAGYLGQVTTIKKGVTECYECHPKPTQRTFPGCTIRNTPSEPIHCIVWAKYLFNQLFGEEDADQEVSPDRADPEAAWEPTEAEARARASNEDGDIKRISTKEWAKSTGYDPVKLFTKLFKDDIRYLLTMDKLWRKRKPPVPLDWAEVQSQGEETNASDQQNEPQLGLKDQQVLDVKSYARLFSKSIETLRVHLAEKGDGAELIWDKDDPSAMDFVTSAANLRMHIFSMNMKSRFDIKSMAGNIIPAIATTNAVIAGLIVLEGLKILSGKIDQCRTIFLNKQPNPRKKLLVPCALDPPNPNCYVCASKPEVTVRLNVHKVTVLTLQDKLIITRSCQNLELEMAAGFKQMTSSRTILY

SEQ ID NO: 905763 - protein, 552 aa, Homo sapiens
PGRPSPTRFRPRLGSPASASAAARGCPAMALSRGLPRELAEAVAGGRVLVVGAGGIGCELLKNLVLTGFSHIDLIDLDTIDVSNLNRQFLFQKKHVGRSKAQVAKESVLQFYPKANIVAYHDSIMNPDYNVEFFRQFILVMNALDNRAARNHVNRMCLAADVPLIESGTAGYLGQVTTIKKGVTECYECHPKPTQRTFPGCTIRNTPSEPIHCIVWAKYLFNQLFGEEDADQEVSPDRADPEAAWEPTEAEARARASNEDGDIKRISTKEWAKSTGYDPVKLFTKLFKDDIRYLLTMDKLWRKRKPPVPLDWAEVQSQGEETNASDQQNEPQLGLKDQQVLDVKSYARLFSKSIETLRVHLAEKGDGAELIWDKDDPSAMDFVTSAANLRMHIFSMNMKSRFDIKSMAGNIIPAIATTNAVIAGLIVLEGLKILSGKIDQCRTIFLNKQPNPRKKLLVPCALDPPNPNCYVCASKPEVTVRLNVHKVTVLTLQDKIVKEKFAMVAPDVQIEDGKGTILISSEEGETEANNHKKLSEFGIRNGSRLKSKMTFS

SEQ ID NO: 905764 - protein, 358 aa, Homo sapiens
LIYIFFSLGEETNASDQQNEPQLGLKDQQVLDVKSYARLFSKSIETLRVHLAEKGDGAELIWDKDDPSAMDFVTSAANLRMHIFSMNMKSRFDIKSMAGNIIPAIATTNAVIAGLIVLEGLKILSGKIDQCRTIFLNKQPNPRKKLLVPCALDPPNPNCYVCASKPEVTVRLNVHKVTVLTLQDKIVKEKFAMVAPDVQIEDGKGTILISSEEGETEANNHKKLSEFGIRNGSRLQADDFLQDYTLLINILHSEDLGKDVEFEVVGDAPEKVGPKQAEDAAKSITNGSDDGAQPSTSTAQEQDDVLIVDSDEEDSSNNADVSEEERSRKRKLDEKENLSAKRSRIEQKEELDDVIALD

SEQ ID NO: 905765 - protein, 166 aa, Homo sapiens
MVAPDVQIEDGKGTILISSEEGETEANNHKKLSEFGIRNGSRLQADDFLQDYTLLINILHSEDLGKDVEFEVVGDAPEKVGPKQAEDAAKSITNGSDDGAQPSTSTAQEQDDVLIVDSDEEDSSNNADVSEEERSRKRKLDEKENLSAKRSRIEQKEELDDVIALD

SEQ ID NO: 905766 - protein, 121 aa, Homo sapiens
GFGISPRSFIDQTSFIEDLGKDVEFEVVGDAPEKVGPKQAEDAAKSITNGSDDGAQPSTSTAQEQDDVLIVDSDEEDSSNNADVSEEERSRKRKLDEKENLSAKRSRIEQKEELDDVIALD

SEQ ID NO: 905767 - protein, 337 aa, Homo sapiens
PGRPSPTRFRPRLGSPASASAAARGCPAMALSRGLPRELAEAVAGGRVLVVGAGGIGCELLKNLVLTGFSHIDLIDLDTIDVSNLNRQFLFQKKHVGRSKAQVAKESVLQFYPKANIVAYHDSIMNPDYNVEFFRQFILVMNALDNRAARNHVNRMCLAADVPLIESGTAGYLGQVTTIKKGVTECYECHPKPTQRTFPGCTIRNTPSEPIHCIVWAKYLFNQLFGEEDADQEVSPDRADPEAAWEPTEAEARARASNEDGDIKRISTKEWAKSTGYDPVKLFTKLFKDDIRYLLTMDKLWRKRKPPVPLDWAEVQSQGRSKRTASGLYITAERNLW

SEQ ID NO: 905768 - protein, 131 aa, Homo sapiens
MALSRGLPRELAEAVAGGRVLVVGAGGIGCELLKNLVLTGFSHIDLIDLDTIDVSNLNRQFLFQKKHVGRSKAQVAKESVLQFYPKANIVAYHDSIMNPDYNVEFFRQFILVMNALDNRATLTIATRDPLD

SEQ ID NO: 905769 - protein, 640 aa, Homo sapiens
MALSRGLPRELAEAVAGGRVLVVGAGGIGCELLKNLVLTGFSHIDLIDLDTIDVSNLNRQFLFQKKHVGRSKAQVAKESVLQFYPKANIVAYHDSIMNPDYNVEFFRQFILVMNALDNRAARNHVNRMCLAADVPLIESGTAGYLGQVTTIKKGVTECYECHPKPTQRTFPGCTIRNTPSEPIHCIVWAKYLFNQLFGEEDADQEVSPDRADPEAAWEPTEAEARARASNEDGDIKRISTKEWAKSTGYDPVKLFTKLFKDDIRYLLTMDKLWRKRKPPVPLDWAEVQSQGEETNASDQQNEPQLGLKDQQVLDVKSYARLFSKSIETLRVHLAEKGDGAELIWDKDDPSAMDFVTSAANLRMHIFSMNMKSRFDIKSMAGNIIPAIATTNAVIAGLIVLEGLKILSGKIDQCRTIFLNKQPNPRKKLLVPCALDPPNPNCYVCASKPEVTVRLNVHKVTVLTLQDKIVKEKFAMVAPDVQIEDGKGTILISSEEGETEANNHKKLSEFGIRNGSRLQADDFLQDYTLLINILHSEDLGKDVEFEVVGDAPEKVGPKQAEDAAKSITNGSDDGAQPSTSTAQEQDDVLIVDSDEEDSSNNADVSEEERSRKRKLDEKENLSAKRSRIEQKEELDDVIALD

SEQ ID NO: 905770 - protein, 668 aa, Homo sapiens; identical to SEQ ID NO: 905754

SEQ ID NO: 905771 - protein, 699 aa, Homo sapiens
QAALPPPASGRGSVLPPPPPPRLVVVPPWHCRGGCPGSWLRRWPGAGCWWWGRAASAASSSRISCSPVSPTSTCHQGLTILLRLVLKVWAQAILSLCPPKVLGLQIDLDTIDVSNLNRQFLFQKKHVGRSKAQVAKESVLQFYPKANIVAYHDSIMNPDYNVEFFRQFILVMNALDNRAARNHVNRMCLAADVPLIESGTAGYLGQVTTIKKGVTECYECHPKPTQRTFPGCTIRNTPSEPIHCIVWAKYLFNQLFGEEDADQEVSPDRADPEAAWEPTEAEARARASNEDGDIKRISTKEWAKSTGYDPVKLFTKLFKDDIRYLLTMDKLWRKRKPPVPLDWAEVQSQGEETNASDQQNEPQLGLKDQQVLDVKSYARLFSKSIETLRVHLAEKGDGAELIWDKDDPSAMDFVTSAANLRMHIFSMNMKSRFDIKSMAGNIIPAIATTNAVIAGLIVLEGLKILSGKIDQCRTIFLNKQPNPRKKLLVPCALDPPNPNCYVCASKPEVTVRLNVHKVTVLTLQDKIVKEKFAMVAPDVQIEDGKGTILISSEEGETEANNHKKLSEFGIRNGSRLQADDFLQDYTLLINILHSEDLGKDVEFEVVGDAPEKVGPKQAEDAAKSITNGSDDGAQPSTSTAQEQDDVLIVDSDEEDSSNNADVSEEERSRKRKLDEKENLSAKRSRIEQKEELDDVIALD

SEQ ID NO: 905772 - protein, 606 aa, Homo sapiens
FSYDVKTPATFDESCYMKKSLPLNRQFLFQKKHVGRSKAQVAKESVLQFYPKANIVAYHDSIMNPDYNVEFFRQFILVMNALDNRAARNHVNRMCLAADVPLIESGTAGYLGQVTTIKKGVTECYECHPKPTQRTFPGCTIRNTPSEPIHCIVWAKYLFNQLFGEEDADQEVSPDRADPEAAWEPTEAEARARASNEDGDIKRISTKEWAKSTGYDPVKLFTKLFKDDIRYLLTMDKLWRKRKPPVPLDWAEVQSQGEETNASDQQNEPQLGLKDQQVLDVKSYARLFSKSIETLRVHLAEKGDGAELIWDKDDPSAMDFVTSAANLRMHIFSMNMKSRFDIKSMAGNIIPAIATTNAVIAGLIVLEGLKILSGKIDQCRTIFLNKQPNPRKKLLVPCALDPPNPNCYVCASKPEVTVRLNVHKVTVLTLQDKIVKEKFAMVAPDVQIEDGKGTILISSEEGETEANNHKKLSEFGIRNGSRLQADDFLQDYTLLINILHSEDLGKDVEFEVVGDAPEKVGPKQAEDAAKSITNGSDDGAQPSTSTAQEQDDVLIVDSDEEDSSNNADVSEEERSRKRKLDEKENLSAKRSRIEQKEELDDVIALD

SEQ ID NO: 905773 - protein, 668 aa, Homo sapiens; identical to SEQ ID NO: 905754

SEQ ID NO: 905774 - protein, 514 aa, Homo sapiens
MTRKFVKRSIFLSGTAGYLGQVTTIKKGVTECYECHPKPTQRTFPGCTIRNTPSEPIHCIVWAKYLFNQLFGEEDADQEVSPDRADPEAAWEPTEAEARARASNEDGDIKRISTKEWAKSTGYDPVKLFTKLFKDDIRYLLTMDKLWRKRKPPVPLDWAEVQSQGEETNASDQQNEPQLGLKDQQVLDVKSYARLFSKSIETLRVHLAEKGDGAELIWDKDDPSAMDFVTSAANLRMHIFSMNMKSRFDIKSMAGNIIPAIATTNAVIAGLIVLEGLKILSGKIDQCRTIFLNKQPNPRKKLLVPCALDPPNPNCYVCASKPEVTVRLNVHKVTVLTLQDKIVKEKFAMVAPDVQIEDGKGTILISSEEGETEANNHKKLSEFGIRNGSRLQADDFLQDYTLLINILHSEDLGKDVEFEVVGDAPEKVGPKQAEDAAKSITNGSDDGAQPSTSTAQEQDDVLIVDSDEEDSSNNADVSEEERSRKRKLDEKENLSAKRSRIEQKEELDDVIALD

SEQ ID NO: 905775 - protein, 616 aa, Homo sapiens
PGRPSPTRFRPRLGSPASASAAARGCPAMALSRGLPRELAEAVAGGRVLVVGAGGIGCELLKNLVLTGFSHIDLIDLDTIDVSNLNRQFLFQKKHVGRSKAQVAKESVLQFYPKANIVAYHDSIMNPDYNVEFFRQFILVMNALDNRAARNHVNRMCLAADVPLIESGTAGYLGQVTTIKKGVTECYECHPKPTQRTFPGCTIRNTPSEPIHCIVWAKYLFNQLFGEEDADQEVSPDRADPEAAWEPTEAEARARASNEDGDIKRISTKEWAKSTGYDPVKLFTKLFKDDIRYLLTMDKLWRKRKPPVPLDWAEVQSQGEETNASDQQNEPQLGLKDQQVLDVKSYARLFSKSIETLRVHLAEKGDGAELIWDKDDPSAMDFVTSAANLRMHIFSMNMKSRFDIKSMAGNIIPAIATTNAVIAGLIVLEGLKILSGKIDQCRTIVKEKFAMVAPDVQIEDGKGTILISSEEGETEANNHKKLSEFGIRNGSRLQADDFLQDYTLLINILHSEDLGKDVEFEVVGDAPEKVGPKQAEDAAKSITNGSDDGAQPSTSTAQEQDDVLIVDSDEEDSSNNADVSEEERSRKRKLDEKENLSAKRSRIEQKEELDDVIALD

SEQ ID NO: 905776 - protein, 668 aa, Homo sapiens; identical to SEQ ID NO: 905754

SEQ ID NO: 905777 - protein, 161 aa, Homo sapiens
MALSRGLPRELAEAVAGGRVLVVGAGGIGCELLKNLVLTGFSHIDLIDLDTIDVSNLNRQFLFQKKHVGRSKAQIFLNKQPNPRKKLLVPCALDPPNPNCYVCASKPEVTVRLNVHKVTVLTLQDKIVKEKFAMVAPDVQIEDGKGTILISSEEGETEVKT

SEQ ID NO: 905778 - protein, 450 aa, Homo sapiens
PGRPSPTRFRPRLGSPASASAAARGCPAMALSRGLPRELAEAVAGGRVLVVGAGGIGCELLKNLVLTGFSHIDLIDLDTIDVSNLNRQFLFQKKHVGRSKAQVAKESVLQFYPKANIVAYHDSIMNPDYNVEFFRQFILVMNALDNRAARNHVNRMCLAADVPLIESGTAGYLGQVTTIKKGVTECYECHPKPTQRTFPGCTIRNTPSEPIHCIVWAKYLFNQLFGEEDADQEVSPDRADPEAAWEPTEAEARARASNEDGDIKRISTKEWAKSTGYDPVKLFTKLFKDDIRYLLTMDKLWRKRKPPVPLDWAEVQSQGEETNASDQQNEPQLGLKDQQVLDVKSYARLFSKSIETLRVHLAEKGDGAELIWDKDDTIWQMDLSTSVKPQGWLFAVLNVTEVLGFRSMGGNIIPGMGVVWRTAGGISDVVQMFGEETGRHFEYNNDKIVL

SEQ ID NO: 905779 - protein, 322 aa, Homo sapiens
PGRPSPTRFRPRLGSPASASAAARGCPAMALSRGLPRELAEAVAGGRVLVVGAGGIGCELLKNLVLTGFSHIDLIDLDTIDVSNLNRQFLFQKKHVGRSKAQVAKESVLQFYPKANIVAYHDSIMNPDYNVEFFRQFILVMNALDNRAARNHVNRMCLAADVPLIESGTAGYLGQVTTIKKGVTECYECHPKPTQRTFPGCTIRNTPSEPIHCIVWAKYLFNQLFGEEDADQEVSPDRADPEAAWEPTEAEARARASNEDGDIKRISTKEWAKSTGYDPVKLFTKLFKDDIRYLLTMDKLWRKRKPPVPLDWAEVQSQGKDF

SEQ ID NO: 905780 - protein, 454 aa, Homo sapiens
MWHEARKHERKLRGMMVDYKKRAERRREYYEKIKKDPAQFLQVHGRACKVHLDSAVALAAESPVNMMPWQGDTNNMIDRFDVRAHLDHIPDYTPPLLTTISPEQESDERKCNYERYRGLVQNDFAGISEEQCLYQIYIDELYGGLQRPSEDEKKKLAEKKASIGYTYEDLQLPLQLSLQLPLSPWWGLLPFRPHARSRSRSWSRSRSRSRRYSRSRSRGRRHSGGGSRDGHRYSRSPARRGGYGPRRRSRSRSHSGDRYRRGGRGLRHHSSSRSRSSWSLSPSRSRSLTRSRSHSPSPSQSRSRSRSRSQSPSPSPAREKLTRPAASPAVGEKLKKTEPAAGKETGAAKPKLTPQEKLKLRMQKALNRQFKADKKAAQEKMIQQEHERQEREDELRAMARKIRMKERERREKEREEWERQYSRQSRSPSPRYSREYSSSRRRSRSRSRSPHYRH

SEQ ID NO: 905781 - protein, 329 aa, Homo sapiens
MWHEARKHERKLRGMMVDYKKRAERRREYYEKIKKDPAQFLQVHGRACKVHLDSAVALAAESPVNMMPWQGDTNNMIDRFDVRAHLDHIPDYTPPLLTTISPEQESDERKCNYERYRGLVQNDFAGISEEQCLYQIYIDELYGGLQRPSEDEKKKLAEKKASIGYTYEDSTVAEVEKAAEKPEEEESAAEEESNSDEDEVIPDIDVEVDVDELNQEQVADLNKQATTYGMADGDFVRMLRKDKEEAEAIKHAKALEEEKAMYSGRRSRRQRREFREKRLRGRKISPPSYAFENKGKSNEPLIKRYRRRRYRIMSYRIRALQLTHLLRRA

SEQ ID NO: 905782 - protein, 674 aa, Homo sapiens
MWHEARKHERKLRGMMVDYKKRAERRREYYEKIKKDPAQFLQVHGRACKVHLDSAVALAAESPVNMMPWQGDTNNMIDRFDVRAHLDHIPDYTPPLLTTISPEQESDERKCNYERYRGLVQNDFAGISEEQCLYQIYIDELYGGLQRPSEDEKKKLAEKKASIGYTYEDSTVAEVEKAAEKPEEEESAAEEESNSDEDEVIPDIDVEVDVDELNQEQVADLNKQATTYGMADGDFVRMLRKDKEEAEAIKHAKALEEEKAMYSGRRSRRQRREFREKRLRGRKISPPSYARRDSPTYDPYKRSPSESSSESRSRSRSPTPGREEKITFITSFGGSDEEAAAAAAAAAASGVTTGKPPAPPQPGGPAPGRNASARRRSSSSSSSSSASRTSSSRSSSRSSSRSRRGGGYYRSGRHARSRSRSWSRSRSRSRRYSRSRSRGRRHSGGGSRDGHRYSRSPARRGGYGPRRRSRSRSHSGDRYRRGGRGLRHHSSSRSRSSWSLSPSRSRSLTRSRSHSPSPSQSRSRSRSRSQSPSPSPAREKLTRPAASPAVGEKLKKTEPAAGKETGAAKPKLTPQEKLKLRMQKALNRQFKADKKAAQEKMIQQEHERQEREDELRAMARKIRMKERERREKEREEWERQYSRQSRSPSPRYSREYSSSRRRSRSRSRSPHYRH

SEQ ID NO: 905783 - protein, 587 aa, Homo sapiens
MKRSRRTQPSSCSSPEQESDERKCNYERYRGLVQNDFAGISEEQCLYQIYIDELYGGLQRPSEDEKKKLAEKKASIGYTYEDSTVAEVEKAAEKPEEEESAAEEESNSDEDEVIPDIDVEVDVDELNQEQVADLNKQATTYGMADGDFVRMLRKDKEEAEAIKHAKALEEEKAMYSGRRSRRQRREFREKRLRGRKISPPSYARRDSPTYDPYKRSPSESSSESRSRSRSPTPGREEKITFITSFGGSDEEAAAAAAAAAASGVTTGKPPAPPQPGGPAPGRNASARRRSSSSSSSSSASRTSSSRSSSRSSSRSRRGGGYYRSGRHARSRSRSWSRSRSRSRRYSRSRSRGRRHSGGGSRDGHRYSRSPARRGGYGPRRRSRSRSHSGDRYRRGGRGLRHHSSSRSRSSWSLSPSRSRSLTRSRSHSPSPSQSRSRSRSRSQSPSPSPAREKLTRPAASPAVGEKLKKTEPAAGKETGAAKPKLTPQEKLKLRMQKALNRQFKADKKAAQEKMIQQEHERQEREDELRAMARKIRMKERERREKEREEWERQYSRQSRSPSPRYSREYSSSRRRSRSRSRSPHYRH

SEQ ID NO: 905784 - protein, 674 aa, Homo sapiens; identical to SEQ ID NO: 905782

SEQ ID NO: 905785 - protein, 649 aa, Homo sapiens
MWHEARKHERKLRGMMVDYKKRAERRREYYEKIKKDPAQFLQVHGRACKVHLDSAVALAAESPVNMMPWQGDTNNMIDRFDVRAHLDHIPDYTPPLLTTISPEQESDERKCNYERYRGLVQNDFAGISEEQCLYQIYIDELYGGLQRPSEDEKKKLAEKKASIGYTYEDSTVAEVEKAAEKPEEEESAAEEESNSDEDEVIPDIDVEVDVDELNQEQVADLNKQATTYGMADGDFVRMLRKDKEEAEAIKHAKALEEEKAMYSGRRSRRQRREFREKRLRGRKISPPSYARRDSPTYDPYKRSPSESSSESRSRSRSPTPGREEKITFITSFGGSDEEAAAAAAAAAASGVTTGKPPAPPQPGGPAPGRNASARRRSSSSSSSSSASRTSSSRSSSRSSSRSRRGGGYYRSGRHARSRSRSWSRSRSRSRRYSRSRSRGRRHSGGGSRDGHRYSRSPARRGGYGPRRRSRSRSHSGDRYRRGGRGLRHHSSSRSRSSWSLSPSRSRSLTRSRSHSPSPSQSRSRSRSRSQSPSPSPAREKLTRPAASPAVGEKLKKTEPAAGKETGAAKPKLTPQEKLKLRMQKALNRQFKADKKAAQEKMIQQEHERQVKWEREGWGDGWVLAWPRPHSPVCCRSGKTSFEPWPARSA

SEQ ID NO: 905786 - protein, 230 aa, Homo sapiens
GSGPRVGCGWGPWSLTVLLPPCCIPRSRSHSGDRYRRGGRGLRHHSSSRSRSSWSLSPSRSRSLTRSRSHSPSPSQSRSRSRSRSQSPSPSPAREKLTRPAASPAVGEKLKKTEPAAGKETGAAKPKLTPQEKLKLRMQKALNRQFKADKKAAQEKMIQQEHERQEREDELRAMARKIRMKERERREKEREEWERQYSRQSRSPSPRYSREYSSSRRRSRSRSRSPHYRH

SEQ ID NO: 905787 - protein, 700 aa, Homo sapiens
MWHEARKHERKLRGMMVDYKKRAERRREYYEKIKKDPAQFLQVHGRACKVHLDSAVALAAESPVNMMPWQGDTNNMIDRFDVRAHLDHIPDYTPPLLTTISPEQESDERKCNYERYRGLVQNDFAGISEEQCLYQIYIDELYGGLQRPSEDEKKKLAEKKASIGYTYEDSTVAEVEKAAEKPEEEESAAEEESNSDEDEVIPDIDVEVDVDELNQEQVADLNKQATTYGMADGDFVRMLRKDKEEAEAIKHAKALEEEKAMYSGRRSRRQRREFREKRLRGRKISPPSYARRDSPTYDPYKRSPSESSSESRSRSRSPTPGREEKITFITSFGGSDEEAAAAAAAAAASGVTTGKPPAPPQPGGPAPGRNASARRRSSSSSSSSSASRTSSSRSSSRSSSRSRRGGGYYRSGRHARSRSRSWSRSRSRSRRYSRSRSRGRRHSGGGSRDGHRYSRSPARRGGYGPRRRSRSRSHSGDRYRRGGRGLRHHSSSRSRSSWSLSPSRSRSLTRSRSHSPSPSQSRSRSRSRSQSPSPSPAREKLTRPAASPAVGEKLKKTEPAAGKETGAAKPKLTPQEKLKLRMQKALNRQFKADKKAAQEKMIQQEHERQEREDELRAMARKIRMKVLEAPALPEFSVSSVPGQMLMPCLRRERERREKEREEWERQYSRQSRSPSPRYSREYSSSRRRSRSRSRSPHYRH

SEQ ID NO: 905788 - protein, 629 aa, Homo sapiens
MWHEARKHERKLRGMMVDYKKRAERRREYYEKIKKDPAQFLQVHGRACKVHLDSAVALAAESPVNMMPWQGDTNNMIDRFDVRAHLDHIPDYTPPLLTTISPEQESDERKCNYERYRGLVQNDFAGISEEQCLYQIYIDELYGGLQRPSEDEKKKLAEKKASIGYTYEDSTVAEVEKAAEKPEEEESAAEEESNSDEDEVIPDIDVEVDVDELNQEQVADLNKQATTYGMADGDFVRMLRKDKEEAEAIKHAKALEEEKAMYSGRRSRRQRREFREKRLRGRKISPPSYARRDSPTYDPYKRSPSESSSESRSRSRSPTPGREEKITFITSFGGSDEEAAAAAAAAAASGVTTGKPPAPPQPGGPAPGRNASARSVTLTPPALRPGHHGGYPGQRGAAAQACADRPSVPRLRRRSSSSSSSSSASRTSSSRSSSRSSSRSRRGGGYYRSGRHARSRSRSWSRSRSRSRRYSRSRSRGRRHSGGGSRDGHRYSRSPARRGGYGPRRRSRSRSHSGDRYRRGGRGLRHHSSSRSRSSWSLSPSRSRSLTRSRSHSPSPSQSRSRSRSRSQSPSPSPAREKLTRPAASPAVGEKLKKTEPAAGKETGAAKVSKNLELARLIPVSSSAQELGP

SEQ ID NO: 905789 - protein, 367 aa, Homo sapiens
MWHEARKHERKLRGMMVDYKKRAERRREYYEKIKKDPAQFLQVHGRACKVHLDSAVALAAESPVNMMPWQGDTNNMIDRFDVRAHLDHIPDYTPPLLTTISPEQESDERKCNYERYRGLVQNDFAGISEEQCLYQIYIDELYGGLQRPSEDEKKKLAEKKASIGYTYEDSTVAEVEKAAEKPEEEESAAEEESNSDEDEVIPDIDVEVDVDELNQEQVADLNKQATTYGMADGDFVRMLRKDKEEAEAIKHAKALEEEKAMYSGRRSRRQRREFREKRLRGRKISPPSYARRDSPTYDPYKRSPSESSSESRSRSRSPTPGREEKITFITSFGGSDEEAAAAAAAAAASGVTVGGGEDKGVGKGLKL

SEQ ID NO: 905790 - protein, 329 aa, Homo sapiens; identical to SEQ ID NO: 905781

SEQ ID NO: 905791 - protein, 256 aa, Homo sapiens
GSGPRVGCGWGPWSLTVLLPPCCIPRSRSHSGDRYRRGGRGLRHHSSSRSRSSWSLSPSRSRSLTRSRSHSPSPSQSRSRSRSRSQSPSPSPAREKLTRPAASPAVGEKLKKTEPAAGKETGAAKPKLTPQEKLKLRMQKALNRQFKADKKAAQEKMIQQEHERQEREDELRAMARKIRMKVLEAPALPEFSVSSVPGQMLMPCLRRERERREKEREEWERQYSRQSRSPSPRYSREYSSSRRRSRSRSRSPHYRH

SEQ ID NO: 905792 - protein, 354 aa, Homo sapiens
MWHEARKHERKLRGMMVDYKKRAERRREYYEKIKKDPAQFLQVHGRACKVHLDSAVALAAESPVNMMPWQGDTNNMIDRFDVRAHLDHIPDYTPPLLTTMEATSQGVARHSVIPRSPCSFPSLPVTFLGAVPIWYRPEPEGDASFPFLLAWGGIHSFSLISRSRPSLKLSPEQESDERKCNYERYRGLVQNDFAGISEEQCLYQIYIDELYGGLQRPSEDEKKKLAEKKASIGYTYEDSTVAEVEKAAEKPEEEESAAEEESNSDEDEVIPDIDRWGPLSALPTCSPWASFLCLVPHPLWGTPCLRTVSLSLPRPRAHQPPAAPVSLLSSSVPAFLCLTHLSFLGCYFYDLFPS

SEQ ID NO: 905793 - protein, 674 aa, Homo sapiens; identical to SEQ ID NO: 905782

SEQ ID NO: 905794 - protein, 136 aa, Homo sapiens
PASSPPSAQADASGEAETEDAEGAEQAEAIKHAKALEEEKAMYSGRRSRRQRREFREKRLRGRKISPPSYARRDSPTYDPYKRSPSESSSESRSRSRSPTPGREEKITFITSFGGSDEEAAAAAAAAAASGVTGGG

SEQ ID NO: 905795 - protein, 743 aa, Homo sapiens
MWHEARKHERKLRGMMVDYKKRAERRREYYEKIKKDPAQFLQVHGRACKVHLDSAVALAAESPVNMMPWQGDTNNMIDRFDVRAHLDHIPDYTPPLLTTMEATSQGVARHSVIPRSPCSFPSLPVTFLGAVPIWYRPEPEGDASFPFLLAWGGIHSFSLISRSRPSLKLSPEQESDERKCNYERYRGLVQNDFAGISEEQCLYQIYIDELYGGLQRPSEDEKKKLAEKKASIGYTYEDSTVAEVEKAAEKPEEEESAAEEESNSDEDEVIPDIDVEVDVDELNQEQVADLNKQATTYGMADGDFVRMLRKDKEEAEAIKHAKALEEEKAMYSGRRSRRQRREFREKRLRGRKISPPSYARRDSPTYDPYKRSPSESSSESRSRSRSPTPGREEKITFITSFGGSDEEAAAAAAAAAASGVTTGKPPAPPQPGGPAPGRNASARRRSSSSSSSSSASRTSSSRSSSRSSSRSRRGGGYYRSGRHARSRSRSWSRSRSRSRRYSRSRSRGRRHSGGGSRDGHRYSRSPARRGGYGPRRRSRSRSHSGDRYRRGGRGLRHHSSSRSRSSWSLSPSRSRSLTRSRSHSPSPSQSRSRSRSRSQSPSPSPAREKLTRPAASPAVGEKLKKTEPAAGKETGAAKPKLTPQEKLKLRMQKALNRQFKADKKAAQEKMIQQEHERQEREDELRAMARKIRMKERERREKEREEWERQYSRQSRSPSPRYSREYSSSRRRSRSRSRSPHYRH

SEQ ID NO: 905796 - protein, 433 aa, Homo sapiens
MVVSQVLVQSWVSTALQAPSTRLVSRVAVARAGAAVDLLCVLFPKRLREPELVSLLLPTRRSPSESSSESRSRSRSPTPGREEKITFITSFGGSDEEAAAAAAAAAASGVTTGKPPAPPQPGGPAPGRNASARRRSSSSSSSSSASRTSSSRSSSRSSSRSRRGGGYYRSGRHARSRSRSWSRSRSRSRRYSRSRSRGRRHSGGGSRDGHRYSRSPARRGGYGPRRRSRSRSHSGDRYRRGGRGLRHHSSSRSRSSWSLSPSRSRSLTRSRSHSPSPSQSRSRSRSRSQSPSPSPAREKLTRPAASPAVGEKLKKTEPAAGKETGAAKPKLTPQEKLKLRMQKALNRQFKADKKAAQEKMIQQEHERQEREDELRAMARKIRMKERERREKEREEWERQYSRQSRSPSPRYSREYSSSRRRSRSRSRSPHYRH

SEQ ID NO: 905797 - protein, 649 aa, Homo sapiens; identical to SEQ ID NO: 905785

SEQ ID NO: 905798 - protein, 474 aa, Homo sapiens [sequence omitted]

SEQ ID NO: 905799 - protein, 603 aa, Homo sapiens
MWHEARKHERKLRGMMVDYKKRAERRREYYEKIKKDPAQFLQVHGRACKVHLDSAVALAAESPVNMMPWQGDTNNMIDRFDVRAHLDHIPDYTPPLLTTISPEQESDERKCNYERYRGLVQNDFAGISEEQCLYQIYIDELYGGLQRPSEDEKKKLAEKKASIGYTYEDSTVAEVEKAAEKPEEEESAAEEESNSDEDEVIPDIDVEVDVDELNQEQVADLNKQATTYGMADGDFVRMLRKDKEEAEAIKHAKALEEEKAMYSGRRSRRQRREFREKRLRGRKISPPSYARRDSPTYDPYKRSPSESSSESRSRSRSPTPGREEKITFITSFGGSDEEAAAAAAAAAASGVTTGKPPAPPQPGGPAPGRNASARSVTLTPPALRPGHHGGYPGQRGAAAQACADRPSVPRLRRRSSSSSSSSSASRTSSSRSSSRSSSRSRRGGGYYRSGRHARSRSRSWSRSRSRSRRYSRSRSRGRRHSGGGSRDGHRYSRSPARRGGYGPRRRSRSRSHSGDRYRRGGRGLRHHSSSRSRSSWSLSPSRSRSLTRSRSHSPSPSQSRSRSRSRSQSPSALKVPIPKPPLPTLGRRVGGGEDKGVGKGLKL

SEQ ID NO: 905800 - protein, 293 aa, Homo sapiens
MWHEARKHERKLRGMMVDYKKRAERRREYYEKIKKDPAQFLQVHGRACKVHLDSAVALAAESPVNMMPWQGDTNNMIDRFDVRAHLDHIPDYTPPLLTTISPEQESDERKCNYERYRGLVQNDFAGISEEQCLYQIYIDELYGGLQRPSEDEKKKLAEKKASIGYTYEDSTVAEVEKAAEKPEEEESAAEEESNSDEDEVIPDIDVEVDVDELNQEQVADLNKQATTYGMADGDFVRMLRKDKEEAEAIKHAKALEEEKAMYSITFITSFGGSDEEAAAAAAAAAASGVTGGG

SEQ ID NO: 905801 - protein, 157 aa, Homo sapiens
GDPAPGTGRGGEGSAPVRTMSLSPPHCTLGLHLSLNLLGHPPPLPPLLPPPQPKLTPQEKLKLRMQKALNRQFKADKKAAQEKMIQQEHERQEREDELRAMARKIRMKERERREKEREEWERQYSRQSRSPSPRYSREYSSSRRRSRSRSRSPHYRH

SEQ ID NO: 905802 - protein, 285 aa, Homo sapiens
MWHEARKHERKLRGMMVDYKKRAERRREYYEKIKKDPAQFLQVHGRACKVHLDSAVALAAESPVNMMPWQGDTNNMIDRFDVRAHLDHIPDYTPPLLTTISPEQESDERKCNYERYRGLVQNDFAGISEEQCLYQIYIDELYGGLQRPSEDEKKKLAEKKASIGYTYEDSTVAEVEKAAEKPEEEESAAEEESNSDEDEVIPDIDRWGPLSALPTCSPWASFLCLVPHPLWGTPCLRTVSLSLPRPRAHQPPAAPVSLLSSSVPAFLCLTHLSFLGCYFYDLFPS

SEQ ID NO: 905803 - protein, 463 aa, Homo sapiens
MATFPCQLCGKTFLTLEKFTIHNYSHSRERPYKCVQPDCGKAFVSRYKLMRHMATHSPQKSHQCAHCEKTFNRKDHLKNHLQTHDPNKMAFGCEECGKKYNTMLGYKRHLALHAASSGDLTCGVCALELGSTEVLLDHLKAHAEEKPPSGTKEKKHQCDHCERCFYTRKDVRRHLVVHTGCKDFLCQFCAQRFGRKDHLTRHTKKTHSQELMKESLQTGDLLSTFHTISPSFQLKAAALPPFPLGASAQNGLASSLPAEVHSLTLSPPEQAAQPMQPLPESLASLHPSVSPGSPPPPLPNHKYNTTSTSYSPLASLPLKADTKGFCNISLFEDLPLQEPQSPQKLNPGFDLAKGNAGKVNLPKELPADAVNLTIPASLDLSPLLGFWQLPPPATQNTFGNSTLALGPGESLPHRLSCLGQQQQEPPLAMGTVSLGQLPLPPIPHVFSAGTGSAILPHFHHAFR

SEQ ID NO: 905804 - protein, 339 aa, Homo sapiens
LVWPIAASQHLSRFSCVIGLWRPILAETSASRPRCRPQAGSGLPAPALYLGDLGFAPTGDPARRTCGCRSAPPASAADPQLPGGASSCHVTPPPGAPAPSSRPRRSGSRAPPARGLLGAAILLAAAGGKAHGICHLSFSPSVPPRALIRHGWGVLWPHSPGGCWTDGRTGQPCSQLSSAGPWRAGRFPGSPSWPRRWHARAASPELRGSSPRRVGVWVLAAAAGGLGAAVAVHCRAARTALGSRPRGGCAFAAPPTCGSGLRGAGCGTPQIVTRNPGSPTASAAGPPGRRCQRRSRLSGMRSTDPILTTWRSNLANGPGKKQNKEKKKKSVPSNNGTRQ

SEQ ID NO: 905805 - protein, 411 aa, Homo sapiens
MATHSPQKSHQCAHCEKTFNRKDHLKNHLQTHDPNKMAFGCEECGKKYNTMLGYKRHLALHAASSGDLTCGVCALELGSTEVLLDHLKAHAEEKPPSGTKEKKHQCDHCERCFYTRKDVRRHLVVHTGCKDFLCQFCAQRFGRKDHLTRHTKKTHSQELMKESLQTGDLLSTFHTISPSFQLKAAALPPFPLGASAQNGLASSLPAEVHSLTLSPPEQAAQPMQPLPESLASLHPSVSPGSPPPPLPNHKYNTTSTSYSPLASLPLKADTKGFCNISLFEDLPLQEPQSPQKLNPGFDLAKGNAGKVNLPKELPADAVNLTIPASLDLSPLLGFWQLPPPATQNTFGNSTLALGPGESLPHRLSCLGQQQQEPPLAMGTVSLGQLPLPPIPHVFSAGTGSAILPHFHHAFR

SEQ ID NO: 905806 - protein, 463 aa, Homo sapiens; identical to SEQ ID NO: 905803

SEQ ID NO: 905807 - protein, 411 aa, Homo sapiens; identical to SEQ ID NO: 905805

SEQ ID NO: 905808 - protein, 463 aa, Homo sapiens; identical to SEQ ID NO: 905803

SEQ ID NO: 905809 - protein, 463 aa, Homo sapiens; identical to SEQ ID NO: 905803

SEQ ID NO: 905810 - protein, 463 aa, Homo sapiens; identical to SEQ ID NO: 905803

SEQ ID NO: 905811 - protein, 411 aa, Homo sapiens; identical to SEQ ID NO: 905805

SEQ ID NO: 905812 - protein, 411 aa, Homo sapiens; identical to SEQ ID NO: 905805

SEQ ID NO: 905813 - protein, 463 aa, Homo sapiens; identical to SEQ ID NO: 905803

SEQ ID NO: 905814 - protein, 463 aa, Homo sapiens; identical to SEQ ID NO: 905803

SEQ ID NO: 905815 - protein, 101 aa, Homo sapiens
VTLRIPHRFAGQLLRQQEPSHIKPACPHHLLPCSPLLRHPFPITSTTPLLPHTPHLQACPSKQILKVFAISVCLRTCLCKSLSHLKSSTQVLIWLREMLVK

SEQ ID NO: 905816 - protein, 407 aa, Homo sapiens
PARAWRRWRQWQQWQPRSPAEWSGAGAEPGAHGPPHVPRGERLPSGRRASARGPVGAAAGAAPEMGEQPIFTTRAHVFQIDPNTKKNWMPASKQAVTVSYFYDVTRNSYRIISVDGAKVIINSTITPNMTFTKTSQKFGQWADSRANTVFGLGFSSEQQLTKFAEKFQEVKEAAKIAKDKTQEKIETSSNHSQASSVNGTDDEKASHAGPANTHLKSENDKLKIALTQSAANVKKWEIELQTLRESNARLTTALQESAASVEQWKRQFSICRDENDRLRNKIDELEEQCSEINREKEKNTQLKRRIEELEAELREKETELKDLRKQSEIIPQLMSECEYVSEKLEAAERDNQNLEDKVRSLKTDIEESKYRQRHLKVELKSFLEVLDGKIDDLHDFRRGLSKLGTDN

SEQ ID NO: 905817 - protein, 407 aa, Homo sapiens; identical to SEQ ID NO: 905816

SEQ ID NO: 905818 - protein, 249 aa, Homo sapiens
PARAWRRWRQWQQWQPRSPAEWSGAGAEPGAHGPPHVPRGERLPSGRRASARGPVGAAAGAAPEMGEQPIFTTRAHVFQIDPNTKKNWMPASKQAVTVSYFYDVTRNSYRIISVDGAKVIINSTITPNMTFTKTSQKFGQWADSRANTVFGLGFSSEQQLTKFAEKFQEVKEAAKIAKDKTQEKIETSSNHSQASSVNGTDDEKASHAGPANTHLKSENDKLKIALTQRLMSWKNNAVRSTERRRRTRS

SEQ ID NO: 905819 - protein, 407 aa, Homo sapiens; identical to SEQ ID NO: 905816

SEQ ID NO: 905820 - protein, 299 aa, Homo sapiens
PARAWRRWRQWQQWQPRSPAEWSGAGAEPGAHGPPHVPRGERLPSGRRASARGPVGAAAGAAPEMGEQPIFTTRAHVFQIDPNTKKNWMPASKQAVTVSYFYDVTRNSYRIISVDGAKVIINSTITPNMTFTKTSQKFGQWADSRANTVFGLGFSSEQQLTKFAEKFQEVKEAAKIAKDKTQEKIETSSNHSQASSVNGTDDEKASHAGPANTHLKSENDKLKIALTQRMQAQFVVFPNQLCRPLTPFQNRNLLSLLWPCEVVDNWKILTQESRTRSTFNIYAVRAGMFISFIRAVATI

SEQ ID NO: 905821 - protein, 418 aa, Homo sapiens
PARAWRRWRQWQQWQPRSPAEWSGAGAEPGAHGPPHVPRGERLPSGRRASARGPVGAAAGAAPEMGEQPIFTTRAHVFQIDPNTKKNWMPASKQAVTVSYFYDVTRNSYRIISVDGAKVIINSTITPNMTFTKTSQKFGQWADSRANTVFGLGFSSEQQLTKFAEKFQEVKEAAKIAKDKTQEKIETSSNHSQESGRETPSSTQASSVNGTDDEKASHAGPANTHLKSENDKLKIALTQSAANVKKWEIELQTLRESNARLTTALQESAASVEQWKRQFSICRDENDRLRNKIDELEEQCSEINREKEKNTQLKRRIEELEAELREKETELKDLRKQSEIIPQLMSECEYVSEKLEAAERDNQNLEDKVRSLKTDIEESKYRQRHLKVELKSFLEVLDGKIDDLHDFRRGLSKLGTDN

SEQ ID NO: 905822 - protein, 319 aa, Homo sapiens [sequence omitted]

SEQ ID NO: 905823 - protein, 260 aa, Homo sapiens
PARAWRRWRQWQQWQPRSPAEWSGAGAEPGAHGPPHVPRGERLPSGRRASARGPVGAAAGAAPEMGEQPIFTTRAHVFQIDPNTKKNWMPASKQAVTVSYFYDVTRNSYRIISVDGAKVIINSTITPNMTFTKTSQKFGQWADSRANTVFGLGFSSEQQLTKFAEKFQEVKEAAKIAKDKTQEKIETSSNHSQESGRETPSSTQASSVNGTDDEKASHAGPANTHLKSENDKLKIALTQRLMSWKNNAVRSTERRRRTRS

SEQ ID NO: 905824 - protein, 68 aa, Homo sapiens
QIDPNTKKNWMPASKQAVTVSYFYDVTRNSYRIISVDGAKVPPPQLILILPVAYLSSKMHPKSCRLNT

SEQ ID NO: 905825 - protein, 485 aa, Homo sapiens
MSTGFSFGSGTLGSTTVAAGGTSTGGVFSFGTGASSNPSVGLNFGNLGSTSTPATTSAPSSGFGTGLFGSKPATGFTLGGTNTGIATTITTGLTLGTPATTSAATTGFSLGFNKPAASATPFALPITSTSASGLTLSSALTSTPAASTGFTLNNLGGTTATTTTASTGLSLGGALAGLGGSLFQSTNTGTSGLGQNALGLTLGTTAATSTAGNEGLGGIDFSSSSDKKSDKTGTRPEDSKALKDENLPPVICQDVENLQKFVKEQKQVQEEISRMSSKAMLKVQEDIKALKQLLSLAANGIQRNTLNIDKLKIETAQELKNAEIALRTQKTPPGLQHEYAAPADYFRILVQQFEVQLQQYRQQIEELENHLATQANNSHITPQDLSMAMQKIYQTFVALAAQLQSIHENVKVLKEQYLGYRKMFLGDAVDVFETRRAEAKKWQNTPRVTTGPTPFSTMPNAAAVAMAATLTQQQQPATGLNAFKL

SEQ ID NO: 905826 - protein, 599 aa, Homo sapiens
MSTGFSFGSGTLGSTTVAAGGTSTGGVFSFGTGASSNPSVGLNFGNLGSTSTPATTSAPSSGFGTGLFGSKPATGFTLGGTNTGIATTITTGLTLGTPATTSAATTGFSLGFNKPAASATPFALPITSTSASGLTLSSALTSTPAASTGFTLNNLGGTTATTTTASTGLSLGGALAGLGGSLFQSTNTGTSGLGQNALGLTLGTTAATSTAGNEGLGGIDFSSSSDKKSDKTGTRPEDSKALKDENLPPVICQDVENLQKFVKEQKQVQEEISRMSSKAMLKVQEDIKALKQLLSLAANGIQRNTLNIDKLKIETAQELKNAEIALRTQKTPPGLQHEYAAPADYFRILVQQFEVQLQQYRQQIEELENHLATQANNSHITPQDLSMAMQKIYQTFVALAAQLQSIHENVKVLKEQYLGYRKMFLGDAVDVFETRRAEAKKWQNTPRVTTGPTPFSTMPNAAAVAMAATLTQQQQPATGPQPSLGVSFGTPFGSGIGTGLQSSGLGSSNLGGFGTSSGFGCSTTGASTFGFGTTNKPSGSLSAGFGSSSTSGFNFSNPGITASAGLTFGVSNPASAGFGTGGQLLQLKKPPAGNKRGKR

SEQ ID NO: 905827 - protein, 320 aa, Homo sapiens [sequence omitted]

SEQ ID NO: 905828 - protein, 587 aa, Homo sapiens
MSTGFSFGSGTLGSTTVAAGGTSTGGVFSFGTGASSNPSVGLNFGNLGSTSTPATTSAPSSGFGTGLFGSKPATGFTLGGTNTGTPATTSAATTGFSLGFNKPAASATPFALPITSTSASGLTLSSALTSTPAASTGFTLNNLGGTTATTTTASTGLSLGGALAGLGGSLFQSTNTGTSGLGQNALGLTLGTTAATSTAGNEGLGGIDFSSSSDKKSDKTGTRPEDSKALKDENLPPVICQDVENLQKFVKEQKQVQEEISRMSSKAMLKVQEDIKALKQLLSLAANGIQRNTLNIDKLKIETAQELKNAEIALRTQKTPPGLQHEYAAPADYFRILVQQFEVQLQQYRQQIEELENHLATQANNSHITPQDLSMAMQKIYQTFVALAAQLQSIHENVKVLKEQYLGYRKMFLGDAVDVFETRRAEAKKWQNTPRVTTGPTPFSTMPNAAAVAMAATLTQQQQPATGPQPSLGVSFGTPFGSGIGTGLQSSGLGSSNLGGFGTSSGFGCSTTGASTFGFGTTNKPSGSLSAGFGSSSTSGFNFSNPGITASAGLTFGVSNPASAGFGTGGQLLQLKKPPAGNKRGKR

SEQ ID NO: 905829 - protein, 599 aa, Homo sapiens; identical to SEQ ID NO: 905826

SEQ ID NO: 905830 - protein, 425 aa, Homo sapiens
GNCCSLLMEFISYVLFIGLGQNALGLTLGTTAATSTAGNEGLGGIDFSSSSDKKSDKTGTRPEDSKALKDENLPPVICQDVENLQKFVKEQKQVQEEISRMSSKAMLKVQEDIKALKQLLSLAANGIQRNTLNIDKLKIETAQELKNAEIALRTQKTPPGLQHEYAAPADYFRILVQQFEVQLQQYRQQIEELENHLATQANNSHITPQDLSMAMQKIYQTFVALAAQLQSIHENVKVLKEQYLGYRKMFLGDAVDVFETRRAEAKKWQNTPRVTTGPTPFSTMPNAAAVAMAATLTQQQQPATGPQPSLGVSFGTPFGSGIGTGLQSSGLGSSNLGGFGTSSGFGCSTTGASTFGFGTTNKPSGSLSAGFGSSSTSGFNFSNPGITASAGLTFGVSNPASAGFGTGGQLLQLKKPPAGNKRGKR

SEQ ID NO: 905831 - protein, 570 aa, Homo sapiens
MSTGFSFGSGTLGSTTVAAGGTSTGGVFSFGTGASSNPSVGLNFGNLGSTSTPATTSAPSSGFGTGLFGSKPATGFTLGGTNTGIATTITTGLTLGTPATTSAATTGFSLGFNKPAASATPFALPITSTSASGLTLSSALTSTPAASTGFTLNNLGGTTATTTTASTGLSLGGALAGLGGSLFQSTNTGTSGLGQNALGLTLGTTAATSTAGNEGLGGIDFSSSSDKKSDKTGTRPEDSKALKDENLPPVICQDVENLQKFVKEQKQVQEEISRMSSKAMLKVQEDIKALKQLLSLAANGIQRNTLNIDKLKIETAQELKNAEIALRTQKTPPGLQHEYAAPADYFRILVQQFEVQLQQYRQQIEELENHLATQANNSHITPQDLSMAMQKIYQTFVALAAQLQSIHENVKVLKEQYLGYRKMFLGDAVDVFETRRAEAKKWQNTPRVTTGPTPFSTMPNAAAVAMAATLTQQQQPATGPQPSLGVSFGTPFGSGIGTGLQSSGLGSSNLGGFGTSSGFGCSTTGASTFGFGTTNKPSGSLSAGNKSQVLTEFRKPSVTETNEIGRKIQF

SEQ ID NO: 905832 - protein, 525 aa, Homo sapiens
MSTGFSFGSGTLGSTTVAAGGTSTGGVFSFGTGASSNPSVGLNFGNLGSTSTPATTSAPSSGFGTGLFGSKPATGFTLGGTNTGIATTITTGLTLGTPATTSAATTGFSLGFNKPAASATPFALPITSTSASGLTLSSALTSTPAASTGFTLNNLGGTTATTTTASTGLSLGGALAGLGGSLFQSTNTGTSGLGQNALGLTLGTTAATSTAGNEGLGGIDFSSSSDKKSDKTGTRPEDSKALKDENLPPVICQDVENLQKFVKEQKQVQEEISRMSSKAMLKVQEDIKALKQLLSLAANGIQRNTLNIDKLKIETAQELKNAEIALRTQKTPPGLQHEYAAPADYFRILVQQFEVQLQQYRQQIEELENHLATQANNSHITPQDLSMAMQKIYQTFVALAAQLQSIHENVKVLKEQYLGYRKMFLGDAVDVFETRRAEAKKWQNTPRVTTGPTPFSTMPNAAAVAMAATLTQQQQPATGPQPSLGVSFGTPFGSGIGTGLQSSGLGSSNLGGFGLALYSRAPQGG

SEQ ID NO: 905833 - protein, 599 aa, Homo sapiens; identical to SEQ ID NO: 905826

SEQ ID NO: 905834 - protein, 599 aa, Homo sapiens; identical to SEQ ID NO: 905826

SEQ ID NO: 905835 - protein, 599 aa, Homo sapiens; identical to SEQ ID NO: 905826

SEQ ID NO: 905836 - protein, 485 aa, Homo sapiens; identical to SEQ ID NO: 905825

SEQ ID NO: 905837 - protein, 516 aa, Homo sapiens
MSTGFSFGSGTLGSTTVAAGGTSTGGVFSFGTGASSNPSVGLNFGNLGSTSTPATTSAPSSGFGTGLFGSKPATGFTLGGTNTGIATTITTGLTLGTPATTSAATTGFSLGFNKPAASATPFALPITSTSASGLTLSSALTSTPAASTGFTLNNLGGTTATTTTASTGLSLGGALAGLGGSLFQSTNTGTSGLGQNALGLTLGTTAATSTAGNEGLGGIDFSSSSDKKSDKTGTRPEDSKALKDENLPPVICQDVENLQKFVKEQKQVQEEISRMSSKAMLKVQEDIKALKQLLSLAANGIQRNTLNIDKLKIETAQELKNAEIALRTQKTPPGLQHEYAAPADYFRILVQQFEVQLQQYRQQIEELENHLATQANNSHITPQDLSMAMQKIYQTFVALAAQLQSIHENVKVLKEQYLGYRKMFLGDAVDVFETRRAEAKKWQNTPRVTTGPTPFSTMPNAAAVAMAATLTQQQQPATGDKWCNVAELKNRTQLSLFVNKLELSCYCVIDLLYNEQ

SEQ ID NO: 905838 - protein, 149 aa, Homo sapiens
LSLAFAAVGAGSSRQVRAGRERCCPARLGFEAREVSQTHFALLTASSPGQTCPQGSPSGPGLWAPPPWPPAGPAQAAFSPSERERLGNRTFSPSWAGFTPTPTPAKLPWCPHPVSSLWLPSQWGWREALNLAARRRRPLAAVPGPSAAW

SEQ ID NO: 905839 - protein, 410 aa, Homo sapiens
MVESSRHNWSGLDKQSDIQNLNEERILALQLCGWIKKGTDVDVGPFLNSLVQEGEWERAAAVALFNLDIRRAIQILNEGASSEKGDLNLNVVAMALSGYTDEKNSLWREMCSTLRLQLNNPYLCVMFAFLTSETGSYDGVLYENKVAVRDRVAFACKFLSDTQLNRYIEKLTNEMKEAGNLEGILLTGLTKDGVDLMESYVDRTGDVQTASYCMLQGSPLDVLKDERVQYWIENYRNLLDAWRFWHKRAEFDIHRSKLDPSSKPLAQVFVSCNFCGKSISYSCSAVPHQGRGFSQYGVSGSPTKSKVTSCPGCRKPLPRCALCLINMGTPVSSCPGGTKSDEKVDLSKDKKLAQFNNWFTWCHNCRHGGHAGHMLSWFRDHAECPVSACTCKCMQLDTTGNLVPAETVQP

SEQ ID NO: 905840 - protein, 875 aa, Homo sapiens
MSGTKPDILWAPHHVDRFVVCDSELSLYHVESTVNSELKAGSLRLSEDSAATLLSINSDTPYMKCVAWYLNYDPECLLAVGQANGRVVLTSLGQDHNSKFKDLIGKEFVPKHARQCNTLAWNPLDSNWLAAGLDKHRADFSVLIWDICSKYTPDIVPMEKVKLSAGETETTLLVTKPLYELGQNDACLSLCWLPRDQKLLLAGMHRNLAIFDLRNTSQKMFVNTKAVQGVTVDPYFHDRVASFYEGQVAIWDLRKFEKPVLTLTEQPKPLTKVAWCPTRTGLLATLTRDSNIIRLYDMQHTPTPIGDETEPTIIERSVQPCDNYIASFAWHPTSQNRMIVVTPNRTMSDFTVFERISLAWSPITSLMWACGRHLYECTEEENDNSLEKDIATKMRLRALSRYGLDTEQVWRNHILAGNEDPQLKSLWYTLHFMKQYTEDMDQKSPGNKGSLVYAGIKSIVKSSLGMVESSRHNWSGLDKQSDIQNLNEERILALQLCGWIKKGTDVDVGPFLNSLVQEGEWERAAAVALFNLDIRRAIQILNEGASSEKGDLNLNVVAMALSGYTDEKNSLWREMCSTLRLQLNNPYLCVMFAFLTSETGSYDGVLYENKVAVRDRVAFACKFLSDTQLNRYIEKLTNEMKEAGNLEGILLTGLTKDGVDLMESYVDRTGDVQTASYCMLQGSPLDVLKDERVQYWIENYRNLLDAWRFWHKRAEFDIHRSKLDPSSKPLAQVFVSCNFCGKSISYSCSAVPHQGRGFSQYGVSGSPTKSKVTSCPGCRKPLPRCALCLINMGTPVSSCPGGTKSDEKVDLSKDKKLAQFNNWFTWCHNCRHGGHAGHMLSWFRDHAECPVSACTCKCMQLDTTGNLVPAETVQP

SEQ ID NO: 905841 - protein, 875 aa, Homo sapiens; identical to SEQ ID NO: 905840

SEQ ID NO: 905842 - protein, 875 aa, Homo sapiens; identical to SEQ ID NO: 905840

SEQ ID NO: 905843 - protein, 844 aa, Homo sapiens
MSGTKPDILWAPHHVDRFVVCDSELSLYHVESTVNSELKAGSLRLSEDSAATLLSINSDTPYMKCVAWYLNYDPECLLAVGQANGRVVLTSLGQDHNSKFKDLIGKEFVPKHARQCNTLAWNPLDSNWLAAGLDKHRADFSVLIWDICSKYTPDIVPMEKVKLSAGETETTLLVTKPLYELGQNDACLSLCWLPRDQKLLLAGMHRNLAIFDLRNTSQKMFVNTKAVQGVTVDPYFHDRVASFYEGQVAIWDLRKFEKPVLTLTEQPKPLTKVAWCPTRTGLLATLTRDSNIIRLYDMQHTPTPIGDETEPTIIERSVQPCDNYIASFAWHPTSQNRMIVVTPNRTMSDFTVFERISLAWSPITSLMWACGRHLYECTEEENDNSLEKDIATKMRLRALSRYGLDTEQVWRNHILAGNEDPQLKSLWYTLHFMKQYTEDMDQKSPGNKGSLVYAGIKSIVKSSLGMVESSRHNWSGLDKQSDIQNLNEERILALQLCGWIKKGTDVDVGPFLNSLVQEGEWERAAAVALFNLDIRRAIQILNEGASSEKGDLNLNVVAMALSGYTDEKNSLWREMCSTLRLQLNNPYLCVMFAFLTSETGSYDGVLYENKVAVRDRVAFACKFLSDTQLNRYIEKLTNEMKEAGNLEGILLTGLTKDGVDLMESYVDRTGDVQTASYCMLQGSPLDVLKDERVQYWIENYRNLLDAWRFWHKRAEFDIHRSKLDPSSKPLAQVFVSCNFCGKSISYSCSAVPHQGRGFSQYGVSGSPTKSKVTSCPGCRKPLPRCALCLINMGTPVSSCPGGTKSDEKVDLSKDKKLAQFNNWFTWCHNCRHGGHAGHMLSWFR

SEQ ID NO: 905844 - protein, 844 aa, Homo sapiens; identical to SEQ ID NO: 905843

SEQ ID NO: 905845 - protein, 875 aa, Homo sapiens; identical to SEQ ID NO: 905840

SEQ ID NO: 905846 - protein, 875 aa, Homo sapiens; identical to SEQ ID NO: 905840

SEQ ID NO: 905847 - protein, 875 aa, Homo sapiens; identical to SEQ ID NO: 905840

SEQ ID NO: 905848 - protein, 491 aa, Homo sapiens
MSGTKPDILWAPHHVDRFVVCDSELSLYHVESTVNSELKAGSLRLSEDSAATLLSINSDTPYMKCVAWYLNYDPECLLAVGQANGRVVLTSLGQDHNSKFKDLIGKEFVPKHARQCNTLAWNPLDSNWLAAGLDKHRADFSVLIWDICSKYTPDIVPMEKVKLSAGETETTLLVTKPLYELGQNDACLSLCWLPRDQKLLLAGMHRNLAIFDLRNTSQKMFVNTKAVQGVTVDPYFHDRVASFYEGQVAIWDLRKFEKPVLTLTEQPKPLTKVAWCPTRTGLLATLTRDSNIIRLYDMQHTPTPIGDETEPTIIERSVQPCDNYIASFAWHPTSQNRMIVVTPNRTMSDFTVFERISLAWSPITSLMWACGRHLYECTEEENDNSLEKDIATKMRLRALSRYGLDTEQVWRNHILAGGTKSDEKVDLSKDKKLAQFNNWFTWCHNCRHGGHAGHMLSWFRDHAECPVSACTCKCMQLDTTGNLVPAETVQP

SEQ ID NO: 905849 - protein, 2047 aa, Homo sapiens
SGLYRYRSRNSRTALSEEEEEEREFRKQFPLHEKDFADILVQPTLEENKGTSDGQEEEAGTNPALLSQNSMQAVMLIHQQLCLNFARSLWYQQTLPPHEAKHYLSLFLSCYQTGASLVTHFYPLMGVELNDRLLGSQLLACTLSHNTLFGEAPSDLMVKPDGPYDFYQHPNVPEARQCQPVLQGFSEAVSHLLQDWPEHPALEQLLVVMDRIRSFPLSSPISKFLNGLEILLAKAQDWEENASRALSLRKHLDLISQMIIRWRKLELNCWSMSLDNTMKRHTEKSTKHWFSIYQMLEKHMQEQTEEQEDDKQMTLMLLVSTLQAFIEGSSLGEFHVRLQMLLVFHCHVLLMPQVEGKDSLCSVLWNLYHYYKQFFDRVQAKIVELRSPLEKELKEFVKISKWNDVSFWSIKQSVEKTHRTLFKFMKKFEAVLSEPCRSSLVESDKEEQPDFLPRPTDGAASELSSIQNLNRALRETLLAQPAAGQATIPEWCQGAAPSGLEGELLRRLPKLRKRMRKMCLTFMKESPLPRLVEGLDQFTGEVISSVSELQSLKVEPSAEKEKQRSEAKHILMQKQRALSDLFKHLAKIGLSYRKGLAWARSKNPQEMLHLHPLDLQSALSIVSSTQEADSRLLTEISSSWDGCQKYFYRSLARHARLNAALATPAKEMGMGNVERCRGFSAHLMKMLVRQRRSLTTLSEQWIILRNLLSCVQEIHSRLMGPQAYPVAFPPQDGVQQWTERLQHLAMQCQILLEQLSWLLQCCPSVGPAPGHGNVQVLGQPPGPCLEGPELSKGQLCGVVLDLIPSNLSYPSPIPGSQLPSGCRMRKQDHLWQQSTTRLTEMLKTIKTVKADVDKIRQQSCETLFHSWKDFEVCSSALSCLSQVSVHLQGLESLFILPGMEVEQRDSQMALVESLEYVRGEISKAMADFTTWKTHLLTSDSQGGNQMLDEGFVEDFSEQMEIAIRAILCAIQNLEERKNEKAEENTDQASPQEDYAGFERLQSGHLTKLLEDDFWADVSTLHVQKIISAISELLERLKSYGEDGTAAKHLFFSQSCSLLVRLVPVLSSYSDLVLFFLTMSLATHRSTAKLLSVLAQVFTELAQKGFCLPKEFMEDSAGEGATEFHDYEGGGIGEGEGMKDVSDQIGNEEQVEDTFQKGQEKDKEDPDSKSDIKGEDNAIEMSEDFDGKMHDGELEEQEEDDEKSDSEGGDLDKHMGDLNGEEADKLDERLWGDDDEEEDEEEEDNKTEETGPGMDEEDSELVAKDDNLDSGNSNKDKSQQDKKEEKEEAEADDGGQGEDKINEQIDERDYDENEVDPYHGNQEKVPEPEALDLPDDLNLDSEDKNGGEDTDNEEGEEENPLEIKEKPEEAGHEAEERGETETDQNESQSPQEPEEGPSEDDKAEGEEEMDTGADDQDGDAAQHPEEHSEEQQQSVEEKDKEADEEGGENGPADQGFQPQEEEEREDSDTEEQVPEALERKEHASCGQTGVENMQNTQAMELAGAAPEKEQGKEEHGSGAADANQAEGHESNFIAQLASQKHTRKNTQSFKRKPGQADNERSMGDHNERVHKRLRTVDTDSHAEQGPAQQPQAQVEDADAFEHIKQGSDAYDAQTYDVASKEQQQSAKDSGKDQEEEEIEDTLMDTEEQEEFKAADVEQLKPEEIKSGTTAPLGFDEMEVEIQTVKTEEDQDPRTDKAHKETENEKPERSRESTIHTAHQFLMDTIFQPFLKDVNELRQELERQLEMWQPRESGNPEEEKVAAEMWQSYLILTAPLSQRLCEELRLILEPTQAAKLKGDYRTGKRLNIRKVIPYIASQFRKDKIWLRRTKPSKRQYQICLAIDDSSSMVDNHTKQLAFESLAVIGNALTLLEVGQIAVCSFGESVKLLHPFHEQFSDYSGSQILRLCKFQQKKTKIAQFLESVANMFAAAQQLSQNISSETAQLLLVVSDGRGLFLEGKERVLAAVQAARNANIFVIFVVLDNPSSRDSILDIKVPIFKGPGEMPEIRSYMEEFPFPYYIILRDVNALPETLSDALRQWFELVTASDHP

SEQ ID NO: 905850 - protein, 1140 aa, Homo sapiens [sequence omitted]

SEQ ID NO: 905851 - protein, 2108 aa, Homo sapiens
SGLYRYRSRNSRTALSEEEEEEREFRKQFPLHEKDFADILVQPTLEENKGTSDGQEEEAGTNPALLSQNSMQAVMLIHQQLCLNFARSLWYQQTLPPHEAKHYLSLFLSCYQTGASLVTHFYPLMGVELNDRLLGSQLLACTLSHNTLFGEAPSDLMVKPDGPYDFYQHPNVPEARQCQPVLQGFSEAVSHLLQDWPEHPALEQLLVVMDRIRSFPLSSPISKFLNGLEILLAKAQDWEENASRALSLRKHLDLISQMIIRWRKLELNCWSMSLDNTMKRHTEKSTKHWFSIYQMLEKHMQEQTEEQEDDKQMTLMLLVSTLQAFIEGSSLGEFHVRLQMLLVFHCHVLLMPQVEGKDSLCSVLWNLYHYYKQFFDRVQAKIVELRSPLEKELKEFVKISKWNDVSFWSIKQSVEKTHRTLFKFMKKFEAVLSEPCRSSLVESDKEEQPDFLPRPTDGAASELSSIQNLNRALRETLLAQPAAGQATIPEWCQGAAPSGLEGELLRRLPKLRKRMRKMCLTFMKESPLPRLVEGLDQFTGEVISSVSELQSLKVEPSAEKEKQRSEAKHILMQKQRALSDLFKHLAKIGLSYRKGLAWARSKNPQEMLHLHPLDLQSALSIVSSTQEADSRLLTEISSSWDGCQKYFYRSLARHARLNAALATPAKEMGMGNVERCRGFSAHLMKMLVRQRRSLTTLSEQWIILRNLLSCVQEIHSRLMGPQAYPVAFPPQDGVQQWTERLQHLAMQCQILLEQLSWLLQCCPSVGPAPGHGNVQVLGQPPGPCLEGPELSKGQLCGVVLDLIPSNLSYPSPIPGSQLPSGCRMRKQDHLWQQSTTRLTEMLKTIKTVKADVDKIRQQSCETLFHSWKDFEVCSSALSCLSQVSVHLQGLESLFILPGMEVEQRDSQMALVESLEYVRGEISKAMADFTTWKTHLLTSDSQGGNQMLDEGFVEDFSEQMEIAIRAILCAIQNLEERKNEKAEENTDQASPQEDYGMSEIRQKLVSVPDLIFVFDDLFLWLNSEGWMLETDNCMDRDKRICFLLFIMLLFSLKNEAAGFERLQSGHLTKLLEDDFWADVSTLHVQKIISAISELLERLKSYGEDGTAAKHLFFSQSCSLLVRLVPVLSSYSDLVLFFLTMSLATHRSTAKLLSVLAQVFTELAQKGFCLPKEFMEDSAGEGATEFHDYEGGGIGEGEGMKDVSDQIGNEEQVEDTFQKGQEKDKEDPDSKSDIKGEDNAIEMSEDFDGKMHDGELEEQEEDDEKSDSEGGDLDKHMGDLNGEEADKLDERLWGDDDEEEDEEEEDNKTEETGPGMDEEDSELVAKDDNLDSGNSNKDKSQQDKKEEKEEAEADDGGQGEDKINEQIDERDYDENEVDPYHGNQEKVPEPEALDLPDDLNLDSEDKNGGEDTDNEEGEEENPLEIKEKPEEAGHEAEERGETETDQNESQSPQEPEEGPSEDDKAEGEEEMDTGADDQDGDAAQHPEEHSEEQQQSVEEKDKEADEEGGENGPADQGFQPQEEEEREDSDTEEQVPEALERKEHASCGQTGVENMQNTQAMELAGAAPEKEQGKEEHGSGAADANQAEGHESNFIAQLASQKHTRKNTQSFKRKPGQADNERSMGDHNERVHKRLRTVDTDSHAEQGPAQQPQAQVEDADAFEHIKQGSDAYDAQTYDVASKEQQQSAKDSGKDQEEEEIEDTLMDTEEQEEFKAADVEQLKPEEIKSGTTAPLGFDEMEVEIQTVKTEEDQDPRTDKAHKETENEKPERSRESTIHTAHQFLMDTIFQPFLKDVNELRQELERQLEMWQPRESGNPEEEKVAAEMWQSYLILTAPLSQRLCEELRLILEPTQAAKLKGDYRTGKRLNIRKVIPYIASQFRKDKIWLRRTKPSKRQYQICLAIDDSSSMVDNHTKQLAFESLAVIGNALTLLEVGQIAVCSFGESVKLLHPFHEQFSDYSGSQILRLCKFQQKKTKIAQFLESVANMFAAAQQLSQNISSETAQLLLVVSDGRGLFLEGKERVLAAVQAARNANIFVIFVVLDNPSSRDSILDIKVPIFKGPGEMPEIRSYMEEFPFPYYIILRDVNALPETLSDALRQWFELVTASDHP

SEQ ID NO: 905852 - protein, 846 aa, Homo sapiens
TTYFVTTYFRDYNFRITYFRLHTSDYILPTTYFRLHTSDYILPTTYFRGPGMDEEDSELVAKDDNLDSGNSNKDKSQQDKKEEKEEAEADDGGQGEDKINEQIDERDYDENEVDPYHGNQEKVPEPEALDLPDDLNLDSEDKNGGEDTDNEEGEEENPLEIKEKPEEAGHEAEERGETETDQNESQSPQEPEEGPSEDDKAEGEEEMDTGADDQDGDAAQHPEEHSEEQQQSVEEKDKEADEEGGENGPADQGFQPQEEEEREDSDTEEQVPEALERKEHASCGQTGVENMQNTQAMELAGAAPEKEQGKEEHGSGAADANQAEGHESNFIAQLASQKHTRKNTQSFKRKPGQADNERSMGDHNERVHKRLRTVDTDSHAEQGPAQQPQAQVEDADAFEHIKQGSDAYDAQTYDVASKEQQQSAKDSGKDQEEEEIEDTLMDTEEQEEFKAADVEQLKPEEIKSGTTAPLGFDEMEVEIQTVKTEEDQDPRTDKAHKETENEKPERSRESTIHTAHQFLMDTIFQPFLKDVNELRQELERQLEMWQPRESGNPEEEKVAAEMWQSYLILTAPLSQRLCEELRLILEPTQAAKLKGDYRTGKRLNIRKVIPYIASQFRKDKIWLRRTKPSKRQYQICLAIDDSSSMVDNHTKQLAFESLAVIGNALTLLEVGQIAVCSFGESVKLLHPFHEQFSDYSGSQILRLCKFQQKKTKIAQFLESVANMFAAAQQLSQNISSETAQLLLVVSDGRGLFLEGKERVLAAVQAARNANIFVIFVVLDNPSSRDSILDIKVPIFKGPGEMPEIRSYMEEFPFPYYIILRDVNALPETLSDALRQWFELVTASDHP

SEQ ID NO: 905853 - protein, 487 aa, Homo sapiens [sequence omitted]

SEQ ID NO: 905854 - protein, 1071 aa, Homo sapiens
MALVESLEYVRGEISKAMADFTTWKTHLLTSDSQGGNQMLDEGFVEDFSEQMEIAIRAILCAIQNLEERKNEKAEENTDQASPQEDYAGFERLQSGHLTKLLEDDFWADVSTLHVQKIISAISELLERLKSYGEDGTAAKHLFFSQSCSLLVRLVPVLSSYSDLVLFFLTMSLATHRSTAKLLSVLAQVFTELAQKGFCLPKEFMEDSAGEGATEFHDYEGGGIGEGEGMKDVSDQIGNEEQVEDTFQKGQEKDKEDPDSKSDIKGEDNAIEMSEDFDGKMHDGELEEQEEDDEKSDSEGGDLDKHMGDLNGEEADKLDERLWGDDDEEEDEEEEDNKTEETGPGMDEEDSELVAKDDNLDSGNSNKDKSQQDKKEEKEEAEADDGGQGEDKINEQIDERDYDENEVDPYHGNQEKVPEPEALDLPDDLNLDSEDKNGGEDTDNEEGEEENPLEIKEKPEEAGHEAEERGETETDQNESQSPQEPEEGPSEDDKAEGEEEMDTGADDQDGDAAQHPEEHSEEQQQSVEEKDKEADEEGGENGPADQGFQPQEEEEREDSDTEEQVPEALERKEHASCGQTGVENMQNTQAMELAGAAPEKEQGKEEHGSGAADANQAEGHESNFIAQLASQKHTRKNTQSFKRKPGQADNERSMGDHNERVHKRLRTVDTDSHAEQGPAQQPQAQVEDADAFEHIKQGSDAYDAQTYDVASKEQQQSAKDSGKDQEEEEIEDTLMDTEEQEEFKAADVEQLKPEEIKSGTTAPLGFDEMEVEIQTVKTEEDQDPRTDKAHKETENEKPERSRESTIHTAHQFLMDTIFQPFLKDVNELRQELERQLEMWQPRESGNPEEEKVAAEMWQSYLILTAPLSQRLCEELRLILEPTQAAKLKGDYRTGKRLNIRKVIPYIASQFRKDKIWLRRTKPSKRQYQICLAIDDSSSMVDNHTKQLAFESLAVIGNALTLLEVGQIAVCSFGESVKLLHPFHEQFSDYSGSQILRLCKFQQKKTKIAQDSILDIKVPIFKGPGEMPEIRSYMEEFPFPYYIILRDVNALPETLSDALRQWFELVTASDHP

SEQ ID NO: 905855 - protein, 1140 aa, Homo sapiens [sequence omitted]

SEQ ID NO: 905856 - protein, 1082 aa, Homo sapiens
MALVESLEYVRGEISKAMADFTTWKTHLLTSDSQGGNQMLDEGFVEDFSEQMEIAIRAILCAIQNLEERKNEKAEENTDQASPQEDYAGFERLQSGHLTKLLEDDFWADVSTLHVQKIISAISELLERLKSYGEDGTAAKHLFFSQSCSLLVRLVPVLSSYSDLVLFFLTMSLATHRSTAKLLSVLAQVFTELAQKGFCLPKEFMEDSAGEGATEFHDYEGGGIGEGEGMKDVSDQIGNEEQVEDTFQKGQEKDKEDPDSKSDIKGEDNAIEMSEDFDGKMHDGELEEQEEDDEKSDSEGGDLDKHMGDLNGEEADKLDERLWGDDDEEEDEEEEDNKTEETGPGMDEEDSELVAKDDNLDSGNSNKDKSQQDKKEEKEEAEADDGGQGEDKINEQIDERDYDENEVDPYHGNQEKVPEPEALDLPDDLNLDSEDKNGGEDTDNEEGEEENPLEIKEKPEEAGHEAEERGETETDQNESQSPQEPEEGPSEDDKAEGEEEMDTGADDQDGDAAQHPEEHSEEQQQSVEEKDKEADEEGGENGPADQGFQPQEEEEREDSDTEEQVPEALERKEHASCGQTGVENMQNTQAMELAGAAPEKEQGKEEHGSGAADANQAEGHESNFIAQLASQKHTRKNTQSFKRKPGQADNERSMGDHNERVHKRLRTVDTDSHAEQGPAQQPQAQVEDADAFEHIKQGSDAYDAQTYDVASKEQQQSAKDSGKDQEEEEIEDTLMDTEEQEEFKAADVEQLKPEEIKSGTTAPLGFDEMEVEIQTVKTEEDQDPRTDKAHKETENEKPERSRESTIHTAHQFLMDTIFQPFLKDVNELRQELERQLEMWQPRESGNPEEEKVAAEMWQSYLILTAPLSQRLCEELRLILEPTQAAKLKGDYRTGKRLNIRKVIPYIASQFRKDKIWLRRTKPSKRQYQICLAIDDSSSMVDNHTKQLAFESLAVIGNALTLLEVGQIAVCSFGESVKLLHPFHEQFSDYSGSQILRLCKFQQKKTKIAQFLESVANMFAAAQQLSQNISSETAQLLLVVSDGRGLFLEGKERVLAAVQAARNANIFVIFVVLDNPSSRVSDY

SEQ ID NO: 905857 - protein, 653 aa, Homo sapiens
MALVESLEYVRGEISKAMADFTTWKTHLLTSDSQGGNQMLDEGFVEDFSEQMEIAIRAILCAIQNLEERKNEKAEENTDQASPQEDYAGFERLQSGHLTKLLEDDFWADVSTLHVQKIISAISELLERLKSYGEDGTAAKHLFFSQSCSLLVRLVPVLSSYSDLVLFFLTMSLATHRSTAKLLSVLAQVFTELAQKGFCLPKEFMEDSAGEGATEFHDYEGGGIGEGEGMKDVSDQIGNEEQVEDTFQKGQEKDKEDPDSKSDIKGEDNAIEMSEDFDGKMHDGELEEQEEDDEKSDSEGGDLDKHMGDLNGEEADKLDERLWGDDDEEEDEEEEDNKTEETGPGMDEEDSELVAKDDNLDSGNSNKDKSQQDKKEEKEEAEADDGGQGEDKINEQIDERDYDENEVDPYHGNQEKVPEPEALDLPDDLNLDSEDKNGGEDTDNEEGEEENPLEIKEKPEEAGHEAEERGETETDQNESQSPQEPEEGPSEDDKAEGEEEMDTGADDQDGDAAQHPEEHSEEQQQSVEEKDKEADEEGGENGPADQGFQPQEEEEREDSDTEEQVPEALERKEHASCGQTGVENMQNTQAMELAGAAPEKEQGKEEHGSGAADANQAEGHESNFIAQLASQKHTRKNTQVSITPQLNLGEGSM

SEQ ID NO: 905858 - protein, 530 aa, Homo sapiens
MALVESLEYVRGEISKAMADFTTWKTHLLTSDSQGGNQMLDEGFVEDFSEQMEIAIRAILCAIQNLEERKNEKAEENTDQASPQEDYAGFERLQSGHLTKLLEDDFWADVSTLHVQKIISAISELLERLKSYGEDGTAAKHLFFSQSCSLLVRLVPVLSSYSDLVLFFLTMSLATHRSTAKLLSVLAQVFTELAQKGFCLPKEFMEDSAGEGATEFHDYEGGGIGEGEGMKDVSDQIGNEEQVEDTFQKGQEKDKEDPDSKSDIKGEDNAIEMSEDFDGKMHDGELEEQEEDDEKSDSEGGDLDKHMGDLNGEEADKLDERLWGDDDEEEDEEEEDNKTEETGPGMDEEDSELVAKDDNLDSGNSNKDKSQQDKKEEKEEAEADDGGQGEDKINEQIDERDYDENEVDPYHGNQEKVPEPEALDLPDDLNLDSEDKNGGEDTDNEEGEEENPLEIKEKPEEAGHEAEERGETETDQNESQSPQEPEEGPSEDDKLHCEVCDPFEVVIKDTDSLFNQVSQSMYLKLYHFLF

SEQ ID NO: 905859 - protein, 1121 aa, Homo sapiens
MALVESLEYVRGEISKAMADFTTWKTHLLTSDSQGGNQMLDEGFVEDFSEQMEIAIRAILCAIQNLEERKNEKAEENTDQASPQEDYAGFERLQSGHLTKLLEDDFWADVSTLHVQKIISAISELLERLKSYGEDGTAAKHLFFSQSCSLLVRLVPVLSSYSDLVLFFLTMSLATHRSTAKLLSVLAQVFTELAQKGFCLPKEFMEDSAGEGATEFHDYEGGGIGEGEGMKDVSDQIGNEEQVEDTFQKGQEKDKEDPDSKSDIKGEDNAIEMSEDFDGKMHDGELEEQEEDDEKSDSEGGDLDKHMGDLNGEEADKLDERLWGDDDEEEDEEEEDNKTEETGPGMDEEDSELVAKDDNLDSGNSNKDKSQQDKKEEKEEAEADDGGQGEDKINEQIDERDYDENEVDPYHGNQEKVPEPEALDLPDDLNLDSEDKNGGEDTDNEEGEEENPLEIKEKPEEAGHEAEERGETETDQNESQSPQEPEEGPSEDDKAEGEEEMDTGADDQDGDAAQHPEEHSEEQQQSVEEKDKEADEEGGENGPADQGFQPQEEEEREDSDTEEQVPEALERKEHASCGQTGVENMQNTQAMELAGAAPEKEQGKEEHGSGAADANQAEGHESNFIAQLASQKHTRKNTQSFKRKPGQADNERSMGDHNERVHKRLRTVDTDSHAEQGPAQQPQAQVEDADAFEHIKQGSDAYDAQTYDVASKEQQQSAKDSGKDQEEEEIEDTLMDTEEQEEFKAADVEQLKPEEIKSGTTAPLGFDEMEVEIQTVKTEEDQDPRTDKAHKETENEKPERSRESTIHTAHQFLMDTIFQPFFHVNLETQREKVAAEMWQSYLILTAPLSQRLCEELRLILEPTQAAKLKGDYRTGKRLNIRKVIPYIASQFRKDKIWLRRTKPSKRQYQICLAIDDSSSMVDNHTKQLAFESLAVIGNALTLLEVGQIAVCSFGESVKLLHPFHEQFSDYSGSQILRLCKFQQKKTKIAQFLESVANMFAAAQQLSQNISSETAQLLLVVSDGRGLFLEGKERVLAAVQAARNANIFVIFVVLDNPSSRDSILDIKVPIFKGPGEMPEIRSYMEEFPFPYYIILRDVNALPETLSDALRQWFELVTASDHP

SEQ ID NO: 905860 - protein, 834 aa, Homo sapiens
MGDLNGEEADKLDERLWGDDDEEEDEEEEDNKTEETGPGMDEEDSELVAKDDNLDSGNSNKDKSQQDKKEEKEEAEADDGGQGEDKINEQIDERDYDENEVDPYHGNQEKVPEPEALDLPDDLNLDSEDKNGGEDTDNEEGEEENPLEIKEKPEEAGHEAEERGETETDQNESQSPQEPEEGPSEDDKAEGEEEMDTGADDQDGDAAQHPEEHSEEQQQSVEEKDKEADEEGGENGPADQGFQPQEEEEREDSDTEEQVPEALERKEHASCGQTGVENMQNTQAMELAGAAPEKEQGKEEHGSGAADANQAEGHESNFIAQLASQKHTRKNTQSFKRKPGQADNERSMGDHNERVHKRLRTVDTDSHAEQGPAQQPQAQVEDADAFEHIKQGSDAYDAQTYDVASKEQQQSAKDSGKDQEEEEIEDTLMDTEEQEEFKAADVEQLKPEEIKSGTTAPLGFDEMEVEIQTVKTEEDQDPRTDKAHKETENEKPERSRESTIHTAHQFLMDTIFQPFLKDVNELRQELERQLEMWQPRESGNPEEEKVAAEMWQSYLILTAPLSQRLCEELRLILEPTQAAKLKGDYRTGKRLNIRKVIPYIASQFRKDKIWLRRTKPSKRQYQICLAIDDSSSMVDNHTKQLAFESLAVIGNALTLLEVGQIAVCSFGESVKLLHPFHEQFSDYSGSQILRLCKFQQKKTKIAQFLESVANMFAAAQQLSQNISSETAQLLLVVSDGRGLFLEGKERVLAAVQAARNANIFVIFVVLDNPSSRDSILDIKVPIFKGPGEMPEIRSYMEEFPFPYYIILRDVNALPETLSDALRQWFELVTASDHP

SEQ ID NO: 905861 - protein, 832 aa, Homo sapiens
ISHPWDRSNRQKLCMSKSQPMQKQFLGLSVMIVFSSSDIEEDSELVAKDDNLDSGNSNKDKSQQDKKEEKEEAEADDGGQGEDKINEQIDERDYDENEVDPYHGNQEKVPEPEALDLPDDLNLDSEDKNGGEDTDNEEGEEENPLEIKEKPEEAGHEAEERGETETDQNESQSPQEPEEGPSEDDKAEGEEEMDTGADDQDGDAAQHPEEHSEEQQQSVEEKDKEADEEGGENGPADQGFQPQEEEEREDSDTEEQVPEALERKEHASCGQTGVENMQNTQAMELAGAAPEKEQGKEEHGSGAADANQAEGHESNFIAQLASQKHTRKNTQSFKRKPGQADNERSMGDHNERVHKRLRTVDTDSHAEQGPAQQPQAQVEDADAFEHIKQGSDAYDAQTYDVASKEQQQSAKDSGKDQEEEEIEDTLMDTEEQEEFKAADVEQLKPEEIKSGTTAPLGFDEMEVEIQTVKTEEDQDPRTDKAHKETENEKPERSRESTIHTAHQFLMDTIFQPFLKDVNELRQELERQLEMWQPRESGNPEEEKVAAEMWQSYLILTAPLSQRLCEELRLILEPTQAAKLKGDYRTGKRLNIRKVIPYIASQFRKDKIWLRRTKPSKRQYQICLAIDDSSSMVDNHTKQLAFESLAVIGNALTLLEVGQIAVCSFGESVKLLHPFHEQFSDYSGSQILRLCKFQQKKTKIAQFLESVANMFAAAQQLSQNISSETAQLLLVVSDGRGLFLEGKERVLAAVQAARNANIFVIFVVLDNPSSRDSILDIKVPIFKGPGEMPEIRSYMEEFPFPYYIILRDVNALPETLSDALRQWFELVTASDHP

SEQ ID NO: 905862 - protein, 124 aa, Homo sapiens
MFAAAQQLSQNISSETAQLLLVVSDGRGLFLEGKERVLAAVQAARNANIFVIFVVLDNPSSRDSILDIKVPIFKGPGEMPEIRSYMEEFPFPYYIILRDVNALPETLSDALRQWFELVTASDHP

SEQ ID NO: 905863 - protein, 1071 aa, Homo sapiens; identical to SEQ ID NO: 905854

SEQ ID NO: 905864 - protein, 735 aa, Homo sapiens
MALVESLEYVRGEISKAMADFTTWKTHLLTSDSQGGNQMLDEGFVEDFSEQMEIAIRAILCAIQNLEERKNEKAEENTDQASPQEDYAGFERLQSGHLTKLLEDDFWADVSTLHVQKIISAISELLERLKSYGEDGTAAKHLFFSQSCSLLVRLVPVLSSYSDLVLFFLTMSLATHRSTAKLLSVLAQVFTELAQKGFCLPKEFMEDSAGEGATEFHDYEGGGIGEGEGMKDVSDQIGNEEQVEDTFQKGQEKDKEDPDSKSDIKGEDNAIEMSEDFDGKMHDGELEEQEEDDEKSDSEGGDLDKHMGDLNGEEADKLDERLWGDDDEEEDEEEEDNKTEETGPGMDEEDSELVAKDDNLDSGNSNKDKSQQDKKEEKEEAEADDGGQGEDKINEQIDERDYDENEVDPYHGNQEKVPEPEALDLPDDLNLDSEDKNGGEDTDNEEGEEENPLEIKEKPEEAGHEAEERGETETDQNESQSPQEPEEGPSEDDKAEGEEEMDTGADDQDGDAAQHPEEHSEEQQQSVEEKDKEADEEGGENGPADQGFQPQEEEEREDSDTEEQVPEALERKEHASCGQTGVENMQNTQAMELAGAAPEKEQGKEEHGSGAADANQAEGHESNFIAQLASQKHTRKNTQSFKRKPGQADNERSMGDHNERVHKRLRTVDTDSHAEQGPAQQPQAQVEDADAFEHIKQGSDAYDAQTYDVARINGAIPNPCWSSESHGLCTLPLNH

SEQ ID NO: 905865 - protein, 1158 aa, Homo sapiens
GTAGEQCDWGRKEKGGRGGCRRGLGQGGLGLDQVVGLAGWCKRRKQANPRRNNVTNYNTVVETNSDSDDEDKLHIVEEESVTDAADCEGVPEDDLPTDQTVLPGRSSEREGNAKNCWEDDRKEGQEILGPEAQADEAGCTVKDDECESDAENEQNHDPNVEEFLQQQDTAVIFPEAPEEDQRQGTPEASGHDENGTPDAFSQLLTCPYCDRGYKRFTSLKEHIKYRHEKNEDNFSCSLCSYTFAYRTQLERHMTSHKSGRDQRHVTQSGCNRKFKCTECGKAFKYKHHLKEHLRIHSGEKPYECPNCKKRFSHSGSYSSHISSKKCISLIPVNGRPRTGLKTSQCSSPSLSASPGSPTRPQIRQKIENKPLQEQLSVNQIKTEPVDYEFKPIVVASGINCSTPLQNGVFTGGGPLQATSSPQGMVQAVVLPTVGLVSPISINLSDIQNVLKVAVDGNVIRQVLENNQANLASKEQETINASPIQQGGHSVISAISLPLVDQDGTTKIIINYSLEQPSQLQVVPQNLKKENPVATNSCKSEKLPEDLTVKSEKDKSFEGGVNDSTCLLCDDCPGDINALPELKHYDLKQPTQPPPLPAAEAEKPESSVSSATGDGNLSPSQPPLKNLLSLLKAYYALNAQPSAEELSKIADSVNLPLDVVKKWFEKMQAGQISVQSSEPSSPEPGKVNIPAKNNDQPQSANANEPQDSTVNLQSPLKMTNSPVLPVGSTTNGSRSSTPSPSPLNLSSSRNTQGYLYTAEGAQEEPQVEPLDLSLPKQQGELLERSTITSVYQNSVYSVQEEPLNLSCAKKEPQKDSCVTDSEPVVNVIPPSANPINIAIPTVTAQLPTIVAIADQNSVPCLRALAANKQTILIPQVAYTYSTTVSPAVQEPPLKVIQPNGNQDERQDTSSEGVSNVEDQNDSDSTPPKKKMRKTENGMYACDLCDKIFQKSSSLLRHKYEHTGKRPHECGICKKAFKHKHHLIEHMRLHSGEKPYQCDKCGKRFSHSGSYSQHMNHRYSYCKREAEERDSTEQEEAGPEILSNEHVGARASPSQGDSDERESLTREEDEDSEKEEEEEDKEMEELQEEKECEKPQGDEEEEEEEEEVEEEEVEEAENEGEEAKTEGLMKDDRAESQASSLGQKVGESSEQVSEEKTNEA

SEQ ID NO: 905866 - protein, 1158 aa, Homo sapiens; identical to SEQ ID NO: 905865

SEQ ID NO: 905867 - protein, 1131 aa, Homo sapiens
LDTSERIMADGPRCKRRKQANPRRNNVTNYNTVVETNSDSDDEDKLHIVEEESVTDAADCEGVPEDDLPTDQTVLPGRSSEREGNAKNCWEDDRKEGQEILGPEAQADEAGCTVKDDECESDAENEQNHDPNVEEFLQQQDTAVIFPEAPEEDQRQGTPEASGHDENGTPDAFSQLLTCPYCDRGYKRFTSLKEHIKYRHEKNEDNFSCSLCSYTFAYRTQLERHMTSHKSGRDQRHVTQSGCNRKFKCTECGKAFKYKHHLKEHLRIHSGEKPYECPNCKKRFSHSGSYSSHISSKKCISLIPVNGRPRTGLKTSQCSSPSLSASPGSPTRPQIRQKIENKPLQEQLSVNQIKTEPVDYEFKPIVVASGINCSTPLQNGVFTGGGPLQATSSPQGMVQAVVLPTVGLVSPISINLSDIQNVLKVAVDGNVIRQVLENNQANLASKEQETINASPIQQGGHSVISAISLPLVDQDGTTKIIINYSLEQPSQLQVVPQNLKKENPVATNSCKSEKLPEDLTVKSEKDKSFEGGVNDSTCLLCDDCPGDINALPELKHYDLKQPTQPPPLPAAEAEKPESSVSSATGDGNLSPSQPPLKNLLSLLKAYYALNAQPSAEELSKIADSVNLPLDVVKKWFEKMQAGQISVQSSEPSSPEPGKVNIPAKNNDQPQSANANEPQDSTVNLQSPLKMTNSPVLPVGSTTNGSRSSTPSPSPLNLSSSRNTQGYLYTAEGAQEEPQVEPLDLSLPKQQGELLERSTITSVYQNSVYSVQEEPLNLSCAKKEPQKDSCVTDSEPVVNVIPPSANPINIAIPTVTAQLPTIVAIADQNSVPCLRALAANKQTILIPQVAYTYSTTVSPAVQEPPLKVIQPNGNQDERQDTSSEGVSNVEDQNDSDSTPPKKKMRKTENGMYACDLCDKIFQKSSSLLRHKYEHTGKRPHECGICKKAFKHKHHLIEHMRLHSGEKPYQCDKCGKRFSHSGSYSQHMNHRYSYCKREAEERDSTEQEEAGPEILSNEHVGARASPSQGDSDERESLTREEDEDSEKEEEEEDKEMEELQEEKECEKPQGDEEEEEEEEEVEEEEVEEAENEGEEAKTEGLMKDDRAESQASSLGQKVGESSEQVSEEKTNEA

SEQ ID NO: 905868 - protein, 1123 aa, Homo sapiens
MGQQRNSSLWRHLDQHYDVTNYNTVVETNSDSDDEDKLHIVEEESVTDAADCEGVPEDDLPTDQTVLPGRSSEREGNAKNCWEDDRKEGQEILGPEAQADEAGCTVKDDECESDAENEQNHDPNVEEFLQQQDTAVIFPEAPEEDQRQGTPEASGHDENGTPDAFSQLLTCPYCDRGYKRFTSLKEHIKYRHEKNEDNFSCSLCSYTFAYRTQLERHMTSHKSGRDQRHVTQSGCNRKFKCTECGKAFKYKHHLKEHLRIHSGEKPYECPNCKKRFSHSGSYSSHISSKKCISLIPVNGRPRTGLKTSQCSSPSLSASPGSPTRPQIRQKIENKPLQEQLSVNQIKTEPVDYEFKPIVVASGINCSTPLQNGVFTGGGPLQATSSPQGMVQAVVLPTVGLVSPISINLSDIQNVLKVAVDGNVIRQVLENNQANLASKEQETINASPIQQGGHSVISAISLPLVDQDGTTKIIINYSLEQPSQLQVVPQNLKKENPVATNSCKSEKLPEDLTVKSEKDKSFEGGVNDSTCLLCDDCPGDINALPELKHYDLKQPTQPPPLPAAEAEKPESSVSSATGDGNLSPSQPPLKNLLSLLKAYYALNAQPSAEELSKIADSVNLPLDVVKKWFEKMQAGQISVQSSEPSSPEPGKVNIPAKNNDQPQSANANEPQDSTVNLQSPLKMTNSPVLPVGSTTNGSRSSTPSPSPLNLSSSRNTQGYLYTAEGAQEEPQVEPLDLSLPKQQGELLERSTITSVYQNSVYSVQEEPLNLSCAKKEPQKDSCVTDSEPVVNVIPPSANPINIAIPTVTAQLPTIVAIADQNSVPCLRALAANKQTILIPQVAYTYSTTVSPAVQEPPLKVIQPNGNQDERQDTSSEGVSNVEDQNDSDSTPPKKKMRKTENGMYACDLCDKIFQKSSSLLRHKYEHTGKRPHECGICKKAFKHKHHLIEHMRLHSGEKPYQCDKCGKRFSHSGSYSQHMNHRYSYCKREAEERDSTEQEEAGPEILSNEHVGARASPSQGDSDERESLTREEDEDSEKEEEEEDKEMEELQEEKECEKPQGDEEEEEEEEEVEEEEVEEAENEGEEAKTEGLMKDDRAESQASSLGQKVGESSEQVSEEKTNEA

SEQ ID NO: 905869 - protein, 1131 aa, Homo sapiens; identical to SEQ ID NO: 905867

SEQ ID NO: 905870 - protein, 735 aa, Homo sapiens
MVQAVVLPTVGLVSPISINLSDIQNVLKVAVDGNVIRQVLENNQANLASKEQETINASPIQQGGHSVISAISLPLVDQDGTTKIIINYSLEQPSQLQVVPQNLKKENPVATNSCKSEKLPEDLTVKSEKDKSFEGGVNDSTCLLCDDCPGDINALPELKHYDLKQPTQPPPLPAAEAEKPESSVSSATGDGNLSPSQPPLKNLLSLLKAYYALNAQPSAEELSKIADSVNLPLDVVKKWFEKMQAGQISVQSSEPSSPEPGKVNIPAKNNDQPQSANANEPQDSTVNLQSPLKMTNSPVLPVGSTTNGSRSSTPSPSPLNLSSSRNTQGYLYTAEGAQEEPQVEPLDLSLPKQQGELLERSTITSVYQNSVYSVQEEPLNLSCAKKEPQKDSCVTDSEPVVNVIPPSANPINIAIPTVTAQLPTIVAIADQNSVPCLRALAANKQTILIPQVAYTYSTTVSPAVQEPPLKVIQPNGNQDERQDTSSEGVSNVEDQNDSDSTPPKKKMRKTENGMYACDLCDKIFQKSSSLLRHKYEHTGKRPHECGICKKAFKHKHHLIEHMRLHSGEKPYQCDKCGKRFSHSGSYSQHMNHRYSYCKREAEERDSTEQEEAGPEILSNEHVGARASPSQGDSDERESLTREEDEDSEKEEEEEDKEMEELQEEKECEKPQGDEEEEEEEEEVEEEEVEEAENEGEEAKTEGLMKDDRAESQASSLGQKVGESSEQVSEEKTNEA

SEQ ID NO: 905871 - protein, 735 aa, Homo sapiens; identical to SEQ ID NO: 905870

SEQ ID NO: 905872 - protein, 1131 aa, Homo sapiens; identical to SEQ ID NO: 905867

SEQ ID NO: 905873 - protein, 1131 aa, Homo sapiens; identical to SEQ ID NO: 905867

SEQ ID NO: 905874 - protein, 906 aa, Homo sapiens
MTSHKSGRDQRHVTQSGCNRKFKCTECGKAFKYKHHLKEHLRIHSGEKPYECPNCKKRFSHSGSYSSHISSKKCISLIPVNGRPRTGLKTSQCSSPSLSASPGSPTRPQIRQKIENKPLQEQLSVNQIKTEPVDYEFKPIVVASGINCSTPLQNGVFTGGGPLQATSSPQGMVQAVVLPTVGLVSPISINLSDIQNVLKVAVDGNVIRQVLENNQANLASKEQETINASPIQQGGHSVISAISLPLVDQDGTTKIIINYSLEQPSQLQVVPQNLKKENPVATNSCKSEKLPEDLTVKSEKDKSFEGGVNDSTCLLCDDCPGDINALPELKHYDLKQPTQPPPLPAAEAEKPESSVSSATGDGNLSPSQPPLKNLLSLLKAYYALNAQPSAEELSKIADSVNLPLDVVKKWFEKMQAGQISVQSSEPSSPEPGKVNIPAKNNDQPQSANANEPQDSTVNLQSPLKMTNSPVLPVGSTTNGSRSSTPSPSPLNLSSSRNTQGYLYTAEGAQEEPQVEPLDLSLPKQQGELLERSTITSVYQNSVYSVQEEPLNLSCAKKEPQKDSCVTDSEPVVNVIPPSANPINIAIPTVTAQLPTIVAIADQNSVPCLRALAANKQTILIPQVAYTYSTTVSPAVQEPPLKVIQPNGNQDERQDTSSEGVSNVEDQNDSDSTPPKKKMRKTENGMYACDLCDKIFQKSSSLLRHKYEHTGKRPHECGICKKAFKHKHHLIEHMRLHSGEKPYQCDKCGKRFSHSGSYSQHMNHRYSYCKREAEERDSTEQEEAGPEILSNEHVGARASPSQGDSDERESLTREEDEDSEKEEEEEDKEMEELQEEKECEKPQGDEEEEEEEEEVEEEEVEEAENEGEEAKTEGLMKDDRAESQASSLGQKVGESSEQVSEEKTNEA

SEQ ID NO: 905875 - protein, 929 aa, Homo sapiens
LDTSERIMADGPRCKRRKQANPRRNNVTNYNTVVETNSDSDDEDKLHIVEEESVTDAADCEGVPEDDLPTDQTVLPGRSSEREGNAKNCWEDDRKEGQEILGPEAQADEAGCTVKDDECESDAENEQNHDPNVEEFLQQQDTAVIFPEAPEEDQRQGTPEASGHDENGTPDAFSQLLTCPYCDRGYKRFTSLKEHIKYRHEKNEDNFSCSLCSYTFAYRTQLERHMTSHKSGRDQRHVTQSGCNRKFKCTECGKAFKYKHHLKEHLRIHSGEKPYECPNCKKRFSHSGSYSSHISSKKCISLIPVNGRPRTGLKTSQCSSPSLSASPGSPTRPQIRQKIENKPLQEQLSVNQIKTEPVDYEFKPIVVASGINCSTPLQNGVFTGGGPLQATSSPQGMVQAVVLPTVGLVSPISINLSDIQNVLKVAVDGNVIRQVLENNQANLASKEQETINASPIQQGGHSVISAISLPLVDQDGTTKIIINYSLEQPSQLQVVPQNLKKENPVATNSCKSEKLPEDLTVKSEKDKSFEGGVNDSTCLLCDDCPGDINALPELKHYDLKQPTQPPPLPAAEAEKPESSVSSATGDGNLSPSQPPLKNLLSLLKAYYALNAQPSAEELSKIADSVNLPLDVVKKWFEKMQAGQISVQSSEPSSPEPGKVNIPAKNNDQPQSANANEPQDSTVNLQSPLKMTNSPVLPVGSTTNGSRSSTPSPSPLNLSSSRNTQGYLYTAEGAQEEPQVEPLDLSLPKQQGELLERSTITSVYQNSVYSVQEEPLNLSCAKKEPQKDSCVTDSEPVVNVIPPSANPINIAIPTVTAQLPTIVAIADQNSVPCLRALAANKQTILIPQVAYTYSTTVSPAVQEPPLKVIQPNGNQDERQDTSSEGVSNVEDQNDSDSTPPKKKMRKKKNVKNHKGMRKRRRRRKKWKKKR

SEQ ID NO: 905876 - protein, 1131 aa, Homo sapiens; identical to SEQ ID NO: 905867

SEQ ID NO: 905877 - protein, 689 aa, Homo sapiens
MAQVEKRGGLLRKSSASKKPLKEKVVLMYDEIFMTEDPSKCSPRFWEELFLMKVNLEYLEGKLESLDGEELMKIKDNINCLFQHCIQALGEEHPIRVVNALQTLCALIRGVHQKNKSTSGFDIINMLMGFDKAELCMKNLMESLDSLLCAEGSESLKSLCLKLLLCLVTVTDNISQNTILEYVMINSIFEAILQILSHPPSRREHGYDAVVLLALLVNYRKYESVNPYIVKLSIVDDEATLNGMGLVIAQALSEYNRQYKDKEEEHQSGFFSALTNMVGSMFIADAHEKISVQTNEAILLALYEAVHLNRNFITVLAQSHPEMGLVTTPVSPAPTTPVTPLGTTPPSSDVISSVELPLDADVQTSNLLITFLKYSSIVMQDTKDEHRLHSGKLCLIILTCIAEDQYANAFLHDDNMNFRVNLHRMPMRHRKKAADKNLPCRPLVCAVLDLMVEFIVTHMMKEFPMDLYIRCIQVVHKLLCYQKKCRVRLHYTWRELWSALINLLKFLMSNETVLLAKHNIFTLALMIVNLFNMFITYGDTFLPTPSSYDELYYEIIRMHQSFDNLYSMVLRLSTNAGQWKEAASKVTHALVNIRAIINHFNPKIESYAAVNHISQLSEEQVLEVVRANYDTLTLKLQDGLDQYERYSEQHKEAAFFKELVRSISTNVRRNLVFHTLSQEVLLKEFSTIS

SEQ ID NO: 905878 - protein, 198 aa, Homo sapiens
MAQVEKRGGLLRKSSASKKPLKEKVVLMYDEIFMTEDPSKCSPRFWEELFLMKVNLEYLEGKLESLDGEELMKIKDNINCLFQHCIQALGEEHPIRVVNALQTLCALIRGVHQKNKSTSGFDIINMLMGFDKAELCMKVRHKLQMCLWMAASDSCSWTLSADKCTQRFGLRKIQMIEFGLAFRCFYFTDLLYLNKGKF

SEQ ID NO: 905879 - protein, 447 aa, Homo sapiens
MAQVEKRGGLLRKSSASKKPLKEKVVLMYDEIFMTEDPSKCSPRFWEELFLMKVNLEYLEGKLESLDGEELMKIKDNINCLFQHCIQALGEEHPIRVVNALQTLCALIRGVHQKNKSTSGFDIINMLMGFDKAELCMKNLMESLDSLLCAEGSESLKSLCLKLLLCLVTVTDNISQNTILEYVMINSIFEAILQILSHPPSRREHGYDAVVLLALLVNYRKYESVNPYIVKLSIVDDEATLNGMGLVIAQALSEYNRQYKDKEEEHQSGFFSALTNMVGSMFIADAHEKISVQTNEAILLALYEAVHLNRNFITVLAQSHPEMGLVTTPVSPAPTTPVTPLGTTPPSSDVISSVELPLDADVQTSNLLITFLKYSSIVMQDTKDEHRLHSGKLCLIILTCIAEPMRHRKKAADKNLPCRPLVCAVLDLMVEFIVTHMMKEFPMDLYM

SEQ ID NO: 905880 - protein, 225 aa, Homo sapiens
MSRPRKRLAGTSGSDKGLSGKRTKTENSGEALAKVEDSNPQKTSATKNCLKNLSSHWLMKSEPESRLEKGVDVKFSIEDLKAQPKQTTCWDGVRNYQARNFLRAMKLGEEAFFYHSNCKEPGIAGLMKIVKEAYPDHTQFEKNNPHYDPSSKEDNPKWSMVDVQFVRMMKRFIPLAELKSYHQAHKATGGPLKNMVLFTRQRLSIQPLTQEEFDFVLSLEEKEPS

SEQ ID NO: 905881 - protein, 166 aa, Homo sapiens
MSRPRKRLAGTSGSDKGLSGKRTKTENSGEALAKVEDSNPQKTSATKNCLKNLSSHWLMKSEPESRLEKGVDVKFSIEDLKAQPKQTTCWDGVRNYQARNFLRAMKLGEEAFFYHSNCKEPGIAGLMKIVKEAYPDHTQFEKNNPHYDPSSKEDNPKWSMKSLILF

SEQ ID NO: 905882 - protein, 225 aa, Homo sapiens; identical to SEQ ID NO: 905880

SEQ ID NO: 905883 - protein, 167 aa, Homo sapiens [sequence omitted]

SEQ ID NO: 905884 - protein, 168 aa, Homo sapiens
MSRPRKRLAGTSGSDKGLSGKRTKTENSGEALAKVEDSNPQKTSATKNCLKNLSSHWLMKSEPESRLEKGVDVKFSIEDLKAQPKQTTCWDGVRNYQARNFLRAMKLGEEAFFYHSNCKEPGIAGLMKIVKEAYPDHTQFEKNNPHYDPSSKEDNPKWSMVKTMLSIS

SEQ ID NO: 905885 - protein, 199 aa, Homo sapiens
GVALHSLRRSGGGPQSSLQSVGIVRTKVPCSVTMSRPRKRLAGTSGSDKGLSGKRTKTENSGEALAKVEDSNPQKTSATKNCLKNLSSHWLMKSEPESRLEKGVDVKFSIEDLKAQPKQTTCWDGVRNYQARNFLRAMKLGEEAFFYHSNCKEPGIAGLMKIVKEAYPDHTQFEKNNPHYDPSSKEDNPKWSMKSLILF

SEQ ID NO: 905886 - protein, 155 aa, Homo sapiens
MSRPRKRLAGTSGSDKGLSGKRTKTENSGEALAKVEDSNPQKTSATKNCLKNLSSHWLMKSEPESRLEKGVDVKFSIEDLKAQPKQTTCWDGVRNYQARNFLRAMKLGEEAFFYHSNCKEPGIAGLMKVSWAGFGVNPFSSRETNLSRYKGIYLN

SEQ ID NO: 905887 - protein, 118 aa, Homo sapiens
LTGEAESPGLRTWKFQEYILRIMYLGINEIRKNSPKKEWWDGVRNYQARNFLRAMKLGEEAFFYHSNCKEPGIAGLMKIVKEAYPDHTQFEKNNPHYDPSSKEDNPKWSMVKTMLSIS

SEQ ID NO: 905888 - protein, 225 aa, Homo sapiens; identical to SEQ ID NO: 905880

SEQ ID NO: 905889 - protein, 258 aa, Homo sapiens
GVALHSLRRSGGGPQSSLQSVGIVRTKVPCSVTMSRPRKRLAGTSGSDKGLSGKRTKTENSGEALAKVEDSNPQKTSATKNCLKNLSSHWLMKSEPESRLEKGVDVKFSIEDLKAQPKQTTCWDGVRNYQARNFLRAMKLGEEAFFYHSNCKEPGIAGLMKIVKEAYPDHTQFEKNNPHYDPSSKEDNPKWSMVDVQFVRMMKRFIPLAELKSYHQAHKATGGPLKNMVLFTRQRLSIQPLTQEEFDFVLSLEEKEPS

SEQ ID NO: 905890 - protein, 274 aa, Homo sapiens
MSRPRKRLAGTSGSGTFCLSWDEIESSPFFYNVLNELFLSTFIGTFKEQKGDGPGATVSKKERHKGLSGKRTKTENSGEALAKVEDSNPQKTSATKNCLKNLSSHWLMKSEPESRLEKGVDVKFSIEDLKAQPKQTTCWDGVRNYQARNFLRAMKLGEEAFFYHSNCKEPGIAGLMKIVKEAYPDHTQFEKNNPHYDPSSKEDNPKWSMVDVQFVRMMKRFIPLAELKSYHQAHKATGGPLKNMVLFTRQRLSIQPLTQEEFDFVLSLEEKEPS

SEQ ID NO: 905891 - protein, 211 aa, Homo sapiens
MSRPRKRLAGTSGSDKGLSGKRTKTENSGEALAKVEDSNPQKTSATKNCLKNLSSHWLMKSEPESRLEKGVDVKFSIEDLKAQPKQTTCWDGVRNYQARNFLRAMKLGEEAFFYHSNCKEPGIAGLMKIVKEAYPDHTQFEKNNPHYDPSSKEDNPKWSMVDVQFVRMMKRFIPLAELKSYHQAHKATGGPLKNMVLFTRQSYLLLLPSTL

SEQ ID NO: 905892 - protein, 164 aa, Homo sapiens
MSRPRKRLAGTSGSDKGLSGKRTKTENSGEALAKVEDSNPQKTSATKNCLKNLSSHWLMKSEPESRLEKGVDVKFSIEDLKAQPKQTTCWDGVRNYQARNFLRAMKLGEEAFFYHSNCKEPGIAGLMKIVKEAYPDHTQFEKNNPHYDPSSKEDNPKWSMKSLI

SEQ ID NO: 905893 - protein, 239 aa, Homo sapiens
GVALHSLRRSGGGPQSSLQSVGIVRTKVPCSVTMSRPRKRLAGTSGSDKGLSGKRTKTENSGEALAKVEDSNPQKTSATKNCLKNLSSHWLMKSEPESRLEKGVDVKFSIEDLKAQPKQTTCWDGVRNYQARNFLRAMKLGEEAFFYHSNCKEPGIAGLMKIVKEAYPDHTQFEVDVQFVRMMKRFIPLAELKSYHQAHKATGGPLKNMVLFTRQRLSIQPLTQEEFDFVLSLEEKEPS

SEQ ID NO: 905894 - protein, 218 aa, Homo sapiens
MGRVFLTGEKANSILKRYPRANGFFEEIRQGNIERECKEEFCTFEEAREAFENNEKTKEFWSTYTKAQQGESNRGSDWFQFYLTFPLIFGLFIILLVIFLIWRCFLRNKTRRQTVTEGHIPFPQHLNIITPPPPPDEVFDSSGLSPGFLGYVVGRSDSVSTRLSNCDPPPTYEEATGQVNLQRSETEPHLDPPPEYEDIVNSNSASAIPMVPVVTTIK

SEQ ID NO: 905895 - protein, 218 aa, Homo sapiens; identical to SEQ ID NO: 905894

SEQ ID NO: 905896 - protein, 218 aa, Homo sapiens; identical to SEQ ID NO: 905894

SEQ ID NO: 905897 - protein, 218 aa, Homo sapiens; identical to SEQ ID NO: 905894

SEQ ID NO: 905898 - protein, 253 aa, Homo sapiens
RPRWVPSWGNVIQAKRPRKDWGNHHPGTCQKPQENMGRVFLTGEKANSILKRYPRANGFFEEIRQGNIERECKEEFCTFEEAREAFENNEKTKEFWSTYTKAQQGESNRGSDWFQFYLTFPLIFGLFIILLVIFLIWRCFLRNKTRRQTVTEGHIPFPQHLNIITPPPPPDEVFDSSGLSPGFLGYVVGRSDSVSTRLSNCDPPPTYEEATGQVNLQRSETEPHLDPPPEYEDIVNSNSASAIPMVPVVTTIK

SEQ ID NO: 905899 - protein, 877 aa, Homo sapiens
FSAFRYPGHSHFSPLFLVSSPIPLSPVLPLPLQWFSPLSCHQLLGPGLLRLGRLWLRSPSHTAPAPGLWLSGFGLLRGDHLFLCSAPGPGPPAPEDMVHLRRLQEISVVSAADTPDKKEHLVLVETGRTLYLQGEGRLDFTAWNAAIGGAAGGGGTGLQEQQMSRGDIPIIVDACISFVTQHGLRLEGVYRKGGARARSLRLLAEFRRDARSVKLRPGEHFVEDVTDTLKRFFRELDDPVTSARLLPRWREAAGIPKIPESQGPTRISAFPHQNPWFGSPPPHHFPPWGIIQRLGSGEVGRGQRHIHPAFVPKNPSLCTSCHSFFPGPPQPSSIPSPELPQKNQRLEKYKDVIGCLPRVNRRTLATLIGHLYRVQKCAALNQMCTRNLALLFAPSVFQTDGRGEHEVRVLQELIDGYISVFDIDSDQVAQIDLEVSLITTWKDVQLSQAGDLIMEVYIEQQLPDNCVTLKVSPTLTAEELTNQVLEMRGTAAGMDLWVTFEIREHGELERPLHPKEKVLEQALQWCQLPEPCSASLLLKKVPLAQAGCLFTGIRRESPRVGLLRCREEPPRLLGSRFQERFFLLRGRCLLLLKEKKSSKPEREWPLEGAKVYLGIRKKLKPPTPWGFTLILEKMHLYLSCTDEDEMWDWTTSILKAQHDDQQPVVLRRHSSSDLARQKFGTMPLLPIRGDDSGATLLSANQTLRRLHNRRTLSMFFPMKSSQGSVEEQEELEEPVYEEPVYEEVGAFPELIQDTSTSFSTTREWTVKPENPLTSQKSLDQPFLSKSSTLGQEERPPEPPPGPPSKSSPQARGSLEEQLLQELSSLILRKGETTAGLGSPSQPSSPQSPSPTGLPTQTPGFPTQPPCTSSPPSSQPLT

SEQ ID NO: 905900 - protein, 868 aa, Homo sapiens
FSAFRYPGHSHFSPLFLVSSPIPLSPVLPLPLQWFSPLSCHQLLGPGLLRLGRLWLRSPSHTAPAPGLWLSGFGLLRGDHLFLCSAPGPGPPAPEDMVHLRRLQEISVVSAADTPDKKEHLVLVETGRTLYLQGEGRLDFTAWNAAIGGAAGGGGTGLQEQQMSRGDIPIIVDACISFVTQHGLRLEGVYRKGGARARSLRLLAEFRRDARSVKLRPGEHFVEDVTDTLKRFFRELDDPVTSARLLPRWREAAELPQKNQRLEKYKDVIGCLPRVNRRTLATLIGHLYRVQKCAALNQMCTRNLALLFAPSVFQTDGRGEHEVRVLQELIDGYISVFDIDSDQVAQIDLEVSLITTWKDVQLSQAGDLIMEVYIEQQLPDNCVTLKVSPTLTAEELTNQVLEMRGTAAGMDLWVTFEIREHGELERPLHPKEKVLEQALQWCQLPEPCSASLLLKKVPLAQAGCLFTGIRRESPRVGLLRCREEPPRLLGSRFQERFFLLRGRCLLLLKEKKVRPWGQRCGMLGGHGEEHDCTHPLIHSPYSHQSHCFPAPDFCDPVTTDPICFHDVLTSLTMISHLSISLTLFCSQSSKPEREWPLEGAKVYLGIRKKLKPPTPWGFTLILEKMHLYLSCTDEDEMWDWTTSILKAQHDDQQPVVLRRHSSSDLARQKFGTMPLLPIRGDDSGATLLSANQTLRRLHNRRTLSMFFPMKSSQGSVEEQEELEEPVYEEPVYEEVGAFPELIQDTSTSFSTTREWTVKPENPLTSQKSLDQPFLSKSSTLGQEERPPEPPPGPPSKSSPQARGSLEEQLLQELSSLILRKGETTAGLGSPSQPSSPQSPSPTGLPTQTPGFPTQPPCTSSPPSSQPLT

SEQ ID NO: 905901 - protein, 773 aa, Homo sapiens
FSAFRYPGHSHFSPLFLVSSPIPLSPVLPLPLQWFSPLSCHQLLGPGLLRLGRLWLRSPSHTAPAPGLWLSGFGLLRGDHLFLCSAPGPGPPAPEDMVHLRRLQEISVVSAADTPDKKEHLVLVETGRTLYLQGEGRLDFTAWNAAIGGAAGGGGTGLQEQQMSRGDIPIIVDACISFVTQHGLRLEGVYRKGGARARSLRLLAEFRRDARSVKLRPGEHFVEDVTDTLKRFFQLPQKNQRLEKYKDVIGCLPRVNRRTLATLIGHLYRVQKCAALNQMCTRNLALLFAPSVFQTDGRGEHEVRVLQELIDGYISVFDIDSDQVAQIDLEVSLITTWKDVQLSQAGDLIMEVYIEQQLPDNCVTLKVSPTLTAEELTNQVLEMRGTAAGMDLWVTFEIREHGELERPLHPKEKVLEQALQWCQLPEPCSASLLLKKVPLAQAGCLFTGIRRESPRVGLLRCREEPPRLLGSRFQERFFLLRGRCLLLLKEKKSSKPEREWPLEGAKVYLGIRKKLKPPTPWGFTLILEKMHLYLSCTDEDEMWDWTTSILKAQHDDQQPVVLRRHSSSDLARQKFGTMPLLPIRGDDSGATLLSANQTLRRLHNRRTLSMFFPMKSSQGSVEEQEELEEPVYEEPVYEEVGAFPELIQDTSTSFSTTREWTVKPENPLTSQKSLDQPFLSKSSTLGQEERPPEPPPGPPSKSSPQARGSLEEQLLQELSSLILRKGETTAGLGSPSQPSSPQSPSPTGLPTQTPGFPTQPPCTSSPPSSQPLT

SEQ ID NO: 905902 - protein, 793 aa, Homo sapiens
FSAFRYPGHSHFSPLFLVSSPIPLSPVLPLPLQWFSPLSCHQLLGPGLLRLGRLWLRSPSHTAPAPGLWLSGFGLLRGDHLFLCSAPGPGPPAPEDMVHLRRLQEISVVSAADTPDKKEHLVLVETGRTLYLQGEGRLDFTAWNAAIGGAAGGGGTGLQEQQMSRGDIPIIVDACISFVTQHGLRLEGVYRKGGARARSLRLLAEFRRDARSVKLRPGEHFVEDVTDTLKRFFRELDDPVTSARLLPRWREAAELPQKNQRLEKYKDVIGCLPRVNRRTLATLIGHLYRVQKCAALNQMCTRNLALLFAPSVFQTDGRGEHEVRVLQELIDGYISVFDIDSDQVAQIDLEVSLITTWKDVQLSQAGDLIMEVYIEQQLPDNCVTLKVSPTLTAEELTNQVLEMRGTAAGMDLWVTFEIREHGELERPLHPKEKVLEQALQWCQLPEPCSASLLLKKVPLAQAGCLFTGIRRESPRVGLLRCREEPPRLLGSRFQERFFLLRGRCLLLLKEKKSSKPEREWPLEGAKVYLGIRKKLKPPTPWGFTLILEKMHLYLSCTDEDEMWDWTTSILKAQHDDQQPVVLRRHSSSDLARQKFGTMPLLPIRGDDSGATLLSANQTLRRLHNRRTLSMFFPMKSSQGSVEEQEELEEPVYEEPVYEEVGAFPELIQDTSTSFSTTREWTVKPENPLTSQKSLDQPFLSKSSTLGQEERPPEPPPGPPSKSSPQARGSLEEQLLQELSSLILRKGETTAGLGSPSQPSSPQSPSPTGLPTQTPGFPTQPPCTSSPPSSQPLT
